United States Patent 7,750,207 (ZEA MAYS RIBULOSE BISPHOSPHATE CARBOXYLASE ACTIVASE PROMOTER) - sequence listing, part 5

SEQ ID NO: 5878 - DNA, 3027 bp, Zea mays
atctgcttactgtgatcaccaaagttgtgctgatacgatgtgcgattattgctctttcttctctagaatgttcctgccgatgctttataagagaaggttggtcagcatcgatctctgccagtgtctagctgagaacatggtgacctcaagcaagggcaaggtatgcgtaaccggggcctcaggctttgttgcctcttggcttatcaaacggctcctcgagtctggatatcatgtggtagggactgtcagggacccaggaaatcaccaaaagacagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaacccgactctactagcaaggaggacacgctcgtccctgcggtgaacggtactctgaacgtgctgagatcgtgcaagaagaacccgttcctgaaaagggtcgtccttacgtcttcgtcgtctgcggtgaggatcagggacgacggtggccagtccagtaacatctcgctggacgaaacgacatggagctccgtgccactctgcgagaagatgcatctatggtatgccctagccaaggtatttgcagagaaagcggcgtgggagttcgccaaggagaacggcatcgaccttgtgactgtcctcccgtcgttcgtgatcgggcccagtttgtcccacgaactatgcgttaccgcttcagacgtcctaggcctattccaaggcgacacggcaaggttcagctcgtacggaagaatggggtacgtccacatcgacgacgttgcgagcagccacatcctggtgtacgaggccccccaggccgccgggaggtacctgtgcagctcagtggtgctggacaacgacgagctggtctcctcgctcgcgaaacgctacccgatattccccataccccggaggctgaacagcccctacggcaagcagtcgtaccagctgaacacgtcgaagctgcaggggctgggcttcaagttcagaggggtgcaggagatgttcgacgactgcgtacagtcgctcaaagaccagggacacctgctggagtgccccctgtgaactgcgatggggtgcctccgcctgtgaacgcgccggttgggttgcgtcccgaacccgctgttaattcgtttttttttcttcaataattccacgtcatgtcacggtgtcctcgcgcagactgctactgtcagggcgtcatagctcacgggctctccggctacatgaataaaaatgtcacgctcgccaaaaaaaaaaaaaaaatttttggttcgttctgcgagcttccgttcgctgtgtgtacttgtggctgccggtcgccttgtcggtgtggcgactggtgatggtgatcggaggcaggcaccggtgtgtgcgtgcgatcaaccgaacgccatgtggcggttggacggacgaatggctccaccatcgatctgagccattcggattttgaaccgctgatttttccactggacggcactagcatcaagattcagtctcaaatcccaaattcctcaacgcaaagcccacaaagagagaatgtacagtgtttcaaagccacagctcactagctcaaaagtagtgagcatgcacacctgtatttacatgcatgcatgtacacccccacccccactacttgtacactttgtaaaccaaccaaccaagcaagcaatcacacagagcaaaccgtacgtggctggctcccgcctagtcgtcagccagatccctatgtacaacgtatctgaaggacgacttgtacggcatccactcgacgcacttgtcgacggccctccgccggaggccgagctgcagctgcttctgctgcgcgtccgacaaggtctcgcacaccagctccaccaggtgccgcagctccagcgcggcgtcccgggcgtagcagtgcagcaccttgggcagcagcagcgcctgcttccgcaccgccacgctgccccggatgaactccgtccgcgccgcctccagctgctgctgtatcttcttcgccgtgtacagccgcacaggtgggtccgaaaacgctccggtcgacagcgcgaaatgcgcaacgggttctgggtgctggagcgcatacgggtgcctcgccgcggaccttttcgccggcgtgaatagcgcgcggacccacagtgatggacgatgggactggcggcatccaagaatcgagttctgaatagtctgcgcatttactgattggccgccaacattatacgcagccttcagaatcatgtccgtgctcttcatgcgcttgtcgtgcagaccataggccagaaaagcatgcatgaccagagcattgtggatattgatccaaaagcagagctgctcctcgtgcgtcatcttcaccgggtcgactttctccaggcgctgtatcagagacctggtagtctcgagcatcttcgacgcgtactcaaacgtgtcagcgtcgacgcgtatcctcggaacgacgaccatcatcacgcctgggctctgctcaccgctctccttctcgactccacacggccgcgggctccagctatcgaagttgttgcaccgagaccgagggctccagctatcgttccggcgcctcggagagaaggtgctccaagacgagaccgaagggctcggcgaagccacgcagcactccccctccgcgcccgagagcttgcagtagacggcggcgatgcagcccaggatgtcctccgacagcttgcacgagatcttgggcacgtactccgagatggaggcgctcaggaagttgacgaggctggaatgcctcgcgcctgccttgggctctggtggtgcttcctggtcctgctcagagcctgagatggtcgtcgtcggcaggtcgaacgccgcggagcgcttcccggcccgccgccggggccccccctcgtcgatcttttcagaaattcttggtccacctgctcgcttgtgaagctgcaggattcagatacgtttcccggccggcctcgagg

SEQ ID NO: 5879 - DNA, 2922 bp, Zea mays
accaaactagccctaagttctatacgtaggagactgcaaaagcttgtaatattcgtgtttccattataaaaatatatgccttatattataaactaaagctagcacaaactcttttctgtattttgcacattcttcgatttcgttccattagggaaaaagaaatacttacccccggtataacattgctctttggcaggagctggtggactcggagcacaagagccaggagagtgggaaaatgcacgcttgcggacacgacgtgcacacgacaatgcttctgggggctgccagaatactccaggatcgcaagagcgacctaatggtaactgatgcttaattaacccggtcaattccacacagatccgtctataaactccacgttcccatgcgtatgccgtcgacgacggtgttcttgcttgcttcttgtgctcaccatgcagggcaccgtgaagcttgtattccagccggcagaggagggccagggcggcgcgtactacgtgctgcaagaaggcgtccttgacgacgcgtcagccatattcggcttgcacgttgacccggccctccccgtcggcgtcgtttcgtccaggccagggcccttcgcggcgacgtccggtcggttcctggcgacggtcaccggtaaaggcgggcacgccgcgatgccccacgaatccatcgaccctgttgtagctgcagccactactgtcgtcagcctccagaagatcatctcccgagaaatcgatcccctgcagggcgcggtatgcatgtgtttctgcgtcgtcttagctgtgctgtgctgttgttctgggctgtctgactctgcctcatcttcttcgctgatttaaattaaatgtatcaggttgtgtccgtcacttttctgaagggaggagaagcgtacaatgtcatcccagagaatgtggcctttggcggcaccatgaggagcatgacgaatgaaggtctatcgtatctcaagaagaggatcaaagaggtaaaactccgatcctctctcgttacctaacctaacctaaaccgcgcgcacacagttctcttataaaaaacaaaatgctcccttcttcgcaagatcgtcgaaggacaggcagcggtgcaccactgcagtgccagcgtggacttcatggaggacacgatgaagccgtacccggccgtggtcaacgacgaagggatgtacgctcacgccaaggaggtggccgagggcctccttggggagaagaacgtcagggtgggtccccaggtgatgggcgcggaggacttcgggttctacgcgcagaggatggcgggcgccttcttcaccatcggggtcggcaaccagagcaccatggcgaccatccattccacccactcgcctcacttcgtcgtcgacgaggacgtgcttcccgtcggagctgcgttccatgctgctgtggcgattgaatatgtcaggaagaaccgtgcgtcgacctaaacgctaaactcaaataaatcagacggaacaaaacggcagtagtttgtcttaggtgtcactatatataatgcgagtatttacatctagtcgctctcgttcctgtgtcgttagaaacaaagcagagtgattgggattaattcttagatcagttgcgagttgcgactacatgacacactttgccgctaaactgaagcgctgccataaaaatccataaagcactagctagtcaatgcatgtgcgtgaaatatataaataaacaaaaaaaagtacagaacatataactctaagaatcaaactttttattcttgcgtccgactactaattcatagaaaattaatattagtattttgtggtgaggaagttcgcggtaacgtaagcagtcgcggatatgactcccgagccacctgaaacataatctatatatctttagtttacacttgtttttataccaaattataatagaaagaggatttttttaaattggtgccctcagttttggtcgtgtgctcatctatacccttagtcgtgttttttgctcagctgtgcccctctattctataacaccattataattatgtataatagaccgaacaggatgtgattagatcctggattcgtccgctctgataccacttactatgttcccagtgagaaattaaaggtcaccgtaattattgttcttatactggaatcgagggatatcagcaagaacaagaggaagagcacatagagatttgggaacatattctgtcattccatcatgtccctctattcacgattacacgtaggttcatatatagatccactcgagcgtgtccacacggctcctgttaaggatggcaatttaatccgcaaacccgaaattcgacggggactcaacccattgggtacggtacggctacgggtgaagattttaacctacgggtgcaacccgcacccgacctgagatttcgcgggcgtggatgcgggtttttatttcaacctgcaggtggcctgcacccgtctcgattctagttcattctttattttgctaaaaaattattaagatacaataataattattttgaataagtaactcgactagtaatttataaagtgttttgttgctattcacatgtgagaaggcttaaaatacataaatataattcaattattgttgttacttaattgcttgtagatgaatgattgtttaaaagtgtatactgattaaaaccccgtgggtgacccaaaacccgacgggttcgggtgtgggtttggaattgcactcgcgggtacgatcgtaggcgtgtttaggtagatttcacgggtgcaatcgcaagtgggtttccatccaacccaaacctaacccattgccatctctaactcatgtcatatattatatcttcatatatatatatagtatatgtatttagagtcctaggctctatttagctacaagaagccccaaccaaatatgaacgcacgtg

SEQ ID NO: 5880 - DNA, 2156 bp, Zea mays
cgtggacaaatccagattttttttctcctaaccatgccgacacgtatatatgttaggaatgaaattgaaatcagacatccaaactagaaatctactgccatagagtagtggcatgcatcacttgtttacctgtagataccctcgtgatctctgttcattaaatccgtactcaagttgaggtgatgtccctctctaacgccatgtaattgggcacaggtatctagcctaggttgttaagcgccactttgttagatgaccgtaaacaaatgtagtagaaatcacaattcacaaggatacgtatggatttgaaacaagaagttacgtctagatgagaaatacgaaaaaaagggttgttggaaggatgccaagaacagctatatatgacttgtcttttcatgattccgtcacgtacgtccaaagtaatgtcgtcaagaagcgcttagataacgacacaggctagttggccggcggccgcgctaacgctaacgccaaggctaatcccgaacccgaaatggcaggtagctctgctcgatgactcggcccctctcgaaagccacgaaaatcgctgggccgttcgattcactcacctcactccacctcttgactgaagaagccgtctgcctgcctccgactcccgcgtctctcctccaagtgatctccttccacctttgccgatcgcccgttgccaccggccgggcgatcctcgtacttccacttccaccatggcctcctcctcctcttcctcctcctcctcctcctcctcctcctcctcctcccgcttcctcctcccgctgctactgctctgttcgcacctctccctcgcctcggcagaggaggcggcgtcggcggcagcggacctcctcagcgaggcgcgcgcgccggggttcgccgcgtggctgcgcggcgtgcggcggcgcatccaccagcgccccgagctggccttccaggagttccgcaccagcgagctcgtgcgggccgagctcgacgcgatcggcgtcccgtaccggtggcccgtcgcccagaccggcgtcgtggccaccatcgcgggcgccgccgccggccccgtcgtcgcgctccgggccgacatggacgcgctccccgtgcaggagctggtggactgggagcacaagagccaggagagtgggaaaatgcacgcttgcggacacgacgtgcacacgacaatgcttctgggggctgccagaatactccaggatcgcaagagcgacctaatgggcaccgtgaagcttgtattccagccggcagaggagggccagggcggcgcgtactacgtgctgcaagaaggcgtccttgacgacgcgtcagccatattcggcttgcacgttgacccggccctccccgtcggcgtcgtttcgtccaggccagggcccttcgcggcgacgtccggtcggttcctggcgacggtcaccggtaaaggcgggcacgccgcgatgccccacgaatccatcgaccctgttgtagctgcagccactactgtcgtcagcctccagaagatcatctcccgagaaatcgatcccctgcagggcgcggttgtgtccgtcacttttctgaagggaggagaagcgtacaatgtcatcccagagaatgtggcctttggcggcaccatgaggagcatgacgaatgaaggtctatcgtatctcaagaagaggatcaaagagatcgtcgaaggacaggcagcggtgcaccactgcagtgccagcgtggacttcatggaggacacgatgaagccgtacccggccgtggtcaacgacgaagggatgtacgctcacgccaaggaggtggccgagggcctccttggggagaagaacgtcagggtgggtccccaggtgatgggcgcggaggacttcgggttctacgcgcagaggatggcgggcgccttcttcaccatcggggtcggcaacgcgagcaccatggcgaccatccattccacccactcgcctcacttcgtcgtcgacgaggacgtgcttcccgtcggagctgcgttccatgctgctgtggcgattgaatatgtcaggaagaaccgtgcgtcgacctaaacgctaaactcaaataaatcagacggaacaaaacggcagtagtttgtcttaggtgtcactatatataatgcgagtatttacatctcaaaaaaaaaaaaaaaa

SEQ ID NO: 5881 - DNA, 1821 bp, Zea mays
atcaccccacccccacccaccaacccaccacgcgacgcggctgtggcgtccctctaatctcgttcgcttccgctccacgccgcacccccggccgactgcctaacctcgtgttggccgcgatcccgctcccgcccagatctggtggcgccttcgccgctcgagcgcgtgccctcacgggtggagtgcaggcggccgctcggttcagccggctggccgatggtttcggccgcggcgcaggcgggtgtggtcgcggcgtgcgtcgtgctcttcgtccccatggggctggccggctggcacctcagccgcaacaaagtgcttttcttctccggcgcgctcttcatctcgcttgctgtcggggtccacctatccccgtacctcccctccctgccccacctcgcctcctccttcctcctcccccactccggcgccgcgtccgcgtccgcgtcctcctcctctgggtcttcctgcgtcccgtttctgcaccgtgtgtcgtggtctgacgccgccggcgccgcggacgacggctcgggaggcggaaaggcacgggcgtggtcgtggccgccctcgctggcgtccgcctgcgggttcgcgcggctgtcgcgcgatgacgcgtcgctgctgcttaacggctcgtgggtgatggtggcccgggattcgcaggcgcgactgctcgtcctcgcgcttctccgcctcctgctcgacccggccgcggcggcggccgccgagccggagctcttccgccgccacagcgactaccgcgctgccgtccccgcgcgggacatttccgtggacttcgtctgggcacccttcgagagcaacctcacgcgtctgctccgcgaggatctgcgcctcgcgccgcgcctccccgacgtgctcgtcctcggatccgggttgtggcacatgctccacgtcacggacgccgcgagctacggcgatgcactggcgtccgtcgcgggcgccgccgagtccctccgctcgcagcttcccgtgccgccaccacatatgttctggcttggcttgccgcacctcgtgaaccacatgctcaacacagacgccaagagggcacacatgaacggcaccatgcttcatgcctatgatcgtgaggtcgatcggaggggtgttttgcgccgtgatggtggcccgttcctgctgcttgatgtggggaagctcacccaggggtgcgggcagcagtgcacagcagatggtatgcattatgatggtggtgtgtatgacgctgtcatgcatatcatgctcaatgcactggtgattgagtcccaacaaaggatttgagtgggtggggggttcttcaacaggtttgcccccaaccccctgttctttttggtcagtcacggtacacaggtaaccagagattgttgtgaactagggaaggttctttgattgcttcaacattttggtcgcttgccacaagtcacaacccttgaattgctcaacctttagattgtaaaatagggatatcctagaaccacactgttctttgctgaatggcaaaccgaactagctgtactgtatacttcttggtggaataactaagatggtgattctgacacgaagattgtgaaatgctacgaaatatagtcattttttttaattttggcaacataatttgtccttgccatggtaacttcgagaacttattggactgtaattgtgctactccctcttaatatgataaactgcacatcatcactagatctaagatttgtgttttttttggaatctctaatcttatcactatgttgcatgctgagtgcattatgcatagttgaatataaagagtgttggtgtttcgagtaaacatcg

SEQ ID NO: 5882 - DNA, 1577 bp, Zea mays
atttctccatcccccgccccccctacctagcacatcctaaccctgtttccatcccgccgacccgctgcgccaccgccacgctccccaatctccatcccaacgcgacgccgcctctaatctccctcgcttccgctccactccgcacccccggtcgcctgccctaacctcgtgctgctcgtgatcccgccccgtgcccagatctggtggcgccttcgccgcttgagcgcccccgctcagcggtgaagtgcaggcgtacgttcggcctgcgggccggccgatggtttcggccgcggcgcaggcgggcgtggtcgcgtcgtgcgtcgtgcgtgctcttcgtccccatggggctggccggccggcacctcagccgcaacaaggtgctcttcttctccggcgcgctcttcatctcgcttgctgtcgggatccacctatccccgtacctcccttccctttccctgccccaccttgcctcctttttactcctcccccaccctgtctctgcgtccgcctcctctgggtcttcctgcgtccagttcctgcaccgcgtctcgtggtctaacgccgccggagccgctgacaatggctcgggaggcggaaaagcgcgggcgtggtcgtggccgccctcgctggcgtccgcctgcgggttcgctcgactgtcgcgcgacgacgcgtcactgctgctcaatggctcgtgggtgatggtggccggggactcgcaggcgcggctgctcgtgctcgcgcttctccgcctcctgctcgacccggccgcggcggcggccgccgagccggagctcttccgccgccacagcgactaccgcgctgccgtccccgcgcgggacatttccgtggacttcgtctgggcacccttcgagagcaacctcacgcgtctgctccgcgaggatctgcgcctcgcgccgcgcctccccgacgtgctcgtcctcggatccgggttgtggcacatgctccacgtcacggacgccgcgagctacggcgatgcactggcgtccgtcgcgggcgccgccaagtccctccgctcgcagcttcccgagccgccaccacatatgttctggcttggcttgccgcacctcgtgaaccacatgctcaatacagacgccaagagggcacacatgaacggcaccatggtgcatgcctatgatcgtgaggtcgatcggaggggtgttttgcgcggtgaaggcggctcattcctgctgcttgatgtggggaagctcacccaggggtgcgggcagcaatgcacagctgatggtatgcattatgatggtgatgtgtatgacgctgtcatgcatatcatgctcaatgcactggtgattgagtcccaacaaaggatttgagtgggtgggggttcttgaacaggtttgtccccacccccttttctttttggtcagctactatacacgggtaattagagattgttgtgaactaggaaggtcctttggttgcttcaacattttggtcgcttgccagaagtcaccacccttgaattgctcaacccttagattgtaatatagggatatcttagaaccacactgtttttttttggctgaaaaaaaaaaaaaaaa

SEQ ID NO: 5883 - DNA, 371 bp, Zea mays
  misc_feature (13)..(14): n is a, c, g, or t
  misc_feature (368)..(368): n is a, c, g, or t
tcgagggccggcnncgggaaaaaaaataaaaaaaaaaaaaaaaaaaaaaaaaaggtactctccccacaagcatccccctccatgatagtgcttcctctgagctaaggctctctcacctacacacccgctcaccccaagtccacgccggcgatggccgcaatgccggcgccggcagcgggcttgtccgtcctggtgctcttcgtcttcgccgccgccctgccggccctttctgccgatgacctcaacaccgacgcgcaggcgctgcaggcgctacgctcggcggtcggccgctccgcgctgccatcgtggaacagcagcacgcccacgtgccagtggcagggcgtcacctgcgagagcggccgcgtcgncga

SEQ ID NO: 5884 - DNA, 1413 bp, Zea mays
  misc_feature (1365)..(1365): n is a, c, g, or t
  misc_feature (1370)..(1370): n is a, c, g, or t
ttgggtacctcgaggccggcccgttgggtacctcggggccggccgggaacttttgtccccctccctcctccacacctctcgttctctccccctccgcctgctccctctcaggagcgcgcgcgcgcgcgcccagatctagggtttcgtccgcggcaagatgagcagcccgcatggcggtctcgacgaccagatcgagcggctcatgcagtgcaagccgctcgctgagcctgaggttagagctctttgtgagaaggcaaaggagattctgatggaggaaagcaatgttcagcctgtaaagagtcctgttactatatgcggtgatattcatggacaatttcatgatcttgctgaactcttccgaatcggtggaaagtgtccagatacgaactacttgtttatgggagattatgttgaccgtggttactactctgtcgaaactgtcacacttttggtggctttaaaagttcgatatcctcagaggatcaccattctcagaggaaaccatgaaagccggcagattactcaagtgtatgggttctatgacgaatgcttaaggaagtatggaaatgcaaatgtctggaaaacctttacagatctatttgattacttccccttgactgcattggtcgagtcagaaatattttgcttgcatggtggattatcgccatccattgagaccctcgacaacatccgcaactttgaccgcgtccaagaagttcctcacgaaggtccaatgtgtgatcttctgtggtctgatccagatgatcggtgtggctggggtatttctcctcgtggtgctggttataccttcggacaggatatatcagagcagttcaaccataccaatagtctaaggctaattgctagagctcaccagttggttatggagggattcaattgggctcatgagcaaaaagtcgtgactatatttagtgcacctaattattgctaccgctgtgggaacatggcatcaatcttagaagtggatgattgcagagagcatactttcatccagtttgagccagccccaagaaggggagagccagatgtaactcgtaggacacctgactatttcctgtgacgcaaaagtgatgtggatcatgcagagcgaaggtttgatagataggcgcagtttcctggttgcagatatatatatttatatatgtttttgctgggacccctccgtgtgctattcttattatttttgccctggctcgccggccgctctgccgcgtcgtgattcaagtgtatacctacagcctgctacagctggaaggactggactgtgttctcaccttttctcaaactggttggtgcttttggctcggtgtggggccgcagcggtgtggggggttgaagcctctnccagngacttgggttctccgaggaaaccgttctccgttgtgttgtcct

SEQ ID NO: 5885 - DNA, 1866 bp, Zea mays
gctacgagtctacgaccagttcggcagcacggcgagcatcccgtccgaccatccgctcgctcctcagagctagcctccaaactcgcaactatataacattgggcccctcgaggccggccgaccttttgcccccctgcttcctccgcctgcaccctctcacgagcgcccgctcgcccagatctagggttccatccgcgggcaagatgagcagcccccatggcggcctcgacgaccagatcgagcggctcatgcagtgcaagccgctcgctgagcccgaggtaagggctctgtgtgagaaggcaaaggagattctgatggaggaaagcaatgttcagcctgtaaagagtcctgttactatatgcggtgatattcatggacaatttcatgatcttgctgaactcttccgaattggtggaaagtgtccagatacgaactacctgtttatgggagattatgttgaccgtggttactactctgtcgaaactgtcacacttttggtgtctttaaaagttcgatatcctcagaggatcaccattctcagaggaaaccatgaaagccgacagattactcaagtttatgggttctatgacgaatgcttaaggaagtatggaaacgcaaatgtctggaaaacatttacagatctatttgattacttccccttgactgcattggtcgagtcagaaatattttgtttgcatggtggattatcgccatccattgagaccctcgacaacatccgcaacttcgaccgtgtccaagaagttcctcatgaaggtccaatgtgtgatcttctgtggtctgatccagatgatcgatgtggttggggtatttctccacgtggtgctgggtatacctttggacaggatatatcagagcagttcaaccataccaatagcctaaggcttattgctagagctcaccaattggttatggagggtttcaattgggctcatgagcaaaaggtcgtgactatatttagtgcacctaattattgctaccgctgtgggaacatggcatcaatcctagaagtggatgattgcagggaacatactttcatccagttcgagccagccccgagaaggggagagccagatgtaacccgtaggacacctgactattttctgtgatgcaaaagtgacgtggatctgcagcaaaggtttgatagataggcgcagtttcctggttgcagagatatataaatatatatctactatatatattggctggagttcctccgcgtgctattcttatattatttctcgcccatggcgctcttggctgtcgccggctgctttgctgcatcgtggttcaagtgtataccctactacagctggaaggactggatcgtgctcttacggtcttacctgtctctaactggttgattggcttagggtgggctgcggtggtgtgtgtgtgggttcaagcatcaggcagccatctgtattatgggaggaagtgttcccgttgtattcattttgttcccctttcttcctcatctgattttcttctctttttttatttgttccttctctgtgattcttgtagagttcagcacttgtatggttctatgttgggccattagttttttttaactctctttctctgactgccccgatttgccgtatagaattacatttctaagcgcaactagccaacctgtagcattttctgtcaccagcatttgaagttttgaactgagccctggtcgtgtccctgaggtttgatgtgctcttggtgtactactcgtatttgctaattagaaaaggaccttttgtgggtttgctagcgtttggcactaacgcccacgctagaatgttttgacgttgtccatgtgacctggatggaagctgtgaaccgtaattggct

SEQ ID NO: 5886 - DNA, 1141 bp, Zea mays
agaggatcaccattctcagaggaaaccatgaaagccggcagattactcaagtgtatgggttctatgacgaatgcttaaggaagtatggaaatgcaaatgtctggaaaacctttacagatctatttgattacttccccttgactgcattggtcgagtcagaaatattttgcttgcatggtggattatcgccatccattgagaccctcgacaacatccgcaactttgaccgcgtccaagaagttcctcacgaaggtccaatgtgtgatcttctgtggtctgatccagatgatcggtgtggctggggtatttctcctcgtggtgctggttataccttcggacaggatatatcagagcagttcaaccataccaatagtctaaggctaattgctagagctcaccagttggttatggagggattcaattgggctcatgagcaaaaagtcgtgactatatttagtgcacctaattattgctaccgctgtgggaacatggcatcaatcttagaagtggatgattgcagagagcatactttcatccagtttgagccagccccaagaaggggagagccagatgtaactcgtaggacacctgactatttcctgtgacgcaaaagtgatgtggatcatgcagagcgaaggtttgatagataggcgcagtttcctggttgcagatatatatatttatatatgtttttgctgggacccctccgtgtgctattcttattatttttgccctggctcgccggccgctctgccgcgtcgtgattcaagtgtatacctacagcctgctacagctggaaggactggactgtgttctcaccttttctcaaactggttggtgcttttggctcggtgtggggccgcagtggtgtggggggttgaagcatcaagcagcgatttgtgttatgggaggaaactgttcccgctgtattgttcattttattccccttctctttctcaccgcctgattttcttcccctttgttccctccttgctgtgattcttgtagagttctgcacttgtatggttctatgttgttgggccattagttttttttccctttctgtttttgactacctcgatttgccatatagatttttttaccatttaagcgcagctagtcaaactgtagcattgtttgc

SEQ ID NO: 5887 - DNA, 2912 bp, Zea mays
gtctgcgttgcatttaactatgtagtagctgtggttccgtagctgaagttctttggtatggcttgattgtgttctctgatgtggttctaggagaagttttggtaatatgctctcttttgcaataaatgatcgtaactttgtttgaagctaaggtcggaggatttttctattatctaaaaacaaatccaagcagcaccctggtccagcggaggcagacccacatccgtccggcctagtacggtcccctcccgaccgttgcgttcaagcgcgccaatccgaccgttagagcacagacacaccaaatcccctacgccgctcctcgtgtgccaaactgccaatctacctcagacaacaaagctcccaccatgctctgttccacctctgctcctcgtgttcgcaaaccctgctcgcattaaaccataatacgcgagccccacggcttctctcatgaccccgatctcctttcctgcccaccacaaccgatggccgccgctcacctccggttattgccgctcttgctgctaacgctgacagcggcggccaagaacgtcaccctcgactctgccatactatccttcgcggacctcacgctgctgggggactccttcctccgcaacggctccgtctggctcacccgggataccgacgtgccctcctccagcgccggcaccgtgctctgcacccagcccgtcgcgttccggggccccgacgccacggcctccaatgccaccgccgccgtcgcatcgttcgcggccaggttctccttcgtcatcgccaaccccaacgcgggcgccgcggggggcgacggcatcgcgttcttcatctcccccgaccgcgccacgctcggcgccaccggcggctacctcggcctcttcaactcctccaactccgctgcagccaagaacggctccgcgtccgccaccattgtcgccgtcgagttcgacaccatggccaacccggagttcgccgaccccagcgacaaccacgtcggcctggacctcggctcgccggtctccgtcaccgcggccgacctcgccgcatctggggtcgacctcaagagcggcaacgtcacgacggcgtggatcgactaccgcagcgcggaccgccgcctggaggtgttcctgagcagctacgccgtggccgccaagccgaagcggccggtcctctccgtcgctgtcgacctctcgccgtacatcaaggaggccatgtacgtcggcttctcggcgtccacagaggggagcacgcagcagcacaccatcaaagggtggaccttccagacgttcggcttcccgcccacggccaactcaacctttgaatccaatgccaccagcaactcttcagagccggccgcgccaacgccaccgccagcctccaacgcccccaacagccacaagaggagggtcgggatcgcgcttggaatcctcggccccgttgcgcttgccctcgccttcatcttcttcgcctgggtctccatcaagaagctcatagaactcacctcccggaccgacgccgctttctcgcccgagctggtcaagggcccgaggaagttcagctacagggagctgagcgcggccaccagagggttccacacgagcagggtcgtcggcaagggcgcgttcgggactgtgtacaaggccgccatgccgggagctgccgccaccacctacgctgttaagaggtcgacgcaggcgcaccagagccggagcgagttcgtcgccgagctctccgtcatcgcgtgcctccggcacaagaaccttgtccagcttgaggggtggtgcgaggagaaaggcgagctgctgctggtgtacgagtacatgcccaatggaagcctggacaaggccctctacggcgagccttgcacgttgtcgtggccgcagagatacacggtcgccgccggcatcgcgtcggtgctgtcgtacctccaccaggagtgcgagcagcgcgtcatccaccgggacatcaagaccagcaacatcctgctggacgtcaacctgagcccgcgcctgggcgacttcgggctggccaggctcatggaccacaacaagagccccgtgtccacgctcaccgcggggaccatgggctacctcgcgccggagtaccttcagtccggcaaggccaccgagcagaccgacgtgttcagctacggcgtggtgctcctcgaggtgtgctgcgggaggcggcccatcgacaaggacgagcgcggcgggggcggcaggggcggcgggggcaagaacgtgaacctggtggactgggtgtggcgcctccacggcgaggacaggctcatcgaggccgcggacgcacggttggccggcgagtttgccgacgccgagatgctgctgctgctgctcgtggggctgagctgcgccaatcccaactgtgaggagcgtcccgcgatgcggcgggtggtgcagatcctcaaccgagaggcggagcctgcgcccgtgccgcccaagaaaccactgctggtgttcagctccagcgcgtccgcgaagctgcaggagatcgccttctcctgtggcgatgacgtccgaggcggctactccgttgccaagcctgcatcaccaaagtccgagggagccgacattgaacgctgacgcgaagcagtcgataccaattacactactacagatttgttggtgtgggaatatataggtgcttcagtctggaaagtgctgatgaatgcaaattccatgagtcatctacggtctagagaagctggcattgacgcttgatagcaagcgatcaatgcactgatagtgaattactacttgtgtgattcatatatgcattggccatgtgctcgtgaggggaatataggtaataatcccctctgttgtatgaatgttcaatactgaataatggagtcatttgctaagtgtgtttctgcaaaaaaaacaaaaaaaaaaaaaaaa

SEQ ID NO: 5888 - DNA, 2574 bp, Zea mays
  misc_feature (205)..(205): n is a, c, g, or t
tagtctacttcatcatcactagactcatcatcacttgaagaagcatacgtaatagtacttcaagtacttaccttcttctcctttgccatgaggcaggtgtgacgctcgttggggaagagagacgatttgttgaaggccgtggcggcgagtccttcgtcgtcggagtcggacgaagaacaattcgagtcccattcttttccaaggngtgcctcgcccttagccttcttgtaaaccttcttgttctctctcttcccattctttccttgttcctggtcactatcattatcgggacagttagcaataaagtgaccaatctgtaacaccctaaaatattattttgggtaatttaggaaaaaaacattctaaagtaaaaatagttatgttttgaaacaagtggttaaataaaaggtcctaatatgaatgactgtctgtagtaaactatgtagaattagttaaacaatctattaataaaagattatgcattagataaaatcttttctatcaaaatagatgaatgtggacttttgaatatacttttagtttgactacaaacaatgtgtgtatatgttgcatattggagacattctcgaataaataaagtatttaatacaaaaaaatataattgcatttcatgctgaatttttgtatgtgcatttgaactcaaatcctaaatttgaatcttgtgtgaaattataaattccaaatataattcaaaagaaaaaatagacaactgaaaagaaaaaaaaggaaaggagcagacctgcgcttgggccgaaaccatcattggcggcccatctactccttgcccccttccaccaccaatcggcctaatctggcgacatgtgcggcccacgcgcctgacaggcgggcccactcggccagaaacgctgcacgcacgctagttttcactgcggctggtaccctccggtcagtaacgctcactcttccgtgtcgcttactcgtgggaccagcttgtcattttcttccctaccaaccgtaacagaaccccggccgtcagctgcgtgaaaaccgggccagttctcgttgggggattgacgtgatctccggaaccgaccgagccgggggtcagtgccccgcttcgttctctcatcgccggttaggttccacaggtcaggccggagccttcttcttcaactaactccgacgtccgcatgttggcatggtcgagatccgctcggtcgaaactgaattccgcatccaccgtgtgctcatctggccatcccaacagctttcacctatatctgcggctcgctctccgggctataaaaacccaagtctcgcgccgccgtgaggacccaggtccgccacgggcggaagaaaaaccaagccggatgtcacgataggcaacctctcaaccctcgggtgttggaccgagtgcatcatcggaccatggaggtggtgaattcgtgctcgcctcgagaaagtgtcaaccggtgttccaggaattactcaccggaattggcctccgcggtcgtgtcgccttgtgccgcgggtaggatccaaagcgccctaatccatggaggtaagcccaccatctaactcgcgatcacctccgcattgttttgcatcagcgcttgtcgtgaatcggtcgccggggggaaatcgattttgcctctccggcgaggggcgccgccgtgatcgggttcacgggcgcggagtgcgctcgtaggggagaagctcgggtgccgtccgtcttgagataaacggtcacaattaggcggacagctcggggagaaagaagggaatcggtccgttggattttgagccagcggctaggattagaacgagttcagatttgatatggtccgttcgatcggaatggatgcgctggattaaatctgcgcatattggttcgatgcttcactctggaccgccgatctgcgatccgagggctcagggagcgtaccgtttcaaatcctagcaatctaatctggtccgttgattccagatcgcgtggcccctgttagtcgatacccatttggtggccgttttcctaatgagtcccccagagaagtagaaatcaacccgctgtccacccgggttaatcctgagtcatggaaaactttgcgagtaggcccccgaacttctctgtattgtgcgctcagtccacgaaacagggaaaataagtaaataaatacagaaaatagatatttagtataaaaacaattccaaaacctagtttaattcatataaaattcattttaactcatttttagcccattccagtttctataattttgtaatattattatttatcaactagtgtctctgttttgacatgaaaaccatattaaaattaatctcctaactaatcttgtacctagcacctagaaatgttggaaattcataacttaaaatccataactccaaaattaatgattcctgttcctatgatcttattttaatatgtagattattaatatgtattttgttcttatggttggtgtgatattaatttgcctataccatgtttggtttgtatgcaacgattagcgtggagtcacgagtcatgtgaaagagcagttggtacctagaaatctcagtcacaggcaa

SEQ ID NO: 5889 - DNA, 7303 bp, Zea mays
gtgctcacagataatcgatctgcaatatgtatatgtcaacgattattcaaatcacccaattggccaactatagtgaccaacacgtacatagattctggccgggggagatggtttttaaattgcctataaaacagtcacttccttattgtaaaattaccctccttttttcactcattgagaaaaatgttttgacgttagaaacaggttaccggattttggaggctgatggctcagaagagatgtatgacaggatcatattttgtgttcatgctcctgatgctctaaaaatactaggagaagaagcaacacctcatgaacggagagttctaggagctttccagtatatctacaggtatttctatacactactgataaaagtgttttcaaatttcttaggttttccttttttttgcagcgatttgtatttccactgtgatgaaagttttatgccacgtaattcttctgcatggagtgcgatgaacttcttggggactacaagcagtggtgtttgtgttacctactggttaaatatacttcaggtgccattagtttgattatgatggatgatcaatgaacgtatttatgttatttttgtcatgacatggaaggatattaaaactaaccatggaacattgttgtcctttggaaaatgctagaacattgaatctgccggacctttccttgcaacacttaaccctcctcgtgttcccgatcatgtattgctaaaatggcacactaggcacccgattccttccatggctgctgcaagggctactcttgagctcaatagcatacaagggaagaggggaatatggttctgtgtcccatatcaacaaggtgactttgcccattgttttcactgtaacctgcctagttttttttaaacccaaattcagtataaaataagtctgaaatatgtcagtttttactgaataacaacaggttatggaaatcatgaggacagcgtgaaggtattcctttccctcttgcatggtatttatttaggatcaatcacaaaagacccaacaaatattcatcagagtgctttctgtttatttcaaactgaattagtttaggctgggaaagcagtaactttagggttgcttggcaagaaatgtgaccttttggtgaacccgaaacccatgatcgtcccatcatggactgaggccggcgtacgatatatggtggcaaaaaatctaggaaaattcataaccattggtaacttcaggtgaggctgcttcaattctatgaactcgatcgtatatatactacaaattaaaatccctgataatatgcatatatgattctcactcacgtccgtcttctgcacagcatgctcgaagatggaggcacttctcttagttttggcaaaacatgtgaaagatgtcaactaaaatgtgtgatacgggttcacaacccccagttctattggaaggttctgttcgttatcccttcgtctagcttatttcatctttagcttttaattaagctgccttctaattaatttcttcatcacgtatacgtgactaacatctaggctttgtctcatgcatccttctattagattgcaaccgaaggagaccctggttttgcatattcctacatcaatggttatatctcgtttgttgataaaaaagaaggcattcagaatattgtcgaggtacgtatatatacacagtggttggcccataaatattgtaaaatcaaataaaattgttatactaaacggaagaaggcacaatcaagattattacacttcatgacgaactaatgtctctttgcattaattcgctcactaaatttatagcccgtatggtacacagattattattgctaacagaggtgaacggaaaaggttgagcagtacccgtgccaggaataaaaggtaacttaattttaaatgaacattttgtttcataaaattgagcgagggaccagagacataattaagtgtgctagtaataaactcgtttaaactaatgtcttttgcagtggttatgtaaaaaagggctggtggacacccttgtttaaaaaaaatggagctgcaatggcaaaatatgttttgcatgaagtcttaaggagaaacactatatcaaaagctcgtaaaaatatctctgcacactatgacctggtcagttgtacacatgctacaattaaatcagttgtacacgtttctagtataaatgaacaaagtactgtcttattttgaaacataactagtattatttgtatgcagagtaatgatttctttgctctttttctggatccgacgatgacttactcttgtggtattttcaaggtatggaattgattattgtggcgtagtattttcaacgtacatgtaaatcccgtacactgtttgatatttgtaggcggaagatgagagtttagaagcagcgcagctacgtaaacttgacaatctaattaataaggtaaattcatcatatataatgcatgggttgaactctgccatcataatttgctgatttattagataatttccatattaaccactgctgaaggctaaggtggatccggggcatcatgtccttgacattggctgtggttggggctcgttagcaatacgtttggtgaagagaactggctgcaagtgcacgggaattacattatcggaggagcaactgaaatacggaaagagaaaggtgaaagaatttggattagaggtcagttaattacatttattccctaaatattaggtagcattaattaattggaaaagcaaacaccaatcaccatcacgtacggatattaattaaccgcgtgtgtatatatatatgcaggaccacataactctcctgctttgtgattaccgtcaaataccgaacggccagaagtttgataggattataagttggtgagtagtaccgccgctcatgtgatcatatatagatcatcgtctgcatgctggccggggtctgtgtgtctgataacaatttttctgcttaattgctcatttttagtgggatgcttgaacacgttggccatgagttctacgaagatttctttgcctcctgcgagtatcatttggccgaacacggcctacttgtcctccaggtccatcatcatgaccaatatatatttatcttcaactaactgttatatttatctcaaagttaaatttatatcacatatatatatctatatagtccatcgcggtcccagaggaactgtacgacaaaatgaggacgaagcctgacttcctgaaggaatatatcttcccaggtggctgcataccttctttagctcggattgcatctgccatgtctaacgcatcaaggctgtggtatgtacacatgtcatttaactaataagctaggcctccgccatgatttatcagttattcattgagtactcgattcctctgcactgcagcatacaacacgttgagaatattgggtaccactattaccccactctgattcactggagggagaactttgaggctaatgaagagtaagtactactggccctaaaatatagctcaacctcggctacaagctagtgatttatttacgtcattcaatcagtaatatttttttactcctgcagaaaagttttggccctaggatttgatgaaaaattcatccgtacttgggagtactatttaaactactgtgcagctatgttcaaatcacacatgggtttagattaccaggtatgtatatgtgtttgctatatatatagctaacaattaatactatgttcaaatcaccttttaatcgagtgtcgtgctgtatgtacaacatgcatgcatatgcagatagtgtttgctcgcgcaggcgatgcgaagttgccgagctatgtcgccattgcgtaaatggaggaggacgtcgtgtttatgttttatatgtgagacagaacattgtattttctttgttagttaggaagtccaacattcgccaaataaaaatggtttgctagagatgactcgagggtgagacaagtgtcaaagccgcatgatgattaggttgtcaacttccgagagtttttcttggcggggcaaaggtttcctatgatcctttttgtattgaatgtgataaagaagtttaaggttaagtttcatcatttgaatcctttgtgattttctttttattttttttgtgtgggtacgaaagtctcaaaaggtagaagttaactagaacatgtttgtgcatacgtattgagtgcacattcaaccgaggaaggtgtctgtgtgtggtgtaaccttcacatgtcagttcaggccttcagggtttataccttttgttggctatttgttgaataacagtgctatcatgtgcagtgttcggcctacagtttccattcaaaatttccatagtgggccggtaaaacccgtcaaattattgaaagcttgattgaatttgaaggaatttcgaatttcatccaaaccgggtgctctgttgggcacactactgagccctttgtagcaccagcgtgcatttatcctttatctccagcagttccccagcggtccccactcctggctccacactcccacccgagcagcagcagaggctgccggcagcacctcccccgcgctctcccgctgcgctatcgccgccgcatcaacctcccgccgcgtcgtcctctggtaggttggctacctcggttctccctcctcctcgctccccagtccccacacgcccccatcgcctcaccattcgagctgccgtcgtgcgcaacggaggtgcacgcgatgtgttcgacgtatttcctatgcgcgcactgtccgtgagcgtgtcatgtgccgcttctggtttcctcaggatcctgacacgttctcttaccgtgatgatggagcattagctgcattctaattttgcgtcttggttggctcctctctgccagatcgactcggatggccgaggtcacgccgcccgccgacgggcagccggcgtcgtggtcggagatcccgcgggacctggccggcatggtgctctgcctcctcccggccggcccggatcgcgcccgcttcgctgccgtgtgcccgcagtggcgcgccgccgcgcggctgctcgccccttccttgcccccggcgctgccactgctcgcgctcccgaacggcatcttctacagcctcccctacagcaagccctgccgcttccctggctccggttgcgtcgggtacaagggcgccgcctttggcagctggctcgtcttcccgcgcgacgaaggctgcttcttggtcgaccctttcgctggggccaccgtgacgctccctgctctgtcttccgtccggctccgtccaccaaattcagctacgtaggccccccccccccaggagcgtgctacacccaatggcagacattacgtcacgtggctggatatcagggactccaagcatgtggccacattaaacaagctgatcatgtgctctccaaacctcgtcgctgcatttgttggcacatgacacataagtcagattctgatgtgccagccaggcgcttcctcatggtctgttcgcgcatatgatccgtgtgctgcatttgaagacatggctttctatcagggcaagctctacgcccttgatgatgatgaaaacctcctcgtggtcgacatcagccaagaccaaagcactggcgacccacatgtctgtcgaattggacaggtcatcaagggtgatcccgaccatttgtttgatgcttggatgccagatgacactactggcagaaagaagctgtacctagtcgagtcatgtggtgcattgctgatggtacgcaggaaggtatgctgcagaatggtagacgacacagttgttgctggacggatttgtgagtttgaggtgctggaggctgacttggagcactcgcagtgggtggatgtgacaactcttggggatgaccagatgctttttcttggacgaccatgctctagggctgtgtcggcatctcagtatgggatgtctaatgatcagatcttcttcttagatgatgtgatggagaatgctgaggagtatgcctttgatgaggagaacactagtgtcaatgtctacgacatgaggaatgacgaggtctctcgtcctctgcagatggtctggaagcacgagatgtttcttgcgacatggatgttccctaggggctaaatagaaggtgttactatgcgtcctggcactgattactagctgtccctgcctgttctaaggtgatcaattacccctatgtcatatgctaacttcatcagtgttttgtggctttagtgtgttggctacttctatattgggaaaatatggtggttactggtcatgtgcctgtgcaacctatgaagtagatcaaagactaaattgtctaaccgtactttgatctatatatgcttggtacctgtaagagcatttaagttgaacgcagagtgatcatgctgtgagcttagttgtaatgaatcttgtgctaccagttgagcttatttggcttgtgatgcatgtatgtggcagcgcttgattgtgctggttgattgtgtagaattatagcatgtatgtgtcaactttgatattattaccatctagctgacgattatcccaagtgaaaggcaatcgtatgaatccaagatcagtgccatccatttggcgttcaggcctagtcaccccaccgaactgctcatgaatgagcatccaaaatctcattaaaatccccggcacagatccaaggcctagtcactttgggtgggtgctgaggaactgcattaattcccagctcctgaaccttcgctcccttcttgctacaaaccagtgaatcgccacagctcaaatcattgaacaggcgtgtttccgacagaaacaaacacaagcgtcgggcgacgtatgaatgaagctacgaatctcttgaactgcttcgggcgctgcaccaggccccggcagtgtcgatgatccactaccgaaagaatcagctgcagcttcagagaaactctaatcttcttcctcctctcctccggggccctaagcttgatatcacagggcagcttgcctacgaaccactcactggccctaagctccgagtgccccatgaaagacagaagaacgggagcttttccaattgtatatcaaaccatagtggctttcccatctttgtctacatgtaacttcttcaccacaccaaccaggcccatggaacgttcgccggttcatccagccaagcagaaggttcaaaatccggatccagatatccatacgatcgaatccgatctccgtaggcttgagacgtggttgtaacagcggggcgtgctgtcccaccgtccatggcgatccgcctaacgcccgattcatatcttgttcaaacttgaattctgcaac

SEQ ID NO: 5890 - DNA, 509 bp, Zea mays
aacattctcttcctcgactcctcgttctcccctctcctagtctttggcgcgtagtggcgaactggagaggtgtacaatcgtccggcgatccggacttcgattggttctctgctgttgaattgattgtctgtgctaggtctgatgggaagtaaagacggcaccggtgacatatcggaagcccaaggctatgctgccgacattgattccatcagggaggcgcaggcccgcattgcgccgtacgttcacaggacgcccgttatgtcgtcgacgtccatcgatgccatggtggggaagaagctcttcttcaagtgcgagtgcttccagaaagcgggcgcattcaagatccgaggtgcttcgaattcgatattcgcacttgacgatgagcaggtatcaaagggcgttgtgacacatagcagtgggaaccatgccgctgctgtggctttggctgcaaagctgcgtggcatacctgcgcacattgtcattccaagaaatgcaccagcgtgtaaggt

SEQ ID NO: 5891 - DNA, 1338 bp, Zea mays
attggttctactgtacattctcttcctcgactcctcattctcccctctcctagtctttggcgcgtagtggcgaactggagaggtgtacaatcgtccggcgatccggacttcgattggttctctgctgttggtctgatgggaagtaaagacggcaccggtgacatatcggaagcccaaggctatgctgccgacattgattccatcagggaggcgcaggcccgcattgcgccgtacgttcacaggacgcccgttatgtcgtcgacgtccatcgatgccatggtggggaagaagctcttcttcaagtgcgagtgcttccagaaagcgggcgcattcaagatccgaggtgcttcgaattcgatattcgcacttgacgatgagcaggtatcaaagggcgttgtgacacatagcagtgggaaccatgccgctgctgtggctttggctgcaaagctgcgtggcatacctgcgcacattgtcattccaagaaatgcaccagcgtgtaaggttgaaaatgttaagcgctacggtggtcatattatttggagcgatgccagcattgaatcgagagaatatgtttgtaaaagagtccaggaggagaccggcgctgttcttattcatcccttcaatagtaaatacactatcagtggtcagggtacagtatcccttgaacttttggagcaagtccctgaaattgacacaataattgttcccattagtggtggtggtttaatttctggtgtggcccttgctgcaaaggccataaacccttcgatacgcattctagcagcagaaccaaaaggtgctgatgattctgctcagtctaaggctgctggaaagatcatcacattgccttccacaaacaccattgctgatggactacgagcttttcttggagacctgacatggcctgtggtgcgtgacttggtggacgatgttatcgttgtggatgacactgccattgtggacgccatgaaaatgtgctatgagatcctgaaggtggctgttgagcccagtggcgcaattggcctggccgcagcactgtccgacgagtttaagcaaagctctgcttggcacgagagcagcaagatagggataattgtttcgggaggcaatgttgaccttggcactctctgggagtctatgtacaaacactgattggagagagtaggaccgatgatattgcccttgaatttcaaacgtgatagttttagacaagtcgtttgtaaacttggaatagttcgttgtaaacatcacttattacctgtttttttatcaacgggtcattcagttgcaacaaaaaaaaaaaaaaaatagggcgcccgccgaataataccattatac

SEQ ID NO: 5892 - DNA, 1534 bp, Zea mays
atttttacactatccagcgacaaataaaaagaaacggagggagtaacaatctgtaacatgctgctaacatttgggtggctttgcgttctgcttgttgggcccggctctgaaatgagcagtctagaagccaacggcccaacacagagcagctaattcgggcctccacgctacggctatggcttctcagttctcatctccaactacgcaccagatgccaggtggcgataagaccttatcctgcgcggctacttggcgcgagggcggccatccacgtcagacgagcgcgctgacctggcgcccctccagctcatcctatctacatatcagggtccctcgaggccccggcccggccgcctgccatcagaatcagaccaccacacgcccgaggcccgactgcaagcgcctgagcccaagacccatggccatggccgccgccaccgtcgcagcgtcactgcccgtggcgcaagggctcgggaagcccctctgcgccggcagcaacgcgccgtcgctccgggccgtcgcgggcgcgccccgtcgtcggtcggccaggaccaggatggccgtcgtccgggcgtccgcgcaaaagcagcactcggccaaggagtgggcggccgcggctgccgtggcggcggcgctggtgctgccggaggtcgcggaggccgcgccggggatctccccgtcgctcaagaacttcctcctcagcatcgtctccggtggggtcgtgctcgtcgccatcgtcggcgccgtcgtcgccgtctctaacttcgatcccgtcaggcggggttgagctgcatgcgtcgttgtgtgttgttgtattgtacctatgtactgagatctctccccccgtgtgcttcccaatgaaaacagtgtttaatgcgtgaatgtgtaaatttcatttcatgccatctgtatgtatgagagacggattcaacagcgcattcggtttctttatgttgtggactaacctaagatatgatctcattgcatactaaaaaaaaaaaaaaagccccctaactgcccttaatctgctctcaaatctttgtgtttcagttttcagtgaaggaactccttcacatgatctcttttctgatgaatctttgtgttccaattttcattgaaggaaatccttcttttttttgaatgcaaaggaaatccttctttacatgatctcttttctgatgattagttgatggatgatgaaggcactaacctttctttgaccggaggctactgaacatttcaagtgggaaaggtaagcatacataatgaagcccatgcatattatcgtatttacaatacttctgatatttatgtgattcttgtcaggcacccgccaagtaaggagatatccaactggcttggccttttttatgctcaatagttcagacaaaagaagggccccaataaggtatcggaggatctacttaaccgtgcctgaataggatctaggctcctgattccttattgtttttacgtcgtgcaaaattttctttaggaatttgttgctgatccatcccaattatgttctttgtag

SEQ ID NO: 5893 - DNA, 2972 bp, Zea mays
cctcgaggccggccgggccgggaagcacccgcctggccatgtgctggtccccgaatcccgacctcgcctccagttccactcttccggcggcgtcggccgccgccccttccccacgcccacaccatgtacggcgtcggcggcggcttcaacgcgccctccaccgctgcctctcggcgccgcaacccaggcgacgaagaggaggacgaggaggatgagggcggtgagggccgcgtcctggaggcgtgggagcgcgcgtacgcggacgaacggtcgtgggagtcactgcaggaggatgagtcgggcctcctccgtcccgtcgacaccaagaccctcgtccacgcgcagtaccgccggcgcctcctactccggtctgccgccgccgccgctgcccgcatccaaaaggggctcatccgctacctctacatcgtcatagacctctcccgggcggcttcagagatggattatcgtcctagtcgaatggctgttgttgcaaaacatgctgaggctttcataagagaattctttgaccagaatccattgagccatgttggcctagtgacaattaaagatggtattgcccatcgacttacagaaatcggagggagcccagagtcacagattaaggctttgatggggaagcttgagtgttctggtgattcatccctgcagaatgctctagacctcgtacatggttatttagatcaagtaccatcatatggtcacaaggaagttctgattttatactctgccctgaatacatttgatcctggtgatatcacggagacaatagcaaagtgtaagaagtcaaaaattagatgctctgttattggtcttgctgcagagatcttcatttgcaaacatctatgtgaagagactggtggatcttacacagttgcactggatgagtctcatttcaaagagttgttactggaacatgctcccccacctcctgcaatagcagaatatgctgcagctaatttgattaagatgggctttccacagaggggtgctgaggagcttatctctatttgctcttgtcacaagaagataaaatctggggctgaaggttacatatgtcctagatgcaaagttaatgtctgtgagcttccaacagaatgtcgaacttgtggtcttacgctagttagttctccacacttggcaaggtcgtatcatcatctcttcccagtaccaccgtttgatgaggtcacccctgtcccaaatagaattcaaaggggagggcagatctgtttcagctgccagcagagcctttataacccaggtatgcttaagctgtcaaagctcgtgtccgctacttctttagactagaaaatatatctttcacctagcctgcatatgttcaatggtacaaaccttatagttgatagcaggtatttcataaattcatatgtcctttttttttgcaaggaatagtggtacctgtcctctttttgaggaattgtgatacctgtccttattctaactattctttcttagtaaagcatgtccaactaaaaacaagatggcatggcaatatggggagcttattcagcaatagcctcaaactctttctgcaataaaattaacagctgacataatatagttagcttctgcactgatcattaggtcaaataggaattatacgagcattacagttatttctgttataatggaaatggggatgcttcctccttgcgatttttttttggaagtttacagtttgcccatcccaattctcgcattttgatctttcaaagtattctcaagtttcttttccttcgactttcttgtactaaattgttggtcttacgcttcttacatgaattagcaacagccaaggttcattaatcatttgatttccttaaaaaatccttgcagacggccaatctaacctccatgtgcgctgcccaaaatgcaaccaacacttctgccttgattgtgatatttacatccatgagagcctgcacaattgccctggttgtgagagccaacgcagcatcgcttcatatcagctacgtaggccccccccccattcaggttgtaccttaagctttctcctacactgtaacagccagcaaagttgtttcatgatcagcttttttctggctagcttttctgagaatctagctatagagagaatctggctgtgagaagaatctgtgtatcgtgggaattacgtgcggaggaagatgaagtggtccaaatagttcaggatctagaaagcgatggatttctaccatcgcgatgattcaaccgattctgtgtttatgttgattttggatggtttctaccaaaacgattcttataaaagcgggttgaaaagctggatgtttgacagtccgcagcagcttttggtggccagaagctaaaaaaaagcccaaacaaacagggtcattccggcatccttttattgatagttcctgttagattgagtacctactagctagtgttgagctattgctacccatcagaggccaatgggttgatagttttaatttgtgccgagaagagaagctgaaagtgtataacatgaccgagacttgactcttgctgtttttttttttcttccctgaagcgtgacagtatatttatttgttttcatttgtttatgctaaaactttgtcataaattgagttgtggattgggtcgggggtttcatcaatggattgatagaagaaaaacgcttcggttttaatgtttggttgatcggccccgcttgctctcactcgcccagttcacaatcataagaaccaaagcaccctgaatggcttccaagtctagcgatttcaatctaatcctagagatcggtgaacagacaggctaaatctccgaaagatgaacaatctgagaaaaagatgagatatgctgcagtacaagcggttaaactagacttaattaatagatgccatgcataattttcacttgtccacaatagacaacccccaacacttccaatgtcgctcatgccatcgacc

SEQ ID NO: 5894 - DNA, 1592 bp, Zea mays
ctgacatcaccggtgggggctggggaggagagggagagccttctttaagatcagtagatcaccacaccctcacccctcctcattgcccccctctcacacacgcacacacactctctctctccccattgtgtcactgtaactagcaattgagctcttaaaattttggttgaggtgcagtagcaaggcacactactacgatctacaaacaagatgatcagttgatgcccggtgtcttcaggatcttttcaggttcgcgaggtcccattttgcttctccccccgggcttgcagttgcgtttgagtgcacctctgaggctttggttggccctcgcgctgcgtacttaagctctccgccccgtccacggcgttgcatctctcatggcactcggtgtctcctgatagctgctgcttcgatctactccacctaaccgaaagagcgtcgtgtagggtcttggattcttggtccggtgctgttggcgtgtttcttgagatcgaagatccaggagatgatcctgcggcggagatcgaggtcgatgaacagcagcgccggcgcgcagaggagccacgtccccgatcagtccgcgagatcgtcgaccagtccatgcgacggtgacagtggcggggccggcgccgccggcagcaagattgcgaccgcgcgtgccctgttcgcctccccgaggctgctgcactcttcttccctgcccgccggcaccgtcgtcttcgccaagagccccgcgccggacgccgagccccagacggccttctccatgagcccgacgtccgtgctcgacgcggcggcggccttcgtgccgggcacggacggcgccggcaagcgccgcccgccgtggcgggcgcgggacaacaacggcctcgcggacgcgctggactgcagcgaccaccaccaccagcagcagcagcaggagcggatcgtcctcgcggcgacgccgtcgtcgtgctcgctggccagatcgtgctccctggaccgccgcgtcgagttcggcgtcaagaacaggagctcgtggctgcccctccgcggctgcgaggccacggcgccggcgccggccgacccgtgggagatagagccgtcgtcggaggactacacgtgcgtcatctcccgcgggcctaacccgaggacggtgcacatcttcggcgaccgcgtcgtggagggcggcgccggcgccggcgccgacgccgcggcggagagggaggacagctcgccgcggcagatcaatctgccggcgcgcggcgaccggggcttcttcagcctgtgaatgatcccacccacatccatccacgagcgtgcgcgtagactgatgcctaggtaaagagaccgagtttgctgagtgctagtattaagttcagccttcatgttgcggtattgtattggttgctccgtttccatctgatcagatgatcatagttgtttccttgatcagatgatgtgtactagacgttttgtccaggttgagctgaagctgtgatataaaatttcattacgttggtattaaaaatagacaaaaaaaaaagctgcaaatttttcacaggctgaaaactaccttccagtggctgaactgaactactctgtgataaatt

SEQ ID NO: 5895 - DNA, 719 bp, Zea mays
ctaaggttgagagcatcaagagagacaaagcagcaactgagaagttgcttcaagaaacaatagaaagaaatcagactgaacttgcagctcaaaaggagttctacaccaatgctcttaatgcggctaaagaggctgaggcattggctgaagcaagagtcaacagcgaaaccaaaattgaactggagaatcttttaggagaagctggtgaaaaagaaaatatgctgattaagacaatcgaggagttgaggcattttctcacccggcaagaacaggaggctgctttcagggaagaaagactaaaaggggactatgatgatcttcaaaagcggtatcaagccagtgaacttcgttataatgaactggtaacgcaagttcctgagtctaccagaccgcttctaagacaaattgaagccatgcaggagacaactgctcgaagggaagatgcttgggctggtgtggagagaaccttaaactctcgccttcaggaagcagaagctaaagctgcttcttcagaagaaaaggagcggtctgtaaatgagagattgtcacaaagtttattccggataactgtccttgagacccagattacaattcttagaacagagcagacacagctgagccgatctcttgaaaaggagaggcagagagcatctgaaagtagacaggagtacctagcaatcaaagaggaggcagcaatacaagaagggcgagctaaacag

SEQ ID NO: 5896 - DNA, 1846 bp, Zea mays
atctccgtgggcaattgctggctggcctagctagctagaagtatctcatatccgggtataggagtatctctctcgctttctctagccatgacgctggtgaggatgccttgccgcctctgctgcttcctgctcgtcgtcgccgcctccgccgtctccgggcgggggcgggtggtcaccacctcccgggctacgagggccgcctccccttccacctcgaaacagggtatgtggaggtggacgaggacgccggcgcggagctcttctactacttcgtccgggccgagtccggcgccgacgacagcgacaccccgttcgtcctccggatccccggcggccaacgctgctccgccttcagcggcctcgcctacgagataggtcccatcatgttcgtcgtggagccctacaacggcagcttgccgcgcctgcgctacaacccaaactcgtggacaaaggtggcgcatattctttttgtggattcgccagttggggccgggttttccttctccagagatgccaaaggctacaacgctggagcggtatcaaccacgctgcacttggcgaagttcctcaacaagtggttcaacgaccatcctgagtaccatgcaaatcctttctacatcgatggagaatcatacgctggaaaaattgtaccattccttgcacagatgatttcagaaggtattgaagcaggaatgaagtcggcacctcgtctcaagggctatctagtgggcaacccgtccacagaggagcgtattgatgttagcgctagagtgccttgtgctcacgggtttgggattatatcacatcagttgtatgagatgatattggggcattgccatggagaggactactccaatcctgcaaaagagttgtgtggtcaggcactgaagaccttcaatgatctcacctccgaagttgcgcaaggccatgtactgcaggagaaatgcgtcgcggcgtcgtcgtctcctgtgccgaacgcaaacagcagggtggccggcggctcgtcgtcgtgggcctcagatggcaggaagatcctacgggaggaagaaatggtgggacgacgcggagtactgggcaagctatttcatccaccggctcttcctccattcagttgcagggtttaccggtactacctgtcgtatttctgggcaaacgacaggcgcacccgggatgctcttgggatcaaggagggcaccgtggatgagtgggtcagatgccacaacgacgaccaagagttgccttacgagagcgagctgaagagtgtcgtcaagtaccaccggaacctgacgtccagaggctaccgcgccctggtatacagcggcgaccatgacctgctggtgccacatctgggcacccaggcctgggtcaggtcgctcaacttccccgtcgtggacgactggagggcgtggcatctcggtggccagtcagctggatttacgacaacttactcaaacaacatgacattcgcgacgatcaagggcgccgggcatacggcgcctgagtacgagccggagaggtgtttcgccatgttcagccgttggatcctcaaccggccactctaatccatatgtgccttctcgcatcgaagatccatcagtgaatgaagagattcgtgtgtaaatctttcttcacgaaactactggctataagatgtacgtggatggaataaaatgctggctatgaacccttgatgctgatgatatatatatactccatcagtggtgaagccagatatgtattgtaggaataaataaaagtacaaaacggatgtacaaaggtacgtacagtgccctctagctacgctacattagcaatatacacgttcatacaaaaaaaaaaaaaaaaa

SEQ ID NO: 5897 - DNA, 1689 bp, Zea mays
ctggcaagcaaagctcttcagccagtgcagtattggagaggaagtgcaggtcattttccgattctactactagcaacttgaagggctcatcaagagttgctaaagggtttgctgcaagcatatctggatcagaagtatcagttgacctttcctttactggtaccctttccccttctccatcatttgatgccaaggtagttagtaactcaaactcagcacctgctgctagcacagatctttcattggcattgccctcaagtgatagtttaacaccatctttgagtcatgattccaatactgaggtagtggactctagtagcaaaattaatttttcatatgatgaagaacagaaggtctggatcccacaagataaaaaggatgaaattgtcttgattcttgtccagaggcagaaagaactgcaagcacatacacgtgactggacagactgggctcaacagaaagtgatgcaggtcgcacaccgacttgcaaaggagaaggatgaacttcagtcactcaggaaagagaaggaagaggcagaccgtctgcaagaagagaggcatcatttggaagagaggactcggaaaaagcttctagagatggagtctgcaatttctagggcaaatgctcagttggagaaggcagaagcttctgctcgcagacgtgaggttgagaatgcacaacttacgttacagatggaagctgcaaagcgacatgcagcagagtcagcaacaaacatttcagagcttgtaaagaaggatgagaacagtcgcaaaaggtctcagcgttggcaatctgacagagccctgttacaagaggatcttgcagcacaaaagagcaggttatctcgggtccaagaacaccttcagcatgctaaagagctaaaggatcaagtgcaggcaagatggaaacaagaggaagctggaaagattgaggtaattgcccttgtaacctcaaagaagaaagagagggagcaaattgagacctccatgaggtcagaagagaatttactgcatcttaaagcagcgaatgacacagaaagatacaagagtgagatccgtgctcttgagcagcgtattgcacagatgaaggtttctttggactcttcaaaggttgctgcccccaagtggggtgctgacaataaaacatatgcattgcatctttctgaagggagaaagaacagcagtgcccaaattttgtccaacatagcagtaccccaagatcccagttttgatgatatacagcgtgaccgggagtgcgtcatgtgcttgagtgaggagatgtccgtggtgttcctcccttgcgcccaccaggtggtctgtgccaaatgcagcgacctccatgagaagcaagggatgaaggaatgcccttcatgccggacccccatccagcgcagggtgcgcgcccgccccgcaggttgctagatttcacatataccatttggattttatcctgttttttttgttttaccttgattgctcagcttgagttgatggaagattggagagaataatgggggggatgtgagtggtgaaacttggacaataatacatcgttaaacatcaaacaagccccagcggacagtgggtactggttgggtttgttatatggatataccggccgcttctgaatgctttggttttgttgcaaaaaaaaaaaaaaaaaaaaaaactcgaggaagggcgccggtac

SEQ ID NO: 5898 - DNA, 1420 bp, Zea mays
ctcaatgatagtttaacaccatcttcgaatcatgattccattaccgagggagtggactctagtagcaaaattaatttttcgtatgatgaagaacagaagggctggctccccccacagaaaaaggatgaaattgtcttgattcttgttcagaggcagaaagaactgcaagcacatatgcatgactggacagactgggcccagcagaaagtgatgcaggtcgcacaccgacttgcaaaggagaaggatgaacttcagtcactcaggaaagagaaggaagaggctgaccgcctgcaagaggagaggcaccatttggaagagagtactcggaaaaagcttctggagatggagtctgcaatttctagggcaaatgctcagctggagaaagcagaagcttctgctcgcagacgtgaggttgagaatgcacaactcacgttacagatggaagctgcaaagcgacatgcagcagagtcagcaacaaatatttcagagcttttaaagaaagacgagaacagccgtaaaaggtctcagcgttgggaatctgatagagccctattacaagaggaacttgcagcacaaaagagcaggttatttcgggttcaagaacaactccagcatgctaaagaactaaaggatcaagtgcaggcaaggtggaaacaagaggaggctgcaaagactgaggcaattgcccttgtaacctcagtgaggaaagagagagggcaaattgagacctccatgaggtcagaagagaatttgctgcatctcaaagcagcgaatgacgcacaaagatacaagagtgagatccgtgtccttgagcagcgtattgcgcagctgaaggtgtcattggactcttcaagggttgctgcccccaagtggggagccgacaataaatcctatgcattgcatctttctgaagggagaaagaacaacaatgcccaagttttgtccaacacagcagtaccccaaggtctcgattttgacgatatacagcgcgaccgggagtgcgtcatgtgcttgagcgaggagatgtccgtggtgttcctcccctgcgcccaccaggtcgtctgtgccaaatgcagcgacctccatgagaagcaagggatgaaggaatgcccttcgtgccgggcccccatccagcgcagggtgcgcgcccgccctgccggttgctagatttcacatatactatttggattttacttttcttctttttttcactttgattgctcagcttaagttgatggaagattggagagaataatcaggtggtgtgagtggttgaaactgtgacaataatacatcgttaaacaccaaacaagccccagcagacagtgggtactggtttggtttgttatatggctataccggttgcttctgtaaaaaaaaaaaaaaaagcactctggttctaagtaccgtactgttttgt

SEQ ID NO: 5899 - DNA, 1111 bp, Zea mays
tataacgcctcgagaacagcttctatgaggcacctgtcttcgctgaccccaacggaaggggattgtgtgcactcttgcgtccctagatttactctatttctgaccatgcacggtgcaccgttgtctctgagctatcaaacgaggactttgactcttatgtcttatctgagtcaagcctgggggggtacccatacaagattctgatcaagacctgtgggactacaaagcttttgctcggtattccgaggatccttgagcttgctaaagagctctcattgccacttgttgcaactaaatactcccgtgggacattcatattccctgatgcacaaccttccccacacaagaactttgttgatgaggttaccttcctaaatcacttcttcgatggcctcaggtttggtggtaatgcttatgtgattggtgattctgcaaagcataggcagaagtggcacgtctactatgccaccactgagcacccctaaggagcttgttgttactcttgagatgtgcatgactaggctggacaagaagagagcttatgtcttcttcaagacctctattgatggttacacatcttgtgctaaggatatgaccaagccttcagtggcatcgtcaaggagtgcgtcgtgaccagtggtgctagcagcaaggccatggcactcagggtccatgggtcgtgggtgtggcttgttcagcgcctactattcgcgggagtcggcgaggtgcctgctgaacttggtggaagtggagtacaattatgatgctgacatcgacctcgtgttcatcgacctgcccgtgctagagcaggagcggtaccggtggacactggagattgtggtgtaggccatgacgcgtgggcgtcgacgtcagcgcttgtcttcgcgtctgagccactctgagttggagaccattgccatttgtgatgtgcatgagagatgtattgtggcgtcttgttgtataattggtatggagagagtatgttttgctatgtccgtatttgcatactctacatgctctgaatgttgtataacactggacaataaatgatgatgtcccttcaataggaatctcatctctaaacaattaataggaatctgatcttctttac

SEQ ID NO: 5900 - DNA, 471 bp, Zea mays
gacaataagctttacatatttgccttcgcttcgaactaatctattttttcagatggtgacttccatgtgttcgattgtttgaggtgagggatgacgtgaagctgccaagctataagggtgaaaacatcaatgacaagatgttcgacgagaagaatcatatcttggacccataaaggatgctttaggagtacgcccaatccgctaccacgctcaacctactctgtgtcttctccactggcggctacaccgacattcagcgcgtcacgcagtggaaacttgatgtcaccgaacatagcaagcagggcgtcatgagaaataaaatcttccatgcactgagttgatttattctatatatttattgcctgaccacaacagccttaggatcttattgtctgaccacattttttcactatgaaagacgtggcgtactgtcatagtaagagttcaataaaatttcttgtttgatgagct

SEQ ID NO: 5901 - DNA, 1710 bp, Zea mays
aatggaaatttttatttggagggttctaaacccaaaattatgattttgggctgtcacccttgcggactaacagccgacgtctacctttgatacagctgccatttcgatcacctgccacagtttaatctaacattacactgcgttacatgatatataaacagcttacatttgctgacccaaatatccaacaccaccaaaaaaaatgtttaatggcgcacactagtctccagcaaaaacagcagatactgcaggctgagctggtttactctaactccagtgctgcacagtgccgccggcctctcaggaatcaggagagctcagatatgaccctctcgcacttctcttccaaaatcttcacggcttctgtgaacaggacctccgggggcatgcttccagtggactcgatggtgaatatgaaatggtctctgacacgccgtagctccacttgtttctcatttggtcccatcacacattctctgcagagcgtgcatgcccttggcctcgcaacaacagccctctttccaccgttagccaggtcttcgatgtcaaaaacattaacccggcacttattcaccagctcctctgcctgagggccttcaacttctttaagaataacaacctcagggagcattctgtaccaggctgtagcaactggagaccacttggcgtgaacgttcccagttcccttaacagcatgtgcctcgagctcgatagcctgtcctggcccaagcctggcaatagtaatatctttatacttcacaccaagaggcttttctaagatctccttttggctttgactgaaggaagtgaaagtcttctgtttgtctccagactgtgcaggggctgacatgcttaattggctaccttctggtaaccactctagttcactagatttcactgtaattcgttgagaattctttggacaagaaacgtgcagtttataaacaatagtattcctttcatttgggacatcgttttctgagatatattcaaagagtcttggatctgcatcaagtggaataagtcctagtctatgtgaaagaacctcatctgctataactgagttgttgtcagccatgaagactttctcaattgccatagttggaacctctgaaatgaggattctccggaaagcattggctattgatgcatcaataccaatcatatcgaactccatataatcttcagtgagacgatttatttcaattttgaaattcttgcaaaatttatccactgacacgctattatcaattcccatagcagcaaatgcacccgagtattggaaaccttgagtatgaatgggggcatcagcattgcagacgacacgtgtgcgctggagctccaggtagtctggaagcttattttcttgttcattgggcacatcgtccaccttctccttcttagatttagtccccttcttcggcatattgtcttcctctcgatgttctttgttcacccttgtaccgctgttatgacgcagggtcacggctggtgtgctgaggaccggaggcgagggcacggggcgactggcgagaagcgggaggggcagccgctgacgcggttgctgagagcccgagcccgaacgcagccgccgtcgcctgcgtgccgagcacgagtaagggagcgagcggaagatggagcgccggcactgcgaggaagaagatgaccgggggcggagaaacagtggcggctggttttttttccggccgg

SEQ ID NO: 5902 - DNA, 2545 bp, Zea mays
cccacgcgtccgaacgtcttgtaattcagcttgggaagaagatggttgagatgactggtgacttcactccagatgtgatggccctattgtcagctgacatcatcatttctacccctgaaaaatgggatgggattagtcgaaattggcatagcagaagttacgttatgaaggtcgggctcatgatattggatgagatacatcttctgggagctgaccgtggacccatccttgaggtcattgtatcaagaatgcgatacatatcatcacaaacagaacgttcaattcggtttgttggtttatcaacggcattagcaaatgctcgtgatttagctgattggttgggcgttacagatgacggtctattcaatttcaagcctagtgtgagacctgtacctcttgaagtgcatatccagggatatcctgggaaattctattgtccaagaatgaatagcatgaacaaaccagcttatgcagccatatgcactcattcacccagtaaaccaggtctcatttttgtgtcatcacgtcgacagacaagacttacagctcttgatatcattcagcttgcagcatcagatgaaaaaccaaggcagttcctgagcattgaagacaactccctagacatggttctttcacaggtttctgacagtaatttgaggcatactctgcaatttggcataggtctgcatcatgctggtttaaatgacagagacagatccttggttgaggagcttttttcaaacaataagattcatgtgctggtatgtaccagcacattggcgtggggtgtcaatcttccagctcacctggtcataatcaagggcactgaatactatgatgggaaaacaaaaagatacatagattatgatatcacagatattctgcagatgatgggtcgtgcaggtcggccgcaatacgaccaacatggcaaagctgttattcttgtccatgaaccaaaaaagagcttttacaagaagttcctctacgaaccgtttcctgtggaaagtaatctgagggagcacttgcatgaccacataaatgcagaaattgtttctggcaccatcagcaacaaggaggaggcgattatttatctcacctggacttacctatatcgcagattggttgttaatccggcctattatggattggaggatactgaaacaaacacattgaattcttatctatcaaggttagtcgaaactacatttgaagatcttgaggacagtggatgcataaaagtggatgaccactctgtaaagtacttgattttggggaaaatagcttcacagtattacctgagctacctcactgtttcaatgtttgggtcaaatattggccccaacacaacgttggaagtctttctacacatactgtcagctgcatcagaatttgatgagcttcctgtacggcacaatgaggacaatttgaatcgaatactcagcggaaatgtcccgtatccagttgatcaacaccaccttgatgatccacatgttaaagccaacttactctttcaggcacatttctccagagcagaattgccaataagcgactatgtcactgacttgaaatcagttcttgatcagagcatacgcatcatacaggcaatgattgatgtatgcgcgaatagtggatggcttacgagtgcattgacttgcatgcatctcttgcagatgatcatacagggtctctggtttgagagagattatgaatccctctggatgttgccatccatgaatgatgatatattagaccatctcaagagtagaggagtctcaacagtcccctccttactagatctttcccgtgaagaattgcgtagggtacttcaaccattttctgcgtcagagttgtatcaggatctgcaacatttccctcatgttgatgtgaaagttaagcttcataatgaacaggagcgatccaaacctccaactttaaacatcaggttgcaattgaaaaattcgcgacggtcagcatcaagagcatttgcccctagatttcccaaggcaaaacaagaagcttggtggctggtcctggggaatgctacaagttcagagctgtatggtctgaaaagaattagttttgcagatcgggtgattaatactcgcatggaattgccacagacgttcaatgtgcaggagacgaagctgatcttggtgtcggattgctacctaggttttgacttggagtattctcttgagcatctcaccaagggttgagtgctttattcagagctgtttgggctgtttcattttgtatgggttcagcaaccagctcatcctagattgatcctgtaatcacgagacatgagttcattccatgaatttttgtttgtatgactacatccctcgtgttcatggttatattatatttaatagctatatatacgagtggataggtttataactttcatgaaatatcttttccgtaagcatagtagatgtttgagctctaaggttatgaccaacaaattgtgtatatggtcgtgcaaaatactattttataatataaactatattatttacatggtgaagtttgagagggcggc

SEQ ID NO: 5903 - DNA, 2054 bp, Zea mays
gcacgagaccattacctagaacatcctaatcgaaaaccccaataatgcccagtgcggcagtgcctgccaccgtctaagcccaccccaagtctccgccgtcaacccgtcctcccccatggccgccgccgccgccatctctctatccttccactttcgtttccgcccgcccctcccatctccacgtacccccacgcgccacgctcccttttccttgttctccccttcccttcttcccccctgccgcctccgcgtcgctcccggccgcccctcaccgtccccgtggcgccccgacgtgcgggcgcgcgctggaagcaccatcggggcgccgcctgcgcttgtgcgcccgggcggcaccgtggagacggaccgcctcccctccgacgtgcgggaccgggccatggaggcggtcgaccacttcggcggtcgcgtcaccataggagacgtcgcctctcgcgctgggctgcagctcgcgcaggcggagcgcgcgctccaagcactcgccgccgacactgaaggcttcctggaggtatcggaggacggggaagtgctatacgtcttcccaaaggactacagggcaaagctggctggcaaatcgtttaggatgcgggtcgagcctctggttgacaaagccaagcaagtgggtgcttatctggtacgtgtttcatttggcactgcgctcattgcctcaattgtgctggtgtacactacaatcattgccattctctcaagctcaagtagtgatgaagatggtcgtgggaggcggcggagatcttatggttctactatcatcattccgacggatatgttttggtacttggatgcagattattatagaagacgtcgagtagaaaatgaaaatgggatgaactttattgaatctgtaatttaaaagggtattttcatttgtgtttggggatggtgatccaaacgatgggcttgaagaaaagcggtggaagatgattggacagtatatttcatcaaatggtggagttgttacagctgaagaactggcaccatttcttgatgtgccacctccatcagaagagtccaaggacgatgaatcatttgttcttccagttcttttacgctttcagggacatccagaaattgatgagcagtaaagcgaatgcaacagagaaggcgatggttgctggtttgggaggactcaatctctttggtgtcatcattcttggaaacttgttgaagcaaatggcagtgacacctggtggactaatctcatttgccgcacagttatatcctttgcttcagatatacgctggctccttttttgcaatacctttatttagatggtttctgctacgcaagaccaacaatggcattaaaaaagaggaataaggccagagaacagcgagctcaggagctcgtgtcaccagattcttctctacgaagaaagttgctcagtgcacgtgatatggctgaacggaaagtaatcacgccagaggagattgtctatactactgaaaaggatctattggagcaggattatgaagtcaaggagtgggagaggagatttaaggagctcgagtcagagtgatggacatgaccgatatacttgacacttgcagtagctctacatggtcctcacaccatacttgtcggtgatttttatccgcatccaacggagtggaagatggatctgactgaaccactcgagcaagcgaaactggatggtactggacctcactaattgtcgcgtcaccaccagcccaccactgaccacttcgctatggaagttttgtggaagctgttggtttaattgaaaccgaccattatttgcaagctgatgttcgtatctgtgccattgacctgcatatatgtatagttccaatcacggatcaaattcagaatttgacacgaaaaagaaaaaaaaaccagggaatatggctaggatgctactcggtttgaatggagtccaatcaaaacatgtaaaaaggtcagcctgtgaacaggggacccagacttcaacctgttcgctgttgctttgttgctttaatctacctgctcatattttttctacaaaaaaaaaaaaaaaa

SEQ ID NO: 5904 - DNA, 712 bp, Zea mays
cgggcttcagtttgctatctctctctgcatgtttggcgtcagtctttgtgctcatgtacgtgtgtctacatgcatgttggttgatccgattgcgtctgctgtaaccatatattaattggtccacgatgatatgatttgatactatatatataaaaacgggccgggacatactatatattagacataccggtattattgttcttagacatcgcacaagactcttgtcaacaagaccaacaacaggatgaggactgccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcagcccttatcgccggcgacgttggcaacaaaaagggatactgatggcagacgtgtacttcttggttgaataatactgctagaattaatatgggcaccaacgaaatatctataatgttattcttcagtgtaatgcttccagcatgttctgttttagtataactaaatatctatctttcccccccaaaaaaaaaaaaaaaaaaaaagcaaaaaaaaaaaaaaaaaaaagggggggag

SEQ ID NO: 5905 - DNA, 697 bp, Zea mays
atgtcttctcttggataagctgtttggatcttcgcactctcgctgtgctgacaaattccaccctgtccagctcaagtgatccacataatatatctttccattacttgcgtggtcgcggccgaggtccgcggggaagcatactatatattagacataccggtattattgttcttagacatcgcacaagactcttgtcaacaagaccaacaacaggatgaggactaccgtgcatgctgcgctttgcattgtgcttgtgataatgtcttcaacactgtcatcttgcgaggacgatgagaaggtatctatcgcatgtgacacaggatgcaatgccgcgatctcccgtctcaaatgcttcctgatggcctattctgaagggaaagtgttggtcagcagcaactgcgaaacgccgaccaggtgcggctgcgtgtttcgtcacaaacaagatgcaacccttatcgccggcgacgttggcaacaaaaagggatattgatggcagacgtgtatttcttggttgaataatatatactgctagaattaatatgggcaccaacaacgaaatatctataatgttattcttcagtgtaatgcttccagcatgttctgttttagtataactaaatatctatctttcccccccaatttaagtttttttttggttctccaaacaagcccgcttaaaaaaaaaaaaaggccccta

SEQ ID NO: 5906 - DNA, 1384 bp, Zea mays
  misc_feature (12)..(12): n is a, c, g, or t
ggccgctcgagngccggcccggtacgattctgttcggttccttccgaaaacacaacaggaaaacacacgcacaaaactgccgtttccgaatggccacggccgtgctccgccgcccattcctcgccgcgctcctccccgccgccggaggggcgtccgggacctcctcttggttccgtccccggagacgtaggtcctctccttccgtgcgcgcggtgtcttccgactcccccaagcccgtcgcctccacctcctcccccaccggcggtgacagccccgacgaggaaccaccggtcctaccgctcctccaggagcttgcggattgcttgattcttccacccaagctcctcgctcagctcccgagcgaccttcgtctcgacctcaatgacgctgcgtttgatctctccaacgggccagttctcgacgagtgtggccaagaagtgggtgatctgctcctgaacctggcaaaagcatgggagttagctgatacgtcaacatcaaatagcattgccaagcagctgccgttgatggagccctacttgacgcgcagcgccaaatcagcgtttggcaagcggctggtgtcagctggaaggaggtttcagtcaatgggacagtacaaccagggagaactcaaaaagattgctgaaacaatgatcaagaatggtaagctgctatcgaaacacccagtggttcaatctgatgttcaggctatgaaagaaaaaaggagacttaagtttggagaacttgagttcggagtgactgctcaaagtgccactatcggttctgcagtagcggcaatttttggattaatctcatggcaactagcacgaggcgtgcaaagtattcctgacaatacaacgcaatacacaaatgacaatgcactgcagttggccaagtcgctcaagaccgcactgcttgttcttggctacacatctaccggcctatccttattcgcggcttttgggctgctgttgctagcccagcagattaactctgagaacaaatcggaataaccgacagacactcgctgaagttgtgtacctcatgccttgcctttctatgctccaatgaggcaaacgttcatagggaattgcatacactgggaccttgtgtgtatcagtgcatgcaatgttctgtataaaaataaagagccaattgtttgtgattacggataaaataatcggtggagatattgaagcaaacatggaagtcagcctgggactgactgaagaacaaattgttagtgaacgcaacagggaactgcttgtattcaaaattgtgctttcggagtgtggtactgctgttactcatcaaaactgaaaaaaatcgttcttaccatcataattaagtatgatgaatgagtatatattctgcatggttttttttt

SEQ ID NO: 5907 - DNA, 1139 bp, Zea mays
ctctgaaagtgggcctatcctcgctggtcacgtctcctctccgcgcacgaaaaccctagcacgcaggcgcagccagccctgctccaattcccaaagcttctggaaaacacctactcgtctctcatcccttccccgccgtcgcgtcctcttcgaactgaatcgcgccgcgatcacccaccttatggcggacaaggagcctgtcgtggagcgatccgaggcgtctgaggaggaggacgcctccgccgcggccgccgcgggggaggaagaggacacgggtgcccaggtggcccccatcgtgcggcttgaggaggtactcgtcaccaccggtgaggaggacgaggacgtcctgctcgacatgaaggcgaagctgtaccggtttgataaagacgggaaccaatggaaggaacggggcacgggcaccgtcaagcttctcaagaacaaggagaccggcaaggtccgactggtcatgcgccaggccaagacgcttaagatatgcgcgaaccacctcgtggcccccaccacgagaatgcaggaacatgccggcagcgacaaatcgtgcgtctggcacgcttctgactttgcggatggcgaactcaaggaggagatgtttgccatcaggtttggttcggtagaaaactgcaagaagttcaaggagttggttgaggagattgctgagtcacttacagagaacgaggacaaggaaggtcaagatggctcttccacggccggattgctggagaagctcactgtgagcgagggcaaatctgaggaaagtggcaagtcggagtccactgattctggcaaagtgaccgaaaccaaagccgatgcagccccagccgagtagttggtgtggttgcacgcagatcctccccgtgctgaatcagttcctctgccctttagccatgaaatatgtttgctaatttttttggggcgagttggagcagtctcttgtgtttgggtttgttcttaaaaactttgagttaattggggttggaacgttcggtatgcaagtgtagtatttcactgcgtggatcgttatggattgcggtaaattcatataaggtgcatctattgaaaaaaaaaaaaaaaaaaaaaaaaaaaaaaactcgagcgggcggccgctcgcgatctagaactag

SEQ ID NO: 5908 - DNA, 1592 bp, Zea mays
tagtctcgtagtagctttttgccacctgtagtgtggatggctcattctacgtttgcattatgctgtcacattatttccttttcattgatgcacctatatatttgatggggttggcttttataattgttcaatatctttttggtgcatattttacttgattgagttccctactggcaatcgtagccgttagctttgctttaccaacattctatttatgaataaatatgctcttatttgtgctctgtgtcagctccagcttagtggtagttctgtgaggtgtgaatttccaaatactagttaacttcctaattagctcatattttattagttataacatcatgagtggtactttttaggacactctaggtgctatagatatacaacattgcctttgttagatctctgctgtctacttttcatctggtggcaagatgcagcctttctattcatagtttgagttccactattaaacggtggtgttgaaatcttgctaccggtgtagcatctgtactgcagtctatcagtgtatcatattacactggcaaggatgttctcatgtgtgctttgtgtgactgccagagccagcttggtggtagtactgtgaagtgtgaattagccaaaatatttgttgttaacttcctaacttggtgtttattagttacaatgtcatgagtgatactttttagggcattcttggtgttgttacaaccctgccgttgtgtgagactcctgttctgtgtttttccatggttgcaggcttgcagcctctcttcatagtttgagtttcactattattgatgggcttggtgaaaatcttgctaccggcctagcatctgcacagtatatcagggtatcatattacaagtactgcgatttcatgtgttagaccatgtagtgctttgtcctctgtgttttatgttctggcagtcaatttctatgtcatttgttgagtggaataggatgtctagactgtccattttcttttctttctattggttccatgttcttttttgtcttccaaaaacttgctgaatttcactaagttacgctgacatcaatttctgtttgatcttataatcttatatagaccgaaactgcaagaagttcaaggagttggttgaggagattgctgagtcacttacagagaacgaggacaaggaaggtcaagatggctcttccacggccggattgctggagaagctcactgtgagcgagggcaaatctgaggaaagtggcaagtcggagtccactgattctggcaaagtgaccgaaaccaaagccgatgcagccccagccgagtagttggtgtggttgcacgcagatcctccccgtgctgaatcagttcctctgccctttagccatgaaatatgtttgctaatttttttggggcgagttggagcagtctcatgtgtttgggtttgttcttaaaaacttgagttaattggggttggaacgttcggtatgcaagtgtagtatttcactgcgtggatcgttatggattgcggtaaattcatataaggtgcatctattttttgatttctttcagtacacatccccgggtcctgctaaaaaaaaaaaaaactcgagcccgg

SEQ ID NO: 5909 - DNA, 1219 bp, Zea mays
cattgggtcccgcccggccgggccggggacttgcccctttggcctctgtgttcatacttcgctcggcagaaaccttttgctcctgggggcgaacgcgccgccgcctccgacagccccctccagccgcgtcaaatcagcgccctcctctgctgcgccggcggtctcccgccgcaaagacgaagccccgcactcccttatcgcagatccgtgcccgccgccatgacggagtattgggtgagccaaggaaacaaatggtgcgacttctgtaagatttatatagcaaacaattccttcagcatcaggacacatgaacttggtaagcgccacaaggacaatgtcaccaaacgactgtcaacaatgcaaaaagagagtgagacaaaggaaaaggaacagcagcaagctgcacgagccctacagcagatagaagcaaaagctaaaaagagttatcaaaaagatttagagaataaccagaggaatgttgatggagacacttctgcagcacctggagatggatgggtgcttgactcggcgtcaggatattaccatgacaaatctactggactttactacgattcaaactctggcttctattattctgacagtttaggcaagtgggttacccaagaagaggcgtacaagtccgtgcaagcttcgaaatcagacgctggccaatcctcagcttcacaaacaaaagctcctgctgccgcagaaacagctgtccccgcgattaaaggaggtgcagctccaggccgggtggtaacgaaaccgttgaacccaatgagaccgattaagggcactcctgctccgtctgctgttgctgttaacaagaggaagagggatgacggcaagcccaaggcggtctccaaggaggaggaagcggccctcaaagcgcgggaagcagcaaggaagagagtggaggacagagagaagccgctgatgggattatacaagacgtactgatatcttgtccttgccagactgctactactcttcctccatgcatacgggtttgccaattacagtgtgatgttgtaaaatatatttttttaaaaaaatctaaccgaacgcattacgatttacgcatcattctcagaaagaatgccgataatggtgtggcactggatttcagagctcttctgcatcagcaatgtgtgtctacacggtttaatacctcatcagtggttcttgagtggaccaagttccaaaaaaaaaaaaaaaa

SEQ ID NO: 5910 - DNA, 949 bp, Zea mays
gcggtgcgggtgctttctccagcgacagcgacagcgagaggggaggggaaccagcaagctcctcctcctctacccctcgcctcgtccgcgccagatctatctgtcccttcctcttgtagttgcaggcagacgcgccatgcggatgcgggtgcttcccgcgtcctggtcatcttcctccgccaagcatagcagcggcagctccgagtcgcaggagcacccttcttcctcctctgctacggccgcggtgtacctcaacatctacgacatctcccccctcaaccactacctctactggttcggactcggcatcttccactccgggatccaagtccatggcatggagtatggctttggagctcatgaataccccaccagcggagtcttccaagtagaacccaaaagctgccccgggtttatcttcaggcgctctgtgtgtgtgggtgtaactcacatgtcccgttcccaagtccgcacttccatagaggatctcgccgaggattatcatggggacacttatcatttgattctcaagaactgcaatcatttcacagcagatgtctgcgagcgtttgaccgggaagccagtacctggatgggtgaatcgactcgccagattaggtcccatatcatttcacaatcaatctgttgctccttgatgctgattcattctcaactccttcagccgtcatcctgttggaattgcaggttccttcttcaattgtgtattgcctgacagtatcaaggtttcagcagtcagagatgtaaatgcacatccagatttttctggtactctacctacacccagtttaactacttgtaccttcacattcacatcacatggttggaatttgaccttacagaatcctgtaccactttattaaagattgagacagacattgcttccctaaaaaaaaaaaaaaagcggccaaaaaaactcgagagggggggcg

SEQ ID NO: 5911 - DNA, 3170 bp, Zea mays
gggtgacccacccgccggcgggcgggccgaaaaaggggaagttctcgccagcgtgctgccttgcaagctgctaactagaataggaatccgacgtcgcccccgcccccccctgtgaaaattcgtgatgcggagaacagctaccgccgccctcgtcctcgtccccctcctcgctgcggcggtacagacctccgccctgcctttcatcgtcctgcacgggattggggaccagtgcgccaaccatggcgttgccaagttcactaaacttctcgccgattggtccggctccgacggctactgcctagagattggcagaggaacatgggactcttgggtcatgcctcttcaacaacaggctgatataatctgcaacaaggtcaaggaaatgaaacaactgagaggtggctacaacatagttggtctgtctcaggggaacttgattggtcgagcagtggttgagtactgtgatgatggaccgccggtcaagaatttcatctctctaggaggtcctcatgctggtaccgcttcagtgcctctttgtggttctggatttttttgcattattgttgatgctctgatcaaattggagatctactcagactatgtgcaggaacatcttgcacctagtggctacctcaaaatcccaactgatatggcagattatctgaagagttgtaggtttcttccaaaacttaacaatgaaattccagataaaagaaatgccacctacaaggaaagattcagtagcttagagaatttggttctgattatgtttcaggatgatgcagtcctgataccacgagaaacggcatggtttggttactaccctgatggagcctttgatccagttctaccacctcagaagacgaaactgtatgaggaagactggattggtttgaagacactggatgaagcagggcgggtgaagtttgtgtctgtgccgggaggtcatcttggtatctccaaaggtgacatgaagaagtacattgtgccttacctgacaaacaaaaaggcatcggtgacggtttctgatttgctagttgccatttggcacgctgtgcttgggctggcactggcagagggtgatgacgctgttttgatttgatgcatgggcttccgacagtggcttggattgttacgctgcctctgcttggttggcttggcactcagtcacaaataagattcatctcatctcatattctgttctgttggaaggccctttgattcatggtcacagaaataacagaatgcatgcatgcatgcatccaactagctagctagcttatagtcggagacaatctgtgcggtgcagctagttaattatctatctatacagggcaggcccatgccatgagtattgttgatgatgactatgttgtggtggacgtggacgacagagctatggttcctgctgcttcctctctcggttgctcccctgctgcatcttcgtctacaatccttttccaaaaccagtgggtcctccagacctgttccatctgctgccatgggcagctgcttggtctccggcaggaagaaatacacgaagagcgtcatgacgcacacccagccgccgaagaggaagaaggtgccgaacttgaggtggcacagcatcgccaggaaggtctggccgatgaggaaggtgacgaagaagatgacggcgatgacgacgctctgccccgccgacctgatctccagcgggcagatctcggtgggcaccaggtaggtgagagggccccaggaccaggcgaagcccgcgacgaagacgcacatgatgacgagcaccaggtacgcgtactccttctccatccctccgtgctcctggaacttggcggccagcaccgctcccaccatggcctgcgacaggatcatctgcacgccgcccaccaggaagagcttccggcggccgaacctgtccacgaccaccatggccaccacgttggcggccgtggcgcagacgcgcgtgaccacggccgacatgagggacgcgctctccttgagcccgatggtccggaacatgaccggcgcgtagaagttgatgacgttgatgccggtgacctggttgaagaagggtacgaggagagctatgaccagctgcggcctgtacttgcgcctcagtatggtgcggaagggacgccctgtggtggtcgtcctggtcgcggacacgagatcgtcgagctctttctggaccctggtggtgccacgcagcctctggaggagcagccttgcctcgtcgacgttgttgctgccgccgcggcgttggatgatgaagctgggcgtctcgggcaggtagatggcgccgacggtgaggaacgcggccggcacggcggccagggacagagagatcctccagccccatccacctgctatcttctccacgccgtagttgatgaggttggcgatgaggatgccgatgctgatgcagagctcgaagccgttgttgatggcgccacggtactgcggtggcgccatctctgagaggtacagcgggatggactggtttgtgaatccgaggcctactccaaggagtatcctgttgagtaggagcatgtatacgttgacggctgccccgccgaagacggagccgatgacgaagacggtgcctccgataagtatggaggtgcggcggccgaacctcctggtgacggaggaggcgaagagcgtggcgacgaggccggcgatgtagagggaggaggtgaagacggtgagaagctcgctgtcgaagcggcagtagttgctcacgtccttgtctcctttcatctggtggtacacgtccgggaagaactttctaaggaacgactccatggaggtaaccccacctgagatgccgaggtcgtagccgaagaggatgccgccgctaccggctacgatgcaggagagcaccacgaaggacgtcacgcggccaccgtagtcggcgccggcaggggcttccacgaagccacctatcgccatggcggcgccaacaagctctgctgctgctgccgccgccggccgcctcctgagatcgatctcaagctcgctcgctcagtgtctctgtgtgaggaagaagatatggttgggccctgtggtcagggcagagggcacccaagcagaaagaagcagagatgcgaatggggtggatctgggttacatacagcagcaggctttccccgccccgcccgaggggccccctgaaa

SEQ ID NO: 5912 - DNA, 380 bp, Zea mays
catccaactagctagctagcttatagtcgtagacaatctgtgcggtgcagctagttaattatctatctatacagggcaggcccatgccatgagtattgttgatgatgactatgttgtggtggacgtggacgacagagctatggttcctgctgcttcctctctcggttgctcccctgctgcatcttcgtctacaatccttttccaaaaccagtgggtcctccagacctgttccatctgctccatgggcagctgcttggtctccggcaggaagaaatacacgaagagcgtcatgacgcacacccagccgcatcttcgtctacaatccttttccaaaaccagtgggtcctccagacctgttccatctgcccatggagcagata

SEQ ID NO: 5913 - DNA, 1343 bp, Zea mays
gaatgtgtgatgtgtcgccgtcccgttccgtccgcccctgcggtgcgggtgctttctccagcgacagcgacagcgagaggggaggggaaccagcaagctcctcctcctctacccctcgcctcgtccgcgccagatctatctgtcccttcctcttgtagttgcaggcagacgcgccatgcggatgcgggtgcttcccgcgtcctggtcatcttcctccgccaagcatagcagcggcagctccgagtcgcaggagcacccttcttcctcctctgctacggccgcggtgtacctcaacatctacgacatctcccccctcaaccactacctctactggttcggactcggcatcttccactccgggatccaagtccatggcatggagtatggctttggagctcatgaataccccaccagcggagtcttccaagtagaacccaaaagctgccccgggtttatcttcaggcgctctgtgtgtgtgggtgtaactcacatgtcccgttcccaagtccgcacttccatagaggatctcgccgaggattatcatggggacacttatcatttgattctcaagaactgcaatcatttcacagcagatgtctgcgagcgtttgaccgggaagccagtacctggatgggtgaatcgactcgccagattaggttccttcttcaattgtgtattgcctgacagtatcaaggtttcagcagtcagagatgtaaatgcacatccagatttttctgatgatggcttggggtccaatgcctcgatccttgagggaagtgatgacgatgatttagaccaactcctaagaacacctaacagcgacactgtgtcttcaagggacaagacattaactcctggcagggatagtctctaattgttctcctttgatagcaaaatagaggcaagtgctttgatgttcacgtctcatggtggtatggggttggcctgatcatatcatcatctgctgtcaaaatttggtggcgcgctagtctggggtgatgaaggattgtttgatattgttgctattatcagttgttgaggttgatatagctgcctatagtgttaatgtgatcatactttgttgtggtattatcatgtggcgaaggccaagttaaccagcatgtcatggttgtttgtgtgcgccagtgtttgtagtgtggcatattgtctgagtaagtagagggtttggctagtcatctcacgtgacctttcctttgaaacgatgatggtgtgtataagtgatttcttctgtacaaaaattattgacagagtttgaaatggttttccagataacgtggttggggatcaaaaaaccaaaacaaggcggccgtctagagaaccaa

SEQ ID NO: 5914 - DNA, 1067 bp, Zea mays
ccggccgccacgacgcggttaactcgggacggaagcaacgcaactcggcacgaagaaggaaaagccaccaccggttcctccgccgtccccgcggtttcagttccttgcttgcttgcttgctcttgctctccctctctcgtggaagccagccacacaaggcagaaagagagagtgacgttgtgttccatcccgttccgctgaagcaaccgctctcctacaccaaaccacccacaccactctaggtctctagccgatgcgatggatgtggatccagcagcggaccagcggaggaagaacaagggcgggctggagtcggagctggagcgccactacgacgacctgcagcgggagatgatgctgatggccgccgatcggccgcacaagcaactgcaacagcatcgacgtcacgggcaccgccccgatctgctccagaactgcgacctgcccccaccggccaagctcttcggccccgtacccaccctgcagaggctggagaccgctgctgccaaggaccacaaggccgacgacggcctgctgcgggcgctgcgcctgtcgcagtcgcgcgcgcgggaggcggaggacaagctggcggccgcgggcgccaccaacgtcgacctcgcggcgctgctcgtgcgggactccgtcgcgctctccgcccaccgccgctgggtcatgatgctggaggccgagaattccctgctccgaggaccacgacgagatgcggatggtccggaaccggaccacggagccggcggggtggccgcgtggtgggtcgcgctcgccgtctgcgtcggcgtcgccggcgtcggcctcgcgctcggcaggttcctctgctgaacaactgtgatggatcattctccttccttcctgctgctgtagaaagtgtaaatctacttcgagacgacgatcgatcgatcaatcaatcagtcaaaaaaaaaactgtaaatactgctacagtagtacggagtaggattggtctccaagttaaagtacccattcctgcacgctttctgctttagcttgtggaaacaatctgttgagaatttgatgcaaaaaaaaaaaaaaaa

SEQ ID NO: 5915 - DNA, 1131 bp, Zea mays
  misc_feature (1123)..(1123): n is a, c, g, or t
cattgggtacctcgaggccggccgccacggatatcttcgccaaccgctgcgtcgcgagctcgccgccatggcattggctctccccctcgcccgcctcgtccccgcctgccagtgccaggcttggccccacctgcgctttcggaagcgccacgtctccttcgccgctcacgccagttctcgcgccgccttcgctgcctgcgcggcggcccctgccctccaggtccaggcgccggaggcggaggcggaggcggagacggtcgagcaagtgggcccgaagacacgcctcgtcgcgcagaacatcccgtgggactgcacggccgacgaaatgcgcgcgctcttcgagagccacggctccgtcgtcggcgtcgagctttcaatgtacagcgccaataaaaacagaggattggcgtttgtaaccatgggttcagaagaggaggctcttgcagctctcacccatctcaattcaactattttaaatgataggaaaataaaggtggacttcgcaaggcctagaaagaagcaacctaagcaacctgctgtggtatcggatgccacggaaaagtatgttgtgtttgtcgggaatttgacatggagggtaagaaatcgtcaccttcgggaattatttgcctctgccccaggtgtggtatcagctgaagttatcttccataccaccactccgagacgatctgctggctacgcgtttgtttctttttcttcgaaagagagcgcaggggccgccatatctgctttcaacggaaagatattgatgggacggcccattaacgtgatgttcaaagatgaaaatggtgaaaagaatgaatcttcttctgtcccaaagaaggccgaggtggaaccatctgatgaccagagtgataagctaagcatgaactgttaacgaaacaaataggtcatatctgtcattacacaaatatatgtatattctgacccatggtatttccttttcagaaatagttatgtcccttgttttattgatttgtcaaaaaaaaaaaaaaaagtcgtgaggcaaacgtgagcgctgtgacctgtgagggcgtcaaatcctcccgcccgcgttgtaaggggtgaatataaacttaattagttttaataaattcgtctcgtnttttagtt

SEQ ID NO: 5916 - DNA, 1148 bp, Zea mays
actaaagggaacaaaagctggagctccaccgcggtggcggccgctctagaactagtggatcccccgggctgcaggaattcgcacgagaccattacctagaacatcctaatcgaaaagcggtttcagttccttgcttgcttgcttgctctctctctctctctctctctctctctctctctctctctctctctctctctctcgtggaagccagccacacaaggcagaaagagagagagagagagtgactttgtgttccatcccgttccgctgaagcaaccgctctcctacaccaaaccaccccacaccactctagccgatgcgatggatgtggatccagcagcggagcagcggaggaagaacaagggcgggctggagtcagagctggagcgccactacgacgacctgcagcgggagatgatgctgatggccgccgatcggccgcacaagcaactgcaacagcatcgacgtcacgggcaccgctccgatctgctccagaactgcgacctgcccccaccggccaagctcttcggccccgtgcccactctgcagaggctggagaccgccgctgccaaggaccacaaggccgacgacggcctgctgcgggcgctgcgcctgtcgcagtcgcgcgcgcgggaggcggaggacaagctggcggccgcgggcgccaccaacgtcgacctcgcggcgctgctcgtgcgggactccgtcgcgctctccgcccaccgccgctgggtcatgatgctggaggccgagaattccctgctccgaggaccacgacgagatgcggatggtccggaaccggaccacggagccggcggggtggccgcgtggtgggtcgcgctcgccgtctgcgtcggcgtcgccggcgtcggcctcgcgctcggcaggttcctctgctgaacaactgtgatggatcattctccttccttcctgctgctgtagaaagtgtaaatctacttcgagacgacgagtaatcaatcaatcaaaaaaaaactgtaaatactgctacagtagtacggagtaggattggtctccaagttaaagtacccatccctgcacgctttctgctttagcttgtggaaacaatctgttgagaatttgatgcctgccgtgaggttccggcttccgggtcaaaaaaaaaaaaaaaa

SEQ ID NO: 5917 - DNA, 2727 bp, Zea mays
taatatagagtaatgaatcttgatgactagactaaaaatattgaaaaggtattaagtaacatgtgctgcggatagcttaaagatcgaattagttacaagtgggcagacatgatttttttagaagaatagcaaaaataaaaagaattccagaataacagtactctttacttgggatccacatgttacggatagcgcaaacgaccactcactccgagaggagtaacaaacatgctcaagaaagtcaaaaccagatctggagttctgcggccgccgcaccctctcactcatcgacccccgccgtagtagatggctagatgccaaaatcccaaatcccttgcgaacctcctaaacctaagcgatggcggtggcggcatcgccgtatttcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatgccccccgtcaactacaccgtctcgggcgtccccatccgcctgctcgcgctctccgtctccgatcccgacgtcccgctcggccccggcgtcgacgagtcctacacgctctccgtgccacccaattccagctccgctgacatctctgccgccactccctggggcatcatccgcggtctcgagaccttctcccagctcgcctggagcagcggcgccgccgacgcgagcggccagccgatcgtccccagcgagatagaaatctccgaccaccccctgttcacccaccgcgggatcctcctcgacaccgcacggaactactaccccgtccgtgacatcctccgcaccatccgcgccatggcctccaacaagctcaatgtattccactggcacatcaccgactcccagtccttccccatcgtcctcccctccgtccccaatctcgccaacttcggctcctactcccccgtcatgcgctacaccgaccaggacgtccgccgcatcgtccgatacgccggggcctttggcatccgcgtcatccctgaaatcgacatgcccggtgagtgagagctgattccaaagtactgtactggatcctgcactgttctacggttgcaatcttcaatgcaaagacttcagggcacacggggtcgtgggcgggcgcgtacccggagatcgtgacgtgcgcgaacaagttctgggcgccgacggcgaagccggcgctggcagcggagccctgcacggggcagctgaacccgctgaaccccaagacgtaccgcgtggcggaggacgtgctgcgcgacctggcggccttgttcccggacccgtacctccacgcgggcgccgacgaggtgaacacggcgtgctgggaggacgaccccgtggtgcggggcttcctggcggacggcggctcccacgaccgcctgctggagctgttcgtgaacgcgacgcggccgttcctagtccacgagctgaaccgcacgtcggtgtactgggaggacgtcctcctggggcccaaggtgtcggtcgggcagacggtgctgccccacgacaccaccgtgctgcagacgtggaacaacggcgccgagaacaccaagcgcatcgtggcggccgggtaccgcgccatcgtgtcctccgcgtcctactactacctggactgcgggcacggcggctgggtgggcaacgacagccggtacgacgtgcaggagaaggagcacgatggcatgccgctgttcaacgaccccggcggcacgggcgggtcgtggtgcgcgcccttcaagacgtggcagcgcatctacgactacgacatcttgcacgggctgacggaggacgaggcaaggcgggtgctgggcggcgaggtggcgctgtggtcggagcagtcggacgccgcggtgctggacggcaggctctggcccagggcctccgccgccgcggagacgctctggtccgggaacaaggggtccaacggcaggaagcggtacgccaacgcgacggtccggctgaacgagtggaggtaccgcatggtggcccgcggcatccgtgccgaaccgatccagccgctgtggtgcccgatgcacccgcgtatgtgcaacctctcgcagtagcagcctgaagcgcgacgcctttcgactttcttttagagatagctttgctgcttcctgcaagctgccatggacagaaactggatatgcagggagtcatacagggaggcggaactttgcaagaacagtcggtatcgatctacggatcaaggtccggatgaatcaagagaccagaataaaaccaaggcatcgccaatgtaccatgaccatcattgatttcatcttggtttgctcagtcgtgtcatgaattaacaggtgcattattagctctgcactaaaaacttcccaactcccaagttaaacgaaattgagagacaaaaaatcatctttagattttctgttggcttgtccaataatacatccgtcagcatcacccgacccctgttgtttgtgctcaccggtggcgtggccagcgtaatagcgtcctgtcatggattgccatgacggcagtgtcctgctgcttatgatgatggcacttgattttgacctcga

SEQ ID NO: 5918 - DNA, 2818 bp, Zea mays
  misc_feature (1600)..(1600): n is a, c, g, or t
cggaaattatcgggtcaaatgtagaaaatagtacgggtcgggacgggattttttcggtccgttttcaaccctactcccgtcccaggtcccactcccttgtggttgtggccttcccgtcatcccgtggcggcggctcgcctcctcaaggcctccagactccagtgctcggcgtcgacgtgcgaatcagcgacctccaacacgccgccgcttcgtttctcctgtctcctgattcccgatccgctgagcgccagcgacgacctgctctgcgcgcctggccgtccccgtccttctgcgcagtgccttctctacctcttctcctcgccttccccgcaagactgccttggcgtctctggtgagtaaaccgagtactgagacagtagactagatgtctgcacatgcttgaaattggcgagtggttgattgtgaaatgtgggcccggtagttcgtagacagacgaaggtttccgatatgcctaaaactggtgattgacgtattgttaaatgtgaatttatgattcagcaaatgtttgggatttacgtgcaggttgaactccaacttgtactatattgatgatgccctatatctgtggaatcgtgttttcagaacgtccgatcagaacgtccggagccgatcaagggcaacgacgcgatgaggatgattaatcgtgactaatcgttcgatcagtttagaaacgatcagcctggctggctggattgaaatttcggcccagtggcccacttcacttgcccagcggcccagcccagcttccttttttccaattcccaccacttgagcagaagtcgcacgccgcccggccaagagccaacagagcaacgcccaggcacacacgacacgaaccaggcaaccagctgcggacggaggaaccctagcggaacactgtgccggtgacggcggcgcgctaccggtgacgggggatacggcggcatcggcccctcctccatccccggcgcggcggcgccagcagccggcctgcaggtacggtctccagtctccagatcgcccctctggcgatcaggaacgatcagccgatctgaaaacattgctgtggattcagatcctggggtggatggaatggttacttgttgattcgttacttgctttgtcgttcttttgtgtggcacatgggttggtgtgatctgtacccatgctcgattgtgagccttacctgcaacccgaggtgacttgcgtttttgtcttgttttcgtatctcaagctatagtttgaacggtcggggttgtttggatctagaggtgctgatgacaatgtagtgcgcgtgtcagttgattttttgtgcccttccttgaataactagtaatttatcaactatcatgtccgtcggaggtgccgtttggtatttcctatgagtttactcattttgttctttgttggacatagccagcacttgttttttattacatgttccatcgacgttattcagacacatcatattgtgtatttggcattcacttatgctgcttaattgttttattgcactgtgtctgctcattttgataaattgtcttcataaaagatctattttttgtatgcccacaaaaaaaaaaaaaagaaaagttaagtnaattgcatatttcccattggtgtagcaaaggtagttgaatggcttcaagtgcacgggacattatgtttcggcctctcaaaacattaactataagcccggcactggcatccgcgggccgcagacagcgttaccagcttcaacagcatgcaccagtgagtggcacatccaaaggaaaggctaagctcaaagcaggtcagcctttgaagcgttccaccattggagcaaagaaaggggcaccttccgctgctggtggcggcggtggtcgtggtcgtcgtgaggccattgagcgcatcattcagatttccgagtcatgtctcaatgcatctactccgttgcggcacttgcccctcaaggagcgtcttcgtgaggccaaacgtgaggaactgggtcttgtctccaaggagaggcaacgagagcttgatatagccaaagccaaatctaaagccaaatctaaaggtcctggtggagatgatggagaccgtgtgcttatgggtccaccgggccttgactatatcagtcttgggctagttgatgaggaggcaatccccaagtatgaactcacagtcgaggatggtcggcgacttgctaaagaatacagtcgtgtactaatgcggcggcaccgtgcaaggcaaacagcagagtcaatgcttctaaccctaaaaaaggaggccattgatgctctccctgagaagctacgagctgctgctatggtacctgacatgacaccgttccctgcaaaccggtacatggcgacactcacaccaccaattgaaggatatattgaaaaagtgcgggaagcggccaagaagcactctgtgaaggagaaacttcgctgagaattcaagagaggaaactgtttccgtaaggtgaataaatattcaacctaatgtacaagaacagctttggcacaaactgcaattgccatatttggtgatctagtcagacatcccaatttgctgagcagccattatctagtgaaatcctttttgccatttttatgcaactctacaggattgatttttttttgcagttgtcgctagactgtcatttcattttctgtttttgctcatttaggatgtttgctgttgagaggcatgcttggtgcaatggtgagagctgccttactcgttaaaaaaaaaaaaaaaaaaagcacctctttgtctttgcggggaaaagacttcgatttatcccctatttacacctcatttatagtcacgt

SEQ ID NO: 5919 - DNA, 1588 bp, Zea mays
gcacaaccaagaggcaacagagcaacgccagccacacacgacacgaaccaggtaaccagctgccgaggaaccctagcggaacactgtgcaggtgacggcggcgcgctaccggtgacggggtataccgtatacggcggcatcgtccccctcggcccctcctccatcccggcgcggcggcgcaggcagccagccttcaggggttaaacctgatgccaatccgcaggggttaaacctaatgccaatccgaagggccttgctgagctcgcctccatcgcccaggacctcgccgcctcctctgtgtcgttgcccagaacctcacagccaacacacgcatcctcttatcgtgcctcatcctccaagacgatgggctgctccccctacgtgcctcctcctccacgccgacaagcatctccccccgacacgcatcctcctccacgccgtgcttggtggtggcggcggacggtggttacctggggctgcggtgggccgtgcctggcatgcaaggtgagcagtccagcatcgagtggtcagtgtagggtgtgccgcggtctgccattgcgctgattgaagcagagtcagtgagttactgccgtgcgctgattggagccttcgtagccggctggagcgccgccgagaggtgaaggccacacgcgattgctgattagagattagagcagatccattgagccaccactccacctctgttcaccggcacgagtgaattgaattgggttttctgactcagattacttgttcactgtggggtgcaagcttaatcggccaccatggatgttgataagcaagaaacaatggaggagaccatccttgttggtgatgatctcatgcgtgggccgccatcccctgtcataccgaaagagatcgcatcacatgtccttgaagatgttgagctttgtgatggtatactcaagaaccttttcttatgcctacagatcaatgatattgagccattctgccaagatgaaattgtgctatatcgacagtgtgctgagaaaagggacaaggaaataagagagcggatgcaaaatagtgaatataaattgggtttttcaatgcccctggaagaagcgaaagagagagctactcaactccaatcagaagtaacactgctagaaaggcgcatgattcttgctagtggacttgagggtatggaaggatttcgccagagatggagcttgcatggacagcttgaagacacaaggaaaaggctagaagcactgaaccatggcatggcaaaacgagagaaccaaagttctacggcggagaggacaaaatctccagctaggaagaagtggttcttttggtaggttagtatcattgtcagacttgagaaatattgtagcttgagttgtattagcggcaatgctacacactttttaacttccacagcactctgcctccaactagccacttaatttgctaacaagtaacaagcgatttgcttatatatagctgcagttttaaatgtttaaatcatgtattaaaccttgtaactgcaggtgatggtacggttgcattccattttgtgatttatgacagccacttgccctcctcaaaaaaaaaaaaaaaa

SEQ ID NO: 5920 - DNA, 928 bp, Zea mays
cggcacgagggatcaatgatattgagccattctgccaagatgaaattgtgctatatcgacagtgtgctgagaaaagggacaaggaaataagagagcggatgcaaaatagtgaatataaattgggtttttcgatgcccctgaaacaagcgaaggagagagctactcaactccaatcagaagtaacactgctagaaaggcgcatgattcttgctagtggacttgagggtatggaaggatttcgccagagatggagcttgcacggacagcttgaagacacaaggaaaaggctagaagcactgaaccatggcatggcaaaacgagagaaccaaagttctacggcggagaggacaaaatctccagctaggaagaagtggttcttttggtaggtgatggtacggttgcattccattttgtgatttatgacagccacttgccctccccattgttcgagtgcctatttagattatggctatttcataggctcccttcaggaattaacgacagtttgtgttttctatattttggtggagtaagttggctaacacactctacctatgcacattgtggatttacagtacgtgttgtgtgcaatatgcaaactccaacgatggtccagctgtgtggtccagatctgggatgacttgttaggcaagttgcattctaagcggctaagcctgaagcaatgtgatagcagctaacaaagctacaatttgtttgcaacatgtacctctagggtctactccccctaaagtttgtgccatactcatgtgtttccatttgcatctggtcctctttggatgcaaagtagcattggataaagctagggttttgtaaaatatgttgttttttaaaagccacgaactctgtttggatatgacagatcttggtagtttataaaagccatggttttatcaaaaaaaaaaaaaaa

SEQ ID NO: 5921 - DNA, 502 bp, Zea mays
aaaacgacacgaaccaggcaaccagctgccgagggaggaaccctagcggaacaggtgacggcggcgcgctaccggtgacgggggatacggcggcatcgtccccctcggcccctcctccatccccggcgcggcggcgccagcagccggcctgcagctttataatggatcccaacatgaagcagcttcaagaggctctggttgatattgagactgatgcagaaaaagttcttctggctagacatcagttggtggaaaatgataagataagaaatggtaacagggaggctctgacagcccttcggaaacaagctaggacgtccaagactagcgtgccatctccctttgaggtcataatgaaagagatggaaggaagctctggcaagcagctgataaaggagatatgcccaacttgtggagatcatgaccccaaggaacatacttggctaatgtttcctggatcagatatgttttctcgtgttccatttcatgtggcacacactgt

SEQ ID NO: 5922 - DNA, 1676 bp, Zea mays
ttggcttccgcgaccccggccccgagagccaacagagcaacgcccaggcacacacgacacgaaccaggcaaccagctgcggacggaggaaccctagcggaacactgtgccggtgacggcggcgcgctaccggtgacgggggatacggcggcatcggcccctcctccatccccggcgcggcggcgccagcagccggcctgcagcaaaggtagtttaatggcttcaagtgcacgggacattatgtttcggcgtctcaaaacattaactataagcccggcactggcatctggtgtgatcagacagcgttaccagcttcaacagcatgcaccagtgagtggcacatccaaaggaaaggctaagctcaaagcaggtcagcctttgaagcgttccaccattggagcaaagaaaggggcaccttccgctgctggtggcggcggtggtcgtggtcgtcgtgaggccattgagcgcattattcagatttccgagtcatgtctcaatgcatctactccgttgcggcacttgcccctcaaggagcgtcttcgtgaggccaaacgtgaggaactgggtcttgtctccaaggagaggcaacgagagcttgatatagccaaagccaaatctaaagccaaatctaaaggtcctggtggagatgatggagaccgtgtgcttatgggtccaccgggccttgactatatcagtcttgggctagttgatgaggaggcaatccccaagtatgaactcacagtcgaggatggtcggcgacttgctaaagaatacagtcgtgtactaatgcggcggcaccgtgcaaggcaaacagcagagtcaatgcttctaaccctaaaaaaggaggccattgatgctctccctgagaagctacgagctgctgctatggtacctgacatgacaccgttccctgcaaaccggtacatggcgacactcacaccaccaattgaaggatatattgaaaaagtgcgggaagcggccaagaagcactctgtgaaggagaaacttcgctgagaattcaagagaggaaactgtttccgtaaggtcaataaatattcaacctaatgtacaagaacagctttggcacaaactgcaattgccatatttggtgatctagtcagacatcccaatttgccgagcagccattatctagtgaaatcctttttgccatttttatgcaactctacaggattgattttttttgcagttgtcgctagactgtcattccattttctgtttttgctcatttaggatgtttgctgttgagaggcgtgcctggtgcaatggtgagagctgccttgttatcatgtcgcagattcgatgcaggatgcagcctctttgtctttgcggggaaaagacttcgatttatcccctatttacacctcatttatagtcatgtgggagcctctaggacgtttgttgttgacagcaacttccgcaataaagggttagcagtgagaccatgaaactaagaatctcccgattcctcacaaatgccccccgtactattttatactctaggttgctagattgctgatacagcaagggttatatgatgcagcattttgttcatatgtgctttcagtttttagttgcactgcatctttccatgaggtaatggtatattgtgtaccttatgtttctgcgagatgtcagtttcgacttttgagtagccct

SEQ ID NO: 5923 - DNA, 1159 bp, Zea mays
  misc_feature (1142)..(1142): n is a, c, g, or t
ggtaccctcggagcctgccgggaacgctcaggcacactgtgcaggtgacggcgaaccaggtaaccagctgccgagggaggaaccctagcggaacactgtgcaggtgacggcggcgcgctaccggtgacgggggatacggcggcatcgtccccctcggcccctcctccatccccggcgtggcggcgcaggcagccagcctgcagggttttctgactcagattacttgttcactgtggggtgcaagcttaatcggccaccatggatgttgataagcaagaaacaatggaggagaccatccttgttggtgatgatctcatgcgtgggccgccatcccctgtcataccgaaagagatcgcatcacatgtccttgaagatgttgagctttgtgatggtatactcaagaaccttttcttatgcctacagatcaatgatattgagccattctgccaagatgaaattgtgctatatcgacagtgtgctgagaaaagggacaaggaaataagagagcggatgcaaaatagtgaatataaattgggtttttcgatgcccctgaaacaagcgaaggagagagctactcaactccaatcagaagtaacactgctagaaaggcgcatgattcttgctagtggacttgagggtatggaaggatttcgccagagatggagcttgcacggacagcttgaagacacaaggaaaaggctagaagcactgaaccatggcatggaaaaacgagagaaccaaagttctacggcggagaggacaaaatctccagctgggaagaagtggttcttttggtagtacgtgttgtgtgcaatatgcaaactccaacgatggtccagctgtgtggtccaaatgggatgacttgttaggcaagttgcattctaagcggctaagcctgaagcaatgtgatagcagctaacaaagctacaatttgtttgcaacatgtacctctagggtctactccccctaaagtttgtgccatactcatgtgtttccatttgcatctggtcctctttggatgcaaagtagcattggataaagctagggttttgtaaaatatgtttgttttttaaaaagcgacgaactctgtttggatatgacaaatcttggtagtttataaaagccatggttttattaaaaancaaaaaaaaaaaaaaaa

SEQ ID NO: 5924 - DNA, 2701 bp, Zea mays
agtccatcagattcactaggctcaagcatcgcaacatatgcaggacaggcaaaaacattcaaatttgctgagattgacatggccacaaatggatttgatgattcaaaagtacttggagaaggaggcttcggatgtgtctaccagggcacacttgaagatggaacgacggttgctgtgaaggttctgaagagatatgatgaccaaggtgagcgggagttcttggctgaggttgagatgctgggacgtttgcatcaccggaatttggttaagttgttaggcatctgcattgaggagaatgcacggtgtctggtatacgagcttattccaaatggcagcgtagaatcccatttgcatggtatgtatattgtataccatatcatcaagggcatgttagaagttgcgaaaattgacttacagcaatgtgctttgctttgttttgttgttctgtatgctcactgtaggagcggaccgtgagacagctccacttgattggaattcacgtatgaagatagccctcggggcagcacgagcacttgcatatctacatgaagattctagtccttgtgtgattcatcgcgattttaaggcaagcaacattcttctggagcatgattacacaccaaaagtgtcagactttggacttgccaggactgcaaggggagaggggaaccatcacatctctacgcgtgtcatgggaacattcgggtatgaaatctcttgttaaatttcattctatagacaaaaccttgatcaccttcctttatctaaaaaaaacttgctttcttatcagctatgttgcgccagagtacgccatgacgggtcatcttcttgtaaagagtgatgtgtacagttacggagttgtattgcttgagctcctcactggtaggaaacctgtggatatgtcacggcctgccgggcaagaaaacctagttgcatgggctcgaccgcttctaacaaatgttctgagcctacgccaagctgtcgatccacttcttggacctaacgttccactggacaatgtagcaaaagcagctgccatcgcatcaatgtgcgtacaacctgaggttgctcaccgccccagcatgggtgaagtagtgcaggccttgaagcttgtgtgcagcgagggtgacgacggcattgcgtcaggaagattcagccaggagttgcccatgcaaactacagcggtttatgacgcgactggcatggaagctgagagagtgctaatatccgacatatttggctccacaccactctttactcgcggtgccgattcagattcttttcgcaagcagtcaagttcaggtccgctgatgacaggcaagaacaggaagttctggcagaggttgcgaagcctgtcaagagggagcatgagtgagcatggcatctcaccagactatgaaacccgctcgcaatatagtggtaggtgaggaaacctttgcttggctttgattagaaaacggattgatactcagactgggaataaaagagttcaagctgagctagtgtaaactacgcatctggaggtgaaagctatagcttcaggatctcattcagagtagcagagtggagcctgagctttggattgctggaatggaaataacctctgctgtggactgctgggatctacctgcaagcctacgtggccatactccagaaccctgatacccccacttccttttagagcttgttaatttgagatttttgagttactcttttgtctagatcgtagtttatttttgcttaatcttttgtttggtcagttgtttgttagggctgttgatttgtatagattcagactacatctcttcgggcttgtggatttcgatagacttgttgtacattgacatatgctggtctcaaatgaggatgataggttcttggtcctaacttgtgactagttgcttgtgcttcttgtgaattctatctgatgttcagaaaaaaaaatgtccttgggttttgttgtctactgaacgtttgtaatgtctgcgattctggagccaagaactccttaaggttatctagcacaatggcatcataaggaagggcttctctctttgaaattatactgtagcgtgagaaccacttttgtagcttgagctcgtgatttgtttggtccgttgttagggctgttgatgtgtgtgcatccggacaggattcttttggccctgtggagttggacacgtacactgatgccttctgaaatcatgataacagattcttgagtgaatggttctgatttctgactagttgcgtcagttcagttcagctgtgtttagaaggaaaggttccttgagtatgattcctatttcctcctactggacatatttccatggatcggaatcgtgcaagcagtgaagattttctggcattcatacactttgacagttcttttttcttccctcgttgtgaacatactgtaatataatgtgttgttaaattgcattgaccatctcggacgttacatataaaaaactacagtggtttgactgcaagttcgctgcctctattttgttttccgatcgcatggttttagccacattctatatcgttgtacattctaggttaacgatgtcgttgtacattctatctcagatctagatcctgaattttttccatcattaataaacacatgatgaagatatagaaggcttattgccatattttctttccaactaaagcctctgttttgttccttagtcga

SEQ ID NO: 5925 - DNA, 3634 bp, Zea mays
gaaaaacagcgacccctcaccggccagacgtagcatgagtatagtaggagtacgacaggagccttccacgcgagccaccgcgctgacgcaccatgacaaatgtcgtgccacctcggcgtctcgttcaggagaagctccccgccgccgacgtcgacgctgtcccggccagccccccacgccccacccccacctagctagtatgccgcgctacgcatcgcccctctggaaaccctcccacccggggggcgggggtggcggggggggggggcatccggcccatgccaacggaaactcgcgcactccagccgctgcgggagcaccacgtgtaagggccgaaccagtcgcaactctcaagacggataaccattccgtccgtgcatgcggtgattgatccgggccgggggaagaggggcgcgaccggcccgcccggtgcgcaacacctggacgcggcgccaagccatcgaggggcctacatgttctccgtcgcggggagtggcgccacgtgtgcgcgtcgcgccggccagacccgtgcgccgagcactggtataaagagctaccccgccgtgtcccgagcgccagccacgccacttgctactactacacacaaacacagctagccggcgctgccaggttggctttggcgagcaacgacgacgacgacggcgctcaggactcaggtgctttcggttcaggcggaggagggcatggagcgcggcgactgccagttcacggtggtgccgccgcggcagtacgacgaggcccagttcatgcaccagctgatggtggccggcgaccagcaggaccccgcgggcgcggggcggggagctgccgccgccggcggggagaggaagcggcggttcacggaggagcaggtgcggtcgctggagacgacgttccacgcgcggcgcgccaagctggagccccgggagaaggcggagctggcgcgggagcttggcctgcagccgcgccaggtggccatctggttccagaataagcgtgcgcggtggcgctccaagcagctggagcatgactacgccgcgctccgggctcagttcgacgcgatgcacgcccgcgtcgagtcgctcaggcaggagaagatcgcgctcgccgcgcaggtaccagtcgtctgcttgattcctgatttcacagctccatatatacgccgacgttcgatcgctgacgatccatcgatgttggtttccaggtagacgagctgcgggggaggctgaacgagcggcaagaccagagcggcagctgcgaggtcaacgacgcggaggcggcggcggacgacaagaggaacaatagcaccagctccctcgtgcaggacgacggcgccacgccgccgccggctgcagtagacgcctccgaggactcggcggcgaccggcgagtactacgaccacgtcgcgtacgagtacgatggcctgcacgaccccttcgtctgcgccactccggacctgtgggatacgtggccgctgctggagtggaacgcggtggcctgaaacctcgatcgtgtactcgtcgtcatgtctctgtatctagtgcacgtgtggtggattcatggtgattccttatatagctagctagccccaactagctaccgagccagttgatccggggagggatcgacgggtaacagacgatagagagctgggtaattaggaatcaggagcgaccggcggctgtggagggaaaagagggatcgatcgacaatgtccggccaccgtgcaccttaggatccatgttcgtgagagaggtggttcagacttcagagccgaggcaaatggtgtcgcacgtgggttacgcttacgcatgctgttgctctgcacgtattccatcgcatgttctagacgctcctctccgttcgtcgccgtcgccagttagcccatctgtctaggacgttcgtcgtcgtagtaccggcgcctaaggacaacggctacgctccgagcgaggacgacgtcgccttcgacggggccgggacagagtcactctcgcacacaggagatgacccccctttccgcttgctcgtttggaaggatgcaggcgatgcgatcgtcgtgtcggccatccattcaccccggtgctgttgcgcggggcgcaaaggcggaggaggaaaaggtcgctgtcgagaatttggaacgttctggaccggtggcccggcggccagatgggtggcggaaacgactcaccggacgagaaagcgacgcccaaccgaatcacaagtacgcaaaatgttcccacgagctccccgaatcactcactctctttgggcgaatttcgggcttagttgcggctacctcacaaagcatggttgggagggctcccaaactgactctctatttggggagaaacctgataaaaaaaagctccgagcggctaccgtcggtcccgctcctgtctagctactgccgatccttcgccgccgccatggctccggcgctccgcacgggccaccgctgttccactcccgttgttgcctcatttgccatgagttacgtgcaaatagctacacaaggtcattatgaacatttgccttatacattaaataaaaaacgaaaggggcctttcgccaaacaatttgctaaaaaggcgcggacttctaatctcatatgaaggattcttctgcggatcgaggagctagagtcgcaaccctatcaaacatgctcttataagttctaaaaggattcttctgtggaggagctagagccgcaaatcccatatttaaagggtccagtgaagacaacctaaaagaagaagtagagcaacatagaagaggatttagacacaactcaaatgggtttaaaaacaagttttagaagttcaagcaatatcgcagttccaataggttccacaaagcgagttctttaggattagactataactctcaccaaaaacaaagtagagggagagctcatttagaccggccatatctaagagtgtaatcttgtcctgagctctcttcagtgcatccaccacaaaagggatatagggtgttacgctttcagtgctcgaacctctataatatgtttgtgtccttatagccataagcaccctaattcaatgaggatgttgcctacacctctcccttttctcctaactctatgatcttggtaccctagtgtcattacatgacgctatgtgtatggttgcacccgatatgttcactacttatttttataaactattataagttatctttttctacttatgcaaattatcaagtaaaatttagctcaaatgtgtagaaccctaaatctcaatttgagaatatagtaatattttttaaaaaaaatcttgaattagaatatttttttcttttcataacatttgaagttacatctcataaaataaaagttttatagtaaagattcaatacaaagattattctataaataattctttgttgaagttgataagtattataaggataaatattagagattcatttaatcgagattatacaatcaaaaatattgttcacaaaacaattaggtggagtaacatatccaaaagtatgtacttataaacgaataaataaacaataaacgaatatatactttgtgttatgttggatttttttgtgctgtgcatttaactataaagttgaatttccaaaaccctggttgaatttgaac

SEQ ID NO: 5926 - DNA, 1197 bp, Zea mays
ccccctcgggtcgaccccgcgtccggctactactacacacaaacacagctagccggcgctgccaggttggctttggcgagcaacgacgacgacgacggcgctcaggactcaggtgctttcggttcaggcggaggagggcatggagcgcggcgactgccagttcacggtggtgccgccgcggcagtacgacgaggcccagttcatgcaccagctgatggtggccggcgaccagcaggaccccgcgggcgcggggcggggagctgccgccgccggcggggagaggaagcggcggttcacggaggagcaggtgcggtcgctggagacgacgttccacgcgcggcgcgccaagctggagccccgggagaaggcggagctggcgcgggagcttggcctgcagccgcgccaggtggccatctggttccagaataagcgtgcgcggtggcgctccaagcagctggagcatgactacgccgcgctccgggctcagttcgacgcgatgcacgcccgcgtcgagtcgctcaggcaggagaagatcgcgctcgccgcgcaggtagacgagctgcgggggaggctgaacgagcggcaagaccagagcggcagctgcgaggtcaacgacgcggaggcggcggcggacgacaagaggaacaatagcaccagctccctcgtgcaggacgacggcgccacgccgccgccggctgcagtagacgcctccgaggactcggcggcgaccggcgagtactacgaccacgtcgcgtacgagtacgatggcctgcacgaccccttcgtctgcgccactccggacctgtgggatacgtggccgctgctggagtggaacgcggtggcctgaaacctcgatcgtgtactcgtcgtcatgtctctgtatctagtgcacgtgtggtggattcatggtgattccttatatagctagctagccccgactagctaccgagccagttgatccggggagggatcgacgggtaacagacgatagagagctgggtaattaggaatcaggagcgaccggcggctgtggagggaaaagagggatcgatcgacaatgtccggccaccgtgcaccttaggatccatgttcgtgagagaggtggttcagacttcagagccgaggcaaatggtgtcgcacgtgggttacgcttacgcatgctgttgctctgcacgtattcaaaaaaaaaaaaaaagg

SEQ ID NO: 5927 - DNA, 1486 bp, Zea mays
tttttttttttttttttgacaaaatttcgaatttttcgatcagtttacaaatccaaaataaaaaaacggttttcgtgaatcattttttttctaaaaaaatattcgaaaaccgctacgaagttcgttgttttttaaaaaaaaacgatggtattccccgtcttcagtctgcacttgttcctctcaactcccttccctccaccggctctgtcattctgtcctccattaccgccacctcctagtttctcgcgcctcgccgtcggcgagcggcgccaccgtcggcgtagagccaggcccgaggccattcctccctcgcagggaggtgtcgccgttgccccgccctctgggctagcgcggcgtggaggggacaactggagatccgcctgtctctgcttggattgctttttcctcctctcgccgtgcatgattcaaaaagctttgcaagcagagagttgctgaattgaagagggaattgcataagtcagaaagttctattgggcagaactaccctactgctgcgtgaagacgatggagtggccaccgccgtcgacgtcaccatcgccgtcgctggtggtgcgcagccccaggcagacagtcagcctgatccgcaaccggcgaccccatcgtgactgggccccctcatcgaggtctccctctttcgccgcccgtgaccatggccccaagccgtcggaggtgtacggcttcgttggatccatcaccaccgtcattgccaccgccgtgtacctcgcctgggcatacacgcccgagcccgtcctccggtcactcggcatcacctactaccctagcaagtactgggcactggcggtgccatcgttcgtggttgtgaccgtggtgctgtccatgggcatctacatgggcctcaacttcgctgccactcctcctccgacttccttcagtactatcttcgatgaaaagagtagggagcacacagccttttttcctgcaactgaggatgagaggcccatcgaacccatctcagacatcggtattgatcggatcaacactcttatgtttggtgatagatgatttctcccggtggaatgagtttaccatggagcgccggattggaaacagatgcaaacgcgaaggaagatttccatgtcagctgaactttgttgcctgcatatgctattgagaggcccgtcgaacccgttttcagacggtagtattgatcagatcaggaatcttatacttggcggtgatagacgattactcaaaaatggagtgtgagtttacaacagagtgccagattggaaggcgtgaagaaataatccacattgttaagtgaactttcatattaccttcaagcataaccgacaaaggaattcgatccttgagcttttcgtttcacgcgaagggacgcctgtaactggattttttttgtgtttttttttttgagcaagaacacacgttctgtattattgattcaaagtgacattacaatccctgctgaaaaaaaaaaaaaaaa

SEQ ID NO: 5928 - DNA, 1240 bp, Zea mays
ttttttttttttttttgcaagaagaggaacaaatctcctgtcttggagaaacaatcagtatctcctgtcttgagaaacaatcagttaattacacaggaaggaaagaaagaaagaaacaaaagccacccaacggagctagccaggccaccaatggagccggagctgaatcagctagcacccggacttcttggcccggaggatggtgcacttggtccgctggaacgcggtggcggcgacgtcggggtcgacgagctgcagctggagcgggcagacgacgacgagcgggcacttggcggaccggcccttgtactggagcaccgtgtccagccgcatctccacgccgaagctgcccgtgtcgttctccgcccggaactcgcccaccccgggcctggtcagcttgatgggcttgcccacgccgccgactctcacgctcagcgtcgccgtcttccgcgccttgtgcttgaaccccggcacggacgcggagtcgtcgaagcgggtgccgttgaaagagaaggtcacggcgagcgcgccgtactcgatggcccggtacatgttggggttccggagcgacaccgtggcggtgacgttgaaggagatggtggagttggacgccgggtcggcgggcgccagcgcgaaccgctgcagcacggcgtcgtcggccgtggccttgggcgggaacaccacgccgaaggcgagcaccaggacggtgatgaggcctcccacgacgacgatggcggcggcccagatggcgagctgcgtccagctgcagtcgtcacagcagccgtcgcccttgccgccgcaccagccctcccagaacgccatggccgcccgcgctgctcgggtgtgggggtggtcgggtgggggacgcggatcttgcgggcctctggctggctatccaaggcaacggtgctgcttggtgttgagagaatcaatcgccctgcctgccactcaccgattgttattgttgaagaacgaataaaagagggagggccagccggccaggggacgacgaccaagacttggttggggtcatcgccggacgcgggacacggaggaaggtcacactcggggaaaccagccacccaccaatccgaaacttgcccggcagaaatggccacggaggcatggcccgtgaaattaatcaggattcaggagacgggttgtgtcgctggacggagatgctgctccacccacttccaccggccgccggccgctggttggtgagctggtgcactttccg

SEQ ID NO: 5929 - DNA, 2054 bp, Zea mays
atatatatatatatatatatatatatatatatatatatatatatatatatatatatatatatatatatatatatgcttaattgcattgccatgtcatcgagcataacaatgtctcaccatatttagggaatgtttgggagggcttcacttcaaaaatcttagtccattccattttcttccatcaaagaggtctagcatcacgagctcccgcattaaaaaattgaaactagaggccaacttcatgaaatttatgaagccccttaaagggtgtttcacaaacactgttttcatatatcatcatgaagttgtatggaaattacccaccacaccactagttacacaatacagcgcttcggttatctcgtgacaaccattaatcatcatggataattaatgaaactcacataaatcaattgtattacataaattagaatccataatgcaaaccaaacactccttgaatacacttcaacaatttgttggagctattttatgggtgaagctagaatatcgaagctaaaattcttgaaaagaagccctcccaaatagacctttaatgagtatgaaactcccaaagaatggtctaaatataatacaaccccacaaggttatcatatcagcatcatggatgacacaaccaaaagccattggactgattgttttgttggaagcttaaagtaattgtgttggtggacatagccaataactctgttccagacgaccccatctctctccccaaaacggggaggctcccctccccaagctcagaccttcgatccgttgctcctccacggcgccagccgccagcgcctccgttcctcaacgcctgtttgtccttgcatggccggagccagacgtcgcaccttgcctccaccctcgcattccgatcacccgcttccagctcctctccgtctcgctgctcctcctccgctcgcagagctgagctgatcgatggaccacgagcagcggcgccagcggcagcagcacagtcccagaggcaatgctcctgggagcgggaggtgcggctcctcgtcgaggaagcacaagggcgggggcaagaaacccatcaaagtggtgtacatctccaaccccgtgcgcgtcaagactagcgccgctggtttccgcgccctcgtccaagagctcaccggccgcgacgctgacccctccaagtacagccccgaggacctcgccggcgccgccgtggcggcgggcgaccctgactgcggcgccgcccaggggctcagccccggggacacgacggctgcgtcgtccgataccatcgtcgccatccccagccctgccgcggtggaccacctgcacgagcacgacgcctcgcccgcggccgcgccggccgacggcggggactactactacgacgacgaggaggacgagggtggattcgggtcgcagctgctggagaaatactacacggtattctcgccgccgacgctgctctacgactacgaccaccacccgcacaacaaggtgtgtgatattacccgatccatcgatcccgcgcgcctcttcagcgtgacgcgtgccccccctctctctgcatgacatgatcatccctttcgctttgtattgcatgtactatgtgcgtgcccctaatctgtatgcgggtatgagcgaattgctggctccaatccagcacatgatctgctgcataccatatgccggagagaggtagaactataggaagacgagtgtgtatagtactgtgcggtaatatagctgtgcttttgtgtccttttcttgtgtcgtcccaattcccaaaccatcgtctgtgccttttctctgggtttcgttgctctgaaaaatgttctctctgatttcatggtggggatggttgcaagaggacgcttgagacttgagagtacgtcctttttcttgtatatatagtgctcattttggcgtggctactactagttggcaattgcgcttctggatcatccgcactactagagtataaccaaggagactagacacatgagagcatagaagaattggtctacgatgcggcgcacaccggcacaagctggctcttttggcaa

SEQ ID NO: 5930 - DNA, 2117 bp, Zea mays
agtccagtagcaatactcactcctagtcctggagtatagtcactactacccctagaagggaagcgcatccgctcgatacggggggtggcaggttggcgaggagacgaaaggcacggcgagcgagagcccaacgaccgtccagttccagttccagcggtccgagcgagatcgatcgcccctccgcaaggccgcaacaacagacgcggcaagcgggtacaagggagttcttctggaggcgcgggagatcacgcgagtgtgttgcgcttgaaaagaagaaaaaaacaggcagggaggagggagtcccgttcccgaacccgaactacaagcccacgcaactgctgctgccgccgcccgcccagcaggaggagcgagggcattgcccggccccatcgccgtcgcgccgtcgccgtcgccgcgctgcaggcagaggaggacggcgccggccagcatgggcgggtacgagctcgtcaggagcgacgacgcggcgggcgccgcgggagccgacctcgagtccggctccggcgccagcaaggtcgccggcgccccgccgccctcgccggccccgtcggcgtcgcccgccgcgcggcagcagcgcctcgcctcgctcgacgtcttccgcggcataaccgtcctgcttatgatcatcgttgacgacgctggaggcttcctgccggcgctgaaccactctccctgggacggcgtcacagtagctgatttcatcatgccgttcttccttttcatagtcggagtctcactaacactagcgtacaagcgggtgccggatagagtggaggcaactaggaaggcagtgcttcgtgccctcaagctgttctgccttggtcttgttctccaaggtggatttttccatggcgtccacagtctcacgtttggtgttgacctaacgaagattcggttgatgggcatacttcagaggattgcaatagcctatctcctagctgcagtatgtgaaatctggctcaagggagacgacgatgtagattctgggtatggtttgctgaggagataccgctaccaactgtttgtaggattggtcctctctatagcgtactctattcttctctacggcatgtacgttccagactgggagtaccagatagcaggccctggttccagttccacagagaagtcgttctctgtgaaatgcggagtgagaggagacaccggaccagcttgcaacgcagtcggaatggtcgaccgtacggtcctagggatcgaccacctctacagacggccagtttatgcgcgcacgaaggaatgcagtatagattatccagagaatgggcctcttccacctgacgctccgtcgtggtgccaggcgccatttgatcctgaaggcctcctcagctccgttatggcgattgtcacttgcttgatcgggctccagtttgggcatgtaattatacatttcgagaagcacaggggaagaatcaccagttggttggtcccttccttcagcatgctagctctagccttcgtaatggacttcgtcggaatgcgaatgaataaaccactatacacgatgagctacactctggctactgctggcgctgcgggtcttctcttcgctggaatctatgctcttgtggatctgtacgggttcagaagacctaccatcgccatggagtggatggggaagcacgccctgatgatatacgtgctggtggcgtgcaacatccttcccatgttcatccgtggcttctattggagggaccccaacaacagccttctgaaagtcattggtatcggggcgtgaagccatgaccttctacatgttcaggcccaaacttggacatgcacagcgctctcgcatgtttaagagcaataatctaggtgctcaggccaagttttgctatgcggttagaggaccatagcgcgctcaggtcatgcgccatggggctgcctatattctcagcactgccgagatgcctgttgccacttgcagatgcatggaatccattctcccagccaactttgtatatggtggagttgagcacatgtacatgatatcacacgagtaatatgttgtgattcagatgaaatatatactagtacatatcagtccatattctataataatactacctccggtcttgaat

SEQ ID NO: 5931 - DNA, 3077 bp, Zea mays
  misc_feature (87)..(87): n is a, c, g, or t
  misc_feature (714)..(714): n is a, c, g, or t
tagatgagtcaaaccatcagaccaaacacgctataaaagtatgcttccaattactcaaatcaccccgttcaacatgcatgttacccngttagtctttttttcgtatgctattttcagaatttttatgttgtaggaagatatgttcgtctgttttctatggaacatcaggactctagttttactatttccttcttttgttttgtcggataccatagatttgtgctcatgtgccatatacttaatcatgcaaatggcatatggatacattctgaggatctttttttttgaaacatgcaacggaggggacgaaagatccccacctgattgattatacactcataaagttcaaggtacaagcgcggtcagggaataggaaagctttgggatactttagaaaggatggacacaactagagaaagaaaaggataaaaagacagttaaagaagcccatgagaagcataaagttagtgcatacagagctccttctcttattaaaatttaaagaaattaaacatttggtgggtatcaccgtggtttatgaaatgctttgaattagtatcattagtttatggatatagattttttctagtactgcatgttattattgtatagaagcaatgaaaatctagccattttttttcatacatctaatgtagacacaagtggtcaaaacttcagaagttctaagttctggttaccttgatgacattcttntgtgacctgaggtggaggaagtggctgagatttttattttattgactcataagctattaacattggttcagttcatggggtcactgacttcttttacgatgccagcaaaaaaaaacgtttacttcttccctttgaaaatatacaattttacataagttagcaatataagatttacattgttcctagtcgttatgaaaactttttttataatactaatagaaaaggtggcaggtggtcctgccaaatgactactatttttttttgtgtatctggctatccgttgctatagatcgtggttctgccacttgattcctcgagctgaaattttgtcgttttaggttggcagtgttgacgtactttattgttgcaaggctatctgcatcagcttatctattctcatacccatattcaaactatatcattatcctttaatcgattaaaggaggtctatatcattaattcattatctcaagtggatgtggtgtcgtagacatgttttactctataagcagagtggatctgagccgtgctacaccaaagtattcattcatctcatccggtcctcgctgaacgcagctagcgaggaacttgagcaggaggcgcccgtatgcggttctgccacgtgtcacgtgatcgacgtttccccccttccgcggttctgccgtcgtgcgcgcgtcacgccgtgacctgaccctcatgacagcacgaatcccaaagcagaaggccaaaaccccgtcatccctgggccccccgccgggccccgccggggtctaatcaatcccgcattccccattgcacgccgtctccgctagggttttactccgcagccacaccgcgccgccggagcagcgcgagacccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgcgcgatcggcctccccgagctcctccccgaggagcagccccccgaggaggagatcttcgccgagggcgccgccgacgtcgagggaagcgccatccgccgcatccaccacgcgctcctcgaggttcatgtccaggagggctccctcgtctgccccgacaccagccgctgcttccccatcaacaagggcatccccaacatgatgctccacgaggacgaggtctgattttgccgtgtcagtttcgccctggcctcttttgctcgcgcacctgctctacatggtctgtcgcgaagggtatcaggccttgtggacttcgtactcagattgtacctgtgaagtatggattgcagtcttgcagattgtgcccttataatatgatagatagccgtgtaatactcggaattgccgtttcgtgttgttaatttggtgcatgtcatgctttgttcttaactgtctgcgaattgtttgctgccctgtgcctgaggaaatcgaagaggtaaattacaaattgtgcacaaaaaatggcatgaaagttgcgggtgatttagtggaaccaattttgtctgatccatttggtgtttgcaaattgcaattcattctggtggatcatgacgataggccatagcctatagacaggtgtctgtaatctggtccccagtgaggaaactacttctgtgtcgtgtagttttgtgccaaactatagtgttttcttgtagtgaagcgcttgcttaggtgatctagtaaatcactatgttttaggattctggcattgtgggcattcagatttgcttgagtaggttggtaaatgttccccgtgtttgcgtaaaattgaagatatcatcctgcttgcctgaaaatatttgattacgcttccttccaaagtaccagttggatgtttggtgcaatttgtgattattaacacggtaacaagatcaatgcacgcataccctagactgtcttctctattcttctctgcatctttatcattttcagtttcccatcagctgttttgtgtggggtgcatacctgtaaagatttattacgtagaaaggtagaatctttcaaggatacgtttgttattagcctccataacccttcgtaatgttttttaatggataattttcatcaaatcaaccaaatttaggtgccatttggttcaccaaatgtaacgtaaatgatagtggtaatgattcacaccctattaccggtggtaacaagtttgaatagaacaatatcagtttctagtatggtgtctaattacgattggacttaaacaaacatgttttaacattatcaatcatcattcatgt

SEQ ID NO: 5932 - DNA, 2249 bp, Zea mays
cactcctatgggcgattgggatcctcgcggccggccggcgcgcgccgggcaggaggcgcccggatcgtctaatcaatcccgcattccccattgcacgccgtctccgctagggttttactccgccgcagccgcaccgcgccgccggagcagcgcgagaccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgcgcggtcggcctccctgagctcctccccgaggagcagccccccgaggaggagatcttcgccgacggcgccgccgacgtcgagggaagcgccatccgccgcatccaccacgcgctcctcgaggttcatgtccaggagggctccctcgtctgccccgacaccagccgctgcttccccatcaacaagggcatccccaacatgatgctccacgaggacgaggtctgattttgccgtgtcagtttcgccctggcctcttttgctcgcgcacctgctctacatggtctgtcgcgaagggtatcaggccttgtggacttcgtactcagattgtacctgtgaagtatggattgcagccttgcagattgtgccctcataatatgatagatagccgtgtaatactcggaattgccgtttcgtgttgttaatttggtgcacgtcatgctttgttcttaactgtctgcgaattgtttgttgccctgtgcctgaggaaatcgaaagaggtaaattacaaattgtgcacagcttttggccaggaaattgtgggtgatttagtggaaccaattttgtctggtccatttggtgtttgcaaattgcaattcattctggtggatcatgacgataggccatagcctatagacaggtgtctgtaatctggtctccagtgtggaaactacttctgtgtcgtgtagttttgtgccaaactatagtgttttcttgtagttgagttcagggaggtaaatgtgttggaagcgcttgcttaggtgatctagtgaaatcactatattttaggattctggcattgtgggcattcagatttgcatgagtaggttggtaaatgttccccgtgtttgcgtcaaaattgaagatatgatattgcttgactgaaaatatttgattacgcaatttacgcttccttccaaagtaccagatgtttggtgcaatttgtgattattaacacgtaacaagatcaatgcacacataccctagactgtcttctctattcttctctgcatcttcatcattttcagcttcccatcagcgggtttgtgtggggtgcatacctgtaaagatttattacgtagaaaggtagaatctttcaaggatacgtttgttattagcctccataacccttcgtaatgtttttaatggataatttttatcaaatcaaccaaatttaggtgccatttgattcatgaaatgtaacgtaaatgatagtggtaatgattcacactctattaccagtggtacaagtttgaatagaacaatatcacttttagtgtagtatctaattacgattggacttaaacaaacatgttttaacactatcggttcattcatgttataaatatgtgagccaaacaacactttacattgggtgagcatctcatactccacaaatgtggtgaatatagacacaaatttatggatttggtagagcaaagatgatggagttggagttgtttggctaaaaaaataaatttaaatcagattttggtgaacctagagctatcataaacaaaccctaatgtaataagtttagatgagattgcttgagcttgtaaataaaccaaaccaaattgacattatgccttatttatggtgtgtttagttggagagtcaattagaatggagcgattttattctagatttttagaatggagccgttctattctccgtttgccaagtataacgaagccataattttttttattgaagagtagaatagagtggagctattatgttttttgtttgattggagagacatatgagtgcaaagaggagaaaaggaagaggagcgctcgcgtccgagagaacgttcgtatccgaccattttggtggagcgggagcactcaaactatttaaaataaatttttatacgaagactataggagccgctcc

SEQ ID NO: 5933 - DNA, 4433 bp, Zea mays
  misc_feature (540)..(540): n is a, c, g, or t
  misc_feature (1367)..(1367): n is a, c, g, or t
  misc_feature (2953)..(2953): n is a, c, g, or t
atcatgccatctacattcatccaactaggggaatgctaggcctcaagggaaactatagcgaaaagagcatgaaagggctaccaagcttgacaaaagtctagttttgtgtgaagccacatgccatccaacgaggtatcaacaagggccaataaaaaaatgtagccagcgaggattttagtcatcaaaggtggatgctacccttcaaattcacaaaaagtgacctgcaaacaacactaaaaaaatgggcgccaaagaagcggtctctctgaaaaaaaatcaatcatgtgttgtgcaaattcaagtaaagcagttttaaggcggagggtagctatccaccatcctcggcaaaagtgatggcaaaacaattgcctcggccatattcccaaaccttacccccaaaatattagccatatcccacattccccattgaaaagacgtgaatggcatgggacacatgactgaagggaggtctgatgatggtccgcctagcttcaagaggtcatgaggaagtgctaacctttgatacgcagacaatacgangaagctgaagtacaagtgaaaatcgtgttgaagattcgagaagtgatgctaaacataccctttagtggcaccgttgctggctatcatataacttggtgacctaaaggaaagccaacaattttttttaaaaaaaaactttgttcctttcattctttaaaattatcgcataaagtcctcagtctagaagtgacgttcttgttgtctacttgacaaatgtgtcttactagagatatttacccctttgtggtaagatttttactcaaatgaacgattatttgcatgttcatggtatttcggacacaggcacatacaagttattatttaagaagcagtgaagcagaccagtgtggtgactgtggatctgtggacaaagtcaagatatatggttggcaccatggctgctatatggtcgcatttatcctgactaggaactaggttcattggctggcactaaatttcttagtcgcaatgaaaccgtatgttctagcatgacaaaacagatggccggcaccatggtggtcgcgtccgtcggtgataacaaatttcgttggttaatgctgatatatttagcctcaatgaaattgagttatatagacctactcaaagttgatagcatggatatacgctacaccttgtacgatctctaattattctataattatttaacgaagttgtggcatggtcttacgccaacaaattggaaaagtgcagagttgtggcatggttttacatagcggcagtctgtgctttactttggctgatcaaacacattagccacatgcaacgtatcatgtgaatcatgggaacactacagaaatgaaccgttngattattattactactcctgggaattgtaaatacattacatatagaattctagggaagaaaatacaatagataaggtaccagagtactcctatttattgattaactagtattgaatactaaactatggctgatggccagtacattatttaaacaatgagagagagagagagagactaaatatattcatgcatatggtctgaaggtgcaggacgcaaaaaagtcaagaagggagtggacatagttggtaagtccttcctcgtcctgatcagtgaagccggcaatagttttttctgcatcctgaagttggctctgacttttaacagaggaggcctccaattctgattggaaagacacgatttttgccagtcgctcattgtgccgggtcaaaagagttgcagtttcttcttttataagtgtctctaaaagcaaaccatcctcagtctctttgagctgggaagacagtttctttatttgggcttgtaattcctcagcacgagatacatgttgttgccgccttagttcatgcaaattaatttgcgcctcaaggcttttggtaatactaatcatggaagaacaagcagtagcaacagaggcttgagaagcttttatgtcatcaatcttttgacgtacttgcttcctcttgtcaatgatgctggtagtggagtgctctggattttcagagagagtctcatgtagagcattgaacccatctattaatctttgtatttttggcggagctgggttaaaccactccttccaccatttcatagtatcggctatctccgagatcacaatgtctttgttgaaggggcgttcgcgtatacgacgttggaagcgatcaagatccccatgagcatattgcataaagcgtggtgccggaacatctgtaggctcagatatatgcacaggctgccgagcatcaaattcgctataatttggcttctctccaatgacatcagtggcacttgcttgtgctcgaaataagctgatggcttgttcaacctcattccataattgttcagactctacggccaattcaagatctctgtgtttgtctgcaaggaatatatatatatatatatatatatatatatatatatatatatataaaagaaaaacagagaagaaagcatgaacatgtgcacactggtgtcataatgttactgaaagcagtatattacctttgctagttttcttgcttttaggatcagaagcggcaaggttgtcggtgtcatatgcttttcgcttgggagtattgaccttacgcacactagcttggttcgagccaggttgcgtcgagggtacatcctggtcgaggcttgacattagtccagtcgaactaaccggttgcgaaacatgcaccatatcagtctgttctaagttgcctgatgttggaacctgagtatgcgaggcctgcatctccatgacctcatttgggaggtctgtgaataagtctgtaaagggctccagcgctccagtgaagacgaagtcattcaggaaatctggatcatccggaggacatgccaagccgccatctgataatgtatcatcaagtagatcagtgtttgcacgtgaccctttgctngtgtgcgtagattggcctgagtctactagcaaaggtaattcggatgaagaggttagagcagatgccttgtcttgcaaacgagcttgtattatgccaatgttttttccttgaccaagtctggacacagttgtgggggtcgtatcttcccggtcatgttcactatcaccagggagaagagaatatttgatgactgctgtttctttagcaggttgatcaatgtcaccctctgttaaaaaaaatgaaaaaaagtatatatgaatcatgtaacagtaaggtacgcagaaaaccctggatccgtgcgggcctacctgcaggggcagcgactgttgtttcgattacagctgacataaaaatcctatcacaaaagaatgaaggatctcgaagaaaccgaaaagcattgttacaccagataatataattgtacgaacgtctagttccaagattagaaggttgcaccacgagagcatgtccctcaggttgatcataataagaaagatgccgccgaacacaaatttgaagtgtttcctttcggctcgagggagagtaacttcgaaagttcaaactatcagttacattatcagcagcacgataatcaaaatatgggatgagttgatcatagttaaacatgcgtgcgaagcgatgcggacaatacaccaggttgtcagaacgttcgccacgcctatgagtaataccaccaaagaggctgctcataagtagctccattgcagaaactgatatggcaaatggttgtttctcattcttcgtacgaccatctcgaataaataccggtcggtgacctcctgggaatcgcagcgaggatcggcccaaaaaatctagcgagcgcagtccccgaccatcaccatcaaaatcccaaaatatatgatgtgcctctgttataggcatgggttgttccaacttcgtcaaatctatgacaaaaggaggaaatttaactggacaatgtaaggtcgctgatttccgagcttgcttccaaaaagaggcgaaccagcccatgatgaaatgacccgggagaaaaagggaacactcgctcgcggaccgtgtcccactaattatattatcatgaatattatccaaacaattatatagaaaagccaagcttgcgacaccaattgctctgcgaacgccttctgatatctgaacggccatatgaaatacctcaggacgaatgtattggccagcttcgacaggaatgcaataagtgcatagccaagctgctataaatgcagcacggtaaaccgttgaaggatatatagatcggtaagataatgtctcggcaccaagaatggctgcaagacggtcaccttgaaccgcgacatggaaacgaagcttctgaagtaacggatctttggggtcagcaaagccatccaataaagaactgccaaaagaatcagctttatcatcaaaaaagtggtctaaccaagcggtaagactcactaatcctaggcctggctgcaggcatgca

SEQ ID NO: 5934 - DNA, 1165 bp, Zea mays
tgtgcgccgcgcggccggccggggcaactaagacaaagtggcgtactcttctctgtactagctttcttcttcctcctcctcttcctcctcccaaacagactggatttcatcaagataatcctgaaactggagccaacaagcagacagagaaagaagagcaagaagaccggctcccagccgatacaaggtaggagtgagcagcgttagatcagttttcatcacaggatcgatatggtgacagtgagagaggagactcgcaaggggccatggacagagcaggaggacctgcaactggtatgcactgtccgtctgttcggtgaacgtcgttgggatttcattgccaaagtatcagggctcaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagaaagaaggcacaggagaggaagaggaacatgtctccatcgtcgtcctcgtcttcgctgacttaccagtcaggctacccagatactccatcaaccattggagttgagggacaggagcttcatggtggcagtggctgcatcacaagcatcctgaagggcacccctccggacatggatggctatcccatggaccagatatggatggaaattgaggcgccacagatgccctcggaggagagctttgttggggggaaccataatgtgtgcagcagccttgccaccccgctgccaccaccaactgtctgggaatactacccagaggcctgctggaaggttgacgatgagatcaagatggcaccacaatttcaatttggttatagtgaaggagttgggccctgcttctgatgccataaatattgggtcagattactaagttatacacctacctagcagaagtgaagtgcttttgtagaaacaagctttagcatggatctgaatatttatctccgcgcttagaattgcaggtctatggatctatgcatggttgctatgtatctatctagtgtgcaagacaagatcatcttaatttgtcctaaaaaaaaaaaaaaaa

SEQ ID NO: 5935 - DNA, 1127 bp, Zea mays
cattgggtacctcgaggccggccaggaggcaactaagactaggtggcgaactcttctctgtactagctttcttcttcttcctcctcttcctcctcccaaacagactggatttcatcaagataatcctgaaactggagccaacaagcagacagagaaagaagagcaagaagaccggctcccagccgatacaaggtaggagtgagcagcgttagatcagttttcatcacaggatcgatatggtgacagtgagagaggagactcgcaaggggccatggacagagcaggaggacctgcaactgggctcaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagaaagaaggcacaagagaggaagaggaacatgtctccatcgtcgtcttcgtcttcgctgacttaccagtcaggctacccagatactccatcaaccattggagttgagggacaggagcttcatggtggcagtggctgcatcacaagcatcctgaagggcacccctccggacatggatggctatcccatggaccagatatggatggaaattgaggcgccacagatgccctcggaggagagctttgttggggggaaccataatgtgtgcagcagccttgccaccccgctgccaccaccaactgtctgggaatactacccagaggcctgctggaaggttgacgatgagatcaagatggcaccacaatttcaatttggttatagtgaaggagttgggccctgcttctgatgccataaatattgggtcagattactaagttatacacctacctagcagaagtgaagtgcttttgtagaaacaagctttagcatggatctgaatatttatctccgcgcttagaattgcaggtctatggatctatgcatggttgctatgtatctatctagtgtgcaagacaagatcatcttaatttgtccttgatgctatggaatacaagggcaaaggtact

SEQ ID NO: 5936 - DNA, 1012 bp, Zea mays
ctcgaggccggccgggaggcaactaagacaagtggcgtacctcttctctgtactagctttcttcttcctcctcctcttcctcctcccaaacagactggatttcatcaagataatcctgaaactggagccaacaagcagacagagaaagaagagcaagaagaccggctcccagccgatacaagggctcaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagaaagaaggcacaggagaggaagaggaacatgtctccatcgtcgtcctcgtcttcgctgacttgccagtcaggctacccagatactccatcaaccattggagttgagggacaggagcttcatggtggcagtggctgcatcacaagcatcctgaagggcacccctccggacatggatggctatcccatggaccagatatggatggaaattgaggcgccacagatgccctcggaggagagctttgttggggggaaccataatgtgtgcagcagccttgccaccccgctgccaccaccaactgtctgggaatactacccagatgcctgctggaaggttgacgatgagatcaagatggcaacacaatatcaatttggttatagtgaaggagttgggccctgcttctgatgccataaatattgggtcagattactaagttatacacctacctagcagaagtgaagtgcttttgtagaaacaagctttagcatggatctgaatatttatctccgcgcttagaattgcaggtctatggatctatgcatggttgctatgtatctatctagtgtgcaagacaagattatcttaatttgtccttgatgctatggaatacaagggcaaaggtactac

SEQ ID NO: 5937 - DNA, 1434 bp, Zea mays
ttgggaccctcgaggccggccggcaactaagacaaagtggcgtactcttctctgtactagctttcttcttcctcctcctcttcctcctcccaaacagactggatttcatcaagataatcctgaaactggagccaacaagcagacagagaaagaagagcaagaagaccggctcccagccgatacaaggtaggagtgagcagcgttagatcagttttcatcacaggatcgatatggtgacagtgagagaggagactcgcaaggggccatggacagagcaggaggacctgcaactggtatgcactgtccgtctgttcggtgaacgtcgttgggatttcattgccaaagtatcaggtttgaggggtggggatccacaaattaggtagctaaattgaagtcacccgcgctaagtcgcaaaagcagctatcagcctctctgaccgactctattcttgcttcccctctccccttctgtatcttcatgcagggctcaaccggacaggcaagagctgccggctgcgctgggtcaactacctccaccctggcctcaagcgtgggcgcatgtctccccatgaagagcgactcatcctagagctgcacgctcggtggggaaacaggtggtccaggatagcacgccgcttgccagggcgcactgacaatgagatcaagaactactggaggacacacatgagaaagaaggcacaggagaggaagaggaacatgtctccatcgtcgtcctcgtcttcgctgacttaccagtcaggctacccagatactccatcaaccattggagttgagggacaggagcttcatggtggcagtggctgcatcacaagcatcctgaagggcacccctccggacatggatggctatcccatggaccagatatggatggaaattgaggcgccacagatgccctcggaggagagctttgttggggggaaccataatgtgtgcagcagccttgccaccccgctgccaccaccaactgtctgggaatactacccagatgcctgctggaaggttgacgatgagatcaagatggcaacacaatttcaatttggttatagtgaaggagttgggccctgcttctgatgccataaatattgggtcagattactaagttatacacctacctagcagaagtgaagtgcttttgtagaaacaagctttagcatggatctgaatatttatctccgcgcttagaattgcaggtctatggatctatgcatggttgctatgtatctatctagtgtgcaagacaagattatcttaatttgtccttgatgctatggaatacaagggcaaaggtactatatctgtttactcacagtataattagctaccctttgagacttttctgttggacatgatgccaacaatacatgttatattgatatagatggtcttaaccaaaagcggccaaaaaaaagcggcc

SEQ ID NO: 5938 - DNA, 641 bp, Zea mays
ggcggccgccagacgtgggtggacgtcactccccgacctggggcactcatggtcaacatgggcagctttcttcagcttgtgacgaatgaccggtacaagagcgtggatcaccgggtgccggctaacaagagcagtgacacggcgagggtctcggtagctgccttcttcaaccccgacgagaagagaaccgagaggctgtatggccccattccagaccccagcaagcctccgctgtacaggagcgtcacgttcccggacttcatcgccaagttcaacagcatcggactggacggtcgcgtgctcgaccacttccggttggaggacgacggccctactcctcttgctgctgctgcacaccacgtctagtcttgttttcgttcgatcgaacaaacagttctcgtcgtcgtctcttttatttttcctgcaatctgaatttcgagttctccaaataaataagggtatccattcccttcatccgcagagcgcgcggatgccttcactagcagctctagttttgctatgtatatagctgtgtgtgtggtacctttgtgactcatatattatgcaataaagtatgctttctcctcgtaaaaaaaaaaaaaaaaacggcccctgaaggtatgttcttcccccaacacaat

SEQ ID NO: 5939 - DNA, 2230 bp, Zea mays
cccccccccaggctcgagctcgacaacacgcagttcctcacctacccgccggagatcaccacggagcagttcttcgtcggcatcaccgcctgccgcctcaactgcctctccggcggctcctgcgtcgcgtccacagcgctctccgacggctcgggcctctgcttcctcaaggtgtccagcttcgtcagcggctaccagtcggccgcgctgcccagcacgtctttcgtcaaggtctgctccccgccgctgcccaacccggccccgggcagcgcggcggcgccctcggccggcggctccggcgtccgcgcctgggtcgtggcggtcgtggtcctgggtgtggtgtccgcgctggtgctctgcgagtgggcgctctggtggttcctgtgccggcacagccccaagtacggcccggcgtcggcgcagtacgcgctgctggagtacgcgtcgggcgcgcccgtgcagttctcgtaccgcgagctgcagcgctccaccaaggggttcaaggagaagctgggcgccggcgggttcggcgccgtgtaccgcggcgtgctggcgaaccggacggtggtggcggtgaagcagctggaagggatcgagcagggggagaagcagttccggatggaggtggccaccatcagcagcaccctccacctcaacctggtccgcctcatcggcttctgctccgagggccggcaccggctgctggtgtacgagttcatgaagaacggatcgctggacgcgttcctgttcggcgacgcgccgccgggcgggaagatgccgtggccgacgcggttcgccgtggccgtgggcacggcgcgcggcatcacgtacctgcacgaggagtgccgcgactgcatcgtgcactgcgacatcaagcccgagaacatcctcctggacgagcacttcaacgccaaggtctccgacttcgggctggccaagctggtcaaccccaaggaccaccgccaccggacgctcaccagcgtgcgcggcaccaggggctacctggcgccggagtggctcgccaacctgcccatcacggccaagtccgacgtgtacagctacgggatggtgctgctggagaccgtcagcgggcgacgcaacttcgacgtgtcggaggagacgcgcgggaagaagttctcggtgtgggcgtacgaggagtacgagaggggcaacctcgccggcatcatcgacaggaggctccccgcagaggacctcgacatggcgcaggtggagcgcgcgctgcaggtgagcttctggtgcatccaggagcagccggggcagcgcccatccatggggaaggtggtgcagatgctggatggggttatggagctcgagaggcctccgcccccgaagtcgtcggacagcttttttagcaccaccacggccagcggcggcaactccagcatggtctcgacagtcgcctcgtcggcggcgcccccggtcgcgccctcgacgtcgccgaacctagagcaggagatggcgttgggaccctccgagtcggccaggaaccgtgaccgggtgacgcggcccctgctgtcgccgcagccgtacatgacgatgtaaaatgtgcgtctgcgtcatcatcatccatccattgcagagatcatcatctggatacacgcacgcaggcagaatgcctgtttctgtcgtccattccaggtttactacagattgtagagcgattacgtagggctacgctgaatttgctcctaacattctggttggcaatatgtaattgtaagcatcaaatttggaccgagtttggtactgggggcattgcaatctgtacaaaatcaccgaaacgagacgacaaactgtagcatggatttgcaggctagtggtttgtttgttttgttcccccggcagctcacacaggcgatatgtaattgcatcataatttcataatactgagctaccgcatactgttgcaggtctcactttttctctttgttttgttttttctagagaagaactggtgcgagtctcctgtgtttctcgtcggtcggtcgcatcgcacgggtcggtcaccactcaccacactgctggaattcttctctgttctggaacacgagcaggatctttcagcgaagcatctccgtcagcttctaaatgcggttcaatgcgaggggcccatcccatggatgaagccatgcatgacatcgtgaggcaaaggcctgctacatctttgcgcgaagccgccatccctgcaatggcagccaggcggcagggg

SEQ ID NO: 5940 - DNA, 1640 bp, Zea mays
ttttttttttttttttataataacttaatttacattcataagtacaatatagaaagagtcattattacataaacaggttcgagtgcttatacttattatatcacaggaaggcaaataccttccataagtttttcttatttttcttcctcctgctttgggacgaccttggagcagaagcagcaaaactcagcagtttcttcaccagagttctagaacgaccgttgaaaaagcgggtgacgagatggagtagcgagtcgacgtgaaggcgctctgcgacggtgtccagtgacagcgatgaactgctccggctgatctactgaacagctctggccacgacgaagggtatcacgatggtgctccggccgattccaggaaaatccggaattctcgagctatggtggatgaactagggcattgagcggtgggctaggtgtgtaacaatgaggaggaacgaggaaaaacactcaatttatagagatcagccactggtgccacgaatttgggcgaagatgagctcacaacgctgaggggatgagtcaccggagttcatctactgtggcgtttgatggggtatgtcttggggcagtaattggctgtccaccccgacctaccgcgacgtggtaacgctctctagtacgtggcatgatcatgaggagttgcggactctggtgatggcatctcaaccgactgcgaagcaagtgggtacggcggccaatgcacgaactcatccgcagccgtgatattttcaccccctcggcaatatccgctccaagtcgtgcacgaatcttcatggtaagcacgaatcatcgcgcccgatcaccagcgacgagatgcactgcatctatgatcttttgcaggtactgtaccacgtcattagccgtttactcatctaacagaacaactctagggcccctcttcttcaaattttatgcagggaactactaatttgactgcatcaaagttgttctcctatatactagcttcaactttttcacagagatcttggtaatttactcactggatcaagcacaatttggctccaaagtcgatcaaataccactgacagtccaatatcggatcacgacttgactaatagcccgacttccagggcattttactccaaattccatacaattcttaggctaagtcacttaatcaaatttgtactactatagtagctctacaactttgccataatgacttatagcaaaccccttatggatcaagagatacagaagcccaaagttaggttattaacattgtttttccaggatttaagagtaggggtgcttatggacttttgccaattactccaagtttcaccacaaaacatggaaatctccaaatataaaagttgcttagtttttgttaatctaccacattgataaatacacttttggcaaaaagtgcatagaatttgaaatcactctataggacactaattagggttttgactccaaactagggttttgagtgtcctagggtacattaagtgcttaacctctataaaccactatttcttgaacatatctaccaaattggtcagatcacttcttagtgttcaccatacaaagtcatatgcttctaatccttggtgagagacactccaacctagggttaagaattccttttaccgggtc

SEQ ID NO: 5941 - DNA, 2859 bp, Zea mays
gatcctctttagtcgacctgcagaccaagatggaaataggtacggtgaaactaggaagccggtgcatccgaaagacggcaacctcttcggatggaatgtgccggatgagcttagggctccgtcgaccagcgaggccttgttaactgtcctttttagtgtcagttctgtcatgtatgttttaatggatccaaagaaaatatttatatggaatgtccggggtttgaattctccctccaagcaacactctgtacgaactttcattgattccgttggagcagacattgtttgcttgcaagaaaccaaaatgcagaatatttctagaggaactgtcctggctattcttgagtgaattttgaagaattcctctttttaccttcctctggggccagtggtggtattcttttagcctggaaaagacatgtacaagcaacagggcataatagagtggacttttattctgtttctgtccaattccagcagtcaaatggccaaccttggtggttaactggtgtctatgggcctcaggacattgatgacaagattctattcctccaagagctgaggcaaatcagaattgattgtcatggtccatgggttgttgcggatggcttcaatctaatttatagggtggaagacaaaaataatagcaacctaaacatggcaatgatggggagattcaggagatttactaatgatgtcaaactcattgatctccctctatgtggcagaaagtatacttggtctaatcatcaatcttcgcctactttggttaaactggacagagctctttgctctgttgattgggaagccctttttcccaactcccttctccagagtgctgcttcacaagactcggatcattgccccttaattcttggtcttacaagcaactgctctggtaaacgaaggtttcattttgagtctttttggccaaaattggagggattccaggaagtagcccaggaagcgtgggcatcgagtagtggtagctcctgccccttcctgactcttgagatgaagttgaaagccactgcacgtgcccttcagaggtggagcaataaaagaattggacatgtggcttcccagcttgagcttgcacgcgaaattttacaccaacttgagattgctcaggatatcagaccattgatcccagcagaaaagtggctgctgcaggagattaaaaggcattctctccttctttcctcaaacgcacaattgctcgtttgaggtcaagaattaattggttaaaggatggggatgccaatactaaactcttccatatgcatgctagatatagaaaaagaaagaattttattcccaggctgctttctggcagtaacatttgtactgaccatggggagaaggccagcctagtggatgacttctacaacaaacttctgggcagcagggtggacagatcaaaaactgtggatttggactacctagggttgccttctcatgatttggaggagctagattcacagtttactgaagaaagaggtctgggattccattaagcagctaccatcagatagggcgcctggccctgatggattcacaggtagattttacaaggcgtgctggctgatcataaaagatgatgctatggcagtgttctctgcaatttggagcaggaagtttgctcactttaataaattgaatacagccttgataacccttattcctaagaaggaggggggctgatgaggtcaaggatttcaggcccatcagtttagttcacagtatggccaagctagtcacaaaaattcttgcaaacagattggctccaaagttgcaggatatggtctcacctcgacaaagtgcattcattcaaggtcgattcattcaagataactttatgcttgtgcaacaaactgccagattgctccatcagaagtgaggggcaaggataatgctgaaactcgacatcactaaggcttttgactctatttcttggcctttcctcctggaagttctccagaagctaggatttgggcagatctggagagatattttaagtggccccttggcaacatcttccactcaagttctcttaaatggaagtctaaggggagttatccatataagaaggggtttgagacaaggtgatccactatcacccatgctttttattttagtgatggatgtgctgggatttttagtggccaaggctgaggaggaagggctgctgcagccacgctcctctagaccattgcaccatagaatatccctttatgcagatgatgtggttttgtttttacaaccaaaagagtttgatattcagattgtaatgagcattttgaaactgtttggagaagcatctgggctggttactaacgtccagaaaagcagaatatatcctatcagatgcagtgaagaagtggtagcccttcaacagcacctaccctgtgaaatctcatcctttccctgtacttatcttggtttacctctgtccttaaagaggctatccagaggtcaagtgcagccaatcattgacaaggttgctgatcaattgcctgggtggaaagctaagcttatgacaaagtctgggagaaaagttcatgtccaatttgtgatgacaggaaggctcatctatctcaccatggctgtggatttgcctttgggagcatacaaggccattgacaagattagaaaagggttcatctggcaaggaaggagaaatatcaatgaaggacactgcttagtggcctagggaagagtgtgtagacctattgaattgggaggactaggggtcttcagccttaaagagctcagttgggccctacggatgaggtggctatggctggccaaaacagaccttgataagccttgggcgttcctgcctatgcaggtaccgga

SEQ ID NO: 5942 - DNA, 6767 bp, Zea mays
gtagtatttatagtacatactaaattagatatatttttaaatttatttttattacaatttatttagagatgtaaattttgctaatagtttttataaatacaactaattctgataactgatggatataaccaattgttttggaataaaacggagagagtaatgattattaacacaaaatagaaaaaaaaacaccgttactgagcttgcctggtaccgtggtacgtacactacactgacaaactgatagccgttactccagctccagtaacccagtccatcggattcaaatttttcgcagaactccgatatcgccgcgcccagacgccaacgcagagtgcgccactcccagctccgcccacctaccaatcacgccgctccacccaccggcaccatcccgagatatggccaggatccaggacggtggcctcgacaacgacacgctgcagcatctgcggagccgcgccacgcagctgctgctcaaggaggactggagggagtacgtcgccgtctgttcccacatcatcgacgccgccgcctccgtcgacgaccgccgcgtactctgctccgcgctagcgcaccgcgccgacgcccgcgcgcggctcggggatgcctccgctgggctcgccgactgcgacgcggcgattgcggtcgagccggcccaccccggggcgctgctctccaagggcgcgctcctgcggggcctcggccggtacgccgccgcggctgactgcttccgagcggcagcgctcgcctccggaggcggtggcgccgccgtagccgaggcgcggcagctcgctgagcagtgcaggcggctggaggcgcacgcgaggagcggggcggtggacctgtccgagtgggtgctcgcggggttctccgggaagttcccggatctagcggagtacgtcgggtgcgtggaggtgcgccggtccccgcatggcggccgaggggttttcgcggtgaagaatgtcgaggcggggactactttgataatcgccaaggcggtggcgatcgggagaggagtgattcctgatgcctccggcagcgacgagaagatgttcgtatggaaggattttgtcgggaaggtgctcgaagctgctgagaaatgtccgaagacggcggctttgatctatactctgtccaccggccaggagaggcaggacgagcttgccgtccctgacatggcaatgttcaggaaagaaacagaggatgacagtctcagtgatggtactaccgcggggaagacgacgaggacacaggaggctgttcaaatggacaggatcttgaaggtgctcgatgtgacctgcttgactgaggacgcgccagccgccgatgtgcttggtaacaatggcgtcgtcaattgcggcgtggggctctgggtcttgccgtcgttcatcaaccattcctgccaccctaatgctcggcgcactcacatcggggaccatgccatcgtccacgcgtccagggacatcaaagccggggaggagatcacatttccatactttgatgtgcttgtgccggtgagcaagcgcagggaggcatcgagagcttgggggttcgaatgcaagtgtgatcggtgcaggtttgaagccgaggactccattcttgggcacgaaatccttaagttagagaactatttgctcagtggaggagacataggagcagtggtgatgcagctggaggagaagatgaggaagtccatggtgaaggagaggcaaaaggcgttcttgcgtgcgtcattctggagtgcatactccgcgttgtatgattctgataagctgatgaagaaatggggaagacgaattccaagcgaggcccttgtagcagagagtgttgctgatgcggtcggcggaaatgagtgcgtgctgagagcaacgctgaggggttccagggacggcaatggctgtggcaatcggctagaggtggaggacaaggtggtgaggattgggagggcaacctatggcaagttggtgaagaggcacgcaatgagagatctcttcagacttacactggatgccgccagcaaattcaacctttagattttgatactgtcactcctactttattccttggttgggcaacttccaataggctcatgttaatcaatgattagtaattattcagcaaatattcttgtttgtttgacatttataagaagtggggtgagacggattaaatatcatccatgagagctttatcttcatgctctcttgattttggtttcagatcattctttcagtgttcacaataattttctcagtttggtccatgtaatttttgaagtgaggttccttaaatttcattatgcttcctttcttttctagactagcaattgcatgacttttcactttggcttcacaaattgactcacaagaaaacaaattcacttttgggttcacaaattcctcttcaggatgtacttttcacttgaacttcatgtataggaacaaggaatggctcagtttttaaggaacaatgtacagatttcatttcagaactctttctggttggttgagtttcagactttttgtaccaagctgatggatcacaatacttgtttccaaagtctaataacagaaactggcaactcctaattgataatataaaagaataaaatacagtatcagatgtctcattttcttggttggcagatcacaaaaaggaacacaaaggctaagcctcctacttgttcgggagttaggtcagggacaccatatgaatgaaagaaatcttaatttggggtcacaccaagattgtctctctcgaggttgggggatccctaaggttggtagtagcaatacccaatatatcacctaacaaacccaatccatgctacatacatacatagcatccatcacttgtagactggacccttcatcaagagcacaatggaggaagctcacatcacgccagcgacgccatcgccattcttcccactagcagggcctcacaagtacatcgcgctcctcctggttgtcctctcatggatcctggtccagaggtggagcctgaggaagcagaaaggcccgagatcatggccagtcatcggcgcaacggtggagcagctgaggaactaccaccggatgcacgactggcttgtcgggtacctgtcacggcacaggacagtgaccgtcgacatgccgttcacttcctacacctacatcgctgacccggtgaatgtcgagcatgtcctcaagactaacttcaccaattaccccaaggtaaatgacctgaactcactgatgttcagtcttcggaaatcagagctgaaagctgaatcgaatgtgcctgaacaccgtgtagggaatcgtgtacagatcctacatggacgtgctcctcggtgacggcatcttcaacgccgacggcgagctgtggaggaagcagaggaagacggcgagtttcgagttcgcctccaagaacctgagggatttcagcgccattgtgttcagagagtactccctgaagctgtcgggtatactgagccaggcatccaaggcaggcaaagttgtggacatgcaggtgagatatcactggtcccttgccattgccaacatgagcatttcaacctgagacacgagagctaccttgccgattcaggaactttacatgaggatgacgctggactccatctgcaaggttgggttcggggtcgagatcggcacgctgtcgccagatctccccgagaacagcttcgcgcaggcgttcgatgccgccaacatcatcatcacgctgcggttcatcgacccgcggtgccgcatcaagaggttcttccacgtcgggtcagaggccctcctagcgcagagcatcaagctcgtggacgagttcacctacagcgtgatccgccggaggaaggccgagatcgtcgaggtccgggccagcggcaaacaggagaaggtacgtgtacatgactgtttcgattcttcagttcatcgtcttggccgggatggacctgatcctgattgattatatatccgtgtgacttgtgaggacaaattaaaatgggcagatgaagcacgacatcctgtcacggttcatcgagctaggcgaggccggcgacgacggcggcggcttcggggacgacaagagcctccgggacgtggtgctcaacttcgtgatcgccgggcgggacacgacggcgacgacgctgtcgtggttcacgcacatggccatgtcccacccggacgtggccgagaagctgcgccgcgagctgtgcgcgttcgaggcgaagcgcgcgcgcgaggagggcgtcgcgctcgtgccctgcggcggcgctgacgccgacgacaaggcgttcgccgcccgcgtggcgcagttcgcgggcctcctcacctacgacagcctcggcaagctggtctacctccacgcctgcgtcaccgagacgctccgcctgtaccccgccgtccctcaggtgagcgcgcccgtcacgtcacgacctccggtccgcgatgcaacgcatatgtggctgtccgcagagcacagcatgcagtgagtggacctgaatgcaatgcacatgcacttgcgcgcgcgcaggaccccacccccccccccccccccgacgtgctgccggacgggacgaaggtgagggccggcgggatggtgacgtacgtgccctactcgatggggcggatggagtacaactggggccccgacgcggcgagcttccggccggagcggtggatcaacgaggagggcgcgttccgcaacgcgtcgccgttcaagttcacggcgttccaggcggggccgaggatctgcctgggcaaggactcggcgtacctgcagatgaagatggcgctggccatcctcttgcgcttctacagcttccggctgctggaggggcacccggtgcagtaccgcatgatgaccatcctctccatggcgcacggcctcaaggtccgcgtctctagggccgtctgatgtcatggcgatttgggatatcatcccgcttaatccacgacaaataacgttcgtgttacaaatttgcatgcatgcatgtaagggaaagcgatgggtttcattggtggcttggcttaagccttaaaaactccgtcgggtcttgcgaaccaccacatcactagtgttttgtactctactcctcagtggaagtgtagtgacagcatacaagttcatcatatatattatcctctttcttcgccggatgcttcccgggaccttttggagaccattactgacaggcgtgtgaaaaaaaggcttcttctgcggcgaagttttgggttcagagtcttggcgtctttgcagcagaaaaaaggtttggaaggatctgaaccctgaaccgaaaatggcttcggaaatatgctcgcatcggggcggggccgtcactcgggatgacgacaagcccacaagcagtgagagcgaagcgatctttggagtttggagacactctcggacccctcggcgctccgcgagctcatcttcgcctcctctgtcgtgtccgtggcggcaccgcgcccgcccgcctcgtgttcgaccaaatcccgcgccccgaccggttcgtgtacaacaccctcatccgcggcgccgcgcgcagtgacacgccccgggacgccgtatacatctataaatcatggtattgtactttattttcaaacggccttaacacaaccatatttttatggtaaacacgttcaaaattgacacaaatttaaaacaggcacaaaccgtagctaaacataagagaatgagagacaacccaaaggttagagatgaaataagctgagtaaacgacgaattcctaccggaaaactcgctttctcgccggattggaagctggggcgaaacacggagaggggggggggggggggggcatgtggttttttttaaccgacgtaaatgcggttgaatgccaatgtgagatatatcaggatctatctatctatactataaaagaaccagttttattttatccaacggtaccattagatttacaatcctacgatcaccaattgctacagaaacgccagaaatcttgcatgccccaccgtcatgccctttccgccaaacagagcagatacaaaattcgcatgctccaccgccaaacagagcagatacaaaatttgcatgccccactgtcattctgtaagaagattttcttcagctataaaaacctcagcggaaggacagggctggcaaagtagtgataaaccttttcactgagccaaagatcttaggttcgacgcagtttctctgaaaaaaaaattgcaggaataaggcttctcggttattctttccccatactccattcatagccgccggcatcgggtttgtcctttttataaatgccttggcatgggccatccccatttcaccatcacaacaattccagatcttgtagagcctgtccagttagtttgaggcatgttctgcttttccaatgtgcccttttctgtagcattgtccattaaggcgctgccttgttaaatgttcctttctgttttagttcaatgatgtcgatggcttcagttttgacaaaccattgggttgttggcggttcatcccatcgtgagtacacgagcaacagatctgaatcatctgatgattgcttcaaggtgattactaacttggaatcacaatgtgatcaagggaaagcagctcttgcccagagaaaaggttgcttcaactggctggcagatcgcccgagctgcagcaaaagatcccaataaggtaatttccttatcgctaatgaactaattgttatatacacgatcctatgcccttatattacctttaaaaatagggaaaaaaatgttaacttc

SEQ ID NO: 5943 - DNA, 1982 bp, Zea mays
gcacgagaccattacctagaacatcctaatcaaaaatacatacatacatagcatccatcacttgtagactggacccttcatcaagagcacaatggaggaagctcacatcacgccagcgacgccatcgccattcttcccactagcagggcctcacaagtacatcgcgctcctcctggttgtcctctcatggatcctggtccagaggtggagcctgaggaagcagaaaggcccgagatcatggccagtcatcggcgcaacggtggagcagctgaggaactaccaccggatgcacgactggcttgtcgggtacctgtcgcggcacaggacagtgaccgtcgacatgccgttcacttcctacacctacatcgctgacccggtgaatgtcgagcatgtcctcaagactaacttcaccaattaccccaagggaatcgtgtacagatcctacatggacgtgctcctcggtgacggcatcttcaacgccgacggcgagctgtggaggaagcagaggaagacggcgagtttcgagttcgcctccaagaacctgagggatttcagcgccattgtgttcagagagtactccctgaagctgtcgggtatactgagccaggcatccaaggcaggcaaagttgtggacatgcaggaactttacatgaggatgacgctggactccatctgcaaggttgggttcggggtcgagatcggcacgctgtcgccggatctccccgagaacagcttcgcgcaggcgttcgatgccgccaacatcatcgtcacgctgcggttcatcgacccgctgtggcgcatcaagaggttcttccacgtcgggtcagaggccctcctagcgcagagcatcaagctcgtggacgagttcacctacagcgtgatccgccggaggaaggccgagatcgtcgaggtccgggccagcggcaaacaggagaagatgaagcacgacatcctgtcacggttcatcgagctaggcgaggccggcgacgacggcggcggcttcggggacgacaagagcctccgggacgtggtgctcaacttcgtgatcgccgggcgggacacgacggcgacgacgctgtcgtggttcacgcacatggccatgtcccacccggacgtggccgagaagctgcgccgcgagctgtgcgcgttcgaggcggagcgcgcgcgcgaggagggcgtcacgctcgtgctctgcggcggcgctgacgccgacgacaaggcgttcgccgcccgcgtggcgcagttcgcgggcctcctcacctacgacagcctcggcaagctggtctacctccacgcctgcgtcaccgagacgctccgcctgtaccccgccgtccctcaggaccccaaggggatcctggaggacgacgtgctgccggacgggacgaaggtgagggccggcgggatggtgacgtacgtgccctactcgatggggcggatggagtacaactggggccccgacgcggcgagcttccggccggagcggtggatcaacgaggatggcgcgttccgcaacgcgtcgccgttcaagttcacggcgttccaggcggggccgaggatctgcctgggcaaggactcggcgtacctgcagatgaagatggcgctggccatcctcttccgcttctacagcttccggctgctggaggggcacccggtgcagtaccgcatgatgaccatcctctccatggcgcacggcctcaaggtccgcgtctctagggccgtctgatgtcatggcgatttggatatggatatcgtcccgcttaatccacgacaaataacgctcgtgttacaaatttgcatgcatgcatgtaagggaaagcgatgggtttcattggtggcttggcttaagccttaaaaactccgtcgggtcttgcgaaccaccacatcactagtgttttgtactctactcctcagtggaagtgtagtgacagcatacaagttcatcatatatattatcctctttcttaaaaaaaaaaaaaaaaaaa

SEQ ID NO: 5944 - DNA, 1881 bp, Zea mays
atcacataaacgtactgcgtttctactttctagtggagaaggaaaagacaattttctcgtaaccttccgggctcctcttcctctcctcgcgttcccccaccaaaccctaatccgagcacccagcgtcccagcccctacccgcttcctctcgcgccggcctttggggctctcaccctgagcggtaggaatccgcagggctccagttgggtgccagaagcatccaagtcgttggcgggagaccgggaaatggcggaaaaagagggggcgaaggttggggcggaagagatggaagagcgggagcaggaaggggaggcggaggaggtggaggtgaagtttcgtctcttcgacggctccgacatcggccccgtgcgctgcaacgccgccaccaccaccgtcgccgctctcaaggatcgcgtcgtcgccgactggcccaaagataaacaaattatcccaaaggctgctagtgatgtaaaactaataagtggaggcaaaattctagaaaatgacaagaatgttgcacagtgcagagctccttttggtgatcttcccagtagtgctatcacgatgcacgttgttgttcaaccatcatcagccaaatcaaaaccagataagaaggcgaacaaattgcccaaaaccactcgttgctcatgtaccatactgtgaactatatgaaggtcaagtccctacgagaccaacaataatttgtacgtccacaaaaatattctgcagagaatttgagaacaaagattcaagatgtccatgccattctctgccaacgggtggcaatggcgaaagacaacgtccccatgttgtaagctatatgtaattgtaacttaggtacaaagagtcgtccctgtgccgtgctgtcagggaaaaaagtctggtggttgcgctgttttactctccaagatgtcttatatgatgtacaagatacagacccttctgggtgtagtgaccttgttcccccctccccttttaaagtttgtggcgctgagtcaatatggatgtaagtcaattgattgaagaaacattttcgactatgcggggctgtttcctctcatttatttatggcctgtttgaggcaagagctaattactagccatctgaaacctcaaaactatttaaaatagtgcatcagagctaattactagctatctgaaagctaaaagttaaaattggctagaattagttctagtgctaattgaaaggctatttttaagtaaaaaaatatttttagctaattactagttatctaaaacctaaaaactagctaaaattagttatagtgcttctgagctaattactagctatctgaaacataaaaaaataaaattagctaaaattagtattagtgcatccaaacatgagattgaatagataagttaatttttagttaaaaattaccttagtttttaagtagtggtcaaccaaattagatagttaattttagcaaatttaaactaattttaatctaataactagtactagttcaatgtttatatcttaaaatataaatgtttatcttaaatatgctcagtagttcatcatcttggacaatgtcataatcattttaatgataaccatcatcatcgggtgtggtgtgtaagcgtttacaagaattggctttacacactacccgccgagatttcaagcttgagcatggatatgacatataatccagttgctcaatttggtggacaaagttagaattatcgtactcacgtaaccattcctcatgtttgacttcaaccaagccaaattaatgttgttgagtcccacgattggaatcgaacccatcacaatagaataataccactttaggattcttatttactaaaatgctaaactctcttaattatatataaatatttatttgctaac

SEQ ID NO: 5945 - DNA, 1975 bp, Zea mays
tcactagaagatacttatgacttatctaagtaatgactaagggtattacttaagataaaagataatcccatcgtttgctatcttcacctaaagttagatgtatatttattttacgacataataggagtcatgcttacaaatttagatagatatactatatccgtttataaatatatgacatcattgattttttttaaaactttaaataataaccttatttaaaagatataatgaattataatttattttgtgtgttctattttactttgtttaaatgtgatttaaaattttatattgtaaaataaatattttaaataagactagtggtatttttttaaaaaaagccaccgccatcgtatattcactcaccaacggtataaaatcatctttctcgtcggtcgatacccgttcggcgttcgcatcagcttgttgctgctgctgaaggaaaagacaattttctccttacctcctgggctcaggcctcaggcgcacagccttctgcttctcttcctctcctcgcgtccccccaccaaaccctaacccgagcacccagcccctcctcgcgtctgctcgcgccggcctttggggctctcactctgagcggcagggacccgcagggctccggttgtgtccaggaaacatcccagttgttggcgagagaccaagaaatggcggagaaggagggagcgaaggttggagcggaagagatggaagagcgggagcaggaaggggaggcagaggaggtggaggtgaagtttcgtctcttcgatggctctgacatcggtcccgtgcgctgcaacgccgccgccactaccgtagccgccctcaaggatcgcgtcgtcgccgattggcccaaagataaatcaattatcccaaagactgctagtgatgtgaaactaataagtggaggcaaaattctagaaaatgacaaatttgcttatatttttgttgctattcttagtccctatgtctatgtgtcgcaaggaggaacatagggctttaaagggaatgagctcagattttcttattcgttgccttcattgtttggtgcctgatttagggaaaaggaagtgtgcctccattattagcaaccacttcttttgttgagattctaaatggattcaattgaaaatattcgaggcatagcagaaacggtatggaatatgctgcagcaaaaagataactaggaattggtttttccctacctctaagcttggtagatgaatggaagatttgagcttaattaattgttttgtggcctaacctcagtgttaaactatcctggtatttatgatggctataccaactagcttctcaaccagttataccgatcagaacattttttttgggaggggggagggcttgctttgctggtccgcgtttgaatcctggtacagcttcttaaggcaaaaacccaggggtgtctccccactgtggtccagttttttttatgatgattgtgcctgaatatacttatataacctatctagatgcaactagggatgaaaacagttggaaacgatattatctatacgaaaacgattaccggttggtcggaattttacccggtttcataattagtctacttattaacgactacaatatgatgttgacagaaatttaaaattcaaaatttttaatacagtaattttcggaaacagtattgtatttactgaaacgataccgttacgaggccctgattacggaattttttgtttcggttttcatccctagatgcaatcactaagagtcattaatttctatttatctgcatccacgaagctacatcatccgatttgttctaagccacatcatatttgaagaaatgtcaaaccatatgttgcctttggttcaaacattaatagtgtaacttcctcttttttaaagaaaagcagaaataatgagttgatctttaacgatgtccacagcgctatgatttcaaaagaaatgttatcaaattttccagaaaaattac

SEQ ID NO: 5946 - DNA, 1138 bp, Zea mays
gatacccgttcggcgctcgcgtcagcttgttgctgctgctgaaggaaaagacaattttctccttacctcctgggctcaggcctcaggcgcacagccttctgcttctcttcctctcctcgcgtccccccaccaaaccctaacccgagcacccagcccctcctcgcgtctgctcgcgccggcctttggggctctcactctgagcggcagggacccgcagggctccggttgtgtccaggaaacatcccagttgttggcgagagaccaagaaatggcggagaaggagggagcgaaggttggagcggaagagatggaagagcgggagcaggaaggggaggcagaggaggtggaggtgaagtttcgtctcttcgatggctctgacatcggtcccgtgcgctgcaacgccgccgccactaccgtagccgccctcaaggatcgcgtcgtcgccgattggcccaaagataaatcaattatcccaaagactgctagtgatgtgaaactaataagtggaggcaaaattctagaaaatgacaagaatgttgcacagtgcagagctccttttggtgatcttcccagtagtgctatcacgatgcatgttgttgttcaaccatcgtcagcaaaatcaaaaccagataagaaggcgaacaagttgcccaaaaccactcgttgctcatgtaccatactatgaactacgaaggtccaagtccctccgagaccaacaataatttgtacgtccaccgaagattctgcagaggatttgagaacgaaagatccaagatgtccacgtcattcttctctgccaacgggtggcaatggcgaaagacaacaacgtccatatgttgtaagctatgtaattgtaacttaggtacaaagagtgggtccctctgccgtacggacgggggaaaaatagtctactggctgccctgttttaccctacacaagattgttctatatgatgtaccacaagatacatacacgctactattttgggtgtagtgaccttgttcccacttcaccttttgaaagtttgttccagagttgagtacccttatgggcactgagtcaatgtgaaatctaagttggttgatttccgaaaaaaaaaaaaaaaaaaaaaaaaaaaaccgaaaaaaaaaaaaaaaaa

SEQ ID NO: 5947 - DNA, 1103 bp, Zea mays
aggagtgatcgtctattttctcatcgcgccagcgcaccgggtcggcacttcctagtggagaaggaaaagacaattttctcgtaaccttccgggctcctcttcctctcctcgcgttcccccaccaaaccctaatccgagcacccagcccctacccgcttccgctcgcgccggcctttggggctctcaccctgagcggtaggaatccgcagggctccggttgggtgccagaagcatccaagtcgttggcgggagaccgggaaatggcggaaaaagagggggcgaaggttggggcggaagagatggaagagcgggagcaggaaggggaggcggaggaggtggaggtgaagtttcgtctcttcgacggctccgacatcggccccgtgcgctgcaacgccgccaccaccaccgtcgccgctctcaaggatcgcgtcgtcgccgactggcccaaagataaacaaattatcccaaagactgctagtgatgtaaaactaataagtggcggcaaaattctagaaaatgacaagaatgttgcacagtgcagagctccttttggcgatcttcccagtagtgctatcacgatgcacgttgttgttcaaccatcatcagccaaatcaaaaccagataagaaggcgaacaagttgcccaaaaccactcgttgctcatgtaccatactgtgaactatatgaaggtcaagtccctacgagaccaacaataatttgtacgtccacaaaaatattctgcagagaatttgagaacaaagattcaagatgtccatgccattctctgccaacgggtggcaatggcgaaagacaacgtccacatgttgtaagctatatgtaattgtaacttaggtacaaagagtcgtccctgtgctgtgcggtcagggaaaatagtctggtggttgcgctgttttactctacaagatgtcttatatgatgtacaagatacagacacttctgggtgtagtgaccttgttcccacctcaccttttaaagtttgtggcgctgagtcaatatggatctaagtcaattgattgaagaaacattttcgactaaaaaaaaaaaaaaaaaaaaaaaaaaaaacccaccgttgttaccactgct

SEQ ID NO: 5948 - DNA, 7051 bp, Zea mays
  misc_feature (4166)..(4166): n is a, c, g, or t
cccatgaacctctgttaaattcgcctgtatagagtttggatggcagaatgacatgtgccatgttaggtgtttgcattaccagattgcttgaatttattgctctgcataccacaagaactactttcagatattctaccatacctctttcactggttgcagaactgtgttaagcatcctttctgtttgcttggattcagaatgatatcatcttgtcagcgctccaaagttctggaaaggttgcagcgctagcatctgaagaaaacgatctgcccatttggatatctgatggcggtccatatgttgttgttactgatccgcttgatggttctcgcaacattgaggtctccatacctaccggaacaatatttgggatctacaataggctggtggaggtcgaccatctccctttggaggagagagctcagctcaactcactgcaaagtggaactcgcctcgttgctgctggatatgtcctgtactcatctgccaccatcttgtgtatcagctttggtgcaggtacccatgccttcacattggattggtcgactggagaattcatccttacacatccttccatccaaataccacctagaggtaaccaagcatatcagtattcagtaatttgctgctttccacgctcttcactgaacattgaacggttgcttgctagtcattactgattgcttagtttcaggggcaccggctgtgcaagtttcactaaaattgattcctgaactctcaacatgagttgtttctgaagaatgtccagataattttcttatgacttagagactgacagatgtaaccttgcagagtgtgcaactctgcttcattaaacaaacatgtttgaaacttgcatcttctagtaattccttttagaggtttttacctttgctcaaaagctacagttgcgtatcattgcagggcagatatattcagtgaacgacgctaggtattttgactggcccgagggcttaaggaagtacattgacacaatcagacaaggcaaaggacagcatccgaagaagtactcagctcgctacgtgtgctcactggtggctgatttccaccggacgctcatatatggcggggtcgctatgaacccaagggaccatctgcggctggtttatgaggcgaaccctctcagtttccttgctgaacaggctgggggtagagggtcagatggcaagaacagaatcctcaccattcagcctgtgaagttgcaccagaggctgcctttgttcttaggaagcatggatgacatgcttgagttggaaagctacggagatgtgcagcagaaggtcaatcctggatatgaagtttaacgatatgtaaaaaaaggttcagattttttcaagcgcccaagcagaaaataaggtaacactcgtgtggcaaccctgtatctgccgatactataccttgtcttttcctctcggtttttagcccaccgcaacttgattgggactaaatccagttgttgttattgttgttcactcttttctgccaaaaattgctgtacttctcagtgaatgtaagttttatgattggcagcttcctcaaccctgcacgcttatatgtgaataatagaaagcttctaaagtctaaggctagtttggcaacctcatttttatgtagtcaattcagcacagtagtagcagtgccatcgtgtgtttgcaaatgccggctgccgaatggatctaaacttgttagatgccttgacaccaccggatctaggaaacatgcaagtcgctcatgactggtgagggttaatactaggagacattacatatatgaaaccatggaattgatcaggacacaaccatgctaacaatcaccatttcacgaacagtatagcagactggtcgctagtggctgcatcacctgacattacaatcggacagtccggatgatacagatgatcgcagggccgtaacatgcgctgaaactctgggcaaagttacagcatagatcagcaaccatgtagtgaatgatagctgacccccccacatcaatccatacaatttttaaaacctatgtggaaggtgggaggatcacagtgtgcatgggtacagcgtaaatgatgtacaaaattacagtgaatctgttcaaactcaattcgatgttcactgctccagcgcgagctgcttgtgccggttgagatcgctgaggtagctcgagcgcgtgtaatcttctgaatcgcccgagtcaaacatcaggggcttcacgattttaggccttctcaccagctcaagtgactcccggtcacccttcaagaaacagactacctgcagcaacaacaaaaaaaactcaagggtcaatttcctcatttgcactttgattagcaggaaagatccacctaccgatttcatactaggcctcgaggttgagctgtggtggatgcacaaggatgccactgctagtgtgtacaccatctcttcagggtcatactcgcccccgcggccgggatccaccagctcttggatgttgttcgcatcaagcagcggttttgccttcatagatgatcaacaatttgtgaattccagggtttcagaagcatgtaattatgatgttcatcttttttattttattttcattctctcctgctactggatgatcaaaattctcttaacaatatcacaatcaaaccaaatggaatgatttgagttcatatatatagtaaagtgtgcgtagtagttttctaaattgtacccatatcactaggctctgtctggatgagtccaccgctttccgcccggtaactagttcaagaagtagaactccatatgcgaacacatcggtcttctcatttatgatcccatgcatgaagtattctggggccatatacctaaaaatagggtgtgaggttcaagttaaaacaactacagcgttatatgttgactatgaaagcatgaccaggagacagccaggctcacccgaatgtgccttcaatgggatacacaacatgatgggtcaatttgtcagggagccactttgcaagcccaaaatctgatatctgtacaaggagggagcaaaactgtaattcttgacatccatgatgatcacataatgggcatgatcagtgtaacctaagagtagaacataccctgaggttggtagtcttcagttagaaggatattagatgccttgatgtctctgtgaattatgcggcgatggcagccttcatgtagataaagcagcccttcagcaattccaagtgcaattttgaacctgactttccacttcaggggctcctttgtacctgatcagctgaactccattttatcactagactaagggcatcacagtaaactttaacagctaatgaccattttatattaaaaaggcagtggttgtgtcatcagaccgtgcatgtgctgcgggagacttaagccagtgagcgtaaatttataaaacagtatgcagaaatggacacatgaaccttttttctcccaactaattgcactttgaagttggaatttcaaacatttctttgaaggattgtgctgtactggcattaaaggtaaagatctgatcccatccaattcttaattaaagtgtctgtcccttttagaaatgtttgcataaagtatgccccaatatcacagaaaatcactcaactatttcattcattagttggctaacaaaagtgctaatgtaaagaggggaatataccatgtagaacagaagcaaggcttccatgaggtgagaactgaagaaccaagtgcagacccccttccacgctaaaccccaggagctgtgctgcgtttgggtggttaacatgggctattattccaagctcagataagaaatcgctaactctgtcctctttgttaccgccttttgttaatctcttcactgccacaaattgtccatcagcaagctgtcctttgtatacctctgcatgccctcccttcccaatcattttctctagaaaagtcagccacaaaacaaattcagtagatactcagggcagctagatattaaagtttggtgaaacagtattagcattaccacacaaaaagaggaaacggttgcctaaaaagataagagctcaaggaattgcatttctatatttgtattgtcacagtatcagaggtactggaatatataaaggttcgtgccaaaagactagtttagattaacatgtgcgtgatcttaactttttnctgctaaaggacagtcacaagtcatcatcattaacctaaagaaccattcatgattaggacctcagaccctcacgtaaatttgtttccaagtgaaatcatagcagtacagttgtaaatccattgcttaatgcaaaagctattttctaccacacaaatgttgcaatgatagtaccaacacataatgattaaatcaccaacatcacaaagcaggccctcccctcccctgcatgttccctgaaccaaaactgtcagttgcagcacaaagctcattgtagtcaaagctccgccatgatggcctccatttcccgatctgagggaggatctcaggagcaatggcgctgcagtccatttggttcttaccactcctcatcctctccaagtaccctctaagccctttgctcttgggtctctgagggaacgtcactgcgctgcccatggacttctttcttctgagtattagactgctgatcaggttcctccactgcacattttggtttgattctgctgactgctcgactgaaacactgtcatccgagtccatgctgccagatactgagatatctaggacagctcgcggagagctccggtcagcgcactcactgctgtcattgctactgctcttggagagggctcctggcatttcatcagcacacccgtcatcttcatcattactgctcttggatccggtttgaggcacttcagcaccgcactcatcgttgctgctcttggagcctgttccaggcacttgactgcaagcaccatcagattcagcacattggctgttgctgtcactaccatgcctatcattgacatcttcactcgataaggcggctacggacccgccgttatcacaatcccccctagtagattcatcggactgtgtctttgtactctcttcatcctctcctgcaaatatagcatgggctgtgacaggcttgtttttaaataattagctgaactatgatcgtgacaaagaagaagaaaaaacagctacctaactacaatcaagaacaggacaaattgcaaagcaagtcacagcaagaaacaaggcacaatgatacgccgattgtctggcttgccttgaaaagcacgtgctgccagaagctatcacatgacgcactctattgaagaagttttgttttcaagaaatacatatatgaatacctcccaaaaaaaattgacatctgcaccaccccatgcccccactgatgttttgttcctatctaccacagagtgacacaggcgttggagatgaaagggggcgcttaaataaaaacagcgaaagtgtccgtttcagaggctttggtagggttggaaattcggcagaatttgaccatctaccagtccaccatacaaaacggaaggaaaagaccgcacgccctgggacttagtttactgtttcgaattcgaccagaatcccaaaacctgacatcaaccatcccctcacaaataaacaaaacgggcaaacggctgttcaaacttcgaaattgcatcagcaaacctcgaagcttggaatctggaaagccataaatcaaatccaggtttacaaagaagggacccgtcagaaatgatggtttccccaagacgagcatcaaaatggagaaagaaaagatccagcagaggctgtgagccacagaagttggggaagtaaggccaggccaccaaaagaagcgccgctcaccttccttatctgacgaagaagcgagaagatccttcagcagccgctcgtcctcccctgctgcctctgcgggaccaagcaggaaaaactccttcagtttcaccatggccggcggcaaggccaggcggttgtcctctcccgcccaaccaaaatagacggaagaatgtacagagatgattccgatgaaaatgaaaggagcaagctttgtatccgctccgcgcagtagaatctctcatggagagggggagaggggaaggggagaaatgaagaataccttccgtgggagccatatatcccctcttcctcctcaccggcaacgacaccaacaccaacttcgctttcaagggcaatcaagctcgtgaaggacggcgtctcgcattgaaacgacactaccaactggaggagccggaaatggaacaggcaaaggcaagcccgcaagacgggagggagacaggggtacttggagctcgcacggcacccaacaaaaaaaatggaggacggaggaggcgcgaggaaattaatactgtacgagtggagacagagagaggttgccggatgagtggtgtggacggcgcagcgcagggcagagagacagaggtggcgggctcttttgcaaaccgccgctgctgtgctttcctttgcgctgcaggcttgcggctattcctcccttctctcaaaaggagagaacatataggccggccgggcggcaggtctagcgacgagagaagggggggaggcgggagagaagggggacgggagcaatggagcactcgaggtctgtctggtggtagtcactagtccctcaactttttttttcttttagtgacatgagtggacctacgaatgcatggcaggaaggagaaggcagagaagaaaatatttgcaaaactttgtgtgatggaattgtttcttgtggagaaggagagagcggagatgcgagagtgggtggtggaaaagcaacggattttgataggtgctttgtgctgtgtcttgtgcctaatcctctcggtaaatcaagtcgatgatagattagatgttgatatctgccttcgtgcaatcaggaatagggatacatcccatgttggatacagtaggtggagggtaaacttatctctcctcgatgatatagacataatgtttgaaactacctcaatttatataaaccggtttattaaaaactatgtgcttccaaaatataaactaagtt

SEQ ID NO: 5949 - DNA, 2215 bp, Zea mays
ttttttttttttttttgatcaggacacaaccatgctaacaatcaccatttcacgaacagtatagcagactggtcgctagtggctgcatcacctgacattacaatcggacagtccggatgatacagatgatcgcagggccgtaacatgcgctgaaactctgggcaaagttacagcatagatcagcaaccatgtagtgaatgatagctgacccccccacatcaatccatacaatttttaaaacctatgtggaaggtgggaggatcacagtgtgcatgggtacagcgtaaatgatgtacaaaattacagtgaatctgttcaaactcaattcgatgttcactgctccagcgcgagctgcttgtgccggttgagatcgctgaggtagctcgagcgcgtgtaatcttctgaatcgcccgagtcaaacatcaggggcttcacgattttaggccttctcaccagctcaagtgactcccggtcacccttcaagaaacagactaccgatttcatactaggcctcgaggttgagctgtggtggatgcacaaggatgccactgctagtgtgtacaccatctcttcagggtcatactcgttaccaagggaaggatccaccagctcttggatgttgttcgcatcaagcagcggttttgcccatatcactaggctctgtctggatgagtccaccgctttccgcccggtaactagttcaagaagtagaactccatatgcgaacacatcggtcttctcatttatgatcccatgcatgaagtattctggggccatatacccgaatgtgccttcaatgggatacacaacatgatgggtcaatttgtcagggagccactttgcaagcccaaaatctgatatctgaggttggtagtcttcagttagaaggatattagatgccttgatgtctctgtgaattatgcggcgatggcagccttcatgtagataaagcagcccttcagcaattccaagtgcaattttgaacctgactttccacttcaggggctcctttgtaccatgtagaacagaagcaaggcttccatgaggtgagaactgaagaaccaagtgcagacccccttccacgctaaaccccaggagctgtgctgcgtttgggtggttaacatgggctattattccaagctcagataagaaatcgctaactctgtcctctttgttaccgccttttgttaatctcttcactgccacaaattgtccatcagcaagctgtcctttgtatacctctgcatgccctcccttcccaatcattttctctgaaccaaaactgtcagttgcagcacaaagctcattgtagtcaaagctccgccatgatggcctccatttcccgatctgagggaggatctcaggagcaatggcgctgcagtccatttggttcttaccactcctcatcctctccaagtaccctctaagccctttgctcttgggtctctgagggaacgtcactgcgctgcccatggacttctttcttctgagtattagactgctgatcaggttcctccactgcacattttggtttgattctgctgactgctcgactgaaacactgtcatccgagtccatgctgccagatactgagatatctaggacagctcgcggagagctccggtcagcgcactcactgctgtcattgctactgctcttggagagggctcctggcatttcatcagcacacccgtcatcttcatcattactgctcttggatccggtttgaggcacttcagcaccgcactcatcgttgctgctcttggagcctgttccaggcacttgactgcaagcaccatcagattcagcacattggctgttgctgtcactaccatgcctatcattgacatcttcactcgataaggcggctacggacccgccgttatcacaatcccccctagtagattcatcggactgtgtctttgtactctcttcatcctctccttccttatctgacgaagaagcgagaagatccttcagcagccgctcgtcctcccctgctgcctcttccgtgggagccatatatcccctcttcctcctcaccggcaacgacaccaacaccaacttcgctttcaagggcaatcaagctcgtgaaggacggcgtctcgcattgaaacgacactaccaactggaggagccggaaatggaacaggcaaaggcaagcccgcaagacgggagggagacaggggtacttggagctcgcacggcacccaac

SEQ ID NO: 5950 - DNA, 1156 bp, Zea mays
  misc_feature (23)..(23): n is a, c, g, or t
gacttgtttagatgtcatcgctnaaagtgtgttggtcgaatcgatatgtcaccaaataatcctatatatacacatgtactgtgatggatacaagtggcctcgtgtggccgaaagaagagctcccgtttgtttcctcgcgcgcttacgttgtcggcggagcatgaccaagtgtccgtgataagccccggatgagcccccgatggccaaggtctcgcctcctcctcgggatcatcatgtcgtcgttggtccctcgagagcggcaaattaataagtaaatgagccccgtcgcgtcgccggacgcccgggctcccgtcttcttcctcgaccgctaaccttaccggtccccaaatgtcgcctctcgtgctgctgctcctcgcgcacctactcgccacggccactgcagcgggagcagcgcggaccagggacgacgggcctcctgctccgtcgtcgtcgtccccgcgggtgccggcgacgacgccgccgtggccggaccagttccacgcggtggtggtgacgaacctgagcgcgcgcggcggcgggctgcagctgatcgacctgtactacgactggccgcgagggcgcgacctgaacatcgtccgcgaccagctgtccggcgagcggcgctggagctggaacgtggagtggagcaacggcaccgccttcctgttcgactccgcgtcctgccgcaccttccagttcgccgtgggcctcctgccgcccgactggaaggcccgcggcgccgcctacctggggcgcgaccgcgtcgacggcttcgactgccacgtctggtccaacttcgtcttcgcccgctactacgaggacgtcgccaccggacgccccgtcagctggaacttcaatggtatgtacggatgtacctggctgctatgaattgatgcagcagcagagcagtgatgcatggtttctgcatgcggctcttgtcttcttcccagggctgcagcggcatgtgctgagcttcgaggcgggggcagtgctgcaggactcctccaagtggcaggcgccggcttactgcttcaccaacaccaatggcagcagtgccgacgccgccgcttcgtcttcctgagatcacgtcgctgggcctccggagtccgggctccacctgcagctggacgctacatgtcatttggcagtcggctct

SEQ ID NO: 5951 - DNA, 1084 bp, Zea mays
gccggccgggttgccggccgggcgggaaattataataagtaaatgagcaactttttctcgcgtgtggtccagactcccgtcttcttcctcgaccgctaaccttaccggtccccaaatgtcgcctctcgtgctgctgctcctcgcgcacctactcgccacggccactgcagcgggagcagcgccgaccagggacgacgggcctcctgctccgtcgtcgtcgtccccgcgggtgccggcgacgacgccgccgtggccggaccagttccacgcggtggtggtcacgaacctgagcgcgcgcggcggcgggctgcagctgatcgacctgtactacgactggccgcgagggcgcgacctgaacatcgtccgcgaccagctgtccggcgagcggcgctggagctggaacgtggagtggagcaacggcaccgccttcctgttcgactccgcgtcctgccgcaccttccagttcgccgtgggcctcctgccgcccgactggaaggcccgcggcgccgcctacctggggcgcgaccgcgtcgacggcttcgactgccacgtctggtccaacttcgtcttcgcccgctactacgaggacgtcgccaccggacgccccgtcagctggaacttcaatgggctgcagcggcatgtgctgagcttcgaggcgggggcagtgctgcaggactcctccaagtggcaggcgccggcttactgcttcaccaacaccaatggcagcagtgccgacgccgccgcttcgtcttcctgagatcacgtcgctgggcctccggagtccgggctccacctgcagctggacgctgcatgtcatttggcagtcggctctcatcttgatggttgactcaggagagccttttactattagtcagtaccgattctcgcgtcgcgtgggctagaatccgtgcgatgccacggaacataaattgacgagccttcaatagcgcgacggacgacgtgagtataatggtgggattgtttagtggtgctattaagaatcaactcaataatcataatacatattgaatcctgtcatttttattgaaagagatccaagaaattccaacacacgtttaagcat

SEQ ID NO: 5952 - DNA, 1025 bp, Zea mays
cattgggtacctcgaggccggccgggggccgggaggactcccgtcttcttcctcgaccgctaaccttaccggtccccaaatgtcgcctctcgtgctgctgctcctcgcgcacctactcgccacggccactgcagcgggagcagcgccgaccagggacgacgggcctcctgctccgtcgtcgtcgtccccgcgggtgccggcgacgacgccgccgtggccggaccagttccacgcggtggtggtcacgaacctgagcgcgcgcggcggcgggctgcagctgatcgacctgtactacgactggccgcgagggcgcgacctgaacatcgtccgcgaccagctgtccggcgagcggcgctggagctggaacgtggagtggagcaacggcaccgccttcctgttcgactccgcgtcctgccgcaccttccagttcgccgtgggcctcctgccgcccgactggaaggcccgcggcgccgcttacctggggcgcgaccgcgtcgacggcttcgactgccacgtctggtccaacttcgtcttcgcccgctactacgaggacgtcgccaccggacgccccgtcagctggaacttcaatgggctgcagcggcatgtgctgagcttcgaggcgggggcagtgctgctggactcctccaagtggcaggcgccggcttactgcttcaccaacaccaatggcagcagtgccaacgccgccgcttcgtcttcctgagatcacgtcgctgggcctccggagtccggtgtccgggctccacctgcagctggacgctgcatgtcatttggcagtcggctctcatcttgatggttgactcaggagaggcttttactattagtcagtactgattctcgcgtcgcgtgggctagaatcttaagacataattattactagttactaatctctgtaccaaaaagatgtaactacaggttacattacatctttaaaaaaatatgagaagcctcaacactaggcaaaacacccttagtctttgctgaggtactatagtattgatcccgcc

SEQ ID NO: 5953 - DNA, 789 bp, Zea mays
ccggccggggtggtcagaccgtctcgtcctcccttcccgtctaggtgtggccgtctcgcttcggcttctcccacttccttccccagatctccaagaccaggagccccggcgaagccaccgcgcccgcagcgatgtcggcgagcagcacgcccgtagacgctttgggggagccgatcccgacttcgtcggtgctgatggcagcgtcgaagcacatcgcagtccggtgccgcccggagaacgtcgccttcctcaactgcaagaagaaggaccctaatcctgagaagtgcctcgagaagggccgccaggtcacaagctgcgtccttagcctgttgaaagaacttcatcaaaagtgtcccaaggaaatggatgaatatgctggttgcatgtattactacaccaacgaattcgacttctgccgtaaggagcagcaagcttttgaggaatcctgccccatttccgagtagatcttgagagttttacttccagggatctttgcaaataaggaaagaaaggctgaaaaaccgagttcatgatctcccatgtttgttgtcctcatggaatttttactggtggatgaatagcacaccaaggagctattcaccacaattgtccccctcaatattttttttttcaaactggaagtgacttagccgtatgctctaagatggtgaatggtgatgaatgatgatgttttcaccctaaaaaaaaaaaaaaaacgattcgagcggtgactggcgagccgccgcattgcgaccacagacagcgcgcgcttcaaggcctttttttttt

SEQ ID NO: 5954 - DNA, 1126 bp, Zea mays
cagattttgccattttggagaaagcgaagattcaacataggccacctgtcaccgactcaccggtccccaccatcgtcccttcgtctccttcctcgtctgggtgtggccgtctcgcttcgccccttcctctctccttcggttctcctccagatctctaagaccaggagcccggtgaatccacctcgcccgcagcgatgtcggcgagcagcacccccgtagacgcctcgggggagccgatcccgacttcgtcggtgctgatggcggcgtcgaagcacatcgcggtccggtgccgcccggagaacgttgccttcctcaactgcaagaagaaggaccctaaccccgagaagtgcctcgagaagggccgccaggtcacacgctgcgtcctcagcctgttgaaagaacttcaccaaaagtgtcccaaggaaatggatgaatatgctggttgcatgtattactacaccaacgaattcgacttctgccgtaaggagcagcaagcttttgaggaagcctgccccatttccgagtagatcttgagagttttacttgcagtggtcttcgcaaataagggaaaaaaggcagaaaaacagcgttcatgatatcccatgtttgttgtcctcatggaatttgtactggtgaatgaatagcacagcctggagctattcaccccatttgccgcccctcaggattttagagcaggcgaatgctctaaaatggtgatgatggtgttttctctttatggttcacaaattacatttggcggactcgctgttatttctgtctgtcccgagtgtgttaacccgctaatctgatcttctgctctggacttccacaaggctatggcacaactacaatgtactcctacatcatatcgtctcaaatctgaatagtctgtactctgtacagactacagaaaaaaaacattcattgccttctttaaaaattcacagaggatgaggcgctgcgttgcagttgctggctttgctgctgccagcggacgggcgcagacatgagctccgggggagaaggtgtcaatgcgtttcagcgagagccgagagctgcgtggggatgaaaaattatgatccgaacgtatggctgttgcttgccatggttcttcacgatcacgaag

SEQ ID NO: 5955 - DNA, 1613 bp, Zea mays
  misc_feature (1208)..(1208): n is a, c, g, or t
cacgggggcccgcgccgccgaccccgaccttcgatcccgccgtgagtggtcagaccgtctcgtcctcccttcccgtcaggtgtggccgtctcgcttcggcttctcccacttccttccccagatctccaagaccaggagccccggcgaagccaccacgcacgcagcgatgtcggcgagcagcacgcccgtagacgctttgggggagccgatcccgacgtcgtcggtgctgatggcagcgtcgaagcacatcgcagtccggtgccgcccggagaacgtcgccttcctcaactgcaagaagaaggaccctaatcctgagaagtgcctcgagaagggtcgccaggtcacaagctgcgtccttagcctgttgaaagaacttcatcaaaagtgtcccaaggaaatggatgaatatgctggttgcatgtattactacaccaacgaattcgacttctgccgtaaggagcagcaagcttttgaggaatcctgccccatttccgagtagatcttgagagctttacttccagggatctttgcaaataaggaaagaaaggctgaaaaaccgagttcatgatctcccatgtttgttgtcctcatggaatttttaatggtggatgaatagcacaccaaggagctattcaccacaattgtccccctcaatatttttttttcaaacttgaagtgacttagccgtatgctctaagatggtgatggtgatgatgatgatgttttcacctagtggttcacagaatacatttggcagacttgccgttatttctgtcctgggtgtgctaagatattaatctgatctccagctctagaccttgtttctgtcacaaggctataccaccacaatgtactttcaccgtccaaaaaaaagcataggttttcaacaattgagcttttctaagtttgattatgtttacagaaaagaaacactatttatgcatttgatgatatttattataatgtttatttcgtattataaatgttagtgatgttccctctaatagatttggtcaaatttaaaattgctggagtcatgtaccgtttttttattataaatattaataatgttcctcaaatagatttggtcagatttatatttgttgggagtcctgcactgttttggacggagggagtacatcatgtcgtctgaagttggtgattgtgttgcagttgctggattggcgcttgccagcgaacgggcgatnggttctgaggtgagaaggcgtcaatgcgtttcagcgagagacgatagctgcgtggcccttcgcgatgccgtctttttatcacgtgttaggcatccctgtaggttctagtgcagtacagtacagcaatagcttctactttgggagccttcgcctcatcagtacgtgtccaagtgtggactcagtcactcaggccatccgcaaccgttatctctaaattttttcccctatatcactttttctccctatttccctccctattttttcatctcccgcatcggttccccctaaatactcccctataccccactacaactataaaatatcattttttatatcaattatcaattttttatctactaacaattactcgtggacccacaacacagtgtgtagggtgatgaacag

SEQ ID NO: 5956 - DNA, 2987 bp, Zea mays
cgatccgaaccaacctaacacacgagtcttttgaaccaaataagagttattataagttaaactttttctaatccgcatcaacccgctaacaaatacgcactaaaatttaaagtcgattacctatggataaagatggatatgaggtgccaaactccgtggaaatttactattgacatctctaaggacggcgagtgatattcgtgcggaatttctagtgatccgagccggtgcgctgcgggggagatattttttcttgcgcgctccggaacccgacaatccccacgcatacggcgtgtccggcccaccgggcccctcggacctcggcctcgtgagactgacgtggaccctcgcggcaatgcgatcttttataagcgcccggcaggcgtcgtgtggagctcagctattcgcgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggccgccgcccggcgccgccgcgtcgggagcacgggcacggcgaggtgcttcctcagctgctcctgcgcttccagaggtacctgcaccgtttgtttccggattggtctctggcttcagctttcgccaatcgttcctggctctccctccagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcggcgccgggggccaccagcactggtggacggcgctggagaacaacttcgtgctggaggccaccgacgacgagtacggcggggtcgtcgtcgacgccgaccggctgccggccgacagggccgccttcgcgcgctccctcgcggcgtcgctctcctactggaagtccgtggtacggctggcccccccgtttctgatctctctcccgtccatccgatcggcacaccttgggaaggtttgagttcggtgctgaaggacggccgtgccgtttgctgattcgtttttgctacggtgttgatgctgcaggggaagaaaggggtgtggttgaaattaccggtggatctagccgagttcgtccctttagcagtgaaggtacgaatctggtcttcagaatgaatctcggtcccgataatcagttctgcaatgctttccgacatgtgcagcggagactccgaaccaatagaatccaccaactgtttcttaacactcagagctctttctgaaactctgttctgcaggaaggcttcaagtaccaccacgcggaggaagcgtatttgatgatgacgtactggatccccgatgaaccgaatatgctcccagcaaatgcttctcatcaggttggggttgggggttttgtgatcaacgaccaaatggaggtgagcggggtcccgtctatgtccacgcttctctttcgatgggaacggaacggacaggcattctcttgtgtttctgaactctgatggcattctcttgaacaatctcatcaggttctagtggtgcaagagaagtaccgcggatcgtcgctggatggcgtatggaaactccccacaggcttcattcttgcggtgagaaaacttacagtcttgtccaaggccgtcaggcatggtgtgtgactttgtgtacaatttttctgttactaaaatttccttctgtcgcagtctgaggaaatctacacgggggccagcagagaggtgaaggaggaaaccggggtaagaaaatggaactcgctagaaggctagagcccagtactttccgatccgtcttcctcgtagggatcgattctcacaagcgctgtgattgcgatacgctatgcaggtcgacaccgagttcgttgacgtcgttgctttcaggtacagtagtttgtttgccttcctctgtttcggcgattaacccgatataattgcgtctcagtatcttcgaactgtaggctaaatttgtcctacgtaacgtgtgttgccaggcatgcccacaacgtggcgtttcacaagtccgacctcttcttcatctgcatgctgaggcctgtgtcgagtgagatcaagattgacgagacagagattcaggcagcgaaggtgcgtctccatctttatttcaaggggatttcatcacgttttttcttttaaacgagcctgcaaaactagtactggagaaaaaaaacatttcaggcttcatttcacgatattcagataatgaatgaagttcgggacagtgatcgatcgataagcttgcgctaacccaccgagagagacgtttattttcagtggatggcgctggaggagttcgtgaagcagcccttcatccaggaagaccacatgttccagaagatcatggacatctgcatccagcgcctccgcaagtgctactgtgggctgacgccgcaccacgtcgtctccaagttcgacgacagaacgtccacgctctactacaatgtcgccgagcccgaggacgtgaactgcagcgccgcctgatgtaatatgatgtgagggggagggggagccaccccagcatctactagtctaatttttgctgcgcagaagtttcatgatgcagcagtgttagtcgtgcgattactgagagtgaaatactagtggcagactgcgcgaggcaatagagttgccgagcctgtacatatacgtgtagggcatatgcataaccagagagctgtatatcccggggcggatccccgggcaggaggaaaattttcattgccgccgtaaattacaatttaactttagctcgccctaaacataatcaacctctcttttttctttgtcctgagacccgcctgtagctatattagcttatagctcagtgctcgtgcgttgcaacgagatcatataatagctcgataacttatatatcc

SEQ ID NO: 5957 - DNA, 1531 bp, Zea mays
gcacgagaccattccctagcgtccccccaggccggcagctattcgcgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggcggccgggcgccgccgcgtcgggagcacgggcacggcgaggtgcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacggcggggtcgtcgtcgacgccgatcggctgccggccgacagggccgccttcgcgcgctccctcgcggcgtcgctctcctactggaagtccgtggggaagaaaggggtgtggttgaaattaccggtggatcgagccgacttcgtccctttagcagtgaaggaaggcttcaagtaccaccacgcggaggaagcgtatttgatgatgacgtactggatccccgatgaaccgaatatgctcccagcaaatgcttctcatcaggttggggttgggggttttgtgatcaacgaccaaatggaggttctagtggtgcaagagaagtaccgcggatcgtcgctggatggcgtatggaaactccccacaggcttcattcttgcgtctgaggaaatctacacgggggccagcagagaggtgaaggaggaaaccggggtcgacaccgagttcgttgacgtcgttgctttcaggcatgcccacaacgtggcgtttcacaagtccgacctcttcttcatctgcatgctgaggcctgtgtcgagtgagatcaagattgacgagacagagattcaggcagcgaagtggatggcgctggaggagttcgtgaagcagcccttcatccaggaagaccacatgttccagaagatcatggacatctgcatccagcgcctccgcaagtgctactgtgggctgacgccgcaccacgtcgtctccaagttcgacgacagaacgtccacgctctactacaatgtcgccgagcccgaggacgtgaactgcagcgccgcctgatgtaatatgatgtgagggggagggggagccaccccagcatctactagtctaatttttgctgcgcagaagtttcatgatgcagcagtgttagtcgtgcgattactgagagtgaaatactagtggcagactgcgcgaggcaatagagttgccgagcctgtacatatacgtgtagggcatatgcataaccagagagctgtatatcccggggcggatccccgggcaggaggaaaattttcattgccgccgtaaattacaatttaactttagct

SEQ ID NO: 5958 - DNA, 1672 bp, Zea mays
gagaattccctccgaagattgaagagatttaaatcccttcctagttatttttgactaagagaggatttaatgtcctctaatctctttctggattggtcacggggccgggccggcggccccattgccgtctctaccgaaaacccagacaaagcccgagctacgcacgcccccgctgcctcctttctgccgtcccaacgccgccggagtctgtcgccaccgtcgctgctctcccgccttcaccgcgcccaactctcctccttgcctcccctgcgcgcttcagccgcttcactccccatcgttttcgcctggccaggatctactgggaccatggatcaagaaaaaaaactagaagtatctaataccagccatacttacaagcatcattgtagcgttggagttgacgtccacgagatcttttttaagaggagcagattgcgggttgttctgtcatacattggcattattttccttcttgtgaatgcctgccaaccattgctgacaaaggagagcctatctcttggatctgtttggaatattacgtttgctgttctggtcgccaaatgtttgcaatacaaacctgtgaagagagaatcagtagtgataatgccagcttttggagttcagctagaaatacatttttggagtggaagagttgatcatcgttttgtgcccgttggcaagattctcaagccaatgataaatgagtgcgtgacaccggtgacctgttactggagcttggcgctgcttctgcgtgatgaagaggaacttctgctcgttttccagagatctcgtcctcctgtcaaaatgttggttccaatatggaaagctctctgcacgttgacaaactctcaacacccaagcccttctcaaattcctaaccatgacccttgaggaacatgagtcagctggggcgttgtgtagatgtacgtatcatcagaactggcgcctccccttgagccagattcagataggaactgttgatgccaccataggacgtaaccagtgctaggggcattgattgttagggagtgatttcggctggaagtgtatacggataaacactagcaatttgtgacactgaatactctcctttacttgcatgcttcattttgttggatatctgaatgaggtgctgaatataagcaaatttaagtgaaactttggtatgtacgtaaagatgcaaacttttgttaaacaatatcttgtctcgtgtgccacataagtacttgttgagttattcacattccatatggattggttgatattgaaaggaatcagaaagaattttgatttggtagggattcaaatatagattgagattaaaacgaggaggcctgagtgggaggctacaagaagtatcaaagtgaaatgtgcagggacaagcatgtgaggtgtcatgttccatgcagagatccaaatgcagtcaaacaccgaagtacgaactagtggagtaccatatgcacgtgccctgtctccgattcgtaacccagtaacccttgcatataataatactggtgagctttaaccacaattaagagcttggttgactttacaaaaataaaaaaaaaatcagaagaaacactgtagagcctgttcagtttattagcactttcaggatctgagaaacaatgtttgcgcctgcagccctagcaatgtaagaccatcaggggtc

SEQ ID NO: 5959 - DNA, 694 bp, Zea mays
aaaggagaacgaagaatttattacttggttttcttttctgtttttgtatgtcccttctcagcgacaaaggttcagtaatatactctcgttcacggtgttagcccacacgcgcctacggcccacgtactcttacatggccccttctgtgccaaacagtctcacattttccgccgcgacgtgcgaaccgctgcttcctcggtactgcttgacgtgctaacactctcccttgtgctcacccagccgagggatgctgacacgtccctcttcggatccctctccttgagacgcttcacgaccctctctacgttctcctggtgttccttctgtcgacgcttctcggatttcatggcggaccacgtgttcaccaggaagacgctcaggtagatcagcgcagatattggaagggccacgaagagggcaggaatccatcggagtcgcaccaagtagtccgctaagaccttcttccttttgggtcgcgctcgcaccagaggatccgccatgtatgtctctagtagctctagctagctactattgatcctccaaattaaacttgcctgcgtgcatccctggaaattaatccaagtgcaaaattccacaaaaaaaaacaataattaactagaaagacattgaatggatgtatgtagcagagagagagagacgcaccttgcctgcgtgcatccctggaaattaatgg

SEQ ID NO: 5960 - DNA, 2530 bp, Zea mays
tgtcattttatcattttagcatattttcttttggagttcaatatgagttttactcataatccaaaagacattgtgtactccttatttttcccacagggtttttgaggagataatatcttggaagacagctgacagatgatcaaatggacttggatcaagggggagtgttacaatattttgtgaccaaaggggctcgacaaacacatccccaagggacacaccccttagggatgacccatgtcatatgtatataaacctgtcttccctgcaataaagccaacacaactgtcattttgcactattcctctccattctctcgaatctcgttttcactgagttacaacagattctttcagctggtcactgcatcgaccacgtcagcatccgcagcttcagcttcagcctggagcacctcctcctgtgtcttcttgcctttcttggacttgtagtgggcgctcatgaaggtccctacggcgccgtacttgcggcggcagtggtggtagtgggaggcgtcgaacatcctccagaagtccttgccgctgagctcagacacggcgtactgcgcctggtagccgtggttgctgatgacccactgctccagccggtgcacggcttgggcgccgtcgaagtcctcgccccgcagaacaggggcgggggcgtagtagaagccaacgtcggtgaacatctgcgcgtagctggtgtcacccttcctgcgatgctgctcgaatcctggctccggccgcaccatcgtcttcacggggagcttgaacaggcgatgcgggcacagccacactgggtagacctccagctcacggtgagcaaactccagcgcgtcgctgagcctgtgaaggggcagcagcacgtctcctggatgacgtgcctgtcatggtagtagttcctgatggcttcgccttgggtgatcttgagcaaggagatctttggcggcatgagccagccgagcaggagcctgaaccagagctggtcgccgaacgggatgatcagcttcccttcccagtacagggacctggtgtggcgatggtagtactccctcgtggggatgtactccacgaactcgcccctctcgagagccgtctcggcgtgctggtagaaccagggcttgaaccaccagcccacacggttgatgatcctgccgctgcccttcgtcctcctcgcctcctgttccgaggcatacacgcccgtcatcatcacgccctccgaggacgagtacaccatcccttccacaaagtcagggacctttgccggcaggaacaacgaatcagcataagcctccgcgatctccttgagggtgcccctgacaggagtgtacgtgagcctcatgtactccttcacacgaacgagcctgatctcagccgaaaccaggagcccgatcgtgccttgcgaccatggcatgccatagaagaggtcggagtgctcgttgtccatggtggctctcacgacctgcccatccgcaagaacgacctccatggagacaaccgtgtcagagaagaggccgtagacgtgagagctccccgaaatcccgtagccgtttatcagaccaccgacggtaaggtcgtccaactcaggagccacggcgagcgagaggttcatggggcaggtagccttggttatctgggccatgctgacgagaggctccaccctggcgaccatcctctccgcgtcgatctcgaggatgttcctcaacgcggagaggtcgacctcgaagcgtctggcgcgcttgtagtccacgttgcgcatgcccacgaccacccacggcttcctcgcggtgcagacgaggccgtccctcttcggatccctctccttgagacgcttcacgaccctctctacgttctcctggtgttccttctgtcgacgcttctcggatttcatggcggaccacgtgttcaccaggaagacgctcaggtagatcagcgcagatattggaagggccacgaagagggcaggaatccatcggagtcgcaccaagtagtccgctaagaccttcttccttttgggtcgcgctcgcaccagaggatccgccatgtatgtctctagtagctctagctagctactattgatcctccaaattaaacttgcctgcgtgcatccctggaaattaatcgagttgcaaaattccacaaaaaaaaacaataattaactagaaagacattgaatggatgtatgtagcagagagagagagagacgcaccttgcctgcgtgcatccctggaaattaatggagtgagtgctagcagcaccctctgtttatatatagccagtggcccctgtacatgcaatccatctatgcttatcacgtaaaaagtaccggtatccaacaccaaaaagaattaaacgtttcatgagataaatgtgatccatcaaacattgtaccggtaaccaccaacaaagaaaaagtaaacgtttcatgttcgcagaaaaataagatacatgtgatccatctagcgctgtactggtagccaccatattatcaataaaaaaaacgaattgcaatttttttgtgggaacatataaag

SEQ ID NO: 5961 - DNA, 440 bp, Zea mays
acacgtccctcttcggatccctctccttgagacgcttcacgaccctctctacgttctcctggtgttccttctgtcgacgcttctcggatttcatggcggaccacgtgttccccaggaagacgctcaggtagatcagcgcagatattggaagggccacgaagagggcaggaatccatcggagtcgcaccaagtagtccgctaagaccttcttccttttgggtcgcgctcgcaccagaggatccgccatgtatgtctctagtagctctagctagctaccattgatcctccaaattaaactgagaatgtgcagtggagtggcatttttccaagtgcaaaattccacaaaaaaaaacaataattaactagaaagacattgaatggatgtatgtagcagagagagagagacgcaccttgcctgcgtgcatccctggaaattaatt

SEQ ID NO: 5962 - DNA, 1265 bp, Zea mays
attgggtacctccctcgaggccggcctgatcccaatgtgcccggcccggtccctctgcactgcgcccatccatccttaaaccctcctgcgcgcgtaggcctctcgctcgtctcgtctcgtccttccccagcacaacctctgctcctccttcgccaggtgcctcttcgttctcctctccgtttccctgcgtggcgcgcgcggcgctccgggctatatcagggcgaaataactggccgcgctgcacgccggccgccgcgagaagaagcgctcgccccgcgcgctctgccgctggttcggccgtagtccgtcgccgctgattgatcctgcaggaaaaacagggcaaggagctactttgagcccgagactgaactgaagaagatgatgatggccgaggtggccaaccacagcaagaggaaccacacggacagctacttcagtggcaaggccgtcgccgtccccgccgccgcggccaccagctcggaggagttcggcagcatgtcgtcgaagaagccgaggaatgccagccccagactcgcgcccgtatcaccaaaggagaagaaggacaagatcggcgagagggtcgcagcgctccagcagctcgtgtcaccgttcggaaagaccgacacggcttctgtcctgcaggaggcgtcggggtacatcaagttcctgcaccagcagctggaggtcctgagctccccttacatgcgcgctcctccggccgctggcgctgcgcctgaggacccccagcgctacagcctccggagccgcgggctgtgcctggtgccggtggacctgacgctgcagctgacccagagcaacggggccgacctgtgggcgccggcgcacacggccaggcgaaggtgaggactgaggagacgcccctgtcgacctctcgccaggaggagccggcctgtctgtccggagggaaccgcgcaagtgctgccgcgtctgcgtgcgcgccgtggagtagagtttccaggcccctgactgacccgattcgacctcctagcaagcaagcgtgcgtgtccgtatcagccgccttgtattatactcctagtagtagtactctagtgacctgcctggtggtctggtctctccttgttgtccgccgtatatgtgttgagcggcatgtggattagaagcctgtgtggctggctgtcagcaagcagagcggcagtttgatgcctgttccttgagatggatagtgttatcgagttcagaagaataccatgcgcgtgtgccaaaaaaaaaaaaaaaaagcggcc

SEQ ID NO: 5963 - DNA, 1678 bp, Zea mays
cgggcccaggtcggaaacgcagacgcgcaatagctagcatctcttctcctcttcttctgtatgtatataaacattgggtacctcgagcccccccgcgctgatccaaatgtgcccggcccggtccctctgcactgcgcccatccatccttaaaccctcctgcgcgcgtaggcctctcgctcgtctcgtccttccccagcacaccacaacctctcctcctccttcgccaggtgcctcttcgttctcctctccgttccctgcgtggcgcgcgcggcgctccaggctatcaggacgaaataactggccgcgctgcacgccggccgccgcgagaagaagcgctcgccccgcgtgctctgccgctggttcggccgtagtccgtcgccgctgattgatcctgcaggaaaaacagggcaaggagctactttgagcccgagactgaactgaagaagatgatgatggccgaggtggccaaccacagcaagaggaaccacacggacagctacttcagtggcaagcccgtcgccgtccccgccgccgcggccaccagctcggaggagttcggcagcatgtcgtcgaagaagccgaggaatgccagcccgagactcgcgcccgtatcaccaaaggagaagaaggacaagatcggcgagagggtcgcagcgctccagcagctcgtttcaccgttcggaaagaccgacacggcttctgtcctgcaggaggcgtcggggtacatcaagttcctgcaccagcagctggaggtcctgagctccccttacatgcgcgctcctccggccgctggcgctgcgcctgaggacccccagcgctacagcctccggagccgcgggctgtgcctggtgccggtggacctgacgctgcagctgacccagagcaacggggccgacctgtgggcgccggcgcacacggccaggcgaaggtgaggactgaggaggagccggtctgtctgtccggagggaaccgcgcaagtgctgccgcgtctgcgtgcgcgccgtggagttgagtttccaggcgcctgactgacccgattcgacctcctagcaagaaactaaagcaagcgtgcgtgtccgtatcagccgccttgtattatactcctagtagtactctcgtgacctgcctggtcaggtctctctctcctagcttgttgtccgccgtttatgtgttgagcggcatgtggattagaagcctgtgtggctggctgtcagcaagcagagcggcagtttgatgcctgttccttgagatggatagtgttatcgagttcagaagaataccatgcgcgtgtgcctgatgtaaactcactaacgctcgctcactgtctctctcagctgtgatggaactgaaaccgcacgttcaggcaaggcaaaacctaagtgttacaggctcgttcgccctcacatccgcaggacgaagcaacgcaggcccacactttttgaccggcagcggcaggcccctcgggccaacagagactgttccggggtccaaagaatctaactcatcatgattcatgaaccaaaatgaacaggtacaccggacgaaccttgcggatggaaaaaaacaactcccacgcgtctctcttctctctctagttacaagtttagggttataccccccctttttttcccctctcttctgtttctttcgatgaacttcgcacgttctcgaatgaat

SEQ ID NO: 5964 - DNA, 886 bp, Zea mays
ccttgggggacccccagccggcccggccctgatcccaaatgtgcccggcccggtccctctccactgcactgcgctgcgcccatccatccttaaaccctcctgcgcgcgtaggcctcgtcttgtccttccccagcacaacctctcctcctccttcgccaggtgcctcttcgttctcctctccgggctatcaggacgaaataactggccgcgctgcacgccggccgcctcgagaagaagcgctcgccccgcgcgcgcggctccgggctaccaggacgaaataactggccgcgctgcacgccggccgccgcgagaagaagcgctcgccccgcgcgctctgccgctggttcggccgtgccatcccgacgaggttcccccagctgtgcccgctcgatctccttccgcgcgcacgcgcacgcagtggtccgtcgccgctgattgatcctgcaggaaaaacagggcaaggagctactttgagcccgagactgaactgaagaagatgatgatggccgaggtggccaaccacagcaagaggaaccacacggacagctacttcagtggcaaggccgtcgccgtccccgccgccgcggccaccagctcggaggagttcggcagcatgtcgtcgaagaagccgaggaatgccagccccagactcgcgcccgtatcaccaaaggagaagaaggacaagatcggcgagagggtcgcagcgctccagcagctcgtgtcaccgttcggaaagaccgacacggcttctgtcctgcaggaggcgtcggggtacatcaagttcctgcaccagcagctggaggtcctgagctccccttacatgcgcgctcctccggccgctggcgctgcgcctgaggacccccagcgctacagcctccggagccgc

SEQ ID NO: 5965 - DNA, 2935 bp, Zea mays
tgcagcaagggcgttcaatcaagggcttatcaatcgtattacaagcaacaagggaactccactccgacctggtgtgccccctccgggccgtccgcgttttagccttctcgatgaagaggggaagagcatactaccaggaaactttgagcggcactggggaatcttctccttcgatggacaagccaaataccccctgaatcttgggctgggaaattcagtactgaagaatgccaaagaggttccgtaccttccatcacgttggtgtgtcgcaaaccctgctcgggatcttgacagtgtttcagatcacatgaagcttgcgtgcagcatggcggattgtacgactctgtactacggaggttcatgctatggcatcggggagaaaggcaatgtttcatatgctttcaacagctactatcagcagcagaagcaggacccaaagagttgtgattttggtgggcttgggatgataacataccttgacccatctatgggcgaatgccgctttcttgttggtgttgatgacagcaagagctctgcagtcgcctcttgtggcggtggatgctgcggggtctgctgtggactctgggttttagctttgtgggtgctcacgtaccttagaatgatgggttccgcttgattctcaaattgatatacctttgtgccaatgtttagaaagattgtacaattgacttctaggtctaggaaggaatggactgcactgtcgccacatgagattaggaaaccaggatttatatatataatttaatttattgttgaaaattatgcccatctctgaatctgttttccattagttcccgggaactatatactacatccgttcatttttatttgtcgtgttttagttcaaaaatgatctagtggtcgataaatattcaagaactgagataatatactatattaaagctatggtaaattctccttttgttgtagcacctgatggaaccaaagagatgttttattgtcatgcatgctgcagcatatatatcatatgctcacagaaaagtggcgggatactataacaactttccggcggagtttattatgtatcatcatggtactgtatttatgatctatctcgaattcagcgggtggacggtggtggcgtgggcgggcaacagttgtcgccgcagcaggcgtggccgcatgtcaccttcggatgctgcaccagccagcagcattggcatgctgaaatgaaatgaaatgcatccatgatcagtatcggactaccaggatcaggaaaagctgtgagatgatgccaacaggctaacagcatatgagcatgactgatggcctaactgcctgcaaggccgtcagggacactcctctactgatgacaacaatttaacagcatctttggtcggtggaatactaagaaatgaatgaatgaatcaatcaatcaatctagtgaagagaatattccgcacagacttacggagtgaggccgtcgccgttgtgatgaagagtgcaagcaacatgatccatgccacaagggcgagggcagtgttctttctgcggctcatgctcagagttcttcttgtctcagctgagatggtaatgtgccatctgctacgtatatatatatatatataaagggatcgacgacccgaccgcctatgcaattgtgataagatgcagccgctttgctggacttgactgatccgacactctagatctctctgtgttgactcgtcagatgctggtttttttgtataatttctttcctacttgacgttccgttttcttcgaatacaactttggctgttctgtggctacatggattaacaagctacaggaatttactacgcaccgaatttcttgcacatacaacatatctggaatttgtcctcagataaacaaatcagatttaaaactaagcaacatgaatccagcaggattttggtcacaagaaatttcaagatatcatcagtagctaattgatatttcttttgaaatttttatgctgctttcatttcaacattttaataaacatctcgacagtctagggtgtttgttattcagttgccagcaactcaatttagcaatacctgattggtgtccatagaacctttcaggggttccgccatctcaatgaaaaaaatataccgtatgttttagttgcttgtatgagcaaagaaaatataccggcgggttggtcgcttgcttttgactccaaagagaaaccaaaacaagacaacaatctgaattaatactttctacgccttttaattaattctctttaggaagattaattaaagaaagaaggctaaaagattaaacgataactaaaaacatcaaggtatacggatatgacagaatgattcgttctaaattcattacccttcttcgttcattattgtgaataattacaaaaatacctttgacttatggaaaacacgaaagcaagacaatacaacttcgaaggcagagcaattcagttctctctcgttcctggtcgcgagttctgtggacattgttcgttatttataatggcagaatataatttcgtgtaaaattacacacatgttcataaactctctatatatgaactatgactcttgcactcttgcagtggtagtgctttctttttcctccattgacgtgttggccaagcatgcatctcacctgcttttgcttcatatattattagtaccgcggaactcaagcttcttctctcctttgctcctatctgcccgttaatcccatgaggttgaaacttcctagcttcatctctgcttcacgcatcgttgcagacgaaggacagcttcactatcattttatagtatctgaaacatatttgactgataatacaattctttgaggactttcagcaatagaggcctccaacaccgtagatcactggatccttaagggttgatttgatgacaagagaatcacggaagaatttgaggggatt

SEQ ID NO: 5966 - DNA, 1896 bp, Zea mays
agcccctaaacgatgaacagtattagcgtaggggaggtgaagaggcaagcgttgcagtcaatcttaccttattttatgtatgagaaattttatagagctcctcggtactccaactcgcagccaacggatattttcgccactgccgtgcaggtaaagaggacacgtcacaggtctggattatctccatttaccatattgccccccctgtttttcctttgagaagcttcaagctcacaccggctagcttccctcagtcacagaacatcatcagctcactctcttctccatcctgttctcggttatcccaccaactccccaaccccaccccaaagatcaggtttcgatccgcgaacccactcccaatcctccaaagatcaccgctctcagacccctcctccccggcaatggccgccggtggccccgcgctgctgcgtgccctcctcgtcgcggccctctgcgccgtcccgtggcgggccgaggcggcgatcgggttgaactggggtaccgtgtccaaccaccgcgcgccgcctggcgtggtggtggacttgatgcgcgcgaatcggatcagcaaggtgaagctcttcaacgccgacccgggagtcctgcgcgcgctcgccggcagcggcatccaggtcatggtcggcgttaccaacgacgagctcgcaagcatcgcggggtcgcaggcggctgcagacgactgggtcgcgcagaacgtgtcccgttacgtcggccgcagcggcgtcggcatccggtgagccccagaatttctctggatctctcgcaatgtagcattgaagtacaaccttttttagtcttgcttcctcagtcttagaatttggttgggcaacccaggatttatgtagtcaatgtacttgaattgggtatatgtggtgtcactttttagctttcagtggagtattcgctttgttgaactcccttgattcttgtggagccgatgatgaacctttttgtatgtttcttgtttcgtgggcatgaagatgagatgtttcaagtatttttttttaatttgaatgaaacgtttctagatgcagtgctttagtttatttagctttagtggactgtttttcgagtcaatagctgattggtttggtgcagaagatgatctctttttttttcttaatgtggttgcatagatgtggagcattggtaattcgaattatgtgaagaagctggtccatttgctcatcttttgttcagtttggtgcctttgctaagatatcggtatagttatttgaatttgcagtgacatatctggtttcatctattttgaatgttttatcatagaattcgattagtacatctatattcttttcaagcattatttctgcttgtctttgtagcaatatagggttctttataatctgtattaaattgcaagggacttgagctgctgtcacttcaaagcaagcaatcactctgttgttcttcatattgcacaaaaattaaatttcatccgtcaagttgcctaacacaaatcatgttattctttgtttacgcaaagtgaaactgaccatttaaattagtagacaccaataatagtgagaggttaagagtgatgtgcaaatggtcaataaattattatgagagcattgcagaattactgctcaagaaaactggtatagttgattcaggttaacgatgcttagtctggcaagtgatttgtttttgcgtgttctttacgaagttactttctttttcatcaaatttcacttggaatcttgaatgtggtgtgtccatacaggattgaccgattgactctgaaacagttgatttctttgtctaactatgcatttgtttttacagatacattgctgtgggcaatgagcctttcctgacaagctaccagggtcaattccaatcatattcattccggcg

SEQ ID NO: 5967 - DNA, 1934 bp, Zea mays
  misc_feature (1851)..(1851): n is a, c, g, or t
  misc_feature (1874)..(1874): n is a, c, g, or t
  misc_feature (1881)..(1882): n is a, c, g, or t
  misc_feature (1884)..(1884): n is a, c, g, or t
  misc_feature (1916)..(1917): n is a, c, g, or t
  misc_feature (1934)..(1934): n is a, c, g, or t
gggattttacctattgcccccctgtttttccctttgtgaagcctttgcgtcccccgcggccggcccggagtcacagaacatcatcagctcactctcttctccatcctcttctcggttatcccaccaactccccaaccccaccccaaagatcaggtttcgatccgcgaacccactcccaatcctccaaagatcaccgctctcagacccctcctccccggcaatggccgccggtggccccgcgctgctgcgtgccctcctcgtcgcggccctctgcgccgtcccgtggcgggccgaggcggcgatcgggatgaactggggtaccgtgtccaaccaccgcgcgccgcctggcgtggtggtggacttgatgcgcgcgaatcggatcagcaaggtgaagctcttcaacgccgacccgggagtcctgcgcgcgctcgccggcagcggcatccaggtcatggtcggcgttaccaacgacgagctcgcaagcatcgcggggtcgcaggcggctgcagacgactgggtcgcgcagaacgtgtcccgttacgtcggccgcggcggcgtcgacatccgatacattgctgtgggcaatgagcctttcctgacaagctaccagggtcaattccaatcatatatcattccagcgatgacaaatattcagcaatcactggtgaaagctaatcttgctagctatgtaaagctagtagttccctgcaatgctgatgcttatcagagtgcttctgttccatctcaaggagtattcaggactgaattgactcagctaatgacccagctggctgcttttctgagttctagtggggctccatttgtcgtcaatatctatccattcctcagtctttatcaaaattcagatttcccacaagattatgcgttctttgaaggatctactcacccagtagtagatggtccgaacgtgtactacgatgcatttgatgggaactttgacacattagtttctgctctcagtaaaattggctacgggaacctaccaattgcaattggtgagattggttggcctactgagggagcaccaagtgcaaacttaactgcagcaagggcattcaatcaagggcttatcaatcgtattacaagcaacaagggaactccactccgacctggtgtgcctccagctgatgtatatcttttcagccttctcgatgaagaggggaagagcatactaccaggaaactttgagcggcactggggaatcttctccttcgatggacaagccaaataccccctgaatcttgggctgggaaattcagtactgaagaatgccaaagaggttccgtaccttccatcacgttggtgtgtcgcaaaccctgctcgggatcttgacagtgtttcagatcacatgaagcttgcgtgcagcatggcggattgtaccactctgtactacggaggttcatgctatggcatcggggagaaaggcaatgtttcatatgctttcaacagctactatcagcagcagaagcaggacccaaagagttgtgattttggtgggcttgggatgataacttaccttgacccatctatgggcgaatgccgctttcttgttggtgttgatgacagcaagagctctgcagtcgcctcttgtggcggtggatgctgcggggtctgctgtggactctgggttttagctttgtgggtgctcatgtaccttagaatgatggattccgcgtgattctcaaattgatatgcctttgtgcccatgtttagaaagattgtacacttgacttctaggtctaggaaggaatggactgcactgtcgccacatgagattaggaaaccaggatttatatatataatttaatttattgttgaaaaaaaaaaaantaaaaggaacaaaacaaaaaaanggaaaanncnaaagaaaaaaaaaaaaaaaaaaaaaaaaaaannaaaaaaaaaaaaaaaan

SEQ ID NO: 5968 - DNA, 5380 bp, Zea mays
  misc_feature (4885)..(4885): n is a, c, g, or t
aaaactagctcacgttagactttgatgtgggcagaactctaacaagatgacctgataggtacccagaatatcctatcagttgggtatttcaccactgtattattgtgagtttgacaacaagaaagggacactttgccacagaactttcatttttttccattgttcataatcatgcactcacgaaaataccacaggaaagtgtcctagataatgagaaacagctctattttagcagcgcacctacagttaagctgtgccaacatttggtgctgtaaaccatggacaattctcaatgaacatggttactttcctataaataatgcacaagtagcatcagtgtatctagaattagagtggccagtgtgacttaaactgtaatatttttagggtaactatgatgacatttcatattaacatccataggaaaaggacaataacttatttcactggtcgctgagttcagtcctcagtttggtatttatttggttaaggggaataaatacatgtcatgaaaacatagaatggtcaactcaattaatatagaaggttaactacacattgagacgacaaataaatgggattttcaacctgaaaatacaaagtgtatccttgtaattgtgatattaatgttacttaccagataactagacatctatttcaattataaatatggatagatatcaaagaaaaatcttgaaaaaaaatgcacttaccttcaattcaccttatcacatcagtttgcttcagaaatgataattatctgcactcagctacaattatgttggccttgaacaacttgtatgagctatgagtcaaaggactgagagtggccttagtgacgatagactgacaacagaaacaacagggcgagttagctccaagagtaaaataatgtatctgcaaatgactcaaacatccgatgtgaataaacattgtcttgtatttttcgagaacaatattttctacagtaatcttgctacctcacttcagaacaaattatctggttcaaatgaaagagagttattgcatgtcactactgtagaccgagaaccgaagcactttagaaatactgcagtacaatttgagcaccaaagtatactgagaaatcaccggcaacagttttgatctgataggcctattcccatcagtggtgaactttgtttgccactgagagagcttcaatcagttacaaaagcaaacttgttgggtgtaacaaaatatgacattacacgaaagcgtgagatttgagtctgagaggacaaaacattgatacgaatgtagcagtgtaatggccgcaataatatcaccaactatatgtatatacacaagaattttcaacatgttcacagagaaaagtaaggaaatcgcagatctacccgtatccaccgtctcatcactaaagatggccatctaaccatcctatagaaacaaagattttgccttccaatgatagattattttccaagttttctaaacaacttatggaaggtaattttttgaagagaagaccaggataacccttttaaacagtaggctattaagctagagcattcaaaagaagatagctgcaggctgcaaaaggaagttttactcccacatcatcacaagaagctagaaagatattactgtaaaaaaacaaccgaagctagaagggtgccatcaagcagaatgtgatcggatagactgtacatacatgttgattttcatagttaatcttcgacaaattctgaaatgaaaagggagggtcataaaaacaacagttgatacaatgaatttatgcttagcactctaccaaagcaaactttgattatgattttgtcgatataattgacagataagaagagtgtaaacatgttgacattgtgtaaatcaacaaacatggactagaatgcttccttatgtgaaatataagttgtctccactctgacacccaccatgtcccaaaaaataggtgggtgagcgtggtgtccaaatgtctggaggacagaagcagaggattgctattgccagagctatccttaagtcacccaagattctcctgcttgatgaagccacaagtgcattggacacagagtcagagcgtgttgtgcaagaggcacttgacctggcttctgttggcaggacaaccattgtcattgcacatcggctctccacaatccggaatgctgacatgattgctgtgatgcaatacggtgaggtcaaggagctgggatcccacgatgacctcattgccaatgagaatgggctctacacatctcttgtccgccttcagcagaccagagattcaagggaggccaatcaggttggtggaactgtaagtacatctgctgtggggcaatctagcagccacagcatgagcaggaggttctctgcagctagcaggtcaagctcaggacggtcaatgggtgacgcagaaaatgataatattgccgagaagccaaagcctcccatcccatcattcaggaggttactgatgcttaatgcaccagaatggaagcaggctctgatgggaagtttcagtgcaattgtgtttggaggcatacaacctgcatatgcatatgccatgggcagcatgatctcaatctacttcttggcagaccatgatgagatcaaggacaaaacaaggacctacgcactcatctttgttgctcttgcagtgctctcattcttgatcaatattgggcaacattacaacttcggtgccatgggggaatacctcacaaagagagtgagagaacagatgcttgcaaaaatcctcacttttgagattgggtggtttgaccgtgatgagaactccagtggtgccatatgctcacaacttgccaaggatgccaacgtggtaattatacgaaccaaagataagcttatgcaatattattaaaagaaatagtacctgacaatacatatacatttttcggcaggtgaggtctcttgtgggtgatcgaatggctctagtgatccagacagtttctgcagttctcatagcctgcactatgggtctggtgatcgcttggcgtttggcccttgtcatgatagcagtgcaaccccttatcattgtttgcttttatgctcgccgtgtcttactgaagagcatgtccaagaaatcaatacaggcacaatctgaaagtagcaagctagcagctgaggctgtctccaatctccgcaccatcactgctttctcatctcaggaccgtatcctacgcctctttgaccaagcacaagatgggccacgcaaggaaagcatccgacagtcatggtttgcaggactgggccttggcacctccatgagcctcatgacatgcacatgggccctagatttctggtatggtggcaagctcatggctgagcgtcacataactgcaaaggcactcttccagaccttcatgatactagtaagcacagggcgtgtgattgcagatgcaggtagcatgacaacagaccttgctaagggtgctgatgcagtagcttcagtattcgctgttcttgacagggaaaccgaaattgaccctgataaccctgaggggtacaaaccagagaagctaaaaggcgaggttgacatcaaaggagttgactttgcatacccatcaaggccagatgtgattatattcaaaggtttctccttgagcatccaaccaggcaagtcgacagcccttgttgggcaaagtggttctggtaagtcgactatcataggtcttatagagaggttctacgacccacttaggggggtagtgaagatcgatggcaaagacatcaaaacatacaatctcagagccctgcgtcgacatattggattagtcagccaggaaccaacactatttgcaggtacaataagagaaaatattgtgtatggtacagaaacagcaaccgaagcagaaattgagaatgctgcaaggtctgcgaatgcacatgacttcattagcaacctcaaggatggatatgacacatggtgtggtgagaggggtgtgcagctctcaggaggccaaaaacaacgcattgcaattgcccgtgccatcctgaagaaccctgcaatcctgctactggatgaagctacaagtgcactggacagccagtcagagaaggtggtacaagaggcattggaccgagtgatggttggcaggacaagcattgtggtggcacacaggctcagcacaatccagaactgtgaccagatcactgtgcttgaaaaaggaattgttgtggagaagggcacacatgcatcccttatggctaagggtccctctggaacatactttggattggtcagtttgcaacaaggaggcaaccagcactgagtttttttgcatgagaacacagcagtacttacaaatttgttgctccaatcaaatgatgtattactttggatcaatctgcaaaagatatctagcctattccaactagcttgggactgtaagctttgttgttgttgatgatgaaaacgcgagatggcccagcaggcgattgaaatttctgtgacagtggggtgtttttcttccctttgttctattagcactgtagcacacataagtctgacgagcatatagtttcttgatataactgttggacatgtattgtagttgtgcaacggccaggaaatctctgataatatgtacattaggtattatttcatcttattctctactgacttttgtactcgaaattattacattagcttttatttcgtctaattcttttgcgaattatgtgtttgaaatttttatgcctattgacaatgcctggtgcagcggtagagtctaacgtctgtaaccggaaggtcctggatttgagctccagcctctgcatattatgcgggtaaggcttgacgcttaaaaatactttgcgcttaaagataccctttctcagaccctgcacggtacgggaagtctanggcactgggtacgtcctttgattgacaatgaagattagtatattcctaaatccatggtggcagaacagatacaaacaagaaaacacacacacaaaacaattaattgagcacaagctatctttttaagtatcatcttataggtttcaggtgcacatcctaattaaaaccatttaggatgacctaaagttaaactgaggtttgtcaggctagcaatagcgcatatgtatgctacgttgcgatcaagcaggcagagtagtagaaggggtttctctgaagcaagcaggcggcggccgagctcaacaatgtcgacgggcgatgcaaaagagacagcgctagcaaaactgcaaagagagtccgaagctccctgtgccgtcccgtcctgtccttgaggaggccagctgctgatgctcaacgcgccagagtggaagcaggggctggttgggagcttcagcgcgatcgtctccggagaccttagaggatgttttggttcgagta

SEQ ID NO: 5969 - DNA, 1383 bp, Zea mays
acaccgtcatggctgcgccggcgacgccgaggcagtcgctgatcctcccacgtgcctcctcgcactcgcactcccaacccagcgccggcgggctcacctcttaccgcgtcaccgcctcccaccgccggcgcggcgatttcgttttcgtcgtcaaccccttgggcgccaatggccgcacgggaaagcagtggaagcagttgctgccgcttctccgcacccgcctcgctgaccagtgcaacttaggcgcactcactctcatctcacagaatgtttccttttattggtgttggctgatcagatttgcgagtgcatcacttcgggcccatcccatgccatagatgtcacaagggaggctataaaggatggggttgatgccgtgatagctgttggaggtgatggtacacttcatgaggtggtcaatggtttcttttgggaaggaagtccagtgtgtgctctggatcgagggcctgatcattcgacggcgctgggtgtgggctcattccacttggaactggctcagattttgctcggacatttggctggacaaatgatccccatgacgcgattgatcgaattgtgagaggagtaaaatcaaaactagacgtaggcgtgatggagggtccaaacagagaaccacacttctttgttaatgttgctgatatccatttgagtgctaaggcaggttattttgcttctatgtataagagttttggtaacttatgctatgtatttggagctttaagagccttttggggacataataatcaagatatgagaataaaggtaaatgggggagaatggagaactgttcataacgtcacagccctgtgcatagggaatgccaaatacttcggtggtggtatgaagataactccaacagctgatccgtttagtggcaaccttgaggttgttattcttcaagatttcaaatggtacgactttattctgaagctacacaggctctatggaggtacacatctatcagtgaatggtgtttcgtcaatgagggtccaatcaattgaagtagcagaggtggcggctagcggtggcgtctttgtgcaatctgacggagagcatttcggctttctgccgaccaagttttcagtccttccccgtgcagttgatttcttctgctagatcagcaagtgggctgcattcatcccctgcgcatgagacaagttctgccgtgctgtagcactccgccatgtaactataatttagccctgtcatatcgaatgtttgaacctccattccgggtattaaatgtagtcgaattataaaactaatttctcagccgaagattaaaagacgagacaaatctagtccagttggttgggtctaaattgcatgttaaaatttaaaaggcggccaaaaaaaaaaaaa

SEQ ID NO: 5970 - DNA, 1379 bp, Zea mays
aggaaaatgtgtttcgtcgcgcccggcccggaatagaacacagtaggaggcgcattcccacgctttctcggcttctccatccagagtggatcgggataataagcggcaggacaccgtcatggctgcgccggcgacgccgaggcagtcgctgatcctcccacgtgcctcctcgcactcgcactcccaacccagcgccggcgggctcacctcttaccgcgtcaccgcctcccaccgccggcgcggcgatttcgttttcgtcgtcaaccccttgggcgccaatggccgcacgggaaagcagtggaagcagttgctgccgcttctccgcacccgcctcgctgaccagtgcaacatttgcgagtgcatcacttcgggcccatcccatgccatagatgtcacaagggaggctataaaggatggggttgatgccgtgatagctgttggaggtgatggtacacttcatgaggtggtcaatggtttcttttgggaaggaagtccagtgtgtgctctggatcgagggcctgatcattcgacggcgctgggtctcattccacttggaactggctcagattttgctcggacatttggctggacaaatgatccccatgacgcgattgatcgaattgtgagaggagtaaaatcaaaactagacgtaggcgtgatggagggtccaaacagagaaccacacttctttgttaatgttgctgatatccatttgagtgctaaggcaggttattttgcttctatgtataagagttttggtaacttatgctatgtatttggagctttaagagccttttggggacataataatcaagatatgagaataaaggtaaatgggggagaatggagaactgttcataacgtcacagccctgtgcatagggaatgccaaatacttcggtggtggtatgaagataactccaacagctgatccgtttagtggcaaccttgaggttgttattcttcaagatttcaaatggtacgactttattctgaagctacacaggctctatggaggtacacatctatcagtgaatggtgtttcgtcaatgagggtccaatcaattgaagtagcagaggtggcggctagcggtggcgtctttgtgcaatctgacggagagcatttcggctttctgccgaccaagttttcagtccttccccgtgcagttgatttcttctgctagatcagcaagtgggctgcattcatcccctgcgcatgagacaagttctgccgtgctgtagcactccgccatgtaactataatttagccctgtcatatcgaatgtttgaacctccattcgtggctaactgtgccacactttgtctaaggttagtcgaattataaaactaatttctcagccgaaaaaaaaaaaaaaaaaa

SEQ ID NO: 5971 - DNA, 1597 bp, Zea mays
cctcgaggccggccgggagggatacatcatcagtacatatacagggatacatcatcagtacatggcccggcccggcccagagaggagcgcgcccatatcgcttccctgaggccgagagcgaagcggagcgagcaccggacgagaggcatggccatggcgcgggcggagctccgcaccgtgaccgtgcgctcttccccgcttccgcgctgcgtcctctcccggctgctgccgttgctcctctcagtctcagccatcggcgctgcgtctgcggcgccactaaagttcgggatcaactacgggcagattgcgaacaacctcccgcagccgacgcaggtgtcgggcctcctgcagtcgctgaacgtgaaccgcgtgaagctctacgacgccgaccccatcgtgctgacggccttcgccggcacgggcgtcgagttcatcatcggcaacgatgacctctacaacctgaccgacgcacgcaaggcccgggcctgggtggcgcagcacgtccagccgttcctccccagcacgcgcatcacctgcatcaccgtgggcaacgaggtgctctccggcaaggacacgaccgccatgcagagcctcctcccggccatgcagaccgtgtaccaggccgtggtcgccctgggcctcggcggccaggtgaacgtctcgacggcgcactcggtcaacatcctggccagcagctacccgccgtcgtcgggcgccttccgggaggagctcgggcagtacatccagccgatcctcaacttccacgccgaggtcggctcgccgttcctaatcaacgcgtacccgttcttcgcctacaaggcgagccccgggagcgtgtcgctgccgtacgtcctgttcgagcccaaccccggcgtggtcgaccccaacaccaacctcacctacgacaacatgctctacgcccagatcgacgccgtgtacgcggccatggaggccatggggcacagcgacctcaccgtcaggatctccgagaccgggtggccgtccagaggggacgaggacgaggtgggcgccaccgtggccaacgccgccgcgtacaacgggaacctcatgaagaggatcgccatgggccagggcacgccgctcaagccgcacgtgcccgtcgacgtcttcgtgttcgcgctcttcaacgaggacatgaagcccggggcaacgtcggagaggaactacggcttgttttaccccaacggcacgccggtgtacagcctcggcttcaacggagcgtccttcagcccatcgccgacgtactcctcttcttccaagctggtgattacatttcagatggcagttgttgtcctactcgccagcttctccatcctacacactgccgtgccgtgccatgcgtgaagattattgctatttttttgactaacccatctgtggcttcattgtacattaggctagctaccagaacccatattagtctgacttgatgtaaagcatgcgacagtagtgctgtccagctcaattgataatgcgtattatatttgttttctaaaaaaatgaaattacaaatgtccatttctgtttggcgtcagagtagagttatttctctcgttatatggacgtctcttacttc

SEQ ID NO: 5972 - DNA, 5450 bp, Zea mays
gatgaaggaggacggaggcagagagcacgtgctaggggttcttttagctcgctctactcgacgatgaagatggtgaaagaccagcacagacaaagcgagcggcttgccgcggtggataaaccgcgactgttgggaactgagagcctccctattctttgttttttccctcgtcgctacattggatgttagaggggggttttaggtaaaactacacaagccggtagaagagtctaaacgcgaaatatacaactacggtgatggatcaatctattctaaatagagtggtgtcatggtaaaatagacttattccttatgttattactaattattagactataaggaattaaataatgattgattaactcatttcattgcataaaccaaacaagaaagtaaagagtgagaagatgatgaactaccacattctttaaaccaaacatactataaattatcatttagaatcatttacataaaaaccattttctatatttttttaatctctaaccgtgtttctatatcttgtgtacactctagagacacattcacattctatatatttgactaggagaaatccagaatagaatatggctatatttagataagttgttgaaaagtattttttttaaatatatatttatatatattagaaataatatagagagcctcttgaagttgctcttatactgtttgcaaacggagaaaagcaatcgactggtcaggccattttgttatattctttttcaagaaaacgctcccgtgaagagatgttttcaagcaacatgtcgatcctttatttctttccttcaaaccacagcgctcagcatgatgcatgcattcgcgacacaaatgctctttgcttccaagcagagtacaatgtatgttacatggtcaatctttctcaaacccgatcatttgaattgtcaggaggccccaggcaaacatggtcacaatccaccagcaaactggacgtcatactcctgtgctaaagtgtgcttggactacggtcttcaagaacggcacgtgccagatttgatgccagagcccccgccacagagctcatcgcatggcttggtgggtcgcgtctggaaaaatcagggcgcagcttggccattgacagctcttgcagcttgttgagcaacaatgtcgtctcagcaacatccataagagggctgagtttgctattaagtagctccacctggataaagtggtgacagaattacggaatgggtttggttttgtgatctggatgcaagtggtaatagcatcctaagccaacacagaaaataagttaccgaatcatgtagaaggggtagccagaaacgttgaggtgtggatgggtttttcataagctgcaaagaaacacatttatatggtcaggagactgaagacaacagattattggcatcctccaaggtacaatcctgtactgatagtctcaaactgaatttccagatcctcttttttctcaatgtatgggggcctgaagtgtagatatggtttttttgaaagatatggcaggagttctacctttcaactaagataagatagaaaaaagatgcacacagtatgaaaaaacaaagaaaggggagggcacttccccagctagggcccacgaagtgttgatatatggttaaaaaaacgcaactgacatgttagaacttcacctgtattaaaaaatccacagtttgtcgagcagcctcaccacaccttctgtctagagcttgttgcagagacctcttgaaatcccggtaccttggcacaattatatactaagctggcattcaacattgtcatgtagagagacaaattttatgggcaaagaaaatacctgtgaaggaactcaagaccgcctgcactaccaatgtcagaaccaaggagctcgagcagcccttcccattgctgaaatgcaaaatcgttattagttcaaggggattactcttccttatgatcaatgttcctagattactattgtgcagagaactagttgccagttacatctgaggaatttagaaagaaaaaagaaccttaaaactatcgtctgtcactgacttcccaatgtgttcgaataactgttgagcaattctatcaagacaaactttatcacgagcttgctggaaccagtatacaccagttccttttcgtccatgcttccaacgataaatgccagcaatctaaaaaaagaaacaagcagttattagatatgaatccttagtttaagctaacgttgagttcagttgagaaccatggaaaatgcaagctacatgtggaagtttgaataagcaacatccaaaacacaagatgatcactatgccatgtcccaaatttttatttgtaacaaaaaagttgtgcagcacttgaatccatgtttacggtttaccttcatgatgattgtactaacattctccagttcgtacaatcggcaaatttccaaagtctgcccacagaaatgaggattagagaataaaagtgggtctgagacgctgaaatttataattgattaaaatgcatggtaccttgagtactaggcaattatcttgtatgggttgcttaagaagtagaatctccaagagtcctaggccttggtttagacatgaggacagataagtcggcgcgatctgagaaccaaacatgcaagaaagccaagataaatgttgtcaaaagaagatatttttgctatcaaaacaaacaacaacagaaatccaaaagcttctcatactaaaaagcaaaacagatcgatatagcaaatcaaaggcatatcctcatatgcacatataaatgttcagcaaaacatatgaaatagttcctactcaccactcggttggaacctatttcctatttatcattggatggatccatgctgcaataagccacccaacaggtaaaagggaaacgagatctcaaaatgagagaaaaaggcattaagaactgaaatgagagaaaggaaataatcaggggtggatatgggcctaggatcatagccctaggcttgacccagaatatttcttatattacatgtgattttttggcccaatctgaagtaaccctgggctcttgggacaaactcttactcccagccggtccagacagatgagaaagcaggatctccttgacatctgaccctgactcgggaagtcagggtgtggcttcgtgcgctagcgccacaatccgacttggcaactcgactcccatccctgttcctctctgtccagctggctgctgcagtgctgctttgattaaccctgcttgccacgccgccaatcacgtcaccaccaacttgacaagaggggttgcggcagcccatcgcccaaaggtcctctatgctagccactagaggctgtccacggctccgcactccatggtcggaggcacattgagcggccgcctagccagcgagccggcaactggcgtgcccctgtgctaagtggccccttcccttctgcaagactgcagagcaataggggtacaccgtacaccacacaagcacattaatacactacagcaggttgttctctaattcgattgatccaagcctccaaccaaatatgaaataatccaatctcttgttccaattttccatggttccattgttcaatatttgtgtttttgtatgatgtagcaactagcagccaggttgtttactttgttttccttttgcattccgtaaacttacacaatggagaggacaaagacatcgaaaatctgtttttctcttggtcctagactcctacgcctattatacaaccaagccaatcttgtgtttatgtataagtacaaatatgcaatgagaactagtaatggaaatgtcatgcaaccagaatcagtttgttgtacaattatatgtatgtattttattgttcgcctttgtgaagaaattgatatgcggatcaggtctcaaatatttagatctatgtattttattgttcgcctttgtgaagaaattgatatgcggatcaggtctcaaatatttagatccttaactattggccctaggcttggaaattcaccagctccgccactggaaataacccaattaaataatgcaacatgcaatttgtgcatttgctagttcaagaagtgtgtggctaatgcctaataaaaatacataaaattagttggtgatgtactagggttactatgttacataactaacctgccaagttaaaggatgacaacataaaacttgagcatagactaatcggtgaagttcctctatgcttataccgcctaagttaggtcgctcttcatgcaacataatatccgcatagtcattatcagctgtcagaagttccatagcatgtgtgaccagcctgcaggtacaaatgccaaaatcagttaggacagtgcttcagtgaatagaaattagcaaattgttactcttaccaagggccaaaattttttgtgcattctgccaagacaacctaatcatggaaaagatgttataaaaacaataaataagaatgtataagaagtccaaggacacagatagaggacgacttcatgctctaacctctggattttctgacataacaccgataatgaggcctgttaatccattagtgccagaggatggcataagctgtatgcatttctgtgctaaatggtgcatcccttcaaaaccctgacaagatgtatattttattgagatgtaagatgtcgatttttcaaacgcgtacttcctttggaaaaaaaataaaaaaggggtatgaagtattgaactatatactaaaagtgtttcctaacaaccccttttgaagtgatttttattgcgctttcatttcagctgaagtgaagtttgcagctcaagcaacacgaccaggacaggctgaatatggttgtggtcaagaagaggatagtgaaatggatgaacaacttcactcgaaccaacaacccaatgtcagacatcatcaaaatctaaaccaatctgtaacaggatagctgccttggctttatgtttacttttggatggtaaactgatatgtccagcacctaaagtggaaacacttgctttgtatagagcagagagaactctttccaagaaaaagaaaaagggaaacaaagaaactatatactgaaaaacgaattgtttgcatgagaaaaggaagaaattgaagggctaaggctgtctccagcaaggcagcaacatcacctaaatttcatcctctaaaagaatattctccgtcctctacagcacactctaaaagttttttgtcctctatatttgcgtcatctccagcagcgtcctctatatctcatcatctttaatgtaccaacttaattaatgcaatttattgattttgggattaaatagcgacaacagtgttctggcccatggcttaaacatttcgtcaaacaccctccatgcgtcatctggtggttgccgcctccgtccactggacgccaatgacatccacaacacctgaacaccatggccgcggtgctgcaggcatgca

SEQ ID NO: 5973 - DNA, 1745 bp, Zea mays
gcacgaggagagaactagtctcgagtttttgggttttttttttttttttcaagcaacatgtcgatcctttatttctttccttcaaaccacagcgctcagcatgatgcatgcattcgcgacacaaatgcactaagcaagcaagcagagtacaatgtatgttacatggtcaatctttctcaaacccgatcatttgaattgtcaggaggccccaagcaaacatggtcacaatccaccagcaaactggacgtcatactcctgtgctaaagtgtgcttggactacggtcttcaagaacggcacgtgccagatttgatgccagagccaatctcacagagctcatcgcatggcttggtaggtgattactggaaaaatcagggcgcagcttggccattgacagctcttgcagcttgttgagcaacaatgtcgtctcagcaacatccataagagggctgagtttgctattaagtagctccaccgaatcatgtagaaggggtagccagaaacgttgaggtgtggatgggtttttcataagctgtattaaaaaatccacagtttgtcgagcagcctcaccacaccttctgtctagagcttgttgcagagacctcttgaaatcccggtacctgtgaaggaactcaagaccgcctgcactaccaatgtcagaaccaaggagctcgagcagcccttcccattgcttaaaactatcgtctgtcactgacttcccaatgtgttcgaataactgttgagcaattctatcaagacaaactttatcacgagcttgctggaaccagtatacaccagttccttttcgtccatgcttccaatgataaatgccagcaatcttcatgatgattgtactaacattctccagttcgtacaatcggcaaatttccaaagtcttgagtactaggcaattatcttgtatgggttgcttaagaagtagaatctccaagagtcctaggccttggtttagacatgaggacagataagtcggcgcgatctgccaagttaaaggatgacaacataaaacttgagcatagactaatcggtgaagttcctctatgcttataccgcctaagttaggtcgctcttcatgcaacataatatccgcatagtcattatcagctgtcagaagttccatagcatgtgtgaccagccaagggccaaaattttttgtgcattctgccaagacaacctctggattttctgacataacaccgataatgaggcctgttaatccattagtgccagaggatggcataagctgtatgcatttctgtgctaaatggtgcatcccttcaaaacccacagtaaatggttttatgtaaagaaaatgagaagcaaacagctccagccaatgggaagtagcagcagtaatttcctttatgttccccatcataatatgaagcaaattcttcaaaccatcacgggttttttggtggccgcactggatccaaaatgcactgcactccagtttagttacttgacctcgccacttttcccatgccttgataaaatcaggtcttgttttgcagcactggcctaatttaccagttggcaaattcggtctcatgcggggcatcattgatacaagaacagcaacagcctcgaccaatccattttctgtctcacggctatccatctgatctaattggtacgatccatgaaaccgtagcatattcaccacaatatcaagccatccaaccgcggacgcgtgggcggacgcgtgggcggacgcgaccgcgaacgc

SEQ ID NO: 5974 - DNA, 1245 bp, Zea mays
atgttgtattcgagagtgaattccacataccctatctcttccagtcttcctacgctcctgtcggcgcgtcctccgcatcccggtgaccggtgtgttctccgatttgaggggcgtccctcgcacgctccggtctgctgctcctccgccctccggagtccattccagcggagcgcgctacggcacagatcggccgccgtccatccctttcccagctctccagagcctccgctgccgcgtccggtgagcacgtctcgaccggtttccagataactgcataaggccgagctcatgcaaaatggtgctatgccagggcgtatctgttggaaatgctcagttgctagcttttcctggtagatcatcaagccttaagagcacccagtttcttgttaaaacgaatcattttcctgcaagagctctacgtgttggtactgattctattcatcatgccatgcctacatcatccccaagggaaaattctgtcaggggaatcccatcactatcaagacagcacaatcagcatccaaggtccgttagttgtcaggcatcctcactggcatctttcagctaccctgagctgacatccaaacccagatggtggtggagaactctagcttgtgtgccgtacttgctgccactgcacaacatgtggtcttatgctgacgtgatctaccagctgcacacttatttgcaggggttttctctgttgtacaccttcatcgataccatgactctgtgtcctgggtggctctttctggtgatatttatgacagtgtacttcttcgttgtgaggcggaagtggtcgccgcactttctgaggttccatgtgatcctagcaatccttctggacactggctcccaagcagtggccaccatgtgtacatggatgccaagcatcgtttatcaggggaagccaatgcagtacctctggatgtctattgcattcatacagatcttcacagtgctcgagtgtttgcggtgtgctctttgtggaatgtatcctaatgtcccattcatatcccatactgctttcattcactctgatctaaatctgttcagataggtgtttataaggtccgggattcaagaagggtgattttttttgaaatggctacttatcataggaccagctggtacaatagcattcgaacaacactgcgattgatttttgttcctaagatgttattcaatgtacgttgactacctgcaaattttgttttgaggggcactaaaaaaaaaaaaaaaaaa

SEQ ID NO: 5975 - DNA, 4665 bp, Zea mays
  misc_feature (3331)..(3331): n is a, c, g, or t
ctgcagctgacgtccactaactcctccctcttcggcgagaagcaaatagagcacaatctatattgcaaaacaatattttacatggcctactggagagagaaagggagcccggttgagtggttgacgccacacgcacgcatctatgtacggccttgcttagttcgtttggctttaattcgtaccgacttctattgcctttatatagattacagagttcagagtgctgcctttaattcgaaactcaggctgcgatgtttcgtacgtgaggttccatcctgtgtgatctgctcggattcgtgcagacgcggggccctcatatgcctgctgcgtcctgcatgacacataagacaagactgaccaatgaaacgttgcttgcataagaataaagacttgataatgcgattaatggtccaacaggccttggcccatgcctgaactaacaagaaagatgccacaagaccatcttaaaataccctaatgcatgccaatttacagacatcaaacggcaaatggtaattggtcggaagctttacgtctgtgttgtttcgtgatcagaacgtaccatgccacaaggttagtcatgccatattttttacagttgtttagtttgttgccgtaactacatcgtactgtatttttttttatcactctattctacaggtgatatggttttttttgctaaactaattacaagtacacagttcgaccaatgtttgtcgtggcaaactaccgaagaggtgccggaatttttaaatttctactatttggtaggaaagacaaagcaggccgaatgcaacgccgaggtcgagccagacttacatgggcctggattttcctagggcctgcttgttttgatcgagcccagcgagagcagaggtccatgttgtattcgagagtgaattccacataccctatctcttccagtcttcctacgctcctgtcggcgcgtcctccgcatcccggtgaccggtgtgttctccgatttgaggggcgtccctcgcacgctccggtctgctgctcctccgccctccggagtccattccagcggagcgcgctacggcacagatcggccgccgtccatccctttcccagctctccagagcctccgctgccgcgtccggtgagcacgtctcgaccggtttccaggtagtcacgtaccgcacctgtgcctctatctatcctctcctcgccgtatgcctcttggcgatttctattagtttttcattgtcacttagtttaagtcagctgctggtctgttctcgctgtctttccatactggtaggtccatggcttcagctattagctctgagcggtttggtgtccaacagttccaatatgcttgtcgaactgatgaactaagactagtctctggtggtttcacgagaggattatgggcattaaatatgttgatgtggcatattattaacgaagagagataaggtaaaaagttttatcgaatgaaatgagttccacgggcgatgaaacttatgtgcactgtttctaacatatcggagtcttgggaacattgacataaaatccccactgaaactggcctaataaataagctaatctgtgttgggtttgcgtcctgtactgctacatgatttcagtgccagactaaatactcagttcgattacttgtatgtgcagataactgcataaggccgagctcatgcaaaatggtgctatgccagggcgtatctgttggaaatgctcagttgctagcttttcctggtagatcatcaagccttaagagcacccagtttcttgttaaaacgaatcattttcctgcaagagctctacgtggtatgaagacaacaaatctattttcctttggttcacttcaatttcgacgcacatactcttttattgccattgccaatattgttttcttgaatttctgccttcatatgttcttgattgagccttttttattgataattcgagttcttctagacaaaatatcatgaagctgttcttttcttatgaactgaatgtttcttttgagttttgatacccaaagacctcccttcaaacgtagctcactgtatgcctcaaagcaaagtattgtcttaaactattctactttattcatgcatgtttcttctcaaacagtattatcattatagtgactagcactatattaatttattcttttctgcggacaatctgagtatgtaaaaccatattcgttaattcagaatcctgtcttagcaaagtctgtaaaaatcagctattcagcttcataattctcttgtcactatataatatggccatatgggtaagcatgcaggacatgggacaataacacaatggaccattgaatgtccagagtaggataactgaaatataactaaagaaatggtgttatgatttagagcctgtagagtgtagagttacctcggctaacccgatcctgtgcttctctagaagatggctagtgctatcaattcttttatgtgtactgatgtattcatttaaccttatcattatatgctatttctgcaaaatattttgtttcctattaagtgtaatcatatagttatagtcctgtattagatgctataatgtctggtgttgctgatttcctaggctctacctgacagttcaatatttcgtgtttcataaaaaaggattaattgtatacacaccactcagcttttgcaaatttagatggttagttcattttgatgccatggagtggcatgaagatgaactagtttccaacttttcaaagctggagtggcatatttctaattaacccaaaaaaactttttgcggttttagtatgtttattcctctggttacttgttgaggacctattttggatataggtttgctgaaaaaaacagtataatgttttgtttggcaaatgttcaagacaatgcgaagtaataagcaaaatacaatcatttgaacaggatatgaatgaagtccagcctgaacatattatcaacaagataataacatgatatatggagttcaagccttggtttagttatttccattggtacttttttatgtttagaatgacattggaaatgaaaccattttgctagtgttatgtatattgatttctttgatgtccaggatttatctatccgtcccattgtcacattctttgagtattttcctagttactataatggatttgattttcatcattgtttgtgtttttcagttggtactgattatattcatcatgccatgcctacatcatccccaagggaaaattctgtcaggggaatcccatcactatcgggaccgcgcggccggccgccaaggtccgtcagttgtcaggcatcctcactggcatctttcagctaccctngagctgacatccaaacccagatggtggtggagaactctagcttgtgtgccgtacttgctgccactgcacaacatgtggtcttatgctgacgtgatctaccagctgcacacttatttgcaggggttttctctgttgtacaccttcatcgataccatgactctgtgtcctgggtggctcttcctggtgatatttatgacagtgtacttcttcgttgtgaggcggaagtggtcgccgcactttctgaggttccatgtgatcctagcaatccttctggacactggctcccaagcagtggccaccatgtgtacatggatgccaagcatcgtttatcaggggaagccaatgcagtacctctggatgtctattgcattcatacagatcttcacagtgctcgagtgtttgcggtgtgctctttgtggaatgtatcctaatgtcccattcatatcccatactgctttcattcactctgatctaaatctgttcagataggtgtttataaggtccgggattcaagaagggtgatttttttttgaaatggctacttatcataggaccagctggtacaatagcattcgaacaacactgcgattgatttttgttcctaagatgttattcaatgtacgttgactacctgcaaattttgttttgaggggcactacttgttttatccgaacttggttgagaacttgagatgaagctggaagttgagatgcattaaattgtgcattatatggtgacctgcagctctaagttgagaacttgagatgaagctggaacagaatggaggggttacgaagaaattttgagacttgtactgcctgtgaagtttactctttccatgaggactttgtgaatattttgcctaacaacagtttggtagagtttgggaaagaaacaacagttcattgaatggacatggcccatctgagacatgattagctgactaatctcatcactagctgcattctatgaattaataagatcactaaatatcccctcaattgaattcttttttagatcaatgaaactgctagctaaaatttctcgaaaaatctgaggaatatgtatgtatagatatgctataaaaactcttctaaattttattgaaaattaaagagaaatgatcatgacacattacatcatgatttgaaaaaaccactatcccatttgaaaacccctatggagatattgaaggtatgacattgacagaatactatttctcttaaaaaccttatgaaagaaatgaggaataatatgaaacgatatgttgctagctgttcggctgtagaagtgcagccacacctggattaaagcagcagcaagctgcagtgaac

SEQ ID NO: 5976 - DNA, 1363 bp, Zea mays
tcactctattctacaggttatatagtttttttttgctaaactaattacaggtacacagtttgaccaatgtttgtcgtggcaaactaccgaagaggtgccggaatttttaactttctactatttggtaggaaagacaaagcaggccgaatgcaacgccgaggtcgagccagacttacgtgggcctggattttccaagggcctgcttgttttgatcgagcccagcgcgagcagagtgaattcgacataccctagctcttccagtcttcctacgctcctgtcggcgcgtcctccgcatcccggtgaccggtgttctccgatttggggggcgtcccttgcacgctccggtctgctgttcctccgccctccggagtcctatccagaggagcgcgctacggcacagatcgcccgccgtccatccctttcccagctctccagagcctccgccgccgcgtccggtgagcacatttcgaccggtttccaggtagtcacgtaccgcacctgtgcctctctctatcctctcctcgccgtatgcctcttggcgatttctattagtttttcattgtcacttagtttaagtcagctgctggtctgttctcgctgtctttccataattctctggtaggtccatggcttcagctattagctctgaaatattctacatcacttcggtttggtgtccaacagttccaatatgcttgtcgaactgatgaactaagactagtctctgtggtggtttcacgagaggattatgggcattaaatatgttgatgtggcatattattaacgaagagagataaggtaaaaagttttatcgaatgaaatgagttccacgggcgatgaaacttatgtgcactgtttctaacatatcggagtcttgggaacattgacataaaatccccactgaaactggcctaataaataagctaatctgtgttgggtttgcgtcctgtactgctacatgatttcagtgccagaccaaatactcagttcgatcacttgtatgcgcagataactgcataaggccgaactcatgcaaaatggtgctatgccagggcgtatctgttggaaatgctcagttgctagcttttcctggtagatcatcaagccttaagagcacccagtttcatgttaaaacgaatcattttcctgccagagctctacgtggtatgaagacagcaaatctattttcctttggttcacttcaatttcgacgcacatactcttttattgccattgccaatattgttttcttgaatttctgccttcttattttcttgattgaaccttttttattgataattggagttctagacaaaatatcatgaagctgttcttttcttatgaactgaatgtttcttttgat

SEQ ID NO: 5977 - DNA, 1509 bp, Zea mays
ggttgtattcgaggtcgagttcctagacgcgccccgccgggcccctatctcttcctagttcctacgccgcggcggcgcggcctctccattccggtgtgttctccgatttgggggacgtcccttgcccgctccggagtccggtccagcggagccagctacggcacagatcggcttccgtccgccccttcccatctcaccagactctgcaccgccgcggtgatcgtgcctcggctgcttcctagattactgcttcaggccgtgctgatgcaaaatggttctatgtcagggcgtttctgttggaaatgctcagttgctagcttttcctggtagatcatcaagttttaagagcacccagtttcatgttaaaacggatcatttttctgcaagagctctacgtgttggcactgattccattcatcatggcatgcctacatcattcccaagggagaattctctcaagggcatcccatcactatcagggcagcataatcagcatccaaggtccgttagttgtcgggcatcctcgctggcatctttcagctaccctgagctgacatccaaacccagatggtggtggagaactctagcttgtgtgccgtacttgctgccactgcacaacatgtggtcttatgccgacgtgatctaccagctgcacacttacttgcaggggttttcgctgttgtacaccttcatcgacaccatgactctgtgccctgggtggctctttctggtgatatttatgacggtgtacttcttcgttgtgaggcgcaagtggtcgccgcactttctgaggttccatgtgatcctagcgatccttctagacactggctcccaagcagtggccaccatgtgtacctggatgccaagcatcgtttatcaggggaagccaatgcagtacttctggatgtctatcgcgttcatacagatcttcacagtgcttgagtgtttgcgctgcgctctgtgtggaatgtatcctaatgtcccattcatatcccacaccgctttcattcactctgatctgaatctgttcaggtaggtgcttactacataaggtccaggactcaaggaaggatttcggaatggctacttacagttgtagagagtctgttttgttcatattgaagtcctgtgtaattcttatcataggaccagctggtacactagcattcaaacaacactacaattgattttcgttccttggattttattgtttgtacgtttggttacctgcaaattttgtttcgaggggcagtacttgttcatccgaactcatgttccgtctgtacttcagggctgaaatcccttaaactgtgccttttagggtgcctcgcggctctaagtggcgatgaagatacaactttgggcacatcgaaaatggaggggttaccaggaaattcagtagagatttgctctgcctgtgaaattcattctttccatgcaagcttgtcaaaaaatttcctaaaaacggttcgataacacccgagtgtcgactgcaggcgaaaaaaatac

SEQ ID NO: 5978 - DNA, 1442 bp, Zea mays
tgggacaggatagacaggcgacagctgcacttcagcgattcacccagcgcgccgctctcgtgcgacaattgggcgtcccgcgtccgccgtcgccctgcccagcccttcgccggtcctttcccaggccttcgacgcgtccttcgccgtcgaagagtccccagcagtgtagcaccatgcccttttctcggcccgccgttggtttcttagttagactggttggggtccggccaagctgctgtcctccttcccgtgcatttgcagctgtcagagctcaaaagattcagcttcccaagaaaaaaaggcgattagatgaagtgtgcttagaaaggtttcaacaatacagtagaacatacatccagtcatggattcttcaaggcaaagtcatcgtggatggaagagttgtgaataaagctggaacacaagtatctgacaagtctgtcatcgaaatcaaggctgaaatcccaaaatatgtatgtagagcaggacataagcttgaggcagctatcaaaggatttgatattgattgtgatggaaagatagcccttgattcaggattatccacaggtggctttactgactgtttacttcagcatggagcatcacatgtttatggtgtagatgttggctatggacaggtggctgaaaaaattcgcacacatgaacgtgtttcagtgatcgaacgcacaaatttaagatatctatctcaactgccagaaccagttgacttggtgacactagacctatcatttatctccattctcttggtcatgcctgctgttatcaaagtaatgaaaacggattctacattgataacacttatcaagcctcaatttgaagcacgtagatcacaggtaggaggtggtgggattgttcgagatcctttggttcatcaagaggtactggatagaataatttcaggcgtggaagaatttggattctgcaataagggttggatcgaatctcctataaagggtgcagaagggaataaggagtttcttgcttgcttcaacaggatcccaatatcagagtcacagccagaggcagaggcaaaggaacctgtaacctaggatgtcagcagaaattactcaaagtgcgtcatcattgatcaggacaccctcataaagtatctggaagctatattgattatcaaccataacctctgatattcctgacattcttagttgtgtgataaaatttgtccagtttatcaccattgtttatagtctgtaggaactaggggtacttgtaggagatggagggaggtcgatggcgctgtggtggtgtcaggccatgccaccttgtagggaccgaccatagggtgataggatgcactgcctctatcctacggtgatggtctgatggagttgctccttcctgacggtagatggtgtgtttagtttagattttggaggtggcttttgcctcccaaaaagtcaaaagct

SEQ ID NO: 5979 - DNA, 1452 bp, Zea mays
cccacgcgtccggtctgcctttccctctcccagtttccgtttttttaatgctttgtttactcgcggggatcatggggtaatcgcgtgggccgtgcctggctgggtttactgccttgggccccccgaggccggccgggcccctttcctgcccctccccctccgcctttcctctctctcgctctcctcctctcctctcctctcctctccttccgcatcacacaccacgactcccaaccgccggttggctttgctgctccgagctcttcctcttccacacccgccctctctcttgggtcggcggccgagtgtctgcgtcgtccacggagatcagggatcggcggcggggtatggcgagggagcgacgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtgcttcaaacaaaggatcaacaattcttggaacagatcagcgacctcgaacaaaagagtacacaactggcagaggagaacaggcaactgaggaatcaagtatcccacatacccccagttggcaagcaatcagttgctgatactgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacctaccacttgcatcggcatggcgcgccggccgtaagctgtgctcaagcatgcatgcttcgtgttatacgtgtgtacttattgggaagttgagtctgcatacaacctgaccgccggtgcggtcttgctgtcttacagagagaccgtttagttttc

SEQ ID NO: 5980 - DNA, 1340 bp, Zea mays
ttgggaccctcccgcccggcagatcccctggccctctccttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctgccaacttccctactgttttggcgcgccgcaagctgtgctcaagcatgcttcatgtttgtttcgg

SEQ ID NO: 5981 - DNA, 2641 bp, Zea mays
ccggcccggccggggcccgatgcagcttccctgagatctatcgtcacgtcgccagatctaaccaagccccaaatctgcgcgccggcaatggcggtgcgcgcgagcctcgcctgcttcccctccgacccagcgctccacgcggcttgcggcatgccgtggggcgtcgccatcaccccgttctctgccacagatgagcgcggcttcccgccggccaccggcgccgagggccacctcctcccgcgctgccagtcctgcttcgcctacttcaacttgctctgtccgctcgaccgctggtcctggaactgcgccatctgcggcgccgagaatgacctctccgccgacgcagctgcgcgctacgcccgcgacggtggccacgacccgcccgagatgcgctccgcgttcgtcgacctcctcctcccagtgggaggagggcgaggcggcagcggcggcggctccgacgcccgtgtacgtggcggcgatcgacttgtcctcttcagaggagttcttggagctagtcaaaagtgctcttcaagctgctcttgaagctcttttgccaggatcactatttggacttttgacatttagcagcaaaataggattatatgatgtccaaggtccaataccaatcgtgaagaatgtgtttatccctcctgattctgatggtgccttacaagtcgaccttgaagatatcatgcccctttgctcatttttggctcctattgatagctgcaaagaccgcattactgaagcacttgaaacaattaaaccaatgtcttcctgggaagtagcagcaaatgcgcacgatggacaggatcatgtattgcatcacatacgtggttttggtgtagcgttggatgttcttatcaactacctaagttcagaatatggaaatgcatttgagcttgctaggatatttgcgtttttatctggtccacccaattatggggctgggcagctggatataaatgaggaccaaaattctggtaaagcaaggggtgctgatcatatattgcttcaagagcagacaagtttctacagaaatctggctactagtgctgttcaagcaggtgtatgcgtggacctttttgcaattacaaatgaatacactgatcttacttctctgaaagttctgagtgttgagagtggtggatcactgtttctatattccagtacagatgaatcaacacttccacaagatatatacaagatgttgagtcgtccttatgcttttggatgtgtaatgcgattgagaacatcgtcgcagttcaagattgttgattcttatggccatttcttcccagacccccagtacatgcatgttcagcacataaattgttgcgactcttttgctacatacagttatgactttgagtttgaaaaggattcccaattttccaggaagtcaagccctcccattattcaaattgcatttaagtacactgtgcttgtgcacaatggtgatatatcagatcttccaaattctgggtgcagatttaaatacttgttagaaaggaggctaagagtgcggactatccagtacaacacaactgctaatatctgggacctttacgattttgttgatccagatgttgttttgacaatattggtacaccaggttattttggcttctttaagtgatgcactggaaacaaggctgtggctccaagattggttggtggttgtcatcgctcagtacaacaaagcatacaagaatgtcacatctggaggtggtactgagatttataatattgatgtcaatttctcacactgctcgcaactgcagcctttgtcgcggtttgtgtttgctattctgttgagccccctgcttcaagtcagcagtgaaggcattcatccagattatgtgacatatttgcaatgcctcttgagtgcactggagccagcttcgcttcggcaggctatttggcctacgttgatttcatactcctcccccgatgtagaagcagaagtacatcaatcactaagccggaccgtgttcaccagtgagaggccaatatatattcttgatgcatacaaagaccttctggtgtattactcacctacagctagtagcgaaatcccttttcctcctccacgaaactgtctactgagatcaacagtcgatagactaaaacaagaaaggaatataacacccaaactggttttcattcacggagcacatgatgacactacagaatttgagaaataccttgttgaggatcagaccttggatgggtccccgttatctagctccacaggtttcagctcattccttgatgaggttagaagtaaagtggctgagcatggcatttgaggaccagtgtcacctgtctcccgattgctgaactgtgatgttaaacgggtgatgactgatgacccatgcaacccagaaatactgtcatgaatagaaagagtaagtgctttgctggtttaccggcaaacgtttttgtatgtgtgccgtgtgtttgatggatgctgttcgccatttttttaccgacagctagatgaattttaaagctttcctttacaagaccgcgctatatgtttttgtaatatccatgcgctactatgtttttttgggtacattgcctgttgctaaactatgcatttgctatatacattgctgaaaaacccgttcattata

SEQ ID NO: 5982 - DNA, 2217 bp, Zea mays
agtcgcagcaaccaactcggtccgcgcccgcccgcctccgttggccatttgaatgtgagaaagagagggaccagtgatccgtcgtcggtcgccggccatgccgagatcctcctccagccccggctccggctccaagcgcatcctggggagggcgatggccgcgatcctggcgctgccgctgaccccgatcaccaaggccaagctcggcctgctgctcttcaagaagcgcgcctcctccgcccgccgctgctacaagccgttccgccactacaactacgcctacgtgggcgagtaccagttctcgccctcccgctccccgctgctcccggccccgccccccggcgtcaccacctggcggagggccgccgccaggaggcgccggggcagggccaggatggtcctcgcctccctcttctgcggcggcggcggcgccgacgagctcgacgtcgccgtgctggacggcctcgcgcgtcgcaccgacgggcgcgcggagagggaccagctggtggtgctcgccccggctctcgagtgggcgcgcggccgcgacgacggtgcctacgcctgcagcagcagcaaccacgacgacgacgaggagtcggaggtggcggttgtggactacggggaggaaggcgacgtggaagtggacgaccgcgccgagcgcttcatcgagcggttctaccaggagatgaggctgcagaggcagcgctctctggtccagcgcctgctctagagacattcgtccgttgctgctgctgcttcaattccttggtcgatcggggcagaaccagtcggttgtcgctgctatcttagctgcacttcggttaaatctctccgtatcttgcatttgcgtcgttccatgttttttttgcttctcatgtggcaattctcttgtctgtggaaggagacattcgtctcccctgctgttgtactgttacttctagtccttacctatataatccatccttgtgttgcaatgttcaattttttttttgggtagtgttttgagtttgtacaattattacaaagcatgcgtgctacacacctgtttctattagcacaaaatggcaacttctgatttcaaatgcgacatcgtggattcttcaattcggaactggaaaggagcggctaccagagcaaatcatgggaaacgatcaggatatataatgtggggatgacaagtcgaagagcagcggacggtcagctgtctcgtatcctggatagattaagcgaatcgaggagtgccttttcgacagagtactgcttcgagaactggctctgatttgttctctaattcctgcttgtttcctgccgagtatcctccacttgaccggacagtccacaagctgacaagctgcacaagtccagaaataaataaataaataaataaataaataaataaataaataaataaataaataaataaataaatattatatttaacatttccgattcaattattggtaaactcaccatgccaaaaaggtcgaacatgttgcttttgaattctctcgattgcatcgtgaactcgggattcagagtgtgatcttagagcagaacatgtgctaacatgggcaaactaacggtcttctaattcgtgcttagcactagatccagcaaaaaaagtgcctttttcatcacacacaacaaaacgtaccctggcgtacaatgttgttatcagctgaagccgggcctttggggaatcccacagatggagcaccacgcacccccctttgaatctgcctcggcaagtcgtccacgccctagacgatctgtgtcattacaacctagaaacgattaggtaagtacaattgtattatattaattatgcaagggtatttgtaataattatcattatgtttaggcctttattcgatgtttattcacatattatgttcgtaactgcttttatgaactatttaattgtaagtatggcaggtaactatcctgcaacgcctgagctcttggaccaagtaatcgactcgggtcaccggtcttttctggcagcggtcgagcacgctaacctgcatgtactacgtccacgtccacccgaggagcgtatcgagctacaccactgttggtttccgaggtttgtaatgaattgatcaaatattcactttaaatgttatcgtgtactgatctcgcatgtatctttaggttgcaggatgccggtctcctcactttagttcgtctggtagacggtgggcttgtgcaagggta

SEQ ID NO: 5983 - DNA, 1723 bp, Zea mays
cagcctccaggcccatgtgaaacggtggatggcccgccctacgcgacccgggttctgcaccctgccgtttcttctccattattcccagcgggcgcgctcgctctctctttctccctcccctcctcgtggcgacgattgggggcagtcgctgccgccgtacgccaggtgcccagatcttcttcatgcccttctccagcgacgagtatcagaagctgtttgtgcttttaaggatgcataagcgtatggcggttttgatggtatccattgtttgaacgatgggaggatagaagaccattctctgcataaataggcttcataagtattattgctttattgctttaatattatcatatgattgagtgcacaatgccatcaaccttacttgatgatctccctaacgaagttgctctccagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaacacactatatacttcatcattttcatttggcatttaaatattttggtggttttaaatgacatcttgctggtttgaataaaaaaaaaaaaaaaaaaaaaaaaaaaaaaaaaaaaaaaa

SEQ ID NO: 5984 - DNA, 894 bp, Zea mays
  misc_feature (9)..(9): n is a, c, g, or t
  misc_feature (14)..(15): n is a, c, g, or t
  misc_feature (871)..(871): n is a, c, g, or t
taccctcgnaggcnncggccggaaaaaaaaaaaccctccccgagccgctcccttattcccagcgggcgcgctcgctctctctttctccctcccctcctcgtggcgacgattgggggcagtcgctgccgccgtacgccaggtgcccagatcttcttcatgcccttctccagcgacgagtatcagaaggcttcataagtattattgctttattgctttaatattatcatatgattgagtgcacaatgccatcaaccttacttgatgatctccctaacgaagttgctctccagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcagggntaagatgcatgtattgcataaag

SEQ ID NO: 5985 - DNA, 1797 bp, Zea mays
gtcaaactttctcaaatctgattaggtttagagaaaatttagcaatgttcatatatttaaataagtttattgtaaaaatagatttaagtgtcaatactaattatgcactgtgaacattaatattttttttatataccttatcaaagctaaaagcatttgactctttggaaagagagaaggacgattcttttagaacgacgcgagtagttatgttatttaatgcttttgcatatagtatatattatgtgtagataggaacgtcatgttggcatttcgtcatgttcttgcattgtttacgttatatatatacggagtagcgcgcggcagtatataagcattagctggtgggatcgatcgctgcagagttgttgattgcagggaaaccgccaattggcaaggatgatgaagcttgcgatcgccttcgtcgcgctgctctcttctttcctcgccgactcgtccaccgcggaggagttcgatttcttctaccttgtccaacaggtgctgcggcatgtcgtcgtgaccggagcggagatcgaccgaccgatcggccagcctctcctctgaccaatttaacccagcgacgacgacgcacgaatctaatctaactctaacggcgtgttctgttccttgtcgatcgatgcatgcatgcagtggccgggctcgttctgcgacacgcggcagggttgctgcttcccggacggcgcgggcaagccggcggcggcgctcggcatccacgggctgtggcccaactacgccaagtgccgcggccgccaccaccgcgagggcggcggcctcgcccgcgcggtgctcggcgccggcgacgccttcctcgccgccgtggggcggcggggcaagtgctggccggagtactgcggcggcgcggccgccgcggccaccagctgagcccctgggacgtccgggacctggtggcgtcgctgggccggagctggccgacgctgtcgtgcaagaaccggcgcagcttcgagttctggagctacgagtggaagaagcacggcacctgctccaacctggacccgcacgactacttcgcgcgcgcgctgcagctcagggagcggcacgacctcgcggcggtcctcgcggacgccgggatcgtgccgtccgacaccgacacgtacccggtggaccgcgtcagggacgccatcgcgcaggggaccgttgctgtcgccaacctcgagtgcaaccgcgacgcggacggcgaggcgcagctgttccaggtgtaccagtgcgtggaccgcgaggccaaggacctcatcgactgcccgctcgccatgcccaccaagtgcaccgatcgggtcaagttgcccgtcttctgattccgagcttctggtggctgtcgtttgcaattgtgaaaacgggccgggtgcagatcgatcgatacgacgatacatgcatgtttgcgtatgtgatttcgaaagcggatttgaataaatgtgtttcgacagcaacggtgcgcgtgcagatctgtttgtgttcatagtcatcagcgatgtccggtacaaagctagcttagtggcggcagtgtgtattctcttttaatttgtggatttatagttgaccttttaccctaaaacgtcatcttctgtggatcttattatcgtgccaacatccatcacgactcaacaaacaaattatagaactactactatctctatttgagttcctagctaatcgtaggcagcttgctatctagtcttgttttagcttctctagccagctagcttctcagaaggaaaaagtcaaacaataatgttcattatatattgctgcttacgatcg

SEQ ID NO: 5986 - DNA, 1182 bp, Zea mays
agtcgacctgcagagttgatagcagggaaaccgccaattggcaaggatgaagcttgcgatcgcctccgtcgtgctgctctcttctttcctcgccgactcgtccaccgcggaggacttcgatttcttctaccttgtccaacaggtgctgcggcatgtcgtcgtgaccggagcggagatcgaccgagaccgatcggccagcctctcctctgaccaatttaatttaacccagcgacgacgtacgaatctaatctaactctaacggtgtgttctgttccctgtcgatcgatgcatgcttgcagtggccgggctcgttctgcgacacgcggcagggttgctgcttcccggacggcgcgggcaagccggcggcagcgttcggcatccacgggctgtggcccaactacgccaagtgccgcggccgccaccaccgcgagggcggcggcctcgcccgcgcggtgctcggcgccgacgacgccttcctcgcctccgtggggcggcgggggggcaagtgctggccggagtactgcggcggcgacggcgacggcggccatcagctgagcccctgggacgtccgggacctggtggcgtcgctgggccggagctggccgacgctgtcgtgcaagaaccggcgcagcttcgagttctggagctacgagtggaagaagcacggcacctgctccaacctggacccgcacgactacttcgcgcgcgcgctgcagctcagggcgcggcacgacctcgcggcggtcctcgcggacgccgggatcgtgccgtccgacaccgacacgtacccggtggaccgcgtcagggacgccatcgcgcaggggaccggcttcgcggccaacctcgagtgcaaccgcgacgcggacggcgaggcgcagctgttccaggtgtaccagtgcgtggaccgcgaggccaaggacctcatcgactgcccgctccccatgcccaccaagtgcaccgatcgggtcaagttgcccgtcttctgattccgagcttctggctgtcgtttgcaattgtaaaaacgggccgggtgcagatcgatcgatacgacgatacatgcatgtttgcgtatgtgatttcgaaagcggatttgaataaatgtgtgtttacctttcaaaaaaaaaaaaaaaaaaaaaagaaaaaaaaaaaaaaagaccggccgcccgcgatctagaactagtc

SEQ ID NO: 5987 - DNA, 1892 bp, Zea mays
  misc_feature (1706)..(1706): n is a, c, g, or t
  misc_feature (1804)..(1804): n is a, c, g, or t
  misc_feature (1826)..(1826): n is a, c, g, or t
  misc_feature (1839)..(1840): n is a, c, g, or t
cctcgaggccggccgggccggtagagctagccggccgggaactcggcactagcaccggtagcagcagctaccaatggctcacgttgccggtgacatcgccgttctggtgctctttctctcgttgtcgtgccaaagcacggtgtcggccggtgccgccgtgcttggccgtaaggcaggagggtcatctccggcgacgacgcacgagggtacgaatccagccggcacgggcatgggcacgggcacggcacagtacgcggtcattttcgacggcggcagcacggggagccgcgtgcacgtcttcaagttcgacaagcagttggacctcgtcaagatcggcgacgatatccagttcttcgcgcaggtaaagccggggctcagcgagtacgctggcgaaccacaagaggctgccaggtccatcgcccccctcctcgagaaagctcaaggcgccgtccctgcgtcgctgcagagcagaactccccttaaactcggcgccactgccgggctacggctgattggagatgagaaatcggaagagattcttgaagcgatccgtgatcttgtgaagagcaagagcgaattcgaatacaacccaaactggatcactgtgcttgaggggtctcaggagggatcttacctatgggtcgccctgaactacctgctgggcaagctaggtggggactactcagacacggtaggcgtggtggacctcggaggtgggtcggtgcagctggcctatgccatctctgacgacgcgtccgcgaacgctcctgcggtgccggagggacaggacccttacgttaccaaggaacacctcaaagggaaacactacaatctctacgtgcacagctacttgcactacgggcttctagccgctcgcgcagagattctgaaggcgaacaacgggccattcagtccctgcattctgcgtgggttcagtggtacgtacacctacaacggcgaggaatacgaggcggcggcggcaccagaaggcgcgtcctacgaaaagtgcagggacggcgcggtggcggcgctgaacctgggcgcgcgctgcgaggcgaaaaactgcaccttcaacggcgtgtggaacggcggcggcggcgccggccaggccgacctctacgtggcgtcctacttctacgacagggcctcgcaggtcgggatcatcggcggcgacgcgcccaacgggaggagcaccccggccgcgttcgccgacgccgcgctcaaggtctgctcgctgagcgttgccgatgccgaggccgcgttccccgatgcctgggacgccgagtacctctgcatggaccttgtgtacgagtacacgctgctcgtcgacggcttcggtttggagccgaccaaggagttcacgctggtgacaaaggtgaagtacggagaatactacgtcgacgcagcatggccgctaggcgatgcgatagaaaccttgtcgtcccagaagctgaaccaaatcgcgtgaccagtaataataatgcttaatggagtggtaaaaaataatggtgtttagacgacgtgctacagttgatgtaatggcgtaataaatggatgtatatatctctgtcccttggctacgcctgctaatatatatcagagaggaagatcgatgagaggaggaaattgtaagttctgcaataattagcatgttcacgtgaaaaaaaaaccttctatgggtgccaacaaatgatcatcattatatngaaaagagtttatacatcacgtggaatacaatgagttatcttaaaaaaaaaaaaaaaaaaaaaaaaaaaaaaaaaaaaaaaaaaaaaaaaaaaaaaanaaaaaaaaaaaaaaaaaaaaanaaaaaaaaaaaannaaaaaaaaaaaaaaaaaaagggggggggggctttgggaaaccccccgcttcc

SEQ ID NO: 5988 - DNA, 4824 bp, Zea mays
  misc_feature (345)..(345): n is a, c, g, or t
  misc_feature (459)..(459): n is a, c, g, or t
aaaaaatactactagctaagcctttcatttatccttttatctaacattagcatcgacctctgtatactagaagcatgcatctaaactttataccttaaatcattaccaccaatacacatcaatgtgtcattatattgcttaatgtatgtgcatataaattataatttgtcgacaatatatttcttgtgcttatcaattatttactgataaataataaacatacactaagcatggtgaatccaaatttatgaaaaatgacatattgagaatgaatcatgacattagaaggcaaactatattagggtagaatgttattttttacttgattgtcataaaaatcagcantttattttgttttgaggatgaggattgcatcactaattttccttagttttacaaaaaaaaaactaaagcaagaaggactaagaagaaaatcgtgtgattatttacaaaatgcantaaagataaacggttttggatttgacaggtcactaaaaaaggaataagttttagttgcgcaacaccatgtattgttgttaccttatctgcagaagcaactttagaagttacctcacgacttattcttgattcccccacatttcttccccttctacaatgacacaaaaatgaacaagatatgcaaatcttaactcattgtttgaaatatccatgggaagcaaaacaagcagcactgctgaaaaaggataatttttatggcagtcactgaaagtggagtaactatactactgaagatcaaaatttaggcacaatctgcagaaagggagggaggagacattttagtttgtttatcgatatgaatagggcacagtttacctcctactttatgttggtgatattgtactaacaatttcctcaaccactctggttgcactaacaattacctccttactttatgttggtgcacttcagcagaagtcccctgtgatagatcttaacgctcttcataacttcttgggcatacatgttcagcacacaggtttgggtctcttcctctctaagctatagtacattattgagatttcttgagcatgctagaatgattgactgcagaggccacctagttacgtcaattattgttgcctaaggctaagatgcacactctcagccattggtcattcagccattctggtaccgtttcagtcgttgtattacattttcactcattctgttgtggtttcagtgattctgttactgttacagttgcagacgttcggtcacagcgggacacatggggagtgccgcgtgtttggtggttgcagcgtgcgggctaatcggggtgcgacggttagggcacctgaagaagcgcatgggctaattagaatacatgtgtttagtgtgtttacaacggttcccgatggaatgtttcgaaagttttgattgacattttttattttaaagattttcataaatggcttacgaaatgacatagtggcttacgaaatgacatagtggcttacgaaatgacatgttctcaagtatgccattgggtaatactgatcccgtggaggaactgtagaacaggccctgctcatagcatgaaagcatagatctgggcctaggcccaggaatgcatgggcttatccctgagcccttcaccatctcggttctcgaagccgtagtagaagatatgacagggacaagtattccacacctgatccccggacagaaaaagaaaaaaaaaactgaaaaagaccccgccgattctaagcggctggctgccactcaagttgctcgtccttttcttgccacccagcagcgctccatctgcatattggcaacggagaaaacctttactatctcgatgataagcacatagaacctttgcgtctcaatgacaagaacctaaaggttacctttctttgttcttgggccacatgccactctgttcacgcatttagctagagcaacgaagcagatatcctacgggagggaatgacaacaaaacatgaccatgaatattcacggcacgccttgtccagcggcgctggtaaatactttgtggccatggagatgcaagcgggtagcaggacaacagcaaccatacgaccagcatggcactttcttatcatacgaacctagcacagtgtgagtttagtgcaaataacaagacttgatatatggtgctcgtccaatttgattaatgtgcacagtgtgtgtgtatactatatagcagtacatatgaaaatccaacaaggaacaggcacgacgaaacatttcaggatccaggattttccaaccgccctaagatggtagcgacatgctgaacagtgacgaacagcagaaacggacacagaactagatatctggaaaaccggctgggcggaaggtgaggccaaaacgatcatgcaaactgggaacagtgaggtgatcagctgcgacacaagttatggatcaggcaggaatcttgcccacatccccttccaccactcattcgcagccaccaaccgttcgcctcagcgtgcgcagccgcggtcaccacatcacagaacggcgctcacttcttcccatagccggccgcccttgcccacagtcacacagcttgtctccttcctcctctccaccccggccccttgatctcatctcttccatcctagcttgctcgccgctgccagtctctcctccacctgcaactcccatgtctcagtcttctcctctcttctccgtcgcccgagcgcacgccggagcaggagggcgagccgtggcagccgctctcctgctccgtcgtcgccccattgcacagctgccgcacagcatccatggcctacggtgtctctctccagccagagcgacaccttccaagacgctcctcagcctcccccgcgccacgctgtcctccttcgccgaccccgacggcgacggcggctccagcgcgaaagccagcgacggcggcgccaaggccggcgccggcggggaggagcaggtcggggaatgcgagatgtcggagatggccagggcgttccacatctcgccacgggtggcgacgtccatctccgtgacgatcgcgttcgccgccctcaccgtgccgctggcgatgcgctcgctggtctgccacgggaccttcaggatgaacgcgctggcgtacttcacgctcctgtcggggttctacatggcgtggaacatcggggcgaacgatgtcgcgaacgccatggggacgtcggttgggtccggagctctgacgctccggcaggcggtgctgaccgccgcggtgctcgagttctccggcgcattcctcatggggacccatgtcaccagcaccatgcagaagggaatcctggttgcgtctgcgttccaagggaaggactctctgctcttcgctggactcatatcctcccttgctgctgccggtacatggctgcaggttgcttcgtcatatggctggcctgtctcaactacacattgtatcgttggggccatggttggtttcgggctggtgtatggaggggtggatgcagttttctggagttctttggctagagtatcttcatcctgggtcatctctcctttgatgggtgcagctgtctcttttcttgtttacaagtgcatacgcaggtttgtatacagcgcaccaaatccaggccaggctgcagctgctgctgcaccaatcgcagtcttcaccggtgtcactgcaatctcgtttgctgcttttcctctcagcaaggtgttctccattgccatcctgcaagcagtgtccagtggggcaataggagccatcattgtctcccgagtgatccaaaagcagctaggtgacttgctgtcttcagaagcagagaagatcgcgtctgctgagaagtcaagtgcccagcaggctggatttctctcggacattgctggccctacgggagctcagctgcagatcgtgtacggtgtgtttggttacatgcaggtcttatcggcatgcttcatgtcatttgctcacggagggaacgacgtctccaatgccatagggcccctggctgcagctttgtccatccttcaaggtgtggcaagcagcgctgagatagtcatacccactgaagttcttgcttggggtggttttgggattgttgcagggctcacaatgtggggatacagggtgatagcaacaattggcaagaagatcacagaactaacacctaccaggggctttgccgcagagtttgcagcagcttcagtagtcttgttcgcatcaaagctcgggttgcctatatctgccacgcatacacttgttggtgcggtgatgggtgtcgggtttgcaagagggctcaatagagtcagggcagagacagttcgcgaaattgtggcgtcctggttggtcacaattccagttggtgctgtcctatctatcttctacacattgatcttaaccaaaattctggcgtacttcatgtgagtggattgtaaaataaaagggctgcttttaagtggtacagcccattgtcacttcataaattttgatcagtggaaaaaggattttcttttgcaaaagtaaagagatggactgattccacaagttccaccagaaatttacaagaatttccaagaccaaataaccattttcttggaaactgagcaaattagaagtgtttcccagcaaataatcatggtacaggctcctgaattattatttttttcaactttttatactaccttgtatgtctatcacaaggtcgaatactgtaacttctcgtagagctgttatacatatagatgtaatgtaatggttggtcaaatttattcttgtaaattgtaatgatatcgcatgactttgttcattgccaatcatcctagaataagagctcattcctctgcaggaaattatatgac

SEQ ID NO: 5989 - DNA, 1281 bp, Zea mays
gcacgagaccattacctagaacatctatcaaaaaccctagcaaagccacctcaactctcctgctggtccggcgcaggctccgctccgttcccccgctgtagttcgagtgttcgacccggcggccggcggcgacgcgctcgtggtttccagcgatgtcggcgcaggcgggtccagggacgtactccccggcggcggccgcaggagacaggcggcgggagaggaaggaggagctgcggcgccacctcgccgaagacgccgactggccgcgggccgacggccgctccttccacgactgccggccagcgtttatgcagacaggaccaactactgctgcatcagggtctgcttatgcagaatttgggaagacaaaggtcattgtatcggtttttggaccaagggaaagtaagaaagcaatgatgtacagtgacgttggtaggctcaattgcaatgtgagctatacaacctttgccactccagtgcgtggacagggagcagacaacaaagagtattcatcgatgcttcataaagctctggaaggcgcagtaatgctgcacactttcccaaagaccactgttgatgtttttgccttggttcttgagtctggtggcagtgatcttcccatcattatatcatgcgctagtcttgcattggcagatgctggaatcatgatgtatgaccttgttacgtctgtatccgtgtcctgtttcagaaagaacatcatcatcgatccaacctcagacgaggaagcatggcaagacggaagccttgtggtggctttcatgccagcccgcaaggagatcacgcagctcacgctcactggagagtggagcgatggcagaataaccaatgcagtagagctctgtatggatgcttgcagcaagctgggtgacatattgcgtgaccgcttgaaagataccgctaccttgacgtgtgaatgacgtgttagagagagcactggcaacaacagatgttcttagctgtacaaattctgtaggcaggggaggctgatcggcctgatgtttgagtgagcatgatgcatggttatgatgatggtctccttcacggcaaaagctgtcaaaccgggaagaaattgcagggcagtgtgtatttggcatgtaacgtacttctgactgacctttgccttcatgtagcatctgtatctttctttttccgcgtactgtaacacttcttactctaccaggagctggaattttttttggttcgggtgaaaaaacattttgctgctctcagcttttcaccaaaaaaaaaaaaaaaaatata

SEQ ID NO: 5990 - DNA, 2437 bp, Zea mays
atggcataattttccatactggtgactggaaaattgatgaatcaccagtggatggaaaaaattttgaccgacaagcattggaggagctctccaaagaaggtgttactcttatgatgagtgactcaacaaatgttctttcccctggaagatcaatcagcgaatctgttgttgctggttcattgctgcgacatatttcggaagcaaaaggaagagtaatcacgacacagtttgcctcaaacatacatcgaattgggagcatcaaagctgctgcagatttaactggtcgaaaaatggtgtttgttggaatgtcactcaggacataccttgaagctgctttcaaggatggaaaggcaccactggatccatcaaccttgagtcaaggtagaggatatggatgcgtatgcccctaaagatcttttggttgtcactacaggttcacaaggagagccacgtgcagctctgaatcttgcatcttatgggggaagtcacgctcttaaactatcaaaagaggatgtccttctttattcagctaaggttattcctggaaatgagacacgggtaatgaagatgatgaatcgtctcactgatcttggcccaaaaattatcatgggtaaagattctggcctgcatacctctgggcatgcctaccgagaggagctggaggaagttcttcggattgttaaaccacaacatttcttgcctgttcatggagaactcctatttctcaaagaacatgaatcacttggaagatcaactggcatacggcacacaactgtaataaaaaatggagagatgcttggtgtgtcgcatctaagaaacagaagagttttgtccaatgggtttgtttcattagggaaggaggatcttcagctcatgtatagtgatggtgataaggcttttggtacatccactgatctctgcgttgatgagagactaagaattgcatctgatggcattatttttgtaagtatggagatcttccgacctcagaaggaacatgggttagcgcagtcaggtttgaaaggaaaatttaagattaccacaagatgtctatggcttgataatggaagattattggacgcactctacaaagcagctcatgctgcattgtcaagctgtcctgtgaattgtccacatagtcacatggagaggatggtagctgaaatcttgaggaaaatggtacggaagtatagtggaaagaggcctgacgtcattgctgttgctacagagaacaccacagcaggtttctcagaacacctcgacactaaagcatctggaaattttggaccgtcctcagctactagccacctgagcaggagtccagctacgagtcttgaaggcagttataaaacacacccagacaacccagaggtggatgctgaagaaatccttcccgagactgtgagaacaacacccgacgatgcaaccacaagctccaatggcgaagcattattctcttcagatttacatcagcctaaaacattggagcacttttgggagtcattcaaatcccctacagctgtcaaaattgcacggatcgtcaatgggggggacaaacaaaatttcggcaagattggcataatgggtcaggactcattaatccagtcagctcctgctccagttaaatcctcaaaacggaacaagtggaaacctgaggaaattaagagcttaatacagatgcgtggcgaaatgaatgagaaatttcagagcgtgaaaggaagaatggtactgtggaaggagatttctgataccatgttgaaccaaggagtaagtcgtactccggcacagtgcaaatctctatggacatcgctagttcagaaatatgaggaaagcaaggatacggaaagcatgaagacttggccgtatttctcggccatggataagattctatcgcagcaaggggagatggcaaccaaaggatagaaaaaggcttgtagcttagtggtagaaatttagaatattgattggtatgttgcagcagagcccagtcagtctagtaatataaagatgaaatgtctgtctacagtgcctggtgatctattgggatcggattcttttgttttgtgtaagacatgcagtagcacaagatcgagatgcatcgactggcttggaattaagcttcagggcccgtggactcagagcggggtagccaggagcgctctattcttagcaacaggcagacatgtgtggttttatctgccagataacgtttgtaactcctataatgtaataggctacacggtaggcgaacggcgaacccctaaaagacaactgatgtatcatatgttttgaggagttatgtaatcgcctgcacggcatatacgtgtacttttcttcaaagcgactgtgtacatcaatggtggatacatggtcgccccacctgttgtctgacaaaagaaaatggagacgcgtgccgacgcgaggcacgtgttgctgc

SEQ ID NO: 5991 - DNA, 3318 bp, Zea mays
  misc_feature (1896)..(1896): n is a, c, g, or t
ggggtgtggtgctggacgtcagcgtccaaacaggccctcagtcagtcattgatgtgcaccattttgatggcataagtgatttgtttatgtcttgcatcatagtactataaatctgattcttagaattcagtcatatatcagtcatcatggcctcatatgttctcaacggaagccatttaggagcaacagtaagaaccattgcaattggttcattatgtagtacttgaaatccacgatttctattatgaaaaaatacagccaaatttgagggatagttacacatcgaggctttttgaacgctactcttctggcttcctcctggtatgcccctatccacttcctccattccgcctttcagaggaaagcatttgccttttggccctttgattattgtgtggtttcaaattaatttattcattcatagcttcctaggtcgaaggtaaatagaaagtcgttggtttttgttaaacctggattgttatggctatcgatgttacttggacctctggtactaggctcctcatattccgctcactagatttctgatgttgattcaatttccttccattcaataaaatccatgtgtgtgattgttgtcctatgttaatttgaggccaaggaagtgaatgggtgaaaatgattttgtctattatcacatgatttggttttttacagcatactcttatagcccacctgtaattcatcagcatggattgattatgtgcctctctattttgttgtatcagttatgaagtttaaataaacattgaatccatgttcttgcacactatttttgtaatgttcaaccaaaaaatctgcttcatatatgttcagcaagacagaagttaataggttacattcagttttttcagttggtaatgttcacaacaacaaaaaggacgtattcagttttttcagtccttttctgttcagttcttaaccacttgtagttgcctatttggtaatgtttaagttcccatgaccgatctggcagtgcagttaaatttatgggttcttttagagccatggattagattaatgtacgttgtccacaaactcttaacaccgacaaactatccttcaggaggcgctaggcaaggaggtgagtaatacctattacctcgtgctccatccaaatcccaaaagtgtaactcctctacagctagcaccaacacatgattgttttgtgcaaatgtttaggtgtgttaaatgattatgagcaatagtctgatttgatggttgagttattttcagatattaagatagtttaccttttaacgttatcaacacattgatatgctacatgatctctgtccgtgcaatcttttgatatgttacagaatgcactattcctaattgcttagttgaagcatcctgcagatcaaggtagaggatatggatgcgtatgcccctaaagatcttttggttgtcactacaggttcacaaggagagccacgtgcagctttgaatcttgcatcttatgggggaagtcacactcttaaactatcaaaagaggatgtccttctttattcagctaaggttattcctggaaatgagacacgggtaatgaagatgatgaatcgtctcactgatcttggcccaaaaattatcatgggtaaagattctggcctgcatacctctgggcatgcctaccgagaggagctggaggaagttcttcggattgttaaaccacaacatttcttgcctgttcatggagaactcctatttctcaaagaacatgaatcacttggaagatcaactggcatacggcacacaactgtaataaaaaatggagaaatgcttggtgtatcgcatctaagaaacagaagagttttgtccaatgggtttgtttcattagggaaggaggatctttaggtgaaccatttattttacacngtcgtttttttatgtcttttgcagttatgatatctaacatgatatatgatattacagctcatgtatagtgatggtgataaggcttttggtacatccactgatctctgcattgacgagagactaagaatcgcatctgatggcattatttttgtcaagtagcttcttgtacagttttggagtattttctaggtttatcttcagcaaaaatttctcctcgcatgtgaaatgatagtgatttatgtcgaaccttgtgatagtcaaaatggtaaaccatatatagtattgttcggtgcacctaaacattttacatgttactcctttgcagcatggagatcttccgacctcagaaggaacatggtttagcgcagactggtttgaaaggaaaatttaagattactacaagatgtctatggcttgataatggaagattgttggacgcactctacaaagcagctcatgctgcattgttaagttgtcctatgaattgtccacttagtcacatggagaggatggtagctgaaatcttgaggaaaatggtacggaagtatagtgagaagaggcctgatgtcattgcggttgctatggagaacaccacagcaagtttctcagaacacctcgatgctaaatcatctggaaattttgaaccttcctcagctactagccatctgagcaggagtccagctatgagtcttgaaggcagttataaaacacacccagacaacccagaggtggatgctgaagaagcccttcctgaggccacgagaacagcactggatgatgcaaccacactgttatgcatctatcatgcataatggataatatccgatgttatgtttctttcaccagtggaaatttgctcatgttacattcagtaagccggaatacctccaagatttagatattgtaatgaacagattccataaacagagacctgtttatggaggttgggaacaacaccttggattggagcatacaaccactaccccaaaaaggtcctacttaggcaacaaccagaaccaccattcttttgagaagcctgtgaagatttacaactaaagctgggaatactttttacaagtgatgaatggatatgaaggcagccttgttccaaaaccagtcttttggtgatgtacatagagcttttgcatagagtagtttatgtggcagttatctcaagaattttcatctggtggatgtacagggttcgtatagcaacatttccttgtagaaagttgaagttgtatatcgagggtggatttacctgtgtttatcttttcgaccctaagcctctgggaagctgtgaaccatagcctcatgaaatatgcctgttgttgattcagggtttgtgtttttcttgtttgtcattattttggactcgcttttaatataacacccattttgtatataagttactccggcctt

SEQ ID NO: 5992 - DNA, 1847 bp, Zea mays
ggagtcaccgcgtggcggccgtttagactagtgatccccgggccgcggtagtcccccccccccccaaaaaatggagaaatgcttggtgtatcgcatctaagaaacagaagacttttgtccaatgggtttgtttcattagggaaggaggatcttcagctcatgtatagtgatggtgataaggcttttggtacatccactgatctttgcattgatgagagactaagaatcgcatctgatggcattatttttgtcagcatggagatctttcgacctcagaaggaacatggtttagcgtagactgggttgaaaggaaaatttaagattactacaagatgtctatggcttgataatggaagattgttggacgcactctacaaagcagctcatgctgcattgtcaagttgtcctgtgaattgtccacttagtcacatggagaggatggtagctgaaatcttgaggaaaatggtacggaagtatagtgggaagaggcctgacgtcattgcggttgctatggagaacaccacagcaagtttctcagaacacctcgatgctaaatcatctggaaattttgaaccttcctcagctactagccatctgagcaggagtccagctatgagtcttgaaggcagttataaaacacacccagacaacccagaggtggatgctgaagaaacccttcctgaggccgcgagaacagcaccggatgatgcaaccacaagttccaatggtgaagcattcttctcttcagatttacatcagcctaaaacattggagcacttctgggagtcattcaaatctcctacagctgttaaaattgcacggattgtcaatggggggaagaagcacaatctcggcaagattggcataatgggtaaggactcagcaatccagtcagctcccgctccagctaaatcttcaaaaaagaacaagtggaaacctgaggaaatcaagagcttaatacagatgcgtggcgagatgaatgggagatttcagagcgtgaaaggaagaatggtcctgtgggaggagattttcgacaacatgttgaagcaaggaataagtcgtactctggcacagtgcaaatcgctttggacatcgttagttcagaaatacgaggttagggacaaattctgtttcttccgagttctaaaaaaccaccaccggaaagcaagtacagaagaatgttttgctccatctgtagaacgaagcaagatagcttcagattgcggttgcaatgtctgacagcggtaatttctctgtcgttggcaggaaagcaagaaggacgtggagagcatgaagacgtggccatatttctcggccatggataggatcctatcgcagcaaggggaaagctgggaatgctttcaaactacagatgaacaggatatgaaggcagccttgttccaaaagcagtcttttggtgatgtacatggagcttttgcatagagtagtttatgtggcagttattcaataattttcatctggtggatgtatagggttcgtatagcaacatttccttgtagaaagttgaagttgtatatcgagggtggatttacctgtgtttatcttttcgaccccaagcctctggaagctgtgaaccatagcctcataaaatatgcctgttgttgattcaaaaaaaaaaaaaaaaaaactcgagggggggcccggtacccaattccgccctatagggagcgattacattcacctggccgcgttttacaacgcggactggaaaccctggcgtacccaattaatcgcttgaaagaatccccttccgcagttggtaataccaaaggccgcacctatgcctccaacagtgccacctgatgctatgcaattgaccgttattt

SEQ ID NO: 5993 - DNA, 1372 bp, Zea mays
tgccgatgatgagctcatgagaaccgtcacacgtcacccgcgctgccaaaacacgcgctcgtcgcaatttgcaagcgcaggaaccaggagaaaggtcggcggagcgagcaggaagggcaacgcagcgctgcgtgttgcttgtcgtccttccttccccagcctcccaccgcatcaccaccaaccctcctcccctctctctctcaaattcccacgttgctctcccgtcttccctcctcccctccccaaacccccaccccaacgcccagatctaccctccccatttacagctttctctccggccctgcgccccagggcaccgcgccgcccgaaaccgtcggcgccggcgcgatgcgcgtgccatgctgctcgttatgcaacgtcagatatgacgaggaggagcggacgccgctgctcctccactgcggccatggattctgccgcgcgtgcctctcccgcatgctagcggcagcccccggagccacgctgccgtgcccgcgatgtcgccatccgaccgccgtaggcaactcagtctctgcgctgcggaagaacttccccattctatcgctcctctccgcatccccctcatccccgtctttcctccactccgactcggggtcatcctccgacggctccgaagatgaggatgacttcttcgcacggcccactcgccgccccgcgcccgcgcccgccgccgcgtcgcccggatgcagctccttcgacctcgcctcgcacccggacctcaagctcgcccgtcgcatcgggagcggcccgcctgggcccgccgggcaggacgtgtgggtcggcacgctgtctcgtggcggcggcggggtcaagcggtgcaagcaccaggtggcagtgaagagggtgccccaaaccgcgggggatgggctcgaggttgttcaagaggaggtggagcggctgaggcgtgcctccacatggtgtcggaacgtgtgcaccttccatggtgctgtgagggtcggcggccacctctgtttcgtgatggatcattatgtcgggtctgtgcaggcggagatgcggcagaatggtggacgcctcacgctggagcagattctcaggtgtggcattgcatcaaaatgtcggtacttagtaatattgtgcggctattctttctgctgctgtcttaccaataatcgctgcaaacatattacattgcaacatagctgctctcttttattattactcagtagtcagcaagaagcatgcctagctagaaccttcactaaatgtggcaaattgtgtacgtgtagtgtatgatagcttgctttgtgacatgtaaagtggttgccttgttaatggcgttatgcagtttgaactttgatttcattggttctgcaaaaaaaaaaaaaaaaaa

SEQ ID NO: 5994 - DNA, 3224 bp, Zea mays
agagctcaccaaatcttttggatgggatagctatgattcgttcatgcagcatgatgttcaagaattgaatagggtcctatgtgaaaagctggagaacaagatgaagggaaccactgtggaaggagcaatacaaaaattgttcgagggtcaccatatgaattatatcgagtgtattaatgttgagtctaaatctaccaggaaagagtcattctatgatcttgcactcgatgtcaagggatgttctgatgtctatgcatcatttgataagtatgttgcggtgcaggggttagaaggtgataataagtatcaatctgaggaacatggtctacaggatgccaagaaaggaatgctttttattgactttcctccagttctgcaacttcagttaaaacggtttgaatatgattttgtgcgggatacgatgctcaagataaatgaccgttatgagttcccacttcaattggatcttgatagagatgatggaaaatatctttctccagacgcggatagaagtgtgcgtaacctatatactcttcatagtgtactggttcatagtggtggagttcatggaggacactattatgcctttattcgtccgaagctgtctgatcaatggtacaagttcgaggatgaacgagtgacgaaagaagacatgaaacgagcattggaggaacaatatggtggtgaagaagagctcccgcataccaaccctgggttggatactgcaccgcttagatttaccaagcattcaaatgcttacatgcttgtttacattcgagaaagtgacaaagataacattatctgtgatttggatgatgaagatatttcagaacaccttaaggttaggttgagaaaggaacatgaagagaaggagtacaagaaaaaggagaaggctgaggctcatatgttcactgcattgaaggtggcccgagactttgatattaaagagcaaattggaagacacatgcactttgatcttgtggactttgacagagttaatagcttccgtgcacctaagaacatgtcaatcaacgaagtcaaggaggagctttctaaagaatttggcatccctgtagaatgccaacgattttgggtatgggcaaaacgacagaactgtacctacagacccagtcgtccattaacctcccaggaggaaacatctactattggggttctcaaagatgcaacagtggcgaagttaccgaattctgaagtacgattgttcttggaggttcatttcagacaggagaaccaaccaattgctccttggaataccaaagaagatatattacttttcttcaagctctatgatcctgaaaaagaagacctaagatatgtcggcaatttttttgtgaaagcatcaggcaaaccatctgatatagtagaaaggctgaatcagattgctggatttctgtctgatgaagatattgagctctatgaggaaataaagtttgaaccagttgtgatgtgcgtacccattgagagtaatgcttcgttccgttcaagccagattgacaatggtgatataatatgctaccaaaagcactgtttgccagattcaatggatcgatatcgatatcctaccgtcccttctttctttgaatatattcataatagacagattgtccatttcagattgcttgagaaaccaaaagaagaaggcttctctcttgagctttcaaaatgctccacatatgatgatgttgttgagaaggttgctaagcaactacgtatggatgacccttctaaaatccggcttactcaacacaatccatcgtctcagcaacccaaacctcacttcatcaaatacaggagtcttaattatctttcggacatgctacataatcacaatcagatgtgtgacatattatattatgacatcctggatattcctttgcctgaactagaatctatgagatctctgaaggtcgctttccaaaatgccgcaaaccatgagatgtcgtttcacattatgcggttaccaaaaagtaactctctccttgatttgattgaagacttaaagtcaaaggttgaaatttcttgtaatgatgctgaatttcggttttttggagtctaccttcacaagatatgcaaggtgtatcaacctggagataagatagattcagttaatgaccatggacccttgtatattgaagaggttcccgaggatgaaaaaaatgccgggcctcatgaccgtttggttcatgtctatcattttgaatataatcatcatattcagtattttggtgaacctttcttcttcctaattcgtgatggtgaagctttgtcggatatgaaagtacggattcagaagagacttcaagttcctgatgagcagtttctaaagtggaaatttgctcatgttacattcagtaagccagaatacctccaagattcagatattgtaatgaacagattccataaacagagacctgtttatggaggttgggaacaacaccttggattggagcatacagccaccaccccaaaaaggtcctacttaggcaacaaccagaaccgccattcttttgagaagcctgtgaggatttacaactaaagctaggaatactttttacatgcgatgaatgatgaacaggatatgaagcagtcttgttccaaaagcagtcttttggtgatgtacatggagcttttgcatagagtagtttatgtggcaattatctcaagaattttcatctggtggatgtacagggtccgtatagcaacatttccttgtagaaagttgaagctgtatatcgagggtggatttacatgtgttaatcttttcgaccccaagcctctgggaggctgtgaaccatagcctcatgaaatatgcctgttgttcattcagtgtttgtgtttttctcgtttgtcattattgtgcactcgcttttaatatgctcggtctattggaccgagcaggaaaatgatgtttaccttatagtggtctaactggttcattaggcgcccaagagaacaaatgaattactcctttggaagcttgaaacgagaaacataggaaatgtctatgacggtggacatgccaagaccccaagtcctcggtttcaaggcctccaccgctggctttctagctattttattttcggtctgaacgcttgaaacggcaggctgctggtctctgttaagggttcgtgatgttctttgctgtgctctttcagggcaacccggtgcccggcgacaagggtgctgggaatgggattctgcag

SEQ ID NO: 5995 - DNA, 4073 bp, Zea mays
cattgggtacctcgaggccggccggggctaaatttctgaactctatttttttccccagctacaacttttctgtaactcgtctaatctgcacggctccacccctatccccttcctctcccctacccaagcaggcaggcagacatcgcaattcttcaattgccaaccacagcgcagtccaatgcagcactagagcccgcgcagcctttctttggtccaacccgatgcttgcctgcccaagcacatcaagtccatggccgcagcggcagccgccgtccccgtgcccgggcgggggtggcggcgccacgcgccacgtggcgctcgcggccaggagcaagcggcggggtgcgggccccgcggcggcggagggggtggacgaggcggcggcggaagcggcggagctggtgcgctcgctgctgcggaggacggcgggcggcaaggagaggctggtgccggtgctggaccggcacgtgcgggtggtccgcaccgagcactgcttcctcctcttcgaggagctcggccgtcgcgacgcctggcccccgcgtccccgggcgcgcgggtggatgcagaaacaacggtggtatgttgctgacaacggcatctactccaagttaatatctgtgatgggaaggaaagggcagatacggatggcaatgtggctgttctctcagatgcggaacagcgggtgcaagcctgacacttctgtatataactcccttatcggcgcacatctgcattcacgagacaagactaaggctttggccaaagctctcggctattttgagaagatgaagtgtatagagagatgtcagccgactattgtgacatacaacattctgctaagggcttttgcacaggctggtgacacaaagcaggtagacatgttgttcaaggatctggatgaaagtgtagtatcgcctgacgtatatacttacaatggggtgcttgacgcatacgggaagaatggcatgatcaaagagatggaatctgtgttggtgcggatgaaaagcacgcaatgccgtccagatgtgatcacattcaacatactcatagattcatacgggagaaagcagacatttgataagatggagcaggtgttcaagagcctactgcggtcaaaggagaggcctacacacccgacgtttaattccatgataacaaattatgggagagcaaggctcagagagaaagcggagtctgtggttgagaagatggaagaattgggattcaaaccaaactatgtgacacaggaatgcctcatcataatgtacgctcattgtgattgtgtatcaaaggcccggcaagtgtttgatgagcttgtgacctcgcaaaccaaagtgcacctttcttcgttgaactcgatgcttgaagcctactgcatgaacggcttgcacacagaagcagatcggctgctggatactgcactgcagcaatgtgttgtgcccaatggttccacctacaagctgctctacaaggcctacaccaaggcgaacgataagttactagtgcagaagttgctcaagagaatgaataaacaggggattgtcccgaacaaaaagttcttcctggacgctttggaagcatttggcacctctgacaggaaacccaggacatcgccaggcataaactctgcaagcaagccaagtacagattctgctggtgattcagaaacagctacttctgacaaaccagaggtaagcgtttggcatgtagctgctacataaggctgttggtttgagcaagctcgtcgaattacctgacatcaggaagaacacatttgatctgcaccagaaaccgttaatacagtgtacttggagctacaggagttcctctactcccaacaggacgctcctttcttaacggaagaatgctaaaacctttcgtgtttcggcaaaatctgcttgtacatgtactctgttatcaaacgtaggtattttgtttctagtcattattgggcatcacaaaaattctggctctctgtactcgtcgattgttattacatgcctgttccttcaatccttctgtggtctctatttactgagcatctcccgatacataaaactgggaactggaatgacatgcatgctgcagcacgttgtttcagaaaaatgctccttttttgtaaatcgcgagcagcataaggccacgtttgaattgatcagttcgctagctaattattagctctgtttggatccaccggacagctaggtggtttgaatagttggcaagaggtccaaatgaaatataagcattcctccagctattgaacaatgaagtgatagatgtttaccagctaggtggtttgaatagttggcaagaggtccaaagggcaacggacaccttcattttgcgcaaaacaactaaagttcatacttacatctaaaacagtactagcaatcgttctaattcaagatgtttaccagattggcaacaaatatttctacaagtccagatgactcaaaatattgggcaatctgacataagataagcttgccttaacaatgcatcatacattttgggaccccttaacagtacttcatacatttcaggatcaacacatttggcttgcctaccactgaatccccgcaaatatcagctacagatggcttcttgtgccatccctttgtttgcagctcaaagcttttcaagaacgcttctatgaactacctcgaaactaacacttgttgtacctatcgaaattagcgcttattgtacctatgtgtctattaaagtctcttcctatggaaaacttgttactaatggttataactctaactataccatctaagtcttcccagaaaagacgcttaacactctcattgtagtctatttggtaggcatacacactaattacatttaaaaacaaatcatccacgataagtttgactaagatcatgtctcctaccacaccactcttgagactcttatcaatcaaaactcctattctcatgctcacaacctattattatatggttaatgatgaaacacataatagtatatgtcttttaaaattttaaatgacaggtattaaaataacatatatttaacaaccggaatagaacattcctatctaggtgcttgacgtataggtatgcatggatttggtgctcgatggacgatgtgatgaccggaattgccttttgccgacgccgttggatttaaggagaaagcatacgaagaaaccagaccaagtccttcgactcttcgagcactcaataaccgtgggaagagcagcgaatggaggcaccgtacagaccggacacccgagcaaattgtgtgcagatgcaagtatgaatcagagcaaattgtgtccacggtcatcactggaccttcatctactgcatgcagggtcaggtcatgctcaccaaataatcaaatgtaaaaccattggacagccatgcgctcttttcacctctttgtttcccctttaccaattaccataacaccatacattactccttttgcaagttacatatacatgagtacaatatttctgttacacgaatcaaaagcaaccgagctagaaagaatcgataataagtcaatatagcagaaaagaaagagacttttttttcagttttgacaacacaatttatacagcaggaagcatccaatcctacactctagaacaaaacgatccagaaatcttcgtattccgtgggttcttacttctggaatttgtatggcttcaagaattggatatcaaaacgaatccatgcttgtgtgaacacagcaaagcacatacaaaatcttatgtgtacacacagattgtacagcaccaagcagacgccttatcagagaatggtgcatccacatctgttctgcttgggggaattggcaagctgcttctctgggaaagtacaggtgaacatgttagaagtatgttcacaagtgtcataagaaaatcataatagcttttggcatcagtcatcatattaatcaatgaatagaaatcacttagtatgcttgtagcgccgccctatcacccaaacattccaccacattaacttaatactcatgtaggtgaaagtcatatcttaagaaacctaagcacctcaagattttctgcactgaaa

SEQ ID NO: 5996 - DNA, 1276 bp, Zea mays
  misc_feature (1275)..(1275): n is a, c, g, or t
cttcccgcgccccggggccccaccaacaaaaaacctcgggagctagcagcaagatcttagcacaaacaccacaccccacaggctgattaatcactccaagactaatcaaacgaacgcttagctaatagcgcgcgatctttttttcccctccccctcttgagcgtgcgagaagagatggcgctgaacggcggcaagacgttggtgcaggacgaggagaagcagcagcttctcctagagaagcacaccgagaagcacttcaccgccggcgaggtggtccgggacatcatcatcggcgtctccgacggcctcaccgtgcccttcgcgctcgccgcggggctgtccggcgccaacgcctcctccgcgctcgtgctcaccgcggggctcgccgaagtggccgccggcgccatctccatggggctcggagggtacctggcggcgaagagcgaagctgaccactacaaccgggagctgcagcgcgagcaggacgagatcgacaccgtccccgacgtcgaggccgccgagatcgccgacatcctgtcgcagtacgggctgggcccggaggagtacggccccgtggtgacctccctccgcaacaaccccaaggcgtggctggagttcatgatgaagttcgagctcgggctggagaggcccgagccccggcgcgcgctggtgagcgccgccaccatcgcgctgtcctacgtcgcgggcgggctggtgccgctgctcccctacatgttcgtgccggaggccgcgcgcgccatgggccgtgtccgtcgccgtgacgctcgcggcgctgctcttcttcggcttcgtcaagggccgcttcacgggcgaccgccccttcttcagcgccgtccagaccaccgtcgtcggcgctctcgcctccgccgccgccttcgcgatggccagggccgtgcagtccatatgaagactggtgatgcagctaaaatagtgaaggccggtcgccgcatgccccatatggccatatcaatcatcaccggccggctaggttggcgagggaaaataagtgcagctatatatgcatacgtggctacggtcactggtagctgtacacatggcgacgtgtgggtgtggtgtacttgtaccgcttcttcgtttgatggctgcgtggtgtagtattgccggctcagctgttgattatttaggtgaagtcgatgccaaactgtggcccgctgggctttggatacatttgtttttatctatctactggtaaattaaatggctgatgttgggctgtgcaatttggcaaaaaana

SEQ ID NO: 5997 - DNA, 1235 bp, Zea mays
  misc_feature (1102)..(1102): n is a, c, g, or t
  misc_feature (1105)..(1105): n is a, c, g, or t
actcctatgggcgagggccctccgcccggccgggcaacaacagaaaacctcgcagctagcagcaagatcttagcacaaacaccacagcccacaggctgattaatcactccaagactaatcaaacgaacgcttagctaatagcgcgcgatcttttttccccctccccctcttgagtcttgagcgtgcgagaagagatggcgctgaacggcggcaagacgacgttggtgcaggacgaggagaagcagcagcttctgctggagaagcacaccgagaagcacttcacagcgggcgaggtggtccgggacatcatcatcggcgtctccgacggcctcaccgtgcccttcgcgctcgccgcggggctgtccggcgccaacgcctcctccgcgctcgtgctcaccgcggggctcgccgaggtcgccgccggcgccatctccatggggctcggagggtacctggcggcgaagagcgaggctgaccactacaaccgggagctgcagcgcgagcaggacgagatcgacaccgtccccgacgtcgaggccgccgagatcgccgacatcctgtcgcagtacgggctgggcccggaggagtacggccccgtggtgacctccctccgcaacaaccccaaggcgtggctggagttcatgatgaagttcgagctcgggctggagaggcctgagccccggcgcgcgctggtgagcgccgccaccatcgcgctgtcctacgtcgcgggcgggctggtgccgctgctcccctacatgttcgtgcccggagccgcgcgcgccatgggcgtgtccgtcgccgtgacgctcgcggcgctgctctttcttcggcttcgtcaagggccgcttcacgggcgaccgccccttcttcagcgccgtccagaccaccgtcgtcggcgcgctcgcctccgccgccgccttcgccatggccagggccgtgcagtccatatgaagactggtgtgatgcagcaaaaatagtgaagcaggccggtcgccgcatgccccatatcaatcatcaccggccggctaggttggcgagggaaaataagtgcagctctatatgcatacgtggctacggtcactgcttctcccccccccccccngcngtggtgtactattgtcagatgtggattattatttaggtcaagtcgattccaaactgtgacccgctgggctttggatccatttgtttttatctatctactggtaaattaaatgactgatgttgggctgtgt

SEQ ID NO: 5998 - DNA, 4730 bp, Zea mays
cttctctcaatcattggtgtctaaaaactggtgtggtcattcttaagctttcgttagtgactcagtgaaaacaggtggaatcggttgagaaaacatgatatgtttttttgtagaagtttggtccctacactaaactttttggattctttttgttgtgaagaaaaaaatgagtagaagcttggtccctgcactaaacttattttaaggcggaatgtcaaaattaaaatgacatctagaatggattttttagggatctgaaacatgtttttataaaaaaaattctaaaaaatatgaagtcaggtgcgaaagagaaaccagacattcacactggtttgaatctttgtgaagccacagccacccactccaaaaccacaaaagcaacatcgactaccaccccatgtccaagttggtcatttccgcccgagctagctaacccctataaatgcccctcccagctcagcgttcgcctcaccaacagaaaacctcgcagctagcagcaagatcttagcacaaacaccacagcccacaggctgattaatcactccaagactaatcaaacgaacgcttagctaatagcgcgcgatcttttttccccctccccctcttgagtcttgagcgtgcgagaagagatggcgctgaacggcggcaagacgacgttggtgcaggacgaggagaagcagcagcttctgctggagaagcacaccgagaagcacttcacagcgggcgaggtggtccgggacatcatcatcggcgtctccgacggcctcaccgtgcccttcgcgctcgccgcggggctgtccggcgccaacgcctcctccgcgctcgtgctcaccgcggggctcgccgaggtcgccgccggcgccatctccatggggctcggagggtaagcttcgcatggatccccattctcttccgcgcatgcatgctccatccgagaccgcatctctctctctctcgatttgcttcttcagttcactggtgccgcggtgcggtcagcaacccgacatgcgtattagcataactgatggctggtgctgagctcatcttggcttcacatgcccttgtttcttcccaacgttacagatcgtgcatgcagctgttggtttcagtttcgtattcttctgcgcattacagcgcgtttatgcaaacgtaatcagttgctaattaaaactcctgatcgccagttaattaatttataaaagggcgtttctcatgctcggaaacattttccgatggatactcgttacatgcataacacactctctgaaatttgaagtacttttgggcctccggacacgtctgaaagtgtgtgtttttggtatcgaaatgtatatatgacgactcagtacaaacatgactaaacatagctagacgtttgtaaatacaatacttctcttccagaagcataagttctataaggcaaactagcgtcatatttcttccacaggaagaaaaaaaatccacagatgcaattactgctctctgcagtgcagcactctggtcactggtcaggaaagagacaagaattcagaaaaattgcgatccaaaattgcgaactgctattttattcatttgtttgtttgtgtttccaacagcttgtgggcctgcactcacgcaattcggcccgcacgaatctgacccaaataaatgacgtttgagcccagctacccacccaccaaaactaacctcttcagttgctgtgctgtgcgtgcgttcaggtacctggcggcgaagagcgaggctgaccactacaaccgggagctgcagcgcgagcaggacgagatcgacaccgtccccgacgtcggtaagcaaacgcaaccgcccgcgacgagctcaccttcttctcttcagacggctaatgcatatgtagtaaggtcgtctgaccatcgcctcgtccgtcctgtacatttcgcatgcaaataatgcagaggccgccgagatcgccgacatcctgtcgcagtacgggctgggcccggaggagtacggccccgtggtgacctccctccgcaacaaccccaaggcgtggctggagttcatgatgaagttcgagctcgggctggagaggcctgagccccggcgcgcgctggtgagcgccgccaccatcgcgctgtcctacgtcgcgggcgggctggtgccgctgctcccctacatgttcgtgccggaggccgcgcgcgccatgggcgtgtccgtcgccgtgacgctcgcggcgctgctcttcttcggcttcgtcaagggccgcttcacgggcgaccgccccttcttcagcgccgtccagaccaccgtcgtcggcgctctcgcctccgccgccgccttcgccatggccagggccgtgcagtccatatgaagactggtgtgatgcagctaaaatagtgaagcaggccggtcgccgcatgccccatatcaatcatcacccgccggctaggttggcgagggaaaataagtgcagctatatatgcatatacgtggctacggtcactgctttctttgtttgatggctgcgtcctgcgtggtgtactattgtcagatgtggattattatttaggtcaagtcgattccaaactgtggcccgctgggctttggatccatttgtttttatctatctactggtaaattaaatgactgatgttgggctgtgtaattcggcaaccggaggcccaaactgggttccgctttgggctttgcctctattttctcctcaactactactactacctagtagtacacctagcaaggatttctagaagcgtgttcctaactgccctgtaaatccttctcgaaagaaaaaacttccccgcaaatctgctgataataagataatgtaataggacatctgattctgtcttctcaagttcaccgagaggcaacgccgagtaaaaaaaaagaaaaaaggggatcgaaacctcgtgctgattgagtgggcaactggccggccattgcaaaggtggaagtaaagaaaataaaagttgggaggtaaaatctgctgatgcaacagaaacaaaaggaccagtaggccaattgttggcagcagccttttttcatcaggttgtaaatttgtaattagttggtataaagtgtgggatcagtataactttacactataccgccaaattcgccttttcatatctgtgtgaggtaaaaggaaaactctgatggtgcagtatagctcatgatacgcactctcaattctcaccaatcaacatcccaaaacccaatcagcaggactcaaaggagcagctagagcgtttcctcagtgacagtgagcgagcaacgagtcgcctttcttctacagctccccccgcccatgcatggtaccaccgctgtacgtgtgacacaaagaagtgacatcgcaagtaggccgagtacgtagggtaggatgcggttgtggacttgtgtggagcgtacgtccaggtagacctccattaggaagaaagatagagaggggcagctggggtttggaagatgcgagacgaacaagggtggtggccgaggccgtgggtggtgaatcatacatgtacctgactttagcacatgtgatgggcagcatgcattggcggcgaggcagcactgcactggatgtctggatggagagatagggtgccggccttcctcctccaagttgctggattttggcaatcatgggctcggattcttgtggactccatggtatatcatcctgatctgaatcagatccggccggtatgttcctccacagttgcacaccgatcgatgagtctgcgctacaagatgtcactctgttaggaaaggatacatactggagcctccatttacattcagaattagatatgcatcgatccaggaccaaatgcctttgaaaaatatggcactagaatataccatgtctttgaggttgagagaatatttatttataccatcatcgtcctcggagaagcatttcttcccgcaggaattaaatcaggcgatgtctgcctggtacgttcaagcaatgcaagcggctggtccggtcatggggcgcgtcgtgcttatccaagccaagccgcagggaagcaggcgacccatagagcagcatcccatcgcacttagctactgtcgccttcagttcgcctgcgcgcatgaaggcagaccgggccggcggccacccaatcccagaacccggccggccgttccggcggacggcggcggatgcatgctcatgcatgtgcctaatcctggatctctctctctctatctcgtcttgttcattgaacctgtacgtggttgctgcttgcttgctagttgcccgagttcattggatctgcgtagtaggttccacggccggactccgacatctacccatgtccttctcaacaacaagaccgcaccacgcaccgaattcttttgcatggatcgacttgctttcgccgcaaatgaacccagctttcggtcccgtcacgaattgtagatcgacgtggctgcatcgtgcgctgctgttgcgtggaaagaaatcgagtgggtgtgaatgtgggaggcaggcagcagggtatatggtgagcattggttctcaacgtttccaacgaatcttgccaaccggtgcttatatctctgctcctttacgagcacacgagcatggtgcctcacgcacgaatcatgttgtctcgttgttatagataagtattgccaccgatctatgcactaaatactggaacaaaccacctgacggttctctctacgaagacgtgaacgatccacggtccaggcgcaggagcggtgcg

SEQ ID NO: 5999 - DNA, 1335 bp, Zea mays
ccggccggggccaacacagaaaacctcgcagcagcagcagcaggatcatagcacaaacacgaaggttaatcaagcgagcgcttagctaataagcgcgcggtcttctttttcctcgagagtgagtgagagagagacagagagtattgaggcgcgagaagagatggctctgaacggcggcaagacgttcgtgcatgacgaggagaagcagcagctgctcctggaggagcacaccgagaagcacttcaccgccggcgaggtggtccgggacatcatcatcggcgtctccgacggcctcaccgtacccttcgcgctcgccgccggcctgtccggcgccaacgcctcctccgcgctcgtgctcaccgcggggctcgccgaggtcgccgccggcgccatctccatggggctcggagggtatctggcggcgaagagcgaggctgatcactacaacagggagctgcagcgcgagcaggacgagatcgacacggtccccgacgtcgaggccgccgagatcgccgacatcctgtcggagtacgggctggggcccgcaggagtacggccccgtggtgacctccctccgcaacaaccccaaggcgtggctggagttcatgatgaagttcgagctggggctggagaagcccgagccccggcgcgcgctggtgagcgccgccaccatcgcgctgtcctacgtcgcgggcgggctggtgccgctgctcccctacatgttcgtgccggaggccgggcgcgccatggccgtgtccgtcgccgtcacgctcgcggcgctgctcttcttcggcttcgtcaagggccgcttcacgggcgaccgccctttcttcagcgccgtccagaccaccgtcgtcggcgcgctcgcctccgccgccgcctacgccatggccagggccgtgcagtccatatgacgatgatgattaatgaggcagctcgtagtgaaaagtccgctcgccggccggtcgccgcaggtcgtatcattcttcaccggccggctaggatggcgaagaaaaataagggcagctactagcctactacgcatacgtggtagccaaactgtactgtacaacgtgtagtgtgcttgtactatcacagtactagtactagtgtgtgtactttgtttgatggctgcctgcgtgtcgcacatgtcgtgtttggatgatttaggtgaagccaaactgtggcccgctgggcttttcttgtgtaatttggcaagcggaggcccaaattgggtgccctttgggctctgtctctattttcttctcagctacactacagtacaacctaacttgttctaaacccagactgctacctaacccaacaaggatttct

SEQ ID NO: 6000 - DNA, 459 bp, Zea mays
  misc_feature (453)..(453): n is a, c, g, or t
  misc_feature (457)..(457): n is a, c, g, or t
tacggttcgtcagataggtttgtcaaagagacgcaggtgatgtgcgacatgtggatgatgcggtacgttggggttgagcgggaggagcatgaatggaaaaggattttcctggaggctggattcagcgattacagaatcacgccgacagcactgggtttccaatcggtcatcgaggtcttcccctgaggaagaagcatatatatatgatcacgctgtatgtgtgccctgtgcgtaagaaaaaaaataccattattaataagttattaataagacagacgtgataatgagcgtatgggcgaatatacaggagatgcataagaatgagaaagatttaatattgtactactgccgttgggattttcacgattacgcccgtttacagggagtaattgtatggatgcaaacattatttaccagtatgcaataaagaatgaaacattttcgctctaaaangaanaa

SEQ ID NO: 6001 - DNA, 4410 bp, Zea mays
gatcttctttgcctccccatgcccccctcgaggtccctcgaggccggccgggccgggaacagccctgcgcccctgccatttacaacgacaccaccatgtcgtctgtccaggaggagcttaataacacacaggacatgctccaaggttacgtggagctctacaattacagtctctcctacgtgaagaccatggcgatcgggtgcgcgatccagctaggcatccctagcgccatccaccgccgaggtggggcagcaacaatctcggacatcatcaccgagaccggcgtcgacccgtcgaagctcccgtatctccgacggctcatgcgcgtgcttaccgtctccagcatcttggccaccacaggcacagacgagactgagactgagagcgacgacagtactgtttacaagctcactccggcgtcccgcctcctcgtaagcggcgcgggggcaccgacctcgtgcgacatatcgccgatgctggaccttctgatgcgccccactacgtcggtcgccacctacttcagcctggaagagtggttcaaggacgcgggcgccaccgccacgctcttcgaggtggcgcacggcatgtccccgtggagcttgacgaagaacgacgcgctgtacaacaagaccttgaacgacgggtgcgcggcggacagcaacttcgccatggacacgctcctgagagagccccgggccgcgggtatattccgcgggctcggctcgctcgtggacgtcggcggcggccacggcgccgctgcgatggccatcgctagggccttcccgcacatccggtgcagcgtgttggacctcgagcaggtggtcagcggggcacctgatgatggcacggtgaagttcatcgccggcgacatgttcgagtctatcccggctgcagattgtgtcttgcttaaggtactcccatctgttctgcattactacgtgtatatatatgctaatacttgtctatgcatgtatttcaagtatgttctgcattgctgggacgacgaaagcagcgtcaagatcctccggcagtgcaagagagcgatccctgcaagagacgccggagggaaagtggtgatcatgaacatggtggtcgggtacggttcgtcagataggtttgtcaaagagacgcaggtgatgtgcgacatgtggatgatgcggtacgttggggttgagcgggaggagcatgaatggaaaaggattttcctagaggctgggttcagcgattacagaatcacgccgacagcgctgggtttccaatcggtcatcgaggtcttcccctgaggaagaagcatatatatatatatatatatatatatatgatcacgctgtgtaggatgtgtcatgtgtgccctgtgcgtaaggaaaaatatataccattattaataagttattaataagacagacatgatgatgagcgtatgggcaaatatacaggagatgcataagaatgagaaagatttaacgttgtactactgccgtttggattttcacgattacccctgtttacaaggagtagttgtatggatgcaaacattatttaccagtatgcaataaagaatggaacattttcgctctcgttgcagttccattcacatgctgacgaataacttagtcggtgtttgactgtttggtttgtgcctcgttcttttttatttgttgtggttcatttgaaaacagaacggagatagtttctcatgtttcattggattttgtgtcacaatctcacaaatcccatataagttgataataggatcggatttgcattggatttgtgctgtatccaactcctcaaaatccatgtctaactaaacaccacctcaaggatttgttcgattgtgagtggattgaataaaactgtgagacctgtttggttcgtggctaactgtaccacactttgtctaaggttagccatctgaattaaaaaaatttaactttagatagaaaagttaagtaaagtgtgacaagttaggtagcgaaccaaacacgtcataaatctcttgctagtcaaaattaaatataacatgatttaatccctcctttgatagcccggaatcccatgagtatccggtccattccctggcacccaaaactgagggctgaaccgctgaactatcctggagcgagagaaaattttgttaggtgacctaacttcccggcccaatgcacggcacgggagagaacggggctttagcccctggcctcacgaggccctcgcctcgcgtacctggggctagctgcggggacgaggtcgaggctgagtgcggggtcaacctctccgcggacggcgcggagactagagacaaccgaggcgggcgcggcggcgtcctttagcgctcagcccggcgccacggctcgacgcgatccccactgagtcgagctcatccggcgtctcgacttctcctacacgaaccgccgtctgcacccgtgtccctcgtgcaatcgctttggatttctttgagccccgccacgtcagtcgccattagtttgcaaggtcatgttcgtgcgcggtgtggtccatcggtctccaccggctgactctgtttacggacgagttcttttgtttcctcccatatctcgtgttcgttctcgtttttcaagaagattgttcacacagatgagatggctgcttcagtactgtcttcttgatcatatatactagagttcagtgtattttcttagataacggatacttgggttacttggtgtcttggttaaattataaatcctgcaactgcaacgagatagcagagtgctggtgaggtttgctgaacatcactacatagtttacagcagggcagctacctagttgaagaatagagaactgtatgttttgtattgtattgtagtctagggacgctacaggcccccatcctacatgtcttccttcttaatctatctcattcaggattccagaccattcttcgtcggtgaaaagaaaaaaaaaagttcgatacacttggtcctcacctcacatttttctcgccattttcccttgcccggttgccctgaacaatctttaacctctagtagggaccatatgtttgtaacgctatttcatagtttttgcaaacacacaagggtggcgcattttagtactcggagttgacttagtagactatggcatgttagatcagcatgtatttacatacaaacgaggcatgtatgtattcatacacagtcggggtagaaactgaaatcaaggagatctaagatggacaaatatcttactgatctgaaatcatatacacacggggtagtgtatggaaattaaagaccacttttttagtttattacatatatttttgctacatttacatttgtatagtttttttatcatttgtcggtgctaaattgctcctgctgctgtcatctcctttgacagtatcaaatttcataatttctaccaacctcatcggtccgacaagccccggcacctcatcggcccgcttggaagtagcaaagtgagtattcgcgtccctaagtcaaaaaagcatgtttcttttttgctataggatcccatattctgctggttgagctgtcattcaaaaaaacagacatcaaagattcaaaagacggggtgttcaacatgtaggaagcgcacaaattaggcagatcgccacctttgcccaacatgcaggacctaccctggcgtggcgatgagctcacgctgcccgtgctcaagccaaaccaacgccgtctcgcaaggagtgggagcttctttcaggtgctcaaccacagggtgctcaacatgttttgtgctcttttttaaaatatatttttcaaactgatatggaaagctggcatccatcccatagtattgtagtagagcacgcttttcatttgtagaggcgagatgcacagcatagtggtggcatccacttctcatctgctagcatccacttggtcggctgaggaggcggacggcggaccggacctttcccgatgtggctgccccccaactggcgtctggcgccccccaagttgccgaaaaaagtaattcttctttcgccctcccgtgtcccgtcgcctgttagtttctgctttgttttgagtgcaggcgcagatctgctgcccacttgaccgagatcgatccttactaaagataatttagctaaaaggcgatggaaaggtagtttgatatgtagcttttgtaatcaaaatgaaagtattcactatctcttttttgactgttatatggccaaaagtatatggagaataatttactttgccttaaaaatagaaatgcccgttagcattaaacatattatcgggtcttgaggaactaataggggtccggggtataaaaaaattttactctctggaatagcagctttattttgggctatttggctcagtcgaaatgaggtgacttttaatcataaaccaattccatcaattgtgcaggtta

SEQ ID NO: 6002 - DNA, 1587 bp, Zea mays
  misc_feature (1550)..(1551): n is a, c, g, or t
ttttttttttttttttgcataaaaagtgcaggcccttcctttgtcgtcgatatcttctttgcctccccattcccttataaaagtagcatcccagcgcagccaatgcaacaagccctgcgcccctgccatttacaacaccaccatgtcctctgtccaggaggagcttaataacacacaggacatgctccaaggttacgtggagctctacaattacagtctctcctacgtgaagaccatggcgatcgggtgcgcgatccagctaggcatccctagcgccatccaccgccgaggtggggcagcaacaatctcggacatcatcaccgagaccggcgtcgacccgtcgaagctcccgtatctccgacggctcatgcgcgtgcttaccgtctccagcatcttgggcaccacaggcacagatgagagcgacgacagtactgtttacaagctcactccggcgtcccgcctcctcgtaagcggcgcgggggcaccgacctcgtgcgacatatcgccgatgctggaccttctgatgcgccccactacgtcggtcgccacctacttcagcctggaagagtggttcaaggacgcgggcgccaccgccacgctcttcgaggtggcgcacggcatgtccccgtggagcttgacgaagaacgacgccctgtacaacaagaccttgaacgacgggtgcgcggcggacagcaacttcgccatggacacgctcctgagagagccccgggccgcgggtatattccgcgggctcggctcgctcgtcgacgtcggcggcggccacggcgccgctgcgatggccatcgctagggccttcccgcacatccggtgcagcgtgttggacctcgagcaggtggtcagcggggcacctgctgatggcacggtgaagttcatcgccggcgacatgttcgagtctatcccggctgcagattgtgtcttgcttaagtatgttctgcattgctgggacgacgaaagcagcgtcaagatactccggcagtgcaagagagcgatccctgcaagagacgccggagggaaagtggtgatcatgaacatggtggtcgggtacggttcgtcagataggtttgtcaaagagacgcaggtgatgtgcgacatgtggatgatgcggtacgttggggttgagcgggaggagcatgaatggaaaaggattttcctagaggctggattcagcgattacagaatcacgccgacagcgctgggtttccaatcggtcatcgaggtcttcccctgaggaagaagcatatatatatatatatatatatatatgatcacgctgtgtaggatgtgtcatgtgtgccctgtgcgtaaggaaaaatatataccattattaataagttattaataagacagacatgatgatgagcgtatgggcaaatatacaggagatgcataagaatgagaaagatttaacgttgtactactgccgtttggattttcacgattacccctgtttacaaggagtagttgtatggatgcaaacattatttaccagtatgcaataaagaatggaacattttcgctcttaaacccannataaaaaaaaaaaaaaaaaaaaaaaaaaaaagaagg

SEQ ID NO: 6003 - DNA, 1423 bp, Zea mays
tgatggataatttacgtgggtattgttgtaagccgtcgcaacgcacgggcaaccgactagtatatatatatatatatatatatatatattacttaataaaaaatcgaatgatctattaaaaatacatgttactattttattatataaatttaggagaaagttaaaataatttataatttagaacggagaacatgaggaagagtaagtatataattaggttaaccatgcatgcatgccaagcacaggttgttattacgtggtccttcgctccatgcacatagacagacacggttagacacacgcgtaaaaaacacagcatgagcattgatccatcagctgagagtggtgtccaaattcgtcttgcgtcagtgtggttctgctgctatatacaagaaggtgagctactgaaccaaacgcagcagccagccactccgcacctcacgtcctctctcctcacctgcccatgctttgcactggaaggccaccaaccatctctaactctccatgtcattcccagttctggccggcaaaacagtacgtgctcagcagcttcggaatgaagctataagatgcccccgcggggccccggccggtccgtctcaattcacaagcgccttcaaactttcagaacacgcacttctgctagctagtagccatggcttccgcagtctcgtctctcttcttcgccacggcgctcgtgatgatgacgctcatgatcatgctcgagggcagcaccacatgccacgccgcgcggcatcttgccgacacgacgaccgccccgaccgctgctcctaccgccatcccggccattcctgccatgccgaagccgccggtcgtgcccaccgtgcccgcggccacccttccaccgatacccgccgtgccgacgtcgacggtgcctgcgctgggcgtgccaccgatccccgcgttacccaagatccccgcgatgccccctatgccggctgtacccgcattgccaaaggtgacggtgacgctgccgccgccgatgcccgccgtcgtcgtccctaaggttggcgccttgccgccgatgcccgccgtgcctaagttgacactgccgccgatgccctcgatcccgggcgtgcccatgccgtttgtggcgccgcctccttcggcataattcaattcaccaatgtctgatagagtgtccatatatctgagtattcgagttgatctcactctcgatcaatccatgtgtacgatcttcgctgggcacgcatgctgcagatttacttaattggtgtatgtatgtgattctatatacttctatatattgttgtatccagtctttttcaaagttataatgttgtgtcaagctttgtcagttcattttctttctttttttttggttggaggtcgtcatttgctgtaatctgtaagtggatacgtatgcacagagtgctccact

SEQ ID NO: 6004 - DNA, 1367 bp, Zea mays
tgaatgcattttcagaagtaaatctcgttgcatttcacctatgtaccagcaccatctcaacggcgagctcccaaacgccggtgaaaagggatgaatgcattttcagaagtaaatctcgttgtatttcacctatgtaccagcaccatctcgacggcgagctcccaaacgccggtggtggaatgaggcctgaaggaggcgagtcgatcaaagtcagggatggtttggtgaccaggaaattaagatatttttgggaagaattgagggagaaataaaataaatttctcctcaattgcatacaatttctctcaattttctggtcaccgaaaaatctctcaatgattcatacgacgacgagagaacgatgagaccttgttggtttctgtatggattaaaggagattgaagtaaattaaatcccttactagagagaattaaatctctcactaataaaaataaataaaatataatttaatcctcttcaattcgtaagtcgcaagacacgtggtgggtcctcgggaaccaatcagtagtaggcatccataggccttgctctcgtggccggccgggcccggcactaaaagtttgtcttgggcctcgcaagttgctaccctcttcctcaccttcactcctcttcctcgtttcccccacggtcaatcgggtgatctgacggcggcggcggcggcggcggcggcactccgagcttccgcaacatggcgacgcggttggctgcggccgcggccgccacgttcatgcggcgcctggccccagcgcgcccaccagtacctatcctggcggcagcatctacggcggaggcggtgacgtgcgggcgcggggacaagaaaaccaagcgcgggaagcggttcaagggctcctacggcaacgcccgaccgaagcgtgagaagaagattgagcgcatcaaggaccgcgtcgaggtgccccgttccactccctggcccctccccttcaagcttatctgagcgcctcccctcggtccgccgggggtaccttgggtttgctgcgacagttgctgctacttcgccgtttccaaatagctgcacgcgctgcacgggcgtgtgtttcctttgtttttaattgtttctcaattgtgtggcgtcagatatgtactgccgccgaactgctgtggttcaagcaatatccttttggatggaagtgaagagatgtgtttctgtccatcattcttcttctgttagtgtatgcataattggaaaaattaatggatcctttattcatcagcagtaaaaaaaaaaaaaaaagcccctaaaggccccttagagttgttgaaggatatcagcttagattggatcatctcttttttatgttctactgtcttcagtcacatgccattca

SEQ ID NO: 6005 - DNA, 2232 bp, Zea mays
gccatttggcagagacgagacggacacctctgcggcgccgcctcgggcctcggcagacgacagcaatcacagcagcggctctacaagaaaggagaaactgcagaaaccgcgagggcaggcgcggcagcgggcaggcagtccatccccatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcgactcttttggttgctcggcgactggggagcgacttgtgtctgctgcaagagatggagacatccaggaggccagggctctcttagaactcaatccccgccttgctcggtactccacgttcgggatccggaattcgcctctccattactcggcagcaaagggccaccatgagattgtctccctcctaatcgagtccggtgttaatattaaccttagaaattgcagagggcagactgctctgatgcaagcttgtctatatggtcactggaaagttgtacagattctagttctttttaaagctaatattcacaggagagattgttttagcggcgcgaccgctattcattttgccgcgctaaaaggtcatactcgctgcattcggcttcttgtggctgattatgtgcctagcttgtcagagttttggaccattatgcgtggaaagtccacagatgaaatgaaaaagggtgcctttgatgccgcgtctctccagagactagttaatggaaagtctgatggtggtgtcaccccgcttcacttggcagcccttcatggacatgctgagagtgtacagttgctgctagaccttggagcctctgtctctgaggtgactgtcaatgatggttcaacaattgacctcattggttcggggagcacacccctccattacgcggcgtgtggtggaagtgctgtttgctgccaacttctcattgcagcaggagcaaacatgggagctcaaaatgttaacgggttgactcctttattggtggctcgttcgtggcacaagactagcatcgaaggtattctaagcaagcaaccagaaaaccgaatgcgtattcttccttcaccatacctttgcttaccactgatgagcattgtcaaaattgccagggaatgtggatggaggaaaacttccgcctcatccacttgtcaggatccatgtgtcatatgtttggaggtggaatgcactgtagctgcagaaggttgcggccatgagttctgcaccaaatgtgcactctacttgtgctccaccactagcagctcaacatccacccgtggagttcctggctccatatcatgccctctgtgtcgccatgccatcgtctccttcatgaggctcaccagcactaccccgataaaggagcttccatggacaagcgcgtcactagctctatgtgcagcgggctcaaacactggccgccctgaacatggcgggtccttgcatcgaaggcctgacctgcgtcgactgcgctccatctcagttcagctgggatgctcttcttttagatccattggctctgggaagctgtcgtccatgaagctgaactgcacaggagctgaagaggcggtgccttgcctcgtcagctgcctcaggcccgatgtgcagcgttcatcgtcgtacaggggaagaattaggagatattcagagttttgaaaggatggttttgtggcgtccttcctgcgagtttttagggtttgggaatttaaacctgtgtcgtcatgttcctcttcgtttgtttccctgttgtttaatatgcatgcagtcctcgttgtgaagatctatttgtgtacatggcccgtttgtcttcattacttttacttatatgtgaattatataccatctctgttttgcaattaccgacaagttaatactcc

SEQ ID NO: 6006 - DNA, 1700 bp, Zea mays
tgcaggctccacggacgtgttccaccccatagctcaagtggctttgcctttgccctacagtgccccgccattcggcgccgccactacgcaaaacggctgcgaggcggcttgtctcggcgactgcaactgcacggcctactccttcagcaccgatggcaaatgctctgtctggaatggggacctgctcaacgtggaccaggccgacagcaccataagctcccaaggtgttctttaccttcgtctcgccaagagtgatttccagggtttgagcagaggcaacaagaggacaccgacggcggcgatcgctgcaggcgctgttggttctggaatactagtgctcgccgtgctagcgctcgtaatctggaggtgcaacaatgtgccgccgccgctacacgccggcgtcggagacggtggcggaatcatggcgttcaaacacaccgatctatgccgcgctactaagaacttcagcgacaggctcgggggaggtggtttcggctccgtgttcaagggactgttgggtgactcgaccgctgtggcggtgaaaaggctcgacgatgcccggcaaggcgagaagcagttccgggctgaggtgagctcggtcgggatgatccagcacatcaacctggtcagactgatcggcttctgctgcgaaggcgacaagaggctgcttgtgtacgagcacgtggtgaacgggtccctcgacgcgcatctgttccagcagagcagtgccgccgtcgtcgccactgcgctggattggagcaagaggtacaggatcgccgtcggggtcgcaagaggattgtgctacctgcaccagagctgccgcgagtgcatcatccactgcgacatcaaaccggagaacatcctcctcgacgcgtccttcgcgcccaagatcgcggacttcgggatggcggcgttcgtcggccgagacttcagccgggtcctgaccacgttccgagggacagcagggtacctcgccccggagtggctgagcggggtccccatcacgcccaaggtggacgtctacagcttcggcatggtggtcctggagatcgtgtccgggcagaggaacacgccgccgcaggctctcagcaggagcggttactaccacgccgcggcgtatttcccggtgcaggccatcacgaagcttcacgagggagacctgcagggcttggtggacccgcgcctacagggagacctcagcctggaggaggcggagaggctgtttaaagtcgcgttctggtgcatccaagacgacgagtgcgaccggccgaccatggctgacgttgtccgcgttctcgagggcctccaggagctcgatatgcccccagtgccaagactacttgcagctattacagcacgcgccaatgcggatttcatgtgatagatagttcatagctaggctgctagactagataattccatctccgtcgtgacgacgcgaggcctcatgatgattgagctcgagcatggctggcatggcagcaccttcctgcttgactgcgtctgcgtggtcagattaagcctttgataattgtaagacgatctgaaaatctgagtggttctatggcgttgacaatcattagtgcaattgacaataactcaatttgcattgcttacacaactggcaggtcacgcggttggtttagcgctgaatcaacgaacatgcaggtagctggagcaggagcctgcaggcatgcaag

SEQ ID NO: 6007 - DNA, 1078 bp, Zea mays
cactccatagggcgattgggttcctcgagggcggccgcgcaccttccttttcagcacctgcaccaatccgttgcgctcgtgctcccctctcgtccgccgccggcgacccccgcgccgccatggccacggactcctccgccggctcgttccagaagatccagatccagcgcgaggacaccacttttgatgcttatgttgttggcaaagaaaatgctcctggaattgtggttttgcaagagtggtggggagttgactatgagataaagaaccatgcgatccacatttcccaacttggtggaggatacaaagcactcattccagatttataccgtggaaaagttgctctcgatgttgctgaggcacaacatctgatggagggtctcgactggcagggtgcagtcaaggatatccaggcttcagttaaatggctgaagtcaaatggatcacccaaggttggtgttactggctattgcatgggaggtgctttatcaattgcaagtggagttttagtcccagaggttgatgctgttgttgctttctatgggacaccatcttctgagcttgctgatccttctaaggctaaggctcctatacaggctcatttcggggagcatgacagttttgttggtttttcagatgtcactgcagccaagtccctggaggagaagctcaaatcttccgggataccatatgaagttcacatataccctggatgttcgcatgccttcatgaacacttcgcctgaggcactcaagaggaagaaggggatgggtctgactgatgagaaccaggaagccgtcgacctggcctggtctcgcttctcttcttggatgggccggttcctcggatctgcttgattatgtgccgcgtgatgatgtgtggagtcaggtcccatgaataaaatagaataaaataaaatgttcagattcaggaaccatgcaaatggactgggctgtacggttctctggatttgcttgtccttctgtttatagttatctacctcagtgtggtttccttatttacaaaaaaaaaacgcacattgtggaatagccgtcgatggcttctgacagtaagcagc

SEQ ID NO: 6008 - DNA, 2887 bp, Zea mays
ttttactaacagggaaagggaagggatggccacagcgcgcctgctccgttgcgcctcctccaccttccttttcagcacctgcaccaccaatccgttgcgctcgtgctcccctctcgtccgccgccagcacccccgcgccgccatggccacggactcctccgccgcctcgttccagaagatccagatccagcgcgaggacaccgttggtgttactggctattgcatgggaggtgctttatcaattgcaagtggagttttagtcccagaggttgatgctgttgttgctttctatgggacaccatcttctgagcttgctgatccttctaaggctaaggctcctatacaggctcatttcggggagcatgacagttttgttggtttttcagatgtcactgcagccaagtccctggaggagaagctcaaatcttccgggataccatatgaagttcacatataccctggatgttcgcatgccttcatgaacacttcgcctgaggcactcaagaggaagaaggggatgggtctgactgatgagaaccaggaagccgtcgacctggcctggtctcgcttctcttcttggatgggccggttcctcggatctgcttgattatgtgccgcgtgatgatgtggagtcaggtcccatgaataaaatagaataaaataaaatgttcagattcaggaaccatgcaaatggactgggctgtacggttctctggatttgcttgtccttctgtttatagttatctacctcagtgtggtttccttattttctgtggatggatgcatattgtggaatagccgtcgatggcttctgacagtaagcagcgacaaggcaactaactgctggccagagttcaccctatcgttttgaattcaaataccgcccctagcccgttttagttttcgcggaaaaaaccactaaagaccagaaaaatcgattggtttaacattttatattcaaaaagtcggtttcccaactcaaacaggcgaaaccactgagatactggttctcgtaagtttttcaatttttcgactgtttgtattttcaaataaaatggtttttatgtcagcgttcttactagaggaagaacactgaacggaaattataggcaagaagagacgaagaaggaggattgagcgtgagctttggtattctgttatttccaaaactgaatgtcttttcctcccactctcctatttattctattacaaccactattcaatatgggccttaacgaatccattcagcaccagaaattctggagttgggcttcctagtgcgtcgacccatcatcctgtcttgtggcccttccatcgttctcccctgctccatcttcagaatgcccttcagccattaaaggagagctgacattccctcctcctcgaaagaacgcttgtccccaagcgttggctttaggaaattttgcacggagagcttcttcatcttcccatgaatccaatgcggcatccgactgtgaccacctgacaagcatctgctgcactgggctgcctcctcgtgatatcacctgtcggtccatgacttgaagaggaacttggagagaactgtcagtaccaggcaaggtagcactgacctgattgtcacctttggaaagcttgagttgcgatacgtggaagatgggatggacagtggcacctagcggcaactgaagcttgtaagcagctttaccaattctctgtagcaccacatatggcccaaaatatttgaaactaagcttgtgatttgcacgagccgctacagatgtctgaacataaggttgcaatttgaggtaaactgaatcccccacgttgaactctctgtcagttctgttcttgtcggcttgtgccttgatgcgttgctgagcccggagaagatgttggcgaacaacacggaccatcaattctctatcattcagccagtcctgaagatctccagagacaggcgtgtcattcagagtaattccaaaatgcctaggaagatggccataaaggacttcaaagggcgttcgtcccaacgaagaatgataactggaattgtaccaatattcggctatagataaccatgacatccatttggatggacaggcgtgtacgaagctgcgaagaaaggtctcaagacattgatttacgcgctctgtctgaccatcggtttgtggatggtatgatgaactcatcttcaatgtggtccctgacagccgaaagagctcttgccacaagtgactagtaaagatcctgtctcgatctgatacgattgacagtggtaaaccatgaagcttgtacactgaatctagataaacttgtgccaccttgagggccgaaaatggatgtaacagtggtaggaagtgagcatatttagaaaaggtgtccaccaccacaagaatagtatcagcattacgagaacggggcaaaccttcgacaaagtccaggctgaccacttgccaagcctgttccgggacaggaagaggttgtagcagccccgggtatttactccggtcaggcttggcttgctgacacaccttgcactgagcaacataatctctgactgccagtttcataccagtccatgcaaatgtttgtttgactcggcggtatgtgacaggaaagcccgaatgcccacccaaaggactatcatgcagggctgcgataattgtcttatggagaccaggatctgctcccacccatactcttcctttgtatcgaataataccagattgcagcgtataaggtccagatgctgctccagtgacagacaaagcagacaacaattgttgcgcctttgtatcctgctgataactgtcaacgacctgcagtatccattagggcacaaccgtggacagactaaacaacactgcatccataaggggacgtcgagacaatgcatctgccgccc

SEQ ID NO: 6009 - DNA, 975 bp, Zea mays
  misc_feature (855)..(855): n is a, c, g, or t
cccacgcgtccgcccccgcgtccgccggccgcgccgcctgctccgttgcgcctcctccaccttccttttcagcacctgcaccaccaatccgttgcgctcgtgctcccctctcgtccgccgccagcacccccgcgccgccatggccacggactcctccgccgcctcgttccagaagatccagatccagcgcgaggacaccacttttgatgcttatgttgttggcaaagaaaatgctcctggaattgtggttttgcaagagtggtggggagttgactatgagataaagaaccatgcgatccacatttcccaacttggtggaggatacagagcactcattccagatttataccgtggaaaagttgctctcgatgttgctgaggcacaacatctgatggagggtctcgactggcagggtgcagtcaaggatatccaggcttcagttaaatggctgaagtcaaatggatcacccaaggttggtgttactggctattgcatgggaggtgctttatcaattgcaagtggagttttagtcccagaggttgatgctgttgttgctttctatgggacaccatcttctgagcttgctgatccttctaaggctaaggctcctatacaggctcatttcggggagcatgacagttttgttggtttttcagatgtcactgcagccaagtccctggaggagaagctcaaatcttccgggataccatatgaagttcacatataccctggatgttcgcatgccttcatgaacacttcgcctgaggcactcaagaggaagaagggggatgggtctgactgatgagaaccaggaagccgtcgacctggcctggtctcgcttctcttcttggatgnggccggttcctcggatctgcttgattatgtgccgcgtgatgatgtggagtcaggtcccatgattaaaatagaataaatataaaatggtcagattcaggaaccatgcaaatggactggggc

SEQ ID NO: 6010 - DNA, 1155 bp, Zea mays
agaaaaatgatgtagactttagaggtcttttactaacagggaaagggaagggatggccacagcgcgcctgctccgttgcgcctcctccaccttccttttcagcacctgcaccaccaatccgttgcgctcgtgctcccctctcgtccgccgccagcacccccgcgccgccatggccacggactcctccgccgcctcgttccagaagatccagatccagcgcgaggacaccacttttgatgcttatgttgttggcaaagaaaatgctcctggaattgtggttttgcaagagtggtggggagttgactatgagataaagaaccatgcgatccacatttcccaacttggtggaggatacagagcactcattccagatttataccgtggaaaagttgctctcgatgttgctgaggcacaacatctgatggagggtctcgactggcagggtgcagtcaaggatatccaggcttcagttaaatggctgaagtcaaatggatcacccaaggttggtgttactggctattgcatgggaggtgctttatcaattgcaagtggagttttagtcccagaggttgatgctgttgttgctttctatgggacaccatcttctgagcttgctgatccttctaaggctaaggctcctatacaggctcatttcggggagcatgacagttttgttggtttttcagatgtcactgcagccaagtccctggaggagaagctcaaatcttccgggataccatatgaagttcacatataccctggatgttcgcatgccttcatgaacacttcgcctgaggcactcaagaggaagaaggggatgggtctgactgatgagaaccaggaagccgtcgacctggcctggtctcgcttctcttcttggatgggccggttcctcggatctgcttgattatgtgccgcgtgatgatgtgtggagtcaggtcccatgaataaaatagaataaaataaaatgttcagattcaggaaccatgcaaatggactgggctgtacggttctctggatttgcttgtccttctgtttatagttatctacctcagtgtggtttccttattttctgtggatggatgcatattgtggaatagccgtcgatggcttctgacagtaagcagcgacaaggcaaaaaaaaaaaaaaaaaaa

SEQ ID NO: 6011 - DNA, 1266 bp, Zea mays
gggatggccacagcgcgcctgctccgttgcgcctcctccaccttccttttcagcacctgcaccaatccgttgcgctcgtgctcccctctcgtccgccgccagcacccccgcgccgccatgaccacggactcctcggccgcctcgttccagaagatccagatccagcgcgaggacaccacttttgatgcttatgttgttggcaaagaaaatgctcctggaattgtggttttgcaagagtggtggggagttgactatgagataaagaaccatgcgatccacatttcccaacttggtggaggatacaaagcactcattccagatttataccgtggaaaagttgctctggatgttgctgaggcacaacatctgatggagggtctcgactggcagggtgcagtcaaggatatccaggcttcagttaaatggctgaagtcaaatggatcacccaaggctcatttcggggagcatgacaattttgttggtttttcagatgtcactgcagccaagtccctggaggagaagctcaaatcttccgggatatcatatgaagttcacatataccctggatgttcgcatgccttcatgaacacttcgcctgaggcactcaagaggaagaaggggatgggtctgactgatgagaaccaggaagccgtcgacctggcctggtctcgcttctcttcttggatgggccggttcctcggatctgcttgattatgtgccgcgtgatgatgtgtggagtcaggtcccatgaataaaatagaataaaataaaatgttcagattcaggaaccatgcaaatggactgggctgtacggttctctggatttgcttgtccttctgtttatagttatctacctcagtgtggtttccttattttctgtggatggatgcatattgtggaatagccgtcgatggcttctgacagtaagcagcgacaaggcaactactgctggccaaaaaaaaaaaaaaaaaaaaaaatctcgcttctcttcttggatgggccggttcctcggatctgcttgattatgtgccgcgtgatgatgtgtggagtcaggtcccatgaataaaattgaataaaataaaatgttcagattcaggaaccatgcaaatggactgggctgtacgggtctctggatttgcttggccttctgtttataggtatctacctcagtggggtttccttattttctggggatggatgcatattggggaatagccgtcgatggcttctgacagtaagcagcgacaaggcaactaactgctggcc

SEQ ID NO: 6012 - DNA, 564 bp, Zea mays
cgagctagcagtcgatacatcagcaacacacagctacgatacaatacatggcggcgacgacgacggcgagcatgatggcgcgggtggatcggctggacctgctgctgggctacctggaggagatgcaccgcaatggcaacggcaacggcagctagtccccctagtgctacaaccgcatcatcaccctccacccttgccgccggcggagtccatctcatcagcagtgacgacgacgtcgacgtcgactcctccgccggccccagcacgccgacctggcgccggccgcggcccgccaaggaggtgctggaggaggcgcaggccaaaggaagcctcatcgaccgcatagcctctctggaacaccgtgtgctcaagatggaagaggacatggaggtcacaccagctaacacggacaaggctagccaacagccgagagcgacgatgatgatgagcaagaacgacgatccaagcagcagaagaagaagaagaaggggctcaagagcttggtcaagtcctgcctgcgtcatcagaggcaacctcaaaccttttaggcgtttcgctgctgca

SEQ ID NO: 6013 - DNA, 1319 bp, Zea mays
accgggtatctctttctccgggtagtgcaccagcggaacggcgaggagcagaagggaacggggatgggaagcacaggggcgctgctttggcacccgtcgccgcaggtgcactccggtggcgtcctcttccgccagagccggcgcatcgtacgccagcgcaacttgcctctattatcgctagctgacgcggcgcttgagctcgagcgccgccgcgggcagcgtctccgctgcgctgccggcgacggggacggcgggccccgggaggctcagaaggagtctccgagcggcatcggcgcagcactcgaggatccgtctccaggacctcctgtggaaaacggtgccttcagaagcccctcacaggaagaacagagtgctctgtataattttctctatccaagcaaagacttacttccagatgataaggagatgagtatatttgatcatctggaggagcttcgcgagaggattttcatctcagttttggctgttggggctgcgatactaggctgttttgctttttcaaaagatctggttctttttctagaggcaccagtgactgttcagggtgttcggtttttgcagctctcgcctggggaatttttctttacaacattaaaggtttcaggttattgtggccttttacttggaagtcctatcattttatatgagatcattgcatttgttatcccaggtttaacaagggatgagcggaaatttctcgggcctattgtgttgggttcttctgttctattctacctaggcattttcttctcctacacggttctcagccctgctgcgttgaacttctttgtgaattatgcagatggggcagtggaatcgttgtggtcaatagaccagtacttcgaattcatacttgtgctgatgtttagcacagggttgtcctttcaggtccctgttatccagcttctgctaggacaacttggattggtttctagtgaccaaatgctttctatctggagatatgttgttgttggcgctgtcgtcgctgctgctgtgcttacaccttcgacggatccgttgacacaaatgttgttggctggtcctttgcttggtttgtacttgggtggcgcatggatggtcaagctaactggacgataagtggttcatgcaaggcaatgatgctccgggaagcaagagcgccactgtaacctagtcttgtaaaaatgaattcactctgttcatcagatgatattgttaccatttctctttctgaagttcatgagcagtagaaaatagaggaaacggttagttagtttcatctacagatcttgaagtaacaaatgaatgcgttgtggtac

SEQ ID NO: 6014 - DNA, 1392 bp, Zea mays
gggtccccgcgcgggcggccaggcgggctcgggacatcgtctgtccgccaccggttacctctttctccaggtagcgcaccatcggaacggcgaggagcagacgggaacggggatgggaagcgctggggcgctgctctggcacacgccgcagcagctgcacggccgtggcgtcctcttccgccagagccggcctctcctgcgccagcgcaacctgcctctaatatcgctagctgccccggcgctcgagcccgagcgccgccgccggcagtgcctccgctgcgctgccgtcgacggggacggcgccccccgggagtctgggccactgccacagaaggagtctccgtccagcggcatcggtgccgcactcgaggacccgcctccaggacctcctgtggagaatggttcctttggaggcccctcacaggaagaacagagtgctctatatacttttctttatccaagcaaagacttacttccagatgataaggagatgagtatatttgatcatctagaggagcttcgtgacaggattttcatctcagttttggctgttggggctgcgatattaggctgttttgctttttcaaaagatttggttatttttcttgaggcaccagtgactgctcagggtgttcggtttttgcagctctcgcctggggaatttttctttacaacattaaaggtttcaggttattgtggccttttacttggaagtcctatcattttgtatgagatcattgcatttgttatcccaggtttaacaagggacgagcggaaatttcttgggcctattgtgttgggttcttctgttctattctatctaggcattttcttctcctacacggttctcagccctgctgcgttgaacttctttgtgaattatgcagatggggcagtggaatcgttgtggtcaatagaccagtactttgaattcatacttgtgctgatgtttagcacagggttgtcctttcaggtccctgttatccagcttttgctgggacaacttggattggtttctagtgaccaaatgctttcgatctggagatatgttgttgttggtgctgttgttgctgctgctgtgcttacaccttcgacggacccgttgacacaaatgctcctggctggtcccttgcttggtttatacttgggtggtgcatggatggtcaagataactgggcgctaactgctttgtgcaaggtgatggtgctccggatagcaagagtcccagtgtaacctagtcttgtaaaaatgaattcactctgcttgcttgtaaaaatgaattcactctgcgtgctcattagatgatactagttagttatccgacactatggtttctatatatgatatatgttttctttatacaaaagaggaaaaaaaaaaaaaaaaaaaaag

SEQ ID NO: 6015 - DNA, 2029 bp, Zea mays
aggtctagagtagagaggtccaggccttcgcccgagccccgccagccactaccaacttgggacgggcaggccggccagtgtcacatacaggcccagaagccgtcagaagacatccggccctaggctaggcgcacgggaggcagacgaggcgagaagtggcaactggtacctttggggaggcgaggaaggacacgaggtcggcgcgttcgtgcgtgcctttctcactgcacgccgatccctctctccgaaccccgccgcccgccgcagatccgagggtcatcggcagccatgatctcgtccagcaagctcaagtctgtcgacttctacaggaaaatacctagggatttgaccgaggcatcactatctggcgctggattatccatcgtagcagcattagcaatggtttttttgtttggaatggagttgagcagttacttagcagtcaatactaccacatctgtgatcgttgataggagttcagatggggagtttttacggatagatttcaatatgagctttcctgcgctttcatgtgaatttgcatcagttgatgttagtgacgtgctgggaacaaacagattgaacataacgaaaactgttcgaaagtattcaattgatcggaatttagtaccaactggatcagaattccaccctgggcctatccccattctcaataagcatggagatgatgtcgaagaggatcacgtggatggtgcattttcattgtcatctcgcaattttgatagcttttcacaccaatatcctgttttggttgtcaacttctatgctccctggtgttactggagcaatcgactgaaaccttcatgggagaagacagcaaaaataatgagggagagatatgaccctgaaatggatggtagaatccttctaggcaaggttgactgcactgaggaagttgaattgtgtaggagaaaccacatacaaggatacccatccattcgtgttttccgtaaagggtctgatataaaggagaatcagggtcaccatgatcatgaatcatactatggggaacgtgatactgagagtttagtcgcggcaatggaaacatatgttgcaaacatcccaaaagaggctcatgctttggaagacaaatccaataagactgttgatcctgcaaagcgccctgctccaatggccagtgggtgcagaatagaaggctttgtgcgtgtcaaaagggttccagggagtgttgttatctcagctcgatctggatctcactcgtttgatccatcccagataaatgtttcgcactatgtgacacagttctcatttggcaaaagactttccccaaggatgctgcatgaattcataagacttactccctatcttcgtggataccatgatagactagctggccagtcttatactgttaagcatggtgaggttaacgccaatgttactattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggtcttggtaactgaagtcccgaaatccttctcccatttcatcacaaatgtctgcgctatcatcggtggggtcttcacggttgctggaatactggattccatctttcacaacacactcaggatggtgaagaagattgagctaggaaagaacatttaaatttcgacgccgctgcaagtttaggcggatgcactaggtagccattgttttgttataactaggtaatgactcatgaaaatcggtatatgaaagatggcgtgctgaattgacggttgaaattcggggggtcatgaactcatcatataataactagggatctcactgtttcgctaaaccactcacaataagacagtggattgctgctagtgtgccactgtgataagtaaccgagttggataatatattcagtatattatcttgccgtgctaaaagggggggcccggtaccc

SEQ ID NO: 6016 - DNA, 1871 bp, Zea mays
cggccgggggcaactggtacctttgggggaggcgaggaaggacacgaggtcggcgcgttcgtgcgtgcccttctcactgcacgccggtgagaattgagatcccagcaccgagacgacgacacaagtctcacctccatcctcctttactcctcatcccagatccctctctccgaaccccgccgcccgccgcagatccgagggtcatcggcagccatgatctcgtccagcaagctcaagtccgtcgacttctacaggaaaatacctagggatttgaccgaggcatcactatctggcgctggattatccattgtagcagcattagcaatggtttttttgtttggaatggagttgagcagttacttagcagtcaatactaccacatctgtgatcgttgataggagttcagatggggagtttttacggatagatttcaatatgagctttcctgcgctttcatgtgaatttgcatcagttgatgttagtgacgtgctgggaacaaacagattgaacataacgaaaactgttcgaaagtattcaattgatcggaatttagtaccaactggatcagaattccaccctgggcctatccccattctcaataagcatggagatgatgtcgaagaggatcacgtggatggtgcattttcattgtcatctcgcaattttgatagcttttcacaccaatatcctgttttggttgtcaacttctatgctccctggtgttactggagcaatcgactgaaaccttcatgggagaagacagcaaaaataatgagggagagatatgaccctgaaatggatggtagaatccttctaggcaaggttgactgcactgaggaagttgaattgtgtaggagaaaccacatacaaggatacccatccattcgtgttttccgtaaagggtctgatataaaggagaatcagggtcaccatgatcatgaatcatactatggggaacgtgatactgagagtttagtcgcggcaatggaaacatatgttgcaaacatcccaaaagaggctcatgctttggaagacaaatccaataagactgttgatcctgcaaagcgccctgctccaatggccagtgggtgcagaatagaaggctttgtgcgtgtcaaaagggttccagggagtgttgttatatcagctcgatctggatctcactcgtttgatccatcccagataaatgtttcgcactatgtgacacagttctcatttggcaaaagactttccccaaggatgttgcatgaattcataagacttactccctatcttcgtggataccatgatagactagctggccagtcttatactgttaagcatggtgaggttaacgccaatgttactattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggtcttggtaactgaagtcccgaaatccttctcccatttcatcacaaatgtctgcgctatcatcggtggggtcttcacggttgctggaatactggattccatctttcacaacacactcaggatggtgaagaagattgagctaggaaagaacatttaaatttcgacgccgctgcaagtttaggcggatgcactaggtagccattgttttgttataactaggtaatgactcatgaaaatcggtatatgaaagatggcgtgctgaattgacagttgaaattcggggtggtcatgaactcatcatataataactagggatctcactgtttcgctaaaccactcacaataagacagtgaattgctgct

SEQ ID NO: 6017 - DNA, 2228 bp, Zea mays
cctcgaggccggccgggtggagataatgcggaggacggtgattccgacgccaccgcggatccatcgcgggcgctcgagtcgttccggctgctctgcggcgaagcggattaccacgccttgaggggattcctggagagggtttcggagggaggtgatggttatttgtcgccaatcattctgtcagctgatgcagataaggcacatcgatccgaggtgcacgagttcatcaagaggaatttcaagttcctgaacacggatacagttgagcacaatgatggtattcagaaatgcattagggtgcgcttgggttcagggccacgctgtggtaggggaaggaacaggagaggcatggacacttcaggctggagagatgacaagccgtttgacagtagaggctctacattctggccttatcacctggggaagttcctgaggtttcacctttataaggagaacaaggacacacatgaggcactaggggttataggaaaattggcaggggttcagccaagatcgtttggatttgcagggacaaaggataaacgtgctgttacaacccaacaggtgacagtttttaaagtgcatgctagcaggctggctgctcttaatagcaaactcacaggtatcagagttggagactttagttacgtgaaggagggccttgttcttggtcgactcagagggaaccactttgcaattactttgaggaatgttattgcagaatcggccgatgttataaatgctgcagttaatggtctaagtaaaaatggatttatcaattactatggcttacagcgctttggcagcggttctgtacctacccactttgttggtgctgctttgctcagaggagaatggagacatgctgttagcttgattcttggtacaagggtacattataaatggcatgttgatgttgatgcagcacttaggggcatgccccgacatctcacagtggagagagctattcttcagagattgaagaactaccctggcaactatctacaagcactaatggctatacctaaagcactgaggctgatgtatgtacatagctaccagagttacttatggaatcatgctgcaagtatgagagtggaaaagtatggtatttcacaagttgtagaaggtgacttagtttacaaaactgggtcctcccttggagaagcaattaccacagatacatttgatgacgatgatagccacgttaattcacctgaaatggaaatgtcttgtgaaacacttactgaagaaatgatccagtctgtgaaggtagttgattctgaagatttattgaaggcagtctattcgtttgaggatgttgttctccctttgcctgggtcagaaacattgtttcctgggaatgaagttactatgatttatcatgaaatagccaagaaggatggcattagcctgatagagagcgcccatggtatcaaggacttctcgattacaagcatgaaaggaggttaccgccgcgtactccaacgccctattgattttgaatgggacctgatgacttacacagatgacaatacacctttagtaccaactgatttagatgttctatcagaaacccagttatcagaaacaaatgagccattatctgatgggacttgcagttgtccatcaagtgattccaggttgcaagttttattggacacctctggactaaccattgaagctagctcagtagaaaccaaatcaattggcatctcagatctgtcaccagagaaactggctgtgaaattagaatttactctaccagcatcatcttatgctacaatggccataagggagttgacgaaaacttcaacttcggttgcttgccagaaaacattaaacggctgaccaagccttgcagtgtaaaatgctttcttcgcaagctggtatccattgtgacaaaacacaccatgtgggtttaactgggcccaggggatggaaccaagcttcggaaaagaaggaacatttcggttctttgctctcactaggaatgatgttccatgattttttagaaaactggaacaggtgttggtctgtcatacatggatgtaaacttagatgactgaaaagtagctttaccttttgcagacagatctttttgtctttagtttatgcatcgtatattgtgatgtctgaactggggtcgcaacctcgtgggcatgcacgtatggccatgcacttctttgaggcgtgcactccctcataacgttcacgtccttaccagc

SEQ ID NO: 6018 - DNA, 1312 bp, Zea mays
gtcccgcactctcatagaaaagaccatatccttccacttgctatggcggcggcggcggcgacggcgaccacgacctctccggcgagggcttcgtggcggcctacggttcccgcgacctcggcatcggcagcaggagtctgcttccgtgttggagcgaagcgctttccagggctccgaacggcaagcacctgccggcaccgacaccgaggcacaacaaggctcacaaccgctcacgtcaagagcggggaagccgaggggcgtccgagcacggaggagagcgcaaccggcagcggcggcccggacgaggactccctgcggcgcgagctcgaaaccgcgatcgaggaggaggactacgcgcgcgccgcggcgctccgggacgagctgcgcgtgctccaggaggacggccgggccgcggtgctggcggcgaacgcgcggttctacgccgcgttcaaggacggcgacctggcggcgatgcgccgggcctgggccaggggcgaccacgtctacgtggtgcacccgtcggcggggaggatctccgggtacgagatggtgatgcagagctgggagatggtgtgcgacgccggctacgagttcccgctgcaggtggacctgcaggacgtggaggtgcgcgtgcggggcggcgtcggctacgtcacctgcctggagatggtcaggaccaaggggagcagcagctggggcatgcagctggccaccaatgtgttcgaggaggtggacggcgagtggctcatgtgcgtccaccatgcctcgcacttcgatgagtgaaatcgctttgcaattcgatcgatcgatgagcggaaataattttggtcggccgtcagtacagaaacatatgaattcagatttcggaaatgtgatctctctctctctctctcacacacacagttgcattgcactctttcgttcttcgcgggagaaaagatagccacgcggcaacacacgttaaggcaccgaatgctcggttagtgaattcgtcgttgatacgtaattccatcattttaccgtgggggcgggacggcggggtcgcgaattatttttgcaatattgtttttattttctataaaagtaacgagagaggattgaataagtttcaagggaggagaatttctggtgccacaaataaatgctagacaatgacacaaaaacacttcaaatgcatacggtgtattatcacgcagctttgaaagagattattgaaaaccggtttgcagagaaacaaacaaactttgttttgttaaaaaatgaataaaagtatcaaaatttttagtgaattcaagtttgaggaaaaaaacac

SEQ ID NO: 6019 - DNA, 2090 bp, Zea mays
  misc_feature (223)..(223): n is a, c, g, or t
  misc_feature (338)..(339): n is a, c, g, or t
aaaaaaaaaaaaacaaaaaaaaaaaaaaaaaaaaaaaaaggaatttgagggctgcacggcgctgctcaaaccgaagagatatcaataaatgatgatgagtggaatgatggtttactggcaaccatccgtgagaaggttcatatggaggctgataggaaggccatgtccaaccaagtaaatgttccagcagatcttgcgttcctatcgaggactacatataggnattagaaataaggttatctattgcttggatggagctaggattggcatacagtatgagacattctttgctggagagccttgtgaaatttttcattgtgttttggaaagcaagtcannttcctggaaaagatgattatgattgaacacaccttacctttctttctgcctgtacgtgaattagaaagtgatctgttgtcatctaattcaattaaattcattgatcatcttgaagaaattttacaggcttatattgacaggagagagcaggttcgtcttatcaaggagctctacgggaaccaaattggcgagctgttccatagtcttccttataatatgatagagtttgtattggaggattttgagtgcaaggttacaatcagtatccgatattcggatctactgcagaccctgccgagtcaggcaagggtcttggcttggccacttcgctcggccaagaaaatatctacaagaagcagcagtgcatcagctgcgcaaccagtaccctttcacctttcatatgccgaggaagcactcaaaaccttgtgtctaccagaaggtgcttcctgtcaccttggcttacagcatacatggctttgtgctgaattgatctgtttctccctgttttgtgtttcagcatacgcagacattgtgctggagctaccccatgctttgaagaggattttatcctctcgggacagtgactaaatcgtgacctcaagatgtccagttttgttgtgcataagattcacatctcaatcgtggggcatgtttttgaagatattgttcagaatcttgtggtagtatagcctgcagttgtggactgcaattcctgtgaaagcaaggcagacatttgcgtgggccgctcgaaatattccggctacagttcctgttaaaagaatcaaaatcctaggaaggccttatggtcgaggcataatcttgccaactgctgtccttgtccttgatgtgtgctccttttttttctccactctggctatgtttgtttccttttagaattatactagcgcgttacgcgcgcctgcacgcgcgtgttgacaaacctattttatttcaaatatcaagtatctaagaagacatgctaaaatttcaacaatatttttggtaccaatagcagtagtaatacaaacttagattacaatacatagcaagttgcattaaagtagcatacttcagtgtccagcaatagtgtccgtaaagtttgcatagacaaaatagttttaggaagactttaacaatagagtcatatgtatacaaaagtctactgaccaaaaatgatgaagcctttcttgtatagacacagctttaggaaggcatcaacatcagttttatatgtacataaaagtctcgtgaccaaaagtgatggagcctcttatatgtttgcaaattttttttacctatatacaaatgagaggagtatgttagcatagacaacatcaaagagctcaatgcgatatcacgatcataaaagaaataatattctttcaaaggagagaaacaataacacataacatgtttattttatctttccctctaatcacgacaagcaggtactatgtctattaacacaacaagccatgttgtctccaagatctcaagttacaaaaacttaattgaaaacttgaagtgcttctcgaataaggtacatcaagaggctaacattttaacacactgttatgacaatagctaaggaaagagtagtatacaagcaggtttattaagaacactggcaactgcatcttggtaatgtttgaagaaaaggttcaaagcattcaaataaaattatgtaatgtttgaagaaaaggttcaaagcattcaaataaaaattatgaatgacaggataacttaaagaa

SEQ ID NO: 6020 - DNA, 1708 bp, Zea mays
gcacaatagatcacctacctttctcacccttcatccaacggcgccagcacgcacgagcagtgcgccgccatccgttgcgccgtcgtacgcagccagctggagcgccgcttcccgccagccagccggagcgccgccgcccgcgagagtcccgcccccggcgtgtatcagaaccccccccctccccggcgccgcgcagcagagctccgtggcccccgccctcgccgagcagcagagggccgcctccagccagctcgccggctatggctgccgctggagatccaccacctcctatttatgctgagggtgctgcaaggacaagaggagaaatatctccacatttccagacatatgcaagggacgacgatgcaaaacttgagaccacacgtgcaaggctgtcaaatatcctcaaaaggcatgaagatctgaaagagcgcctttcacgggattctgataagctcatttttgagcgcctacagaaagaatttgaggctgcacgggctgctcaaaccgaagagatatcaataaatgatgatgagtggaatgatggtttactggcaaccatccgtgagaagaccaggttcatatggaggctgataggaaggccatgtccaaccaagtaaatgttccagcagatctttcatttcaatcgaggactacatataggattagaaataaggttatctattgcttggatggagctaggattggcatacagtatgagacattctttgctggagagccttgtgaaatttttcattgtgttttggaaagcaagtcattcctggaaaagatgattatgattgaacacaccttacctttctttctgcctgtacgtgaattagaaagtgatctgttgtcatctaattcaattaaattcattgatcatcttgaagaaattttacaggcttatattgacaggagagagcaggttcgtcttatcaaggagctctacgggaaccaaattggcgagctgttccatagtcttccttataatatgatagagtttgtattggaggattttgagtgcaaggttacaatcagtatccgatattcggatctactgcagaccctgccgagtcaggcaagggtcttggcttggccacttcgctcggccaagaaaatatctacaagaagcagcagtgcatcagctgcgcaaccagtaccctttcacctttcatatgccgaggaagcactcaaaaccttgtgtctaccagaagcatacgcagacattgtgctggagctaccccatgctttgaagaggattttatcctctcgggacagtgactaaatcgtgacctcaagatgtccagttttgttgtgcataagattcacatctcaatcgtggggcatgtttttgaagatattgttcagaatcttgtggtagtatagcctgcagttgtggactgcaattcctgtgaaagcaaggcagacatttgcgtgggccgctcgaaatattccggctacagttcctgttaaaagaatcaaaatcctaggaaggccttatggtcgaggcataatcttgccaaataaagtccttgtccttgatgtgtgctccttttttttctccactctggctatgtttgtttccttttagaattatactagcgcgttacgcgcgcctgcacgcgcgtgttgacaaacctattttatttcaaatatcaagtatctaagaagacatgctaaaatttcaacaaaaaaaaaaaaaaaa

SEQ ID NO: 6021 - DNA, 4086 bp, Zea mays
  misc_feature (1)..(1): n is a, c, g, or t
  misc_feature (4003)..(4034): n is a, c, g, or t
ntaattcgatcaaactctgcatcgcattccattcctgtgctctcaacttgttaaggtcagacgagccagcatacaggtactttgctgcacaagctttgtcaagtctggtttgtaatggtagcagaggaacacttctggctgtcgctaattctggggcagccattggacttgtatctttgcttggatgcgctgatgtcgatatagccgatcttttggaattatcagaggaattcatgttggtgcctaatcctgatcaaattgcattagagaggctatttagagttgatgacatcaggattggtgcaacttctagaaaatctattcctcttcttgttgatctacttaaacccattcctgaaagacctggtgctcctttcttggctttgggtcttctgacccagttagctgttgattgccccccaaacatgctgctaatggctgaagctggaatactagaagcacttaccaaatacttatctcttagtccacaagatgcaacagaagaagctacaactgaattgctgggcattcttttcagtagtccagaaataaggcatcatgaatcagcacttggtgttgttaaccaacttgttgcagtccttcgtctaggaggaaggaattcacgttacagtgctgcaaaggcattagagagtttgttttttgctgaccatgtgaggaacagtgagtcagctaggcaggctatccaaccccttgtggagattctgagtactggcatggagagggagcagcatgcagctatatcagcccttgttaggcttctttctgacaatccttcaagagcacttgcagttgcagatgttgagatgaatgctgtggatgttttgtgccggattctttcttctgattgttcagtggagttgaaaggagatgctgcagaactatgctgtgttctatttaacaatacaaggatccgttccacaatggcggccgctcgttgtgtggaacccttggttggtttactggttagtgaagctaaccctgcccagctttctgttgttcgtgcattggataggcttctagatgatgagcaactggcagaattagtggcagcacatggtgctgtcattcctcttgttgggtttttgtatggcaaaaactacatgcttcatgaggcagttgctggagctttggtgaaacttggaaaggacagaccagcttgcaaattggaaatggtcaaggctggtgtaattgagagcattcttgatattctccatgacgctccagattttctttgcatcgcattggcagaaatgcttcggattttgacaaacaatgctaccatagcgaaaggtccatctgtagccaaagtagtacaacctcttttctctttgctttctaaggcggacatgggtcctgaagggcagtatagcacattgcaggttcttgtgaatattttggagcatcccgaatgccgtgctgattataacttgacacctcgccaaactattgagccagtgataaccttattgaattcatctccaccagctgtgcagcaattagctgcagaactcctgtcacatcttcttctagaagacaacctccaaaaggacacaataacagagcaggcgattactcctcttattcaagttctttcttcaggtttgccaaatctacagcagagagctataaaagctcttgctaaccttgcaatagcttggccgaatacaattgcaaaggagggtggtgtttttgagttgtccaaagtgttgttgcaatctgacccgcctttgccgcatgttgtgtgggaatctgcagcatctgtattgtctagcattctacagtacagtactgagtttttccttgaggtacctgttgcagtactagtgcaattgctcaggtctggaactgaaagcactgttgtcggtgctttgaatgcccttcttgtattggagagtgatgactcaacaagtgcagaagcaatggctgaaagtggtgctgtggaagcattgcttgatctcctgaggagtcatcagtgtgaggaaactgctgccagactaattgaggcattgctgaacaatgtaagaataagggaggcaaaggctgctaaaaatgctattgcaccattgtccatgtaccttctggatccacagacacaatcgcaacagggaagattgcttgctgctcttgctcttggtgatcttttccaaaacgaaggtcttgctcgttctactgatgctgttgcagcatgccgcgctctagtcaatcttcttgaagatcaaccaactgaagagatgaaagtggtagcaatatgtgccttacagaatctagtcatgtacagccgagcaaataagagagcaattgcagaatccggtggtgttcaggtcctgctggatcttatcagttcaagcaatcctgacacttctgttcaggctgcaatgtttgtcaaacttctattcaataaccatactatccaagagtatgcaaccagtgaaacagtcagagttataactggtaaacaatatccctttcttgttctgtcatgttcattttgcatagcaaattcattgttatcaatgcctgccatgctaaagatgtcaatatccacctttagtatgagatttatggaatttctatgtaatgtctagcaaatacttgaatcgagtcacgtttgtgaagttcacctgtactttgtgagttctaatcaaacattctgtgtacagtatgtgaaaggaggccatcttttttttagataaaggaaaataatccggcatcagcattcacacgtgaatgtttatagcccaagaggcaatctatcttagtttagttatttctcctagccagctggaatatgtatatgtttacgatcatacccagcttttatacatttaatgcttacatttttcatgcagcttcgggtgaaaaggatatatgggcttctggaagtgctaacgaagagtatctcaaagcactcaatgctttgctgagtaacttccctcgtctgagggtcactgaacctgccacattgtccagtcctcatcttgtaacatcccttaaaactggttctgaggcaactcaagaagcagcgctagattcactatatcttctcaggcaagcttggtcagcttgcccagctgaagtatttaaagcacaatcagtggctgcatcagaggctattcctctacttcaatacttgatacagtctggcccaccgcggtttcaagaaaaggcagaattgcttcttcagtgcttgcctgggactcttactgttacaataaaacgtggcaacaatctaaggcaatcagttggaaatcctagtgccttctgcaagcttactcttggaaataatccaccacggctgacaaagattgtctcgactggcgcgacacctgaatgggatgaagcctttgcatgggcatttgacagtcctcccaagggccagaagcttcatatctcctgcaaaaacaacagcaaatttggaaagaaagcattcggtaaagtgacaatccagatcgacagggttgtcatgttggggtcagtcgcaggtgagtacaccctgctacccgagagcaaaagcggccccaatagaaacctggaaattgagttccagtggtcaaacaaataactgcatacctacataatttaggcgccctctgtaagttgaagatcgatgagtttgagtgttttcttgttttgtactctgctaaaggttaccctgtttgtgcatcattgtaaatagcgggcagagaaagatgtcgtttgctgtaccttctgtgagatataaacagatgagttctcagacgttttgtactggttgtgtcaggcttcattcgtttatttttttaccctgggattttgtctttgtaaaggggtgtaaacagaagtatatgatatggttaggttctcatacggaatggacgtttgcgactttgcagtctcttaccagtatacatgtttatttgccctgtttgttttgttctcatttttgaggtttgtgagggtgctgattaaaaattactgaatatttgattcatagtatgctttnnnnnnnnnnnnnnnnnnnnnnnnnnnnnnnnggcgtggggatctcgaacctgcccgcctggggcgggctcatggggcagggct

SEQ ID NO: 6022 - DNA, 1951 bp, Zea mays
cctcgaggccggccgggcttactgtattcatctccaccagctgtacagcaattagctgcagaactcctatcacatcttcttctagaagaccacctccaaaaggacacagtaacagagcaggcgattactcctcttattcaagttctttcttcaggtttgccaaatttacagcagagagctataaaagctctagctaaccttgcaatagcttggccaaatacggttgccaaggagggtggtgtttttgagttgtctaaagtgttgttgcaatctgacccgcctttgccgcatgttgtgtgggaatctgcagcatctgtattgtctagcattctacagtacagtactgagtttttccttgaggtacctgttgcagtactagtgcaattgctcaggtcaggaactgaaagcactgttgtcggtgctttgaatgcccttcttgtattggagagtgatgactcaacaagtgcagaagcaatggctgaaagtggtgctgtggaagcattgcttgatctcctgaggagtcatcagtgtgaggaaactgctgccagactaatcgaggcattgctgaacaatgtaagaataagggaggcaaaggctgctaaaaatgctattgcaccattgtccatgtaccttctggatccacagacacaatcgcaacagggaagattgcttgctgctcttgctcttggtgatcttttccaaaacgaaggtcttgctcgttctactgatgctgttgcagcatgccgcgctctagtcaatcttcttgaagatcaaccaactgaagagatgaaagtggtagcaatatgtgccttacagaatctagtcatgtacagccgagcaaataagagagcaattgcagaatccggtggtgttcaggtcctgctggatcttatcagttcaagcaatcctgacacttctgttcaggctgcaatgtttgtcaaacttctattcaataaccatactatccaagagtatgcgaccagtgaaacagtcagagttataactgcttctattgaaaaggatatatgggcttctggaagtgctaacgaagagtatctcaaagcactcaatgctttgctgagtaacttccctcgtctgagggtcactgaacctgccacattgtgcattcctcatcttgtaacatcccttaaaactggttctgaggcaactcaagaagcagcgctagattcactatatcttctcaggcaagcttggtcagcttgcccagctgaagtatttaaagcacaatcagtggctgcatcagaggctattcctctacttcaatacttgatacagtctggcccaccgcggtttcaagaaaaggcagaattgcttcttcagtgcttgcctgggactcttactgttacaataaaacgtggcaacaatctaaggcaatcagttggaaatcctagtgccttctgcaagcttactcttggaaataatccaccacggctgacaaagattgtctcgactggcgcgacacctgaatgggatgaagcctttgcatgggcatttgacagtcctcccaagggccagaagcttcatatctcctgcaaaaacaacagccaaattgggaaagaaagcaattcggtaaagtgacatcccagtccgacagggttgtcatgttggggtcagtcgcaggtgagtacaccctgctacccgagagcaaaagcggccccaatagaaacctggaaattgagttccagtggtcaaacaaataactgcatacctacataatttaggcgccctctgtaagttgaagatcgatgagtttgagtgttttcttgttttgtactctgctaaaggttaccctgtttgtgcatcattgtaaatagcgggcagagaaagatgtcgtttgctgtaccttctgtgagatataaacagatgagttctcagacgttttgtactggttgtgtcaggcttcattcgtttattttttttaaaaaaaaaa

SEQ ID NO: 6023 - DNA, 2905 bp, Zea mays
  misc_feature (132)..(132): n is a, c, g, or t
gtgaacagtgtcgtggagtccagccatcctagttacagtgttttactctcacaagtcacaacggatgcagacgcagccgaatacggatgtttgcattgcacaatgaacatgattttcttttaaaaaatctcntagtgcagacatatgttttgtttcaatatggataaataactgtttgttttcttgcacgatgaacaagagcggcgtcgagcgtttttctttcctcctcgtcggcgccgccttgcacttccacgcctaatcaatgcagccgtagccgccactgcgcccaaagtcagagccagccgctcatcgtctcttaagagctaggggtactctcctagccaaacacatttcttgagtagctctaactttatgtgaagcttacttgagctgaattgtagaagtgaaacataaatttatggagttggagttggacctatgtcaaccagggcctgatgatagtactatatatatggccggccgcgccgggacctcagcaaagaagaagaatggcgttgctcggcgagtacagcagtcaggagctcctccagggtcagctccagctctggcaccagtccctgggcttcttcaagtccctcgcgctcgcggtcgccatggacctccgcatcgccgacgccatccaccgcctcggtggcgccgccacccttccccagatactcgcggaggccgggatcaagatcgacccgcgcaacaacaagctccgcgacctgcggcgcgtcatgcgcgcgctcaccgtgtcgggcatcttcaccgtcgtccagcgaccagcgtcgtcgtcagatggaggcggcaggcgtggcgcagaagcggaaggtccggtctacaagctgacggcggcctcccgcctcctcgtcgtcggagagaaggagagctcgacggcgacgacgaggcagctgcctcctcctcctccttctctgaccgtttatgtgcagctcttactcgaaacctgccgaggatccgcgttcagcagggccgtgcgcgagtggttccagttccagcagccgccgcaggatgatgagcagcaccagcagccggccggccgcctgtcgtccccgttcgccctggcgtgcggcgggcagacgatctgggagcgagccgagcgcgacgcccacgcgttcccgttcgacgacgccatggcctcggacaccgccttcctcatgccgatcgtgctgagggagtgcggcgccgacgtgctcggccttcgtcgcccctcccccctcgtcgacgtcgccggcggcctcggcggggctgccgccaccatcgcggcggccttcccggacctcagctgcaccgtcctggacctcccgcatgtcgtcgcaaaggcagctgccggcaccaccgacagcaacgtccagtacgttgccggtgacatgtttcaatgcatcccaccggcggacgcggtgttgctcaaggtacgtgtacgtccggtccgattcgatccatcgccggatccagctcgcgacgacattattctatcactatataatattgctgtcctgtcaccgtccagtggattcttcacgactggagcgacgacgagtgtgtgaggatactgaagaactgcaagcaagccatacccccacgagcggcgggagggaaggtgataatcatagacatggtggtggccggaccaggatcaggatccgcggacgatgagccgtcggagtcggacttgaggcacgtggagacgcagatcttgtttgacctcttgatgatgtgcgtcaacggagtggagcgagacgagcaggagtggaagaagatcttctccgaggctgggtttcaggactacaggattatgccgcttctgggcgttcgatccatcatcgagctctatcctaattaaaattagtatactgaattgaaagctaagctcgccactcgcgacaagcttgttgtggttgtggctgggcgtgtggtggtgatcgaacgtgtgtttgccatgctcagggatccatgcatgctatatgtactccctccgctcccttcttgttggcgctggtcggttccattttgtactatttagcgacaaataaaacgaaacggagggagtaataaaataacatccactacatgattgattatatcggtttcgatccatcatagagctgtatcctaattagtttttactgaattgaaaactaagctcgctagtcgggactcgggactggctcgttgtggcacgggcactatatatggcagggcgtgtcgagcagacaagcatgcatgtgcgtgcagtcgatccccacgctctcatgttatcactttgggaaccatggatgctcgctgtaaatgccaataaaataacgggaccgcaggcgattgttaattcagaccgtacatgatcttgattatagccatatatatgaaacaaatctttttacgtctctattccgttacccatgagctaaggctatttctaaagttatgttcggtatatttagcgtaagttagtctcctttttttttctctctagcaaggcaagcggacgctccggtaaaatagtggacgatgccagcacccaccaaacgtggcgtctctctttgtgctcgctatcgtgtctccgtctttactctgcggccactcgaaaagttttcatcacactcgtcacccctgctccgagcaatgaagcaggttcgtgtttgttcgaaggctttcgcttatgtttctttctggtagagatttgaggactgtagttaagaaggcgcctacgaaatctagtgagaaggcatctctgtgaaatctagtgagaaggttgcttgcttcgccatggcctgctctggcgctacatacggccaaacggtgccgccatcggcgatctcagcctcaccatcagacgtgaaatctcttgttgaagtactcccgcactgccaccgtttcatctaac

SEQ ID NO: 6024 - DNA, 3426 bp, Zea mays
  misc_feature (6)..(6): n is a, c, g, or t
ttacgnttcccggtcaacaggtaaaggggccctaacatccccttttaagcttctgaagtccaaccatctcggtgtggtgcttacattcactgtatataaatatgatctgcctccaaatgcaacaccacaggagcgtattcatgctacattgggctatcttggtgcctcatttgatgtcccttctctggttgataaactcctagaacaactcgctagcaaacgaaagatagtagttaatttatatgacaccacaaatcatacctctcctattgaaatgtatggttctgattttactccatctggtgatctgcatattagtagcattgattttggagacccaacacgcaaacatgagatgcattgcagatttaaacatgaaccttcactgccatggtctgcaataataatatcaacagctgtagctataattgttttgcttgttggacatattatttatgcaactctgaactcccttgaaaaggctgaacatgattatagagtaatgagagaacttaaaggacaagctgaagctgcagatatagcaaaatctcagtttctagcaactgtttcccatgagattcggactccaatgaatggtgttttaggtatgctgcagatgctaatggacactgaacttgatacaactcagcaggattttgtagtcaccgctcaagaaagtggaaaggtattaataaacttaataaatgaagtccttgatctggctaagatagagtcaggaaggattgagctggaagcagtgccttttgatgtccgtgatattcttgacaatgtgatatctcttttctacgataaatcacaagctaaaggcatagagttggccgtgcttgtatctgaccaagttcctgatgtcctaattggggatccatggcggttccggcagatcatcccgcgccttgtggggaattctatgaagtttactgaacagggccacatctttgttcaagtccatttggtcaaggaactaaacaggaaaggaaacaatttttgtgatgtttctgctcataacagagaaattctgtatgattctgacaactcgatgctatggaacacactaagcggacttgaagtagcagatagctggaggtccttggagaattttacgatgttcaagaattcaaatggtgaaacagatacaattaggttagctgtcagagttgaagacaccggcataggaataacaaaagatgctcaaatgcgtatttttacacctttcatgcaagctgacagttccacctcacgaacatatggtggaactggaattggcttgagtattacaaaacgtttagttgaattgatgggtggagaaatagggtttactagtaaatcaggagttggtagtacattttcttttactgccattttcaaggagaacagaggatgtcctggagatatgaaaagatactattctgaacctactccgttggattttcaaggaatgagggctcttattattgatggaaggagtgcacgtgcagaggttactatgtaccatcttcgtagacttggaatacagtgcagtcttgttgccacatctgaatctgaatctgcatcttcagctttgatgaaagcctgcacctcaagcaaaaacaatccggacatggtccttgttgatacagaagcttggggtaaaggttcaggtttggcattctatcatcgttttgtagattgtcaactaaagggcgcacacaagttttctcagcccatgccaaagactattcttttgggaagctcaataagccctgttgaatctgattatttaagattgacaggatttggtgattgcataaggaaacccctccgtcttagtactattgttgcctgtcttcgcaaaaccttaggggttggggttacaaggcagcagagtagagaccaatctttggttcttcaaagtgtactaactggaaaacagattctggttgtggatgataatgcagtcaaccgtaaagttgcagctggttctttgaagaaatatggatctaaagttacatgtgttgatagtgggagtgatgcaattgatatgctcaagccacctcacacatttgatgcttgcttcatggatgttcagatgcccgagatggacgggtttgaagctacaagattaatccggtccatagagaaaaaaataaacgatatgatcatgatgggtgaaatatccgctaataattatggaaataaggcccattggcatgtaccaatattagctatgacggcagatgtaatccaagcgacttttgaaaaatgtatgcagtgtggaatggatggatatgtgtcaaagccatttgaagaacagcagctctactttgctgttgctcatttcttagagactgatgaaacagaataacaaatccaacttcgtaggagattgatttgccgcaacactgtttcaacatctgccaaaagaccatctgttcaacaggttctgaaaaacagcgatcggcagcatatttggaaacaaaatacattggactcccactgaccagaagaaagaagataagatagtagggggtacaaaatgtttggtctggtttccgcagcaattttttttctggccgtgttttctggaaccaatacaacatgaccttgcaacagtggtgtcagttgcttctgtaatgccttatgacaccacgatatttccaaatgctgtgttgtaagtgctttacagacaaaccgaggtccagctttctaaaacattgagttcaatgacatcacttcatccattatttaagaaagcgagggtcttcaaatcaggaggatacaattgtatcaccaagtcaggcacacagtttcaaggtgactttgttctgatctgattgttaatgcaatctgtaaagaggcaactatgagttagggattgtttgatgccttgaatgtcgtatattcatattccatcatttttgtgggcacttgtatatacattgatgattaattgtattgttagataattgtgcattttaagatcaaaaaaaaaaaaaaaacaaatcgttacataaacaatgtataaagcacacataacaaataaaggcatgtcttagtagattaaacctatcctaaatgcatctagtagaaacaagagtgatgaactcatcgttatgaggaattgctctagtctggttgagagttcgtggttttgttgaagtccgtagatgttatagtacatatttatttgccaagcagttgcatgattgttgtctaaaaaccctattcattctaacatatgtaggttttttagcggagcatggttttggagacattgctctctttgtcgtctttatcacgtcgatgttagggatagagaagcctgagatcatgcagcaataatgactttcttgtcttaaactaacctgtagtaaattggttgtttcttgtttctttcgaagagaacaacaccctctattatataggata

SEQ ID NO: 6025 - DNA, 568 bp, Zea mays
gccggccgcgccgcggacggatcgaaaacgaattaccctcggtgccctccctctcggcggcggcggcgcaagtccccttcatctccggcgcggcacttgacgtctgacttcaacaccaggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcgtcgtcgtcgaggagtagttcccacgtgtcacctcagaagtttttttttccagttgtttttgaaaactcactctggagagcacgacaaagtgaatgctgtggagatttggcttgaaaataagcataaccatttgagaacaccagcttctgttgaattgtcttttcttgtcatgactatttgagcatgtccgtgtcgtaaccaaacatctgatctactttacaatatgttttatgtgatctttgcgattaactgtgcccaaccaaacggccccta

SEQ ID NO: 6026 - DNA, 558 bp, Zea mays
  misc_feature (557)..(557): n is a, c, g, or t
gcgcggtcggggccccgggacgcggggagacggatcgaaaacgaattaccctcggtgccctccctctcggcggcggcgcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcgtcgtcgtcgaggagtagttcccacgtgtcacctcagaagtttttttttccagttgtttttgaaaactcactctggagagcacgacaaagtgaatgctgtggagatttggcttgaaaataagcataaccatttgagaacaccagcttctgttgaattgtcttttcttgtcatgactatttgagcatgtccgtgtcgtaaccaaacatctgatctactttacaatatgttttatgtgatctttgcgattaactgtgccaaaaaagcggccaaaaaagcggnc

SEQ ID NO: 6027 - DNA, 734 bp, Zea mays
  misc_feature (697)..(697): n is a, c, g, or t
  misc_feature (731)..(731): n is a, c, g, or t
gctcatgcggtcatgcctcttctcttccgtggctctgtggtccgtagtcatagtcagcgccagacgcccacagcccccgaccagcaccggacactcgctcgcgaatagccttggcgggcctttaaaagggcgtccccgcaaatacgggccgggacacggatcgaaaacgaattaccctcggtgccctccctctcggcggcggcggcgcaagtccccttcatctccggcgcggcaaatggcaggcggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcagcgtcgtcgtcgaggagtagttcccacgtgtcacctcagaagtttttttttccagttgtttttgaaaactcactctggagagcacgacaaagtgaatgctgtggagatttggcttgaaaataagcataaccatttgagaacaccagcttctgttgaattgtcttttcttgtcatgactatttgagcatgtccgtgtcgtaaccaaacatctgatctactttacaatatgttttatgtgatctttgcgattaaaaaagaaaaaaaaaaaagcccctagggcccccgggccnaaaaaaaggtttaaaaaaaaaaaaaaaaagcccncta

SEQ ID NO: 6028 - DNA, 2275 bp, Zea mays
ctgaataggcacaattataacgcggctgtatatggcattggttacctgaatagggatggtttgtttgcattactggtgatttagttgttgtattgagggatatccctcctgtaaattgtcctaaaaaccaaacacgaaatcattagacttgtggtggagtattttggagcatgtctgacaaccacttgtattgaagtgaccttacctgttgtttctgtttggagtttttgcgtgcatgctcattggtctttgttgggtgtgtctgtagcatctaagatttgcatgaagtaaaaaaatcagcatggtaaactcacatcttatcaatacattttttgtttagtagatgataagtctatgacagccttgtgcggttctgatattattgttcgtctgatttgacgtatgcttgtttgttagtggatagtttcagctctcgctattgcagatgctaggatgttgatatcattaccttggttctttgttgggtgatagggaaatccgtccgactaatctgctttgcagcattttgtggctttgtttgactatatgatggctatgtttttgggagtgagtgccaggttaggtgaagggtacctggtgtacatttgttttttttggtcgaagaagcaatgattgagagctatgacctggaagtatttcaggtgtcattttctgtttctgccctaatctttaagaaatgtttcgtggtgaatacgggaatttaggatgcaaatgtaagaatagagggagttgactcttttgagtttgatgatgattttctgggagaggttgctgttgagcaatgaacccctctactatttctgaatatcctgtttgctctctgcatatctgtgggcgattctttatagtacgtcattgctgcacaacttggggtccaattttgctatgtaaatatcaccttagcctccccttgtaggtgtgactaatcgtagaatttccggccggccggggaactggcttacctcttcggaaagggaaaacgccaccacacgcggatcgaattaggctctccgagtctccggttccctcctctcggcggcggctcaggtccctctccatctccggcgtggcgcttggcgtctgacctcaacaagcaagaaagcaaatggcaggcggcagggttgcgcatgccaccctcaagggcccgagtgtggtgaaggagatcttcattggactgaccctgggtctgatcgcgggaggcatgtggaagatgcaccactggaacgagcagaggaagactaggtccttctatgacatgcttgacaagggccagatcagcgttgtcgtcgaggagtaaagagttcttcccagttattttcaaagaactctctcgagagcatgacaaagtgattgcttgctgtggagatttgtcctggaaataagcacaaccatttgggaacaccagattttgtcgaattttcctttccttttgatgaatatttgagcacgtccatgtcaataccaaacatctggccttttctctctctattttttttacatatgtttatgtggtcttagcgagtagctgtgctcgactttgcgttatgaggtatgccgtatgtgattggatcacggtgacctaacaggccattctcacacttgtgtttttacatgacttttgagtgggtgatgcacggataatattgacatgttgcgtgcacgctcaggtggtgctctttcacttgatggcgtcgtcggttcggtcaagataagtttttaagggttttcctggttcctttcactgtccttttcgcctgactccatagtctgatgcaagttcaatttcgcttcggtcacatgacaggtgtattaagaaatttcttcattgcttctctttttaaaatacatatacttccttaggtccagaacgagtttggtttagacttttcagctgctccaggttactacttactaaggagatgtttagtttctagaactaatttttagttcctctattttattccattttagtccttaaattgtctaatacgaaaactaaaataaagttttagttttcgtatttgacaatttagaactaaaatggaagaaaatagagggactaaaaattagtccctagaaaccaatacccctaagctttcataactttataacaagtaagtttataaaaaaagggccatcaaataaacacaccatcaggacatttaatgatagatttgattaatttaatgttgtatatgttagtatattattttataatatgattgaaacagagaaaatatgacggtctaggaga

SEQ ID NO: 6029 - DNA, 889 bp, Zea mays
acggatcgaaaacgaattaccctcggtgccctccctctcggcggcggcgcaagtccccttcatctccggcgcggagaactgcactccaatatattatagcagaagggaaggggaaaagaaccccggatacaaggcacccttacagaagggaagggaggccacacagaagcatacataaaacaatccataaggaaaggataagccacacacaccctatgaagatctgaatctgaccctaagaagtggagagcggggcagccaggaaggataatcccttggcaccagccacttgccacttctccctctcctcatgtgcagtctgtaggagaagagagaggttaggagccactccatcaaaaaaccactctatttctatgggtccagatcaaccacgctccaagagagagaggaggcaaatggcaggtggcagggttgcacatgctaccctcaagggccccagcgtggtgaaggagatcttcattggactgaccctgggtctgatcgctggaggtatgtggaagatgcaccactggaacgagcagaggaaaactagatccttctacgacatgcttgacaagggccagatcagcgtcgtcgtcgaggagtagttcccacgtgtcacctcagaagttttttttttccagttgtttttgaaaactcactctggagagcacgacaaagtgaatgctgtggagatttggcttgaaaataagcataaccatttgagaacaccagcttctgttgaattgtcttttcttgtcatgactatttgagcatgtccgtgtcgtaaccaaacatctgatctactttacaatatgttttatgtgatctttgcgattaactgtgctcgaaaaaatgttgtgatttatgtgattggatcacggttaca

SEQ ID NO: 6030 - DNA, 1563 bp, Zea mays
aatgcagaccgtcgaccctcttaccaacggccgtcaattcagcaccgctggtccgccttccccatccccatcccccgccaccggcggcggccgttattcagcaccgccttcctccggcgaccgccgcgccgccgttccctggtctaggttctcgcctcttagcaaccagagcgcgcgcctaaatgaatgcggtggcggaggaggacagggcggcggagctggccggcccgctccgggacctcctcccgcctgtggacttctgctgcgcgtacggctccacgctccttcacgcacgccccgacgggacgtccatggtcgattacatcatcggcgtcgctgaccccctccagtggcactccgagaacctggaaaggaaccccgcgcactactcccgctggatggccggcttcggtgcaggcgccatcactggactggcggatcatgttggggtcggggtgtacttcaacccatttgtggaatggagagacaaggtaccatgaatcgtggtgccttgtgttcgatggcattgtgttccactggctgtgcgtgaattgagtacttgatgaagaaatctgtcttttggccgcagaggataaaatatggggtggtaaggatgagggacctggcaatggatgtcttgacctgggacaggttctacctcagtggtcggctgcagaaaccggtccatgttcttgttgacaactgggatataaggaaggtcaactcaattaacctagaaatggcaacttcagcttctctactccttttaccagcggagttcacggagtacgacctatatgctcaaatctgcagtctatcatatatgggtgatttgagaatgctgtttgcggaagacaaagataaggtgaagaagattgttgagggtagttttcagtcgttccaattgatgtacagccccctcttgcaagagtatattgctgaaggcctattgaagacatcatcccatggacaatataaaactttccggcaggattgcggtccatctacaacaaatgaactgttctctgttcttccgtggacgatccaaagccaaatgcaaggaaggcacacattgcacggaaaagaagtaccaccacgcaccgtagtttcttccaaggagatggcagcaaactgtgtccggagggccctgaggcaccgagtaatggtttcaagcgtgcggcaagcagtgtgtggtctgctcgcctctggcggtgcagttgctgctcaatacctcgggaagaagatggcgaaggcttggcgatctagagtggcttaagccaatgctgccccccaccccacacacccacacccaatggtgtacgctaggcttttgccagttctgggtttcatgcagtgtatggcaatcagtatcgtatgtttttcaccgctgaaagcctgataccggctgaaattttgtaggaccagaaacgtcaatgcttcagaatcaacaccacgcatatattagttataggcaaattcgtcttcactcagagcctagtttggaaattcaaaccatctttaaaattgaaggagatttgagcttccaaaaaaaaaaaaaaaaaa

SEQ ID NO: 6031 - DNA, 845 bp, Zea mays
caagaaatatcgtcatccatggtttcacagtcgtttggtgcatcagatatggcattcaattcaattgactctggtatgaatgatggtggtttcgtgaacagccccgcggcccccccggctcctcccttaaagaggatgaggacatttaccaaggtgtacaaacgtggagctgtaggtcggtccattgacattagtcagttcagtggatacgatgagttgaagcatgctctggctcgcatgtttagtatggaggggcaacttgaggaacggcagagaataggctggaaacttgtctacaaggatcatgaggatgacatcctacttcttggtgatgacccttgggaggaatttgtcaactgtgtgaagtgcattaggatcctgtcgcctcaggaagtgcagcagattagcttggatggggatctggggaacaacattctccccaaccaggcctgcagcagctccgacggcggcaatgcctggagagctcgctgcgatcagaactccggtaacccatctactggttcatatgaccagtttgaatgacctaacttgccggtccatacatgccggatcacaagtaggcgtctcgtgaggggatggcaggtgcagaatgtttgtagatgtgtcgccagatttacgtccgggagagcgaatcgctcgatggattggtagtgtttttgttcatatgtgtaggttttctcacatggaaggaatgtagtatagaggatgggagatgaagattaccgtaggtgaaagatgatgttgtaccatgaggggggaaaacatgcttgtagtagtaaagactgctgcttcagtccacgtatctaaaaagttcttctctgacc

SEQ ID NO: 6032 - DNA, 1484 bp, Zea mays
cctcgaggccggccgggggattatctgacctatagaaagataagcaagctctgcagcgattgacagaagcagctgagaaggcaaagatggaactgtcatctttgacccaaacaaacatgagcttgccttttattacagctactgcagatggtcccaagcatattgagactactcttaccagggctaaatttgaagagctatgctcagatctccttgacaggctgaggacccctgtggacaatgcccttagagatgcaaagttgcaattcaaagatattgatgaggttattcttgttggtggctcaactagaataccagctgttcaggagcttgtcaagaaaatgacaggaaaggaccccaatgtgacagtcaaccctgatgaggttgttgcacttggagcagctgtgcaggctggagttctgtctggcgatgttagcgacattgtacttcttgatgtgacccccttgtccctagggttggagacactgggtggtgtcatgaccaagattatcccacggaatacaaccttgcctacctcaaagtcggaagttttctcaacagcagctgatggccagactagtgtggagatcaatgttctccaaggagaaagagagtttgtgagagacaacaagtctattggtagcttccggcttgatggaatccctcctcccccacgtggtgttccccagatcgaagtcaagtttgatattgatgctaacggtatcctctctgtcagtgctgtggacaagggtacagggaagaagcaggatatcacaattactggtgctagcactctgccaaaggacgaggtggagaggatggttggcgaagctgagaagtttgcaaaggaggacaaggagaagcgagacgccattgacaccaagaaccaagccgagtcggtcatctaccagaccgagaagcaactgaaggaacttggggacaaggtcccaggtgacgtcaaggggaaagtcgagtcgaagctgcaagagctcaaggatgctgttgctagtggctcgacgcagacaatgaaggacgccataagtgcgttgaaccaggaagtcatgcagatcgggcaggccctctacagccagcagggtgccccaggcgctggacctggtgcagctgatgcttcttctgctggttcagcgggcacttctgagaagccaggtgacggaggcgatgtgattgacgcagattttactgacagcaaatgagggggcatgctaggtttagatggaggcggtttgccgggggagctgttttgccgcgagggggataatttgtttccacaagattgtgtaggatgtggatgttctactttttggtagattggcacctaactgtggaatgaatatacataggtctttttcttctgctatcaagagcattcgacgtttgacctggcattgtttctgggttaatctacatcttccataaaaaaaaaagttgccagaaaaaaaaaaaggggggccccccgttttttg

SEQ ID NO: 6033 - DNA, 1141 bp, Zea mays
gggtacctcggggcccctcgggccggcgggaacctcacgccatctcccagcctgaacagcccccaaaaccaaacgaaaatcccatcgcccacacactccaatccacccttgttcattcctctcccttcctatttggtcagtcgacctctcaccgcaccgccgtcggcccatggcgaccacgaccttccccacctcgaccccattcttcgcggcccaccacggtccccgccggagccgaccctccatctccgccgcggtctacgcccggggccgccggtggcgcccgctgcgggtggcgtgcgagaaggtggtaggcatcgacctgggcaccaccaactccgcggtggccgctatggagggcggcaagcccacgattgttaccaacgcagagggggcgcggaccacgccctcggtggtggcgtacaccaagtccggcgaccgcctcgttggccagatcgccaagcgccaggccgtggtcaacccggagaacaccttcttctccgtcaagcgcttcatcggccgcaagatgaacgaggtcgacgaggagtccaagcaggtctcgtatctcgtcatcagggacgacaacggcaacgtcaagctcgattgcccggccattggcaagcagttcgcagctgaggagatctccgcacaggtgctgagaaagctggtggatgatgcatcaaagtttttgaatgacaaggtcacaaaggcagtgatcacagtccctgcttacttcaatgattcacaaaggacagcgaccaaagatgctggccgcattgctgggctggaggttctgcgtattataaatgagcctactgctgcatcactagcatatggttttgagaaaaagaacaatgaaacaattctgggttttgacctcggaggtggcaccttcgatgtttcaggtatctgtcctgtttggtgtttctgtgaatacatactcgtgattttcggtgcaatgcttacccctataggaggtttaacagatactctaaccttttgtctggaaagatttgggttacaatcttttttggcacctatagttgtaatgtgtctgagatcatggttctaaaactatcttgactgcaagttaatgcaggatatcctgcttttgtctagtgaatgatttacacatgacttg

SEQ ID NO: 6034 - DNA, 978 bp, Zea mays
ctcgaagccggccgccccccggccccaggctccagccacagctttcacgcggcatcccgccagtgagcagtgagctctataaaatccacctcctttcccttggcccgtcctcaacctctagccacttcccagggttaaccgcaaaagccaaaatccggtcgcccgctcactccaatccacgttcttcattcctctccctccatagggttttgtgaactctcctgtttgggcaccaccgtcggcccatggcgaccacgaccttccccacctcgaccccattctttgcggcccatcacggcccccgccggagccgaccctccatctccgccgcggtctacagccgcagccgccggtggcgcccgctgcgggtggcgtgcgagaaggtggtaggcatcgacctggggaccacaaattccgcggtggcagctatggagggcggcaagcccacgatcgttaccaacgccgagggggcgcggaccacgccctcggtggtggcgtacaccaagtccggcgaccgcctcgttggccagatcgccaagcgccaggccgtcgtcaacccggagaacaccttcttctccgtgaagcgcttcatcggccgcaagatgaacgaggtagacgaggagtccaagcaggtctcgtatcgcgtcatcagggatgacaacggcaacgtcaagctcgattgcccggcgattggcaagcagttcgcagctgaggagatttccgcacaggtgctgagaaagctggtggatgatgcatcaaagtttttgaatgataaagtcacaaaggcagtgatcacagtccctgcttacttcaacgattcacaaaggacagcaaccaaagatgctggccgcattgctgggctggaggttctgcgtattataaatgagcccaccgcagcaatcactaagcatatggttttgagagaaaagacaatgaaacaattctggtttttgacctcggaagtggcacatttgacgt

SEQ ID NO: 6035 - DNA, 990 bp, Zea mays
gcgtagctcggaattcggctcgagctcgagccgcttggtttggtgacactgggtggtgggatgaccaagattattccacggaatacaaccttgcctacctcaaagtcggaagttttctcaacagctgctgatggccagactagtgtggagatcaatgttctccaaggagaaagggagttcgtgagagacaacaagtctcttggtagcttccggcttgatggaatccctcctgccccacgtggtgttccgcagatcgaagtcaagtttgatattgatgctaacggtatcctttctgtcactgctgtggacaagggtacagggaagaagcaggatattacaattactggtgccagcactctgccaaaggacgaggtggagaggatggtcgacgaagctgagaagtttgcaaaggaggataaggagaagagagatgccattgacaccaagaaccaagccgagtcggtcatctaccagaccgagaaacaactgaaggaactaggggacaaggtcccgggcgacgtcaaggggaaggtcgagtcgaagctgcaagagctcaaggatgctgttgctggtggctccacacagacgatgaaggacgccattagtgcattgaaccaggaagtcatgcagattgggcagtccctctacagccagcagggtgccccaggcgccggacctggtccagctgatgcttctgctggttcagcggcgggcacttctgagaagccaggtgacgatggcgatgtaatagacgcagatttcactgacagcaaatgagtggcatgctaggtttagatgaggctgttcgctggggatgttttgccgcgagggagagatttgttttgtaggatgtgggtgtactttttggtagatttgcacctttgttcccatttggagttcggatgaaggtgagttcgggaaaggtcgggttttaactgtcaaatgaatgtacataggcctatttttctttaaaaaaaaaaaaaaaaaagg

SEQ ID NO: 6036 - DNA, 1796 bp, Zea mays
cattgggtccctcgaggccggccgggtttttgattgacaaggtcacaaaggcagtgatcacagtccctgcttacttcaatgattcacaaaggacagcgaccaaagatgctggccgcattgctgggctggaggttctgcgtattataaatgagcctaccgctgcatcactagcatatggttttgagaaaaagaacaatgaaacaattctggtttttgacctcggaggtggcacctttgatgtttcagttcttgaagtcggtgatggtgttttcgaggtgctgtctacatcaggtgacactcaccttggtggtgatgactttgacaagagaattgtagattggctcgctgggaacttcaagaatgatgagggtattgatttgctaaaagataagcaagctctgcagcgattgacagaagcagctgagaaggcaaagatggaactgtcatctttgacccaaacaaacatgagcttgccttttattacagctactgcagatggtcccaagcatattgagactactcttaccagggctaaatttgaagagctatgctcagatctccttgacaggctgaggacccctgtggacaatgcccttagagatgcaaagttgcaattcaaagatattgatgaggttattcttgttggtggctcaactagaataccagctgttcaggagcttgtcaagaaaatgacaggaaaggaccccaatgtgacagtcaaccctgatgaggttgttgcacttggagcagctgtgcaggctggagttctgtctggtgatgttagcgacattgtacttcttgatgtgacccccttgtccctaggtttggagacactgggtggtgtcatgaccaagattatcccacggaatacaaccttgcctacctcaaagtcggaagttttctcaacagcagctgatggccagactagtgtggagatcaatgttctccaaggagaaagagagtttgtgagagacaacaagtctattggtagcttccggcttgatggaatccctcctgccccacgtggtgttccacagatcgaagtcaagtttgatattgatgctaacggtatcctctctgtcagtgctgtggacaagggtacagggaagaagcaggatatcacaattactggtgctagcactctgccaaaggacgaggtggagaggatggttggcgaagctgagaagtttgcaaaggaggacaaggagaagcgagacgccattgacaccaagaaccaagccgagtcggtcatctaccagaccgagaagcaactgaaggaactaggggacaaggtcccaggtgacgtcaaggggaaagtcgagtcgaagctgcaagagctcaaggatgctgttgctggtggctccacgcagacgatgaaggacgccatgagtgcgttgaaccaggaagtcatgcagatcgggcaggccctctacagccagcagggtgccccaggcgcaggacctggtgcagctgatgcttcttctgctggttcagcgggcacttctgagaagccaggtgacggaggcgatgtgattgacgcagattttactgacagcaaatgagggggcatgctaggtattagatggaggcggttttgccgcgagggagataatttgtttccacaagattgtctaggatgtggatgttctactttttggtagattggcacctaactgtggaatgaatatacataggtccttttcttctgctatcaagagcattcgacgtttgacctggctccgctttgggttaaaaaaaaaaactaaaaagagaataagtaaataaaaaaaaaaaaa

SEQ ID NO: 6037 - DNA, 1821 bp, Zea mays
acttcagacttcactctacaatactcgtgcgcgcaccacggacaaaaaccaaccaccgtgcgccagccgccacgccagcgcctgccatggctcctctcctcctcctcctccccctccccctccgacccatccccgccgagaactccatttcccggctcgcaccgaggccaaggttccctcgtcccttctccaggcggcgcctacgccttcccgccctcctccaagtccaatgcctcgcggccaccggccccgccgcgcccgcgccgcggtggcacgcggcactgtccgccgcggcggggctgtacccggcctacgtcgcagccggcgcctccgtggccttcacgcggcccgaggcgttccggtggttcgtggcgctggcgccggggtcctacaccgctacgctcggctttatcatgctcgccatgggcctcacgctccagctcagtgacttcgccgccctcctccgcgacaggcccctcgccattttgttcgggtgtgccgcccagtacaccataatgcctgcgtttggcgctatcattagccacgcgctggggcttcccccgtcgctctcagctggcctcatcctgctgggatgctgtcctggaggaactgcatccaatgtggtgactttagttgctcaaggcgacgttccattatccgtcgtgatgactgtctgcagcactcttgctgcagtgttccttactcctctgttaacgaaaattcttgctggtgcttatattcctgtggatgccgttaagctctctctcagtactttgcaggtggttgttgccccaattctattaggttcattgatacaaactgcattcccatcagtagctcaatttctgagtccttttgcacctctgatggcagtcttggcttcatcacttctagcatccagtgtcttctctgagaactttgtgcgcctaagatcgacaattgccgatgcatcccctgtgaatggaatgttctttggggatgtagggactgtcatcttctctgtcttcttgctgcattttgctggtttctttgtcgggtatgcagcagcagctataggtggtttcaaagaaaagcaaaggagagcaatatcgatcgaggtaggaatgcagaactcgtccctaggggtagttttagcaaccgcgcatttctcctcgcccttggtcgcgctgcctcctgcagtctcggccgtcgtcatgaacatgatgggtagcacactgggtctcgtatggcaatataccagcacttccgtgtcagagaacgaaaccagtgcgtgatctactcttactgtcgccatgtgcttaatctaatgtgtcgtatctaccaccaccaccactactactacccgaatatacctttcgagtacttttgatcatgttggggaacggggtcgctgatgatgaccctggaatggaaaaaatcttgctgtcttaattactggaggacccagcttacctgtctgaattatgtgggtggtgaatgcccaggctacatatgggtcccttttttcagcactgcaaatagagggaaaacccattttgcatgtgacctggtacattacaatgctgtgctgtgcctgcaaacaaagccccgcgcccactgcttccacctgtatgtgcgtgctcgtgcaatggcatcaggcaaaggtcgcaaggccaagtgccatttgcacccatgcgctcttgtggcagtagtgctaccgactaatgatgatgaccagagctcgcgactgccccacagagagaggtttgccgaaccgcttgatgagattcattcacggaaccacgaggagcaggcaggcagggaaaagcagatctcgccaca

SEQ ID NO: 6038 - DNA, 760 bp, Zea mays
tcgcctcgaggccggccgggagagattcagagctgatgaactgcttctggtgtcctgtacatctcaagatgaaaaaaagcaccaccgtcctcgccatctccatcttggtcctctcccttgcctcccagttctcatggtgtgcagaagcagctgagggaagcgccggaatttccacagagcctgatctccaggtgcaagaacaagtgcacggcgatatgaaaaaccgcctggaaatgcagggtcgcaaccggaagcttggccatgaggtgaccacagtggagttgaagcatcacaggaggattaccagtgggcacaagggtggcagcgcgggtggaggcgccggcgccggtgccgcgggcgcaggcacgggtgggcataacgtgggcggcgggggcgccgtgacgaggccgcacagctccaagaacggcgcggcggcgctcccagtgccggtgtcgtccgtcctgacgctggccttggcctgcggagttgttctgtcagtcatgagctactgatgagatgaaactctcgtcttcccggagccgatcggtatctccgagccgattttacgggtattggtgcgatagtttctcgatttgttcgttgtaacttgtatatcatatcatcatgcagtggtgaaaaccggacggatgctgacggatgtagctgtcattatatatctatcgtaatgtatttctcgcgaatacggaatcaatacagttatttaaaattggaacaaaaaaaaaaaaaaaaagcggccctc

SEQ ID NO: 6039 - DNA, 1496 bp, Zea mays
gcacgagaccattacctagaacatcctaatcgaaaagaatccctaaaccttatgcaatgcaacaacattcccagccgccgccgccgccgcccggccgtctcgtcccctctcgtcgccttctcagccaagctaaaacctcgctctccttgtccagtcagattctcctccgcaatccgccattgcgctccgttatgcaggcgttcgcgcgcctctcctccgctgcctccaggaaagtgatcgcgggtgtctctagcgcaaccacacggtcgtgctaccggacctcccgggggttggcgcatgcggcgtcgctgcctgcgcaggagcctccaccgaaggggcagaagaggattacgaagcaggagaggaggattaggataatggaatttattgagaattatagggcttcaaatgatggcaagtttcctactattaaaaatatccgtcagcaagtggggggcagtcactacacagcgcgtgagataattcaagaaatggagtataataatgcaaaattaccactgagcaatgccaaggcagctccacttcaaggaacagttgaagtcattgagcactccatgcctaaggatgaagccagagtggttgaaagtcatggaatactagaagtttctgagcactccatgaccaaggatggtgctgaagcggctcaaattcaaggaacaattgaagtttctgagcactccttccctaaggatgaatgtaaggtggctcagtgtcaaggaccatttcgatttcctgagcactcaaggcctaaggacgacagtggaaatgttgctaaacatgatatggacactccagaaacctgtaagactgcagacttccccgctttatctgatcaaacagagagcgagataatggaggacctaacggacaaaccagaccctggaaaccagcaaagggaaatagaagctatcaaatttaatttgaagcattatgaaaaacccttgaatgcaaatgattcaaatgcaaagacgcatgccagagaagacaacccaaagcttgaggaatccgcgaacacaggacttttgggcagcctgaaatcttttgcttatggcatcagaaacttctggaaaaatctgtaaatgtctttctttttggccgtcgcctagcacgcttggtcctcgtggcttcatcaatttctaaagctatggtcactagaccgtgcatatgacggtgcatcacactattttacgctgcaaactatacggtttgcagagtggagtttgaaaatggaggcgagatgagtaaagtatctggagatagcctaatcggactaaaattgagaaggctacagaattgataacttgtccctttgttaagtgtttgcgatacagggccaatttgtaaagttctttttatgcgatacaactaatgtcaacttctcgctgtggcactttgataaagctagatacaaggattattgttactgccctgttgtgctggtggtaactttgtgtttgtcaaaaaaaaaaaaaaaa

SEQ ID NO: 6040 - DNA, 1407 bp, Zea mays
ttaactcccggcccccgccgcccgccgggtccgtctcccttcttcgccttctcagtcaagctaaaacctcgctcgcctcgtccagtcagacatggcatgaaaccctagggcgcccgcctcccctccgcaatttgccattgcgctccgcgatgcaggcatccgcgcgcctctcctactccgtggcctccaggaaagtgatcgcgggtgtctctatcgcgtccccacggtcgtgctatcggacctcccgggggaaggcgcatgcggcgccgctgcctgcgcaggagccgccaccgaaggggcagaagaggattacaaagcaggagcggagggttcgaatagtggaatttgttgagaattatagggcttcaaacgaaggcaagtttcctactgtaaaaaatatctgtcagcaaattggaggtggttactatgcagtgcgtgagttacttcaagaaatgaaatataatcatgcaaaattaccactgggtaatgctaaggcagctccacttcaaacaacagttgaagtcactgaacaccccatgcctaaggatgaagctagagtggttgaaagtcaaggaatactagaagtttctgagcactccatgcccaaggatgatgctgaagtggctcaacctcaaggaacagctgaagtttttgagcacttcttatctaaagatgaaggtaaggtggctcagtgtcaaggaacgtttcactttcctgagcactcaagacctaaggatgacagtggaaagactgctcgacatgatatggacacttcagaaacctgtaagactgcagatgccccagctttatctgatctaacagagaatgagggaattttatctgacccaacagagagtgaggacaaaccagatccctggaaatcagcaaagagaaatagaaagctaacatatttgatttgaagaatttcgaaaaaaatccgaaggcaaatgatttaaacgcatcagatcaaagtggaagtgatatggtgaaggaggcaaagacacatgccaggggagacaacccaaagcttgaggaatccgcgaacacgggtcttttgggcagcctgagatcttttgcttatggcatcagaaacttctggaaaaatatgtaaatctgttgttttttttttgccgtgagtcacctaaaattgaaaaggctacagaatcgagaacttgcctctttgtcacgggcttttggttgcataggatcggagaggagagggcttttggttggagaggattgatggtttgtttgggagcaaggggagagcctctccaattcacttgctcccaaacaaaacaagccatgagacataatcccttgctattactagctattactagtaagagattatgtctctaaattcccttcaatccttatgcaataaaagccccaagcgtttgtgat

SEQ ID NO: 6041 - DNA, 610 bp, Zea mays
ccggccgggagccgccgccgcccggcagttccgtctcccttcttcgccttctcagtcaagctaaaacctcgctcgcctcgtccagtcagacatggcatgaaaccctagggcgcccgcctcccctccgcaatttgccattgcgctccgcgatgcaggcatccgcgcgcctctcctactccgtggcctccaggaaagtgatcgcgggtgtctctatcgcgtccccacggtcgtgctatcggacctcccgggggaaggcgcatgcggcgccgctgcctgcgcaggagccgccaccgaaggggcagaagaggattacaaagcaggagcggagggttcgaatagtggaatttgttgagaagtaggttacttttttttcactgtattttctggttgtagagtttatctttttgggtcataggtagcaattgtgtagctttcggcttattagcacttctgtttggctctcgagcttagtaatagacacttagtgtgcgtttggttgggctgtgaactatgaaaacatagctgtgagttgtctgctgtgaaaaaactgttgtgagcaaataaagctgaaactcgtttggttcaaaaaaaaaaaaaaaaaagcccccta

SEQ ID NO: 6042 - DNA, 2866 bp, Zea mays
  misc_feature (2740)..(2740): n is a, c, g, or t
cacgaaataaggcacccaaccaccttcccctccgccccaatcgcttgctcccgcacggccgcaccgccgccgacctcgccgccggcaatggcgtggctcgcgcgctccatcgccaactccctcatcgctactgaggaagaacccgaagcaaccgaccggggcccctcggcctccccgggctcgtcctctcccccgcgcggcgtccgcgaggacctctccgagctaaccggcgcgctcgcgaaccgcttccagggcatcgcctccttcctcgcgcccgcggcgcctgggggcggaggcgccctgcgccggccggacccggccgagatcgcgggccggttccgcgccggcctcgcgcggctcccgggccgccaggccgtagcggatctcgccaggatcgcgtcctcgctcctgccccctgagggcgatgcagactgggcggaggaggcagcgggggtcaccgaagaggtggtcgcgttcgcgcgggacgcggcatcgcggcccgagctatggctcgacttccccctcctccccgacgacgcggactcggatgattttgacatgactgatgcgcagcaagatcacgccctggccgtggaaagcttggcgcccgagctggctgatctgaggatcgagctctgccccagccacatgagcgaggactgcttctggaagatatacttcgtactgctgcatcctaagctcaggaaggatgatgccgacattttatccactccacagattctggaagctagggacaagttgtcgcaggaggtgcggtaccggacggagttacaaggcagccacggcgacaccgtacctgtggctctcggcgatgaaggtggcgtttcaggttctcttgtagagggtttgggcgtattgaagggccaagacgactccgccatgctcacgtctttcagcaacacggactacggcaagccacaaccgatcgaacaggacaaggatattgtatcggttcatacgatcggcgagactggagctgtttcttcggataataccggtagcagcggtgtacctgtacagctagtgcccgtgtcgagagacaccaccaccgtggcgccactatctaggacggaagaaagtacgcacgatctctctacggaagacgaagcagcagcagaagaagaagaggagcagggtctgcagatgtctgagatacctttgacggacagctctccccctaaagatggtcaacagaaacaaccactggctgccatcagtgagcgatcaggagctgactatcagaaaagtgataatgttgaggatggcggcgacggcgtcgaagatgacgacggggatgaatggttggaagaggaagcatgggacccgggaaacacgcaaattccgatagcagatgatgaagacgtgtctttcagtgatctggaggaagaagacgatggtgcggcctgacatcgcctgtaggcttggcttgaccgtactgcttacgtagtctgtgcttcctgttccgttatacgattggtacaattgtcttggttgatgtctaatacacgctctcatagtctcattgcttcctgttccgaaaaaaaaaaaaaaaggcatgcatgctttgctagctgcccccagctagcagacaactaccagctcactagtcgatcgataagaaactaaacagcgaagcccgcagctagcaaagttcgctcaccagctgcactgcaagctcgtacacatacacaattaataataatcaaccgaaaccagctagtagagttcaaagaaaagctcacataataatacacacacgcacaaaacacgtacgacgacagaaccacacgcaatgcagacgacgaagccggccgacgactggggcgtggggcatgcatcgatcgatctgaggaggtgcgctagccggcctagctgtggcctcctccctggccctgggtgtagatgtagtcggtgtgcgccgccagcgtcctcctcatgaggcactcctcgtcctctcctcctcctcctaccccttcgctgccgcaccgctcgtcgtcgcccgccgcgaagctcatgctcatcgacgacctctcctcggcgcctaccttactcacatctctttgctgctcctcttggcttctcgtcgagctcgccgccgccacagctctcgtcgcgtggccggcgacgacggagaggaggaggaggaggaggaggacagcagacaccagcaccagcagcagcggcagggcggtccgccgtggtgccgatgttggtggcgccgccatgtctgcaagactgcaaccaacctgcactgcaggcttgttgctgttcctttggcgtcagcggcgtggcggatatctgacgacccggccggccgcggcgctccctggatttatgtgaagcgttgttggtttggagttggggtgcccaggtagaacgggccttaaatacacccatcacccatgccgatcgaccgcatacatcacatgtacgtagatagcatgtgaacctatactaacgcttctctttcatatgacgcaggctaaagagactaattttttgttcctttattttattttatcctctaaattgtcaaatataaaacatttgttaatttagagactagaatataataaaacagaaagactaaaaattagtctctaaaaactaaataccacttagttattgttctatagcaacgacatatctgaaaggaaaataggcttacacctttttctaattgattttggtggtttaattatccaacacaaataattgnactaactagtttgctctaaattatatgttctacaggtgccaaaggttcatctacaactatactaaatcgactgtccggaataccgtagattattccggacaggagaagcttttggaaaatcaggcc

SEQ ID NO: 6043 - DNA, 1299 bp, Zea mays
ccacgcgtccggaccgatattcctgacacaggaaaaacttctgattatgaggagctgatgaatacccttaatactagtcaagctgaaagagatgagctgatcaaatgcccaaatccctgtggtggggaagggtctgaactgactccgatggaggaccatgatgtgaaggagagtgacgatggtggtgagggagagaatctcccccctggttcatatgtaatcttgcaactggaaaaggaggagattttagcaccacatactcatttctgcttgatctgtggtaagggtttcaaaagagatgctaacctaaggatgcacatgaggggccatggagatgagtacaagactccagctgctcttgccaaacccacaaaagattatggtgcagatcatgcaccggttacaaggtactcatgcccatttgtgggttgcaaacggaacaaggagcacaggaagttccagcctctcaaaacaatcttgtgtgtgaagaaccattacaagagaagccactgtgacaagagctacacctgcagccgttgcaacaccaagaagttctctgtcatcgcggacttgaagactcatgagaagcactgtggtcgtgacaagtggctctgttcttgcggaacgaccttctccaggaaggacaagctttttggacatgttgcgcttttccaaggccacacacctgcgctccccgtggaagacggggatgtatcagaagcatcagagcaacctcaggacagtgagccgatgaatgaaatggcgaggagcaatgtgtatagcttcccctgtagttcgtctgatggtatatcgaacctcgacatgaaaatggctgatgatgtgcgtggttatttctcgccgctgaactttgatccttgctttggcgcgctcgacgatttcactcgccctgggtttgacatctctgagaaccccttctcattcctgccttcaggatcttgcagttatgggcagcagaacggagatagctgatggatgccgccatcgatgatgacgacaacagcactgccaacctttatttatgttgttgcatgatgctagcttggttcttcctctgttcaagagccatttgagattatgcctttatattttccctaaatgtacttacgtttgtggtcattaataatgatcaaggacttctagcatttcttagacccagatagccccaattttcagtatacatacgcaagtattgcttgttcattttgtctgaatcggcgtgatgcttgtagcactgacaatttatcataacaagctgctcagctattaatctggttctcc

SEQ ID NO: 6044 - DNA, 967 bp, Zea mays
  misc_feature (9)..(9): n is a, c, g, or t
  misc_feature (11)..(11): n is a, c, g, or t
  misc_feature (24)..(24): n is a, c, g, or t
  misc_feature (959)..(959): n is a, c, g, or t
ggtaccctncngggctggccgggnacgaggtgggagcagacaggaaggctcggggctccggcctcccccaacccattcggacccgcgaggctggccggcattttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggcaagcagcatggcaaggaatgctgaccctaaccaacagactctccgccccaatttagtggagcagttctattttccaagacctggtcaatctttgccaggcattcctccattttttgggcctccctctagtttgtatcttcctaatgacaatgaagctaaatttggcaacaactttgaatcaaatccttcacagaatacagattggaacccacaggcaatagtgagcaacctaaccttccttgagcagaagatcaagcaggtaaaggatattgtgcagtccatgagtaaccgagagaaccaagtagctggtggttcctgtgaggtagctgcaaagcagcagctcataaccgctgacctcactagcattataatccagctcatatctactgcgggttcgctgctcccttcaatgaagaacccacttcttagcagcaatccagcagtcaggcagcttggcaacactcttggttctcctacgggctttggcatgaatgctaatcagcgaccaagcgtagacagcaagaccgatattcctgacacaggaaaaacttctgattatgaggagctgatgaatacccttaatactagtcaagctgaaagagatgagctgatcaatgccccaatccctggggggggggggagggtctgaactgactccgatggnagacatga

SEQ ID NO: 6045 - DNA, 994 bp, Zea mays
ccggcgcacccctcctctcttttcttatctgtgcttcccgtgcggcgctggagaactgacgctgatggcgaggctgacctcatggacccacaccaaacgggatagtagaagcagctggagcacgtcacggcgccgcgctgggttggtgggggcgcaccgcagtccgcaccggacctcgagaggggaggagaggagatgggaggggtcaacgaggtgggagcagacaggaaggctcggggctccttcctcctataaacccaccgcacctgccttagaggctcccattttctcggccgggagccgcaattccatcctgctgctagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggcaagcagcatggcaaggaatgctgaccctaaccaacagactctccgccccaatttagtggagcagttctattttccaagacctggtcaatctttgccaggcattcctccattttttgggcctccctctagtttgtatcttcctaatgacaatgaagctaaatttggcaacaactttgaatcaaatccttcacagaatacagattggaacccacaggcaatagtgagcaacctaaccttccttgagcagaagatcaagcaggtaaaggatattgtgcagtccatgagtaaccgagagaaccaagtagctggtggttcctgtgaggtagctgcaaagcagcagctcataaccgctgacctcactagcattataatccagctcatatctactgcgggttcgctgctcccttcaatgaagaacccacttcttagcagcaatccagcagtcaggcagcttgggcaacactcttgggtctcctacgggctttggcatgaatgctaaacagcgaccaagcgta

SEQ ID NO: 6046 - DNA, 5092 bp, Zea mays
  misc_feature (748)..(748): n is a, c, g, or t
  misc_feature (1994)..(1994): n is a, c, g, or t
  misc_feature (2234)..(2234): n is a, c, g, or t
  misc_feature (4089)..(4089): n is a, c, g, or t
  misc_feature (4575)..(4575): n is a, c, g, or t
cttctgacctcatggacccacaccaaacgggatagtagaagcagctggagcatgtcacggcgccgcgctgggttggtgggggcgcaccgcagtccgcaccggacctcgagaggggaggagaggagatgggaggggtcaacgaggtgggagcagacaggaaggctcggggctccttcctcctataaacccaccgcacctgccttagaggctcccattttctcggccgggagccgcaattccatcctgctgctaggtaagtccacttccgaattgtttatctacgaacttctcttcctgtttccgtaattccgtcacgctggattcaaacaagaacatgtattcaagcaccggcgacggtaatttgggttctgtattgcttgtcctccctgtgatgatttcctctactgttgcctgctttgtctgatctgggcccagggcatctgataaagataaacgataaaatatctccttttttttggcggaatagcatcttgaggtatggggaaaggacgatgcatgacagcgtgaggatttgatatctcgtgatctggaatctctgttctttgtgttgggttgatctgcttcctgttcttgaaattcatagtggggacaaacaagggaagttgtttactgaacctttatttgattattaggagatttgggatctttgatttgatctcattagggtcttttgattgaactgaacagtcataatcctctcacgactcaactctttgatcgacctttngggttgcgtgtcttgaagttttcatccatccttctgtttgcctcaactaggtaccatgctcctttatttactaaatattgctgaggtctggccttttgggatgtgcttcccttctggccatagatatgtcagtattcagattagattatcttattagtgaagaagatctatgagaagttacctatcagtaaagaagaagaaaagttctttcctgaaaaggcaggagctccagcgctccgcggctccgccactggtttaagggcctgattgaatgcactagagctaaaagttagctagctaaaaaaaactctagggaaattagctggctaaatattagctaattttacctaggttgaaccagctaatggactaatgggtagttgaggtgcaatgcagttaatcgttagctgcactatagctgagggtgttttttagcagctaactattagctctattgaattcaaacagggcctaagactatcgttattatccggacaagtaagcttggctagctggtgaacctactatcgtttgtcatgactctaggaatgtgcctagtagcagcagcatatgaagaaaaggggagaagtgatagttgtaatcagaaaattcgtgtaccagtagatctaggccaatatagcctaagaaggttctagcagctagatgattagccggttaatagctgactatataaacttgtaaccgattggagaaggttgtggagaaaataacagaaatcataatccacccaaacctgtgtacggacctgggattcgtcctgggaaaacttaccttggcgcgtcggagtccctgacctcggcgtcttcaccgtcgacggaacggcctcatgcctcggcgactcgccggcggccaggggatctgacatcgttttaacttcccacttggttcctgaaaaattatataccttccctatttgatatgagaagggccatttgagtcatagcttccttccatctttgtctatgacatgttgaatctaacgttctgcggcttataatctctgaatctctctgttgcagagttacatactcacccaatagaacaattctatgcccggtgattgtacctcctgaagtagaagagcatactgaagcagaactcgagtggtgttggatcgaaatggaaggcgggatgtcaagtttggaagccgccatgaaagcttcttcatcgatggcaagcagcatggcaaggaatgctgaccctaaccaacagactctccgccccnatttagtggagcagttctattttccaagacctggtcaatctttgccaggcattcctccattttttgggcctccctctagtttgtatcttcctaatgacaatgaagctaaatttggcaacaactttgaatcaaatccttcacagaatacagattggaacccacaggcaatagtgagcaacctaaccttccttgagcagaagatcaagcaggtaaaggatattgtgcagtccatgagtaacngagagaaccaagtagctggtggttcctgtgaggtagctgcaaagcagcagctcataaccgctgacctcgcgtagcctcgtggcccagccgcgtttctactgcgggttcgctgctcccttcaatgaagaacccacttcttagcagcaatccagcagtcaggcagcttggcaacactcttggttctcctacgggctttggcatgaatgctaatcagcgaccaagcgtagacagcaagaccgatattcctgacacaggaaaaacttctgattatgaggagctgatgaatacccttaatactagtcaagctgaaagagatgagctgatcaaatgcccaaatccctgtggtggggaagggtctgaactgactccgatggaggaccatgatgtgaaggagagtgacgatggtggtgagggagagaatctcccccctggttcatatgtaatcttgcaactggaaaaggaggagattttagcaccacatactcatttctgcttgatctgtggtaagggtttcaaaagagatgctaacctaaggatgcacatgaggggccatggagatgagtacaagactccagctgctcttgccaaacccacaaaagattatggtgcagatcatgcaccggttacaaggtactcatgcccatttgtgggttgcaaacggaacaaggagcacaggaagttccagcctctcaaaacaatcttgtgtgtgaagaaccattacaagagaagccactgtgacaagagctacacctgcagccgttgcaacaccaagaagttctctgtcatcgcggacttgaagactcatgagaagcactgtggtcgtgacaagtggctctgttcttgcggaacgaccttctccaggaaggacaagctttttggacatgttgcgcttttccaaggccacacacctgcgctccccgtggaagacggggatgtaccagaaggttcagagcagcctcaggacggcgaaccaacgaatgaaatggcgaggagcatggtgtatagcttcccgtgtagctcgtctgatggtttattgaacctcgacatgaaaatggctgatgacgtgcgtggttatctctcgccgctgagctttgataattgctttggcgcgtttgacgacttcactcgccctggatttgacatctctgagaaccccttctccttcccgccttcaggatcttgcagttatgggcagcagaacggtgatagctgatggatgccgccatcgatgatgactacaccgcggcactgtcaacctttatgtatgttgttgcatgatgctagtttggttcatcctctgttcaagagccattttaggctatgcctttaactttcttaagtgtacctccgtttgtggtcattaataatgatcaaggacttctagatagccccaattttctgcatacatatgcaaggattgctggttcatttggttgaatcggtgcgatgcctctagcgctgacaatatgtcaaaaatctggttctccagtatgttgatggtcaggcccggccctcgggagcacatgtgcatcggatcttggccccctccccatatatgtaggtggtgccgtagtttataatataccaatttaaatagttttaaaaatataactgttttataccgtagactgtactattaaaatattgttttgcactatgaactatatggttcgtggagtggagtttgaatacaggacagagatgaataaaactgctagagataacttaataaacaaaatgatttatgctagagatagcttaataaacaaaataatttatctaaatgtttttaaaggtttatctaatgatccaactttaccaatcttaaacacaatcgtactgcatagctatattnattgctctcgtataactcgtaaggcgagggcgaagcgacacaagggctcagtcctgactattacgattgattgatgacatgacatatcatgaaatcctcgattgagatgagaagatgagatctgtagacgtcggaactactgatgttgtgccgcctgctttctgcctccacgggtcagtactctgttgcgcccgtcgcctggattaagccagcatgtccttgtctattaagttagactgacttcaacagaaaacagacttagcctattcataatagtggttttatggtgatttcatatatatatttaatagtgtgatacatcagattttttgatgacacgacatatcatttaagagaattaacatgacataattatttaatatgcacatagtgtaggaggctgtttcagcaaaaagaatttgtagacgagtatgcaaacaaagtagttcagttgaaagtatgcaaactgaaatggcgaccatctgnttcatagctaagaactgaatactttgatttctactaacagaagtgcattcgttttagttttatatttcaagcaaagcattttactgttcatattatgctgattcatggatctagagaacaaacttctagagtttaaaattcaaatagtaagtacacacaatataccatgctcatcgaagtacatcagcagaaattcatatagtaagtacacacaatatactatgctactccgacgtcgtccaagtttagtaaatatgtatcatattcttttagattttaaatatctaaagtagcataacttataaattctcctatctaaaacttgattgattaaatagtacatatattccttgttgcatgattatcttcaattgatactccttttatgctaaatatactttaaattgtaaataagtactctcaatatgtataatcatatgtatgtactaaaatacgagaacttagtttaatatgctagttatctaccagattgtatcaatttgtggttttcacattg

SEQ ID NO: 6047 - DNA, 3007 bp, Zea mays
gggtaatctgggcgtcgcctatggctcgtcctccctatgatgatttcctctactgttgcctgcttggtctgatctgggctctgcctgataaacgataaaatatctcccttttttttgtggaatagcatcttgaggtatggcgaaaggatggtacatgaggaatttgtgatctctcgatcgggaatctgtgttcttggtgtcgggtgggtttgcttcgtgttcttgaagttcataggggggacaaacaaggggagctgtttactgaatctttatttgattattaggagatttgggatcttcgatttgatcttcttggggtctttgattgaactgagcagttataatcccctcatgatttatcctttcaatcgacctttgggttgcgtgtattgaagtccatccatccttctgtttgcctcagctaggtaccatgctcctttatttactaaatattgctaaggtccgactttttgggatgtacttcccttctggtcacagatcagtccgtgttagaatagattatcttagtgaacaagatctcgagaagttaccaatcagtaaaatagttcgtactatgtttattcgttaaaaaagttcttttaccctgaaaaggcaggagctctgccactggattaaaagactattcggtaaaaaaaatgtctgttttgttgaaatactaggacatgatgttatgatcctgacaagcttggctggctggtgaacctatggtatcgttttaacttccgtcttggttcctgaaaaaaatatgtaccttccctatttcttgcatgttatacatgtgaaacagagaagtaccaggattggtatgccttttacaactagaataggatcctcttcttgcttgtttcttttttcccctctcttttgatatgagaaaggccatttgtgaaccttctccacccgcgggcccggccggaattttctcgcccgggagccgcaattccatcctgctgctcgagttacatactcacccaatagaacaattctatgcctgatgattgtacttccggaggtagaagatcatactgaagcagaactcgagcagtgttgaatcgaaatggaaggcaggatgacaagtttggaagccaccatgaaagtttcctcattgatggcaagcagcatgtcaaggaatgctgaccctgaccaacagactctacgccccaattcggtggagcagttttattttccaagacctggtcaatctttgccaggcattcctccattctttgggcctccctcctccagtttgtatcttcctaatgacaatgaagctaaatttggcaatcagtttgaatcaaatccttcacagaatacagattgggatccgcaggctatagtgagcaacctaaccttccttgagcagaagatcaagcaggtaaaagatattgtgcagtctatgagtaatcgagagaaccaagtagctggcggttccagtgagctagccgcaaagcagcatctcgtaactgctgatctcactagcatcataatccagctcatatctactgctggttccctgctcccttcaatgaagaatccacttcttagcagcaatccagcagttaggcagcttggcaacactcttggttctcctatgggccttggcatgaatgctaatcagcgaccaagtgtagacagcaagactgatattcctgacacaggaaaaacttctgactatgatgaactgatgaatagccttaatcctacccaagatgaaagagatgagatgatcaaatgtccaaatccctgtggcggggaagggtctgaaccgactcctatggaggaccatgatgtgaaggaaagtgatgatggtggtgagggagagaatctcccccctggttcatatgtagtcttgcaattggaaaaggaggagattttagcaccacatactcatttctgcttgatctgtggtaagggtttcaagagagatgctaaccttaggatgcacatgaggggccatggagatgagtacaaaactccagctgctcttgccaaacccacaaaggattcaggtgcagatcatgcacctgttacaaggtactcatgcccatttgtgggttgcaaacggaacaaagagcacaagaagttccaacctctcaaaacaatcttgtgcgtgaagaaccactacaagcgaagccactgtgacaagagttacacctgcagccgttgcaacaccaagaagttctctgtcatcgcggacttgaagactcatgagaagcactgtggtcgtgataaatggctctgttcttgtggaacaaccttctccaggaaggacaagctttttgggcacgttgcccttttccagggccacacacctgcgcttcccatggaagatgtgaaggtatcagaagcatcagagcaacctcaggacagtgagccgatgaatgaaatggcgaggagcaatgtgtatagcttcccctgtagttcgtctgatggtatatcgaacctcgacatgaaaatggctgatgatgtgcgtggttatttctcgccgctgaactttgatccttgctttggcgcgctcgacgatttcactcgccctgggtttgacatctctgagaaccccttctcattcctgccttcaggatcttgcagttatgggcagcagaacggagatagctgatggatgccgccatcgatgatgacgacaacagcactgccaacctttatttatgttgttgcatgatgctagcttggttcttcctctgttcaagagccatttgaggttatgcctttatattttccctaaatgtacttacgtttgtggtcattaataatgatcaaggacttctagcatttcttagacccagatagccccaattttcagtatacatacgcaagtattgcttgttcattttgtctgaatcggcgtgatgcttgtagcactgacaatttatcataacaagctgctcagctattaaaaaaaaaaaaaaaggggactagttctagatcgcgatagcacgggctacattgctgggttacagttacagaa

SEQ ID NO: 6048 - DNA, 2140 bp, Zea mays
cccacgcgtccggcagtctcgctctcgcacaacggaaagtgaggagggggagagcgagaacggaaggtgaggactgaggagggggagagcgagagagagaggagggagggagctcgagaggtcaacgagggggagctggcacgaaagctcagggctccttgctcctcctataaacccagcgcacccgccttccaggctcccattttctcgcccgggagccgcaattccatcctgctgctcgagttacatactcacccaatagaacaattctatgcctgatgattgtacttccggaggtagaagatcatactgaagcagaactcgagcagtgttgaatcgaaatggaaggcaggatgacaagtttggaagccaccatgaaagtttcctcattgatggcaagcagcatgtcaaggaatgctgaccctgaccaacagactctacgccccaattcggtggagcagttttattttccaagacctggtcaatctttgccaggcattcctccattctttgggcctccctcctccagtttgtatcttcctaatgacaatgaagctaaatttggcaatcagtttgaatcaaatccttcacagaatacagattgggatccgcaggctatagtgagcaacctaaccttccttgagcagaagatcaagcaggtaaaagatattgtgcagtctatgagtaatcgagagaaccaagtagctggcggttccagtgagctagccgcaaagcagcatctcgtaactgctgatctcactagcatcataatccagctcatatctactgctggttccctgctcccttcaatgaagaatccacttcttagcagcaatccagcagttaggcagcttggcaacactcttggttctcctatgggccttggcatgaatgctaatcagcgaccaagtgtagacagcaagactgatattcctgacacaggaaaaacttctgactatgatgaactgatgaatagccttaatcctacccaagatgaaagagatgagatgatcaaatgtccaaatccctgtgacggggaagggtctgaactgactcctatggaggaccatgatgtgaaggaaagtgatgatggtggtgagggagagaatctcccccctggttcatatgtagtcttgcaattggaaaaggaggagattttagcaccacatactcatttctgcttgatctgtggtaagggtttcaagagagatgctaaccttaggatgcacatgaggggccatggagatgagtacaaaactccagctgctcttgccaaacccacaaaggattcaggtgcagatcatgcacctgttacaaggtactcatgcccatttgtgggttgcaaacggaacaaagagcacaagaagttccagcctctcaaaacaatcttgtgcgtgaagaaccactacaagcgaagtcactgtgacaagagttacacctgcagccgttgcaacaccaagaagttctctgtcatcgcggacttgaagactcatgagaagcactgtggtcgtgataaatggctctgttcttgtggaacaaccttctccaggaaggacaagctttttgggcacgttgcccttttccagggccacacacctgcgcttcccatggaagatgtgaaggtatcagaagcatcagagcaacctcaggacagtgagccgatgaatgaaatggcgaggagcaatgtgtatagcttcccctgtagttcgtctgatggtatatcgaacctcgacatgaaaatggctgatgatgtgcgtggttatttctcgccgctgaactttgatccttgctttggcgcgctcgacgatttcactcgccctgggtttgacatctctgagaaccccttctcattcctgccttcaggatcttgcagttatgggcagcagaacggagatagctgatggatgccgccatcgatgatgacgacaacagcactgccaacctttatttatgttgttgcatgatgctagcttggttcttcctctgttcaagagccatttgaggttatgcctttatattttccctaaatgtaattacgtttgtggtcattaataatgatcaaggacttctagcattttttagacccaaatagccccaattttcagtatacaaacgcaagtatttcttgttcattttggcc

SEQ ID NO: 6049 - DNA, 1860 bp, Zea mays
tgggaccctcgagggcgggccgcacgacgagacgaccgtccccgccgtccgacccattcacccccactgtgccgcgccccgccccgccccgccccgcccacgccgccgtggcaacgccatggggaagcgatccggcggccggaagctgccgttcttcaccagatcctcctcgtcctcgtccaagcggaatcgctccgcccgccgcctcccttccctccccaagcaggacaacgcgacgagggctcttctcgcctccccctctgctgcctcgccgtccgcgaccccgggatcggcggcggcggggcagaccgcccagctgccccctcccctctcagttaccgcgggcggcggggttgccgtgtcggggaaggtcaacaagaagaaggccggcacgcgcctatggatgcggttggaccgctggagtgcctccgagatcgtcgagctcgacaaggcctccataatccgccgcgccggactgcccccgcgcgacctacgcatcctcggccccgttttctctcgctcctccagcatcctcgctagggagaaggcgatggtgatcaacctcgaattcatcagggcgatagttactgccgaggaggtgctcctgttggaccctctcatgcacgaagtgctccctttcgttgaccaattgaggcagcacctgcctctgaggagccgggtgggtgagaatggtgagtgtgcccctgatggcaatggggaaaaacagaagggctcgcttaatgaagcgaccggggcagagcatgagctgccattcgagttccatgtgctggaggtagcactcgaggttgtgtgctcatcgttggaccttagcgtgtctgaccttgagaggcatgctactccagtgcttgacgaactgaccaagaatgtaagcacaaggaaccttgagcgagtgcggaaccttaagagtcatcttacccgtttgcttgcccgtgtgcaaaaggtcagggatgaaatagaacatcttctagatgataatgaagacatggaacatctgtatctaacaaggaagcaagtacaaaaccaacaggttgaggctttaatgtcatctgctgcttccaacagcattgttcttgccggaacaggtgtgcccaggctgaactctagcttccggcgtagcctgagcattgctactagcatgcatttggataatgatgtggaggacctagagatgttacttgaggcctacttcatgcagctggatggaattcgcaacagaattttgtcggttcgggagtatattgatgacacagaagactacgtcaacattcaactcgacaaccagcgtaacgaactcattcaactccagcttacacttacgattgcatcctttggcatagctgccaacactttcattgctggagcttttgcgatgaacatcccgggctctctgttcaacaccgatggcagcctcttctggccatttgtcgggagcacctcatctggctgctttgtaatcaccgtcctcttgttggggtatgcctggtggaagaagttgctgggtccttgaacatgaagcaagatggcagagagccttgtcatgcttgcagaaaggaagaaggcgtcctatcctaaggatattagagaaccgtggggatagcatgaaaacctgtatataacatctcaacagtgttcataagatgagtacgtataatatatcattagcataaacgagatgatgtgatgatcgatatacttccttgttaacatcattagctggcaactgaaaaatgttgccatgaaactatattatccagcagcggctggctttgtgtacaaaaaaaaaaaataaaaataaataaaaaataaaaaattaaaaaaatggttattccaatttggcgg

SEQ ID NO: 6050 - DNA, 1419 bp, Zea mays
ccggccggggtctaccacagatttggagttcgaccacgacgacagaacccgccgtccgacccattcacccccgtggaccgtgccggtgccgcggcacgccgccgccgcaacgccatggggaagcgatccggcggccggaagcttccgttcttcaccagatcctcctcgtcctcctccaagcggaatcgctccgggcgtcgcctcccttccccctccaagcaggacaacgcgacgagggctcttctcgcctcccccaccgccgcctcgccgtccgcgaccccggactctgcagcggcggggcagaccgcccagccgccctctcccctctcagtcaccgcgggcgccgggggtgccttgtcggggaagatcaccaagaagaagcccggcgcgcgcctgtggatgcggctggaccgctggggtgcctccgaggtcgtcgagctcgacaaggccaccataatccgccgcgctggccttccctcgcgcgacctacggatccttggtcccgtattctctcgctcctccagcatcctcgctagggagaagacaatggtgatcaacctcgaattcatcagagcgatagttactgccgaggaggtgctcctgttggaccctctcatgcacgaagtgctccctttcgttgatcaattgaggcagcacctgcctctgaggagccttgtgggtgggaatggtgaatgtgcccctgatggcaatggagaaaaacaggggggctcgcatggaggccaggtgccccgtcttaatgaggcgaccggggcagagcacgagtttccatttgagttccatgtgctggaggtcgcgctcgagattgtgtgctcatcgttggaccttagcgttgatgaccttgagaggcatgctactccagtgcttgacgaactgacaaagaatgtgagcacaaggaaccttgagcgagtgcggagccttaagagtcatcttacccgtttgcttgcccgtgtgcaaaaggtatcattaaagaaagactatgtgtgcttaattcctcaatctacctgaatttgaacagtgtataaccatggttgtttcttattgtcgcatgtcaattttgttgatcaaaaggccattgcattatattactaagataatcctaattaattggtttccaacagtctattctatttgcaaaaatggaggtatggttgagttcttcaaacagcctgtataccttgcctatttatgactgtgctgcttagattgcctcatgatgtgaattgttgtagttttagttgctttgtgcatagagtcacaaacgaatccagcttgactgtttgctctgatcttcttatctgtctttatgctcatgcaaaaagaattgcttgatgtacttacagttgtgtatccatgtggattggtaaaggaggcatgattaattttagctgcaggcatgca

SEQ ID NO: 6051 - DNA, 1326 bp, Zea mays
agcctgcaatacagttcatttccagcccactacacctgtcgaaggtcgaccacgctcccgtcttccagatctcggcaatctccatccccgctacgccatggctgctgcctcctccccaaccttcccgccgccggcgaccgacgtcgccgctccaggcgtccccgatctctcgatcccctacgacctggccacccgcgggcagtggcaggcgctcttctcccacctctcccatccggcccacacgccacatccgcaccaccgcctcctcctctccgctctctccgccctctgcctggccaagctccgacgcttccccgacgccgccgcgcttctagcttccctccacccggatccggcctgcccgccgccgcccttcctcatccgcctcctccatgctctcctcccactctttctccccgaccgccccctcgcgctcgaccgcctctacacgctcctctcctccgtccgcgcccgccccaacgccgggcaccccgagtggcgccgccgcgacgcgctcgtcgcgtccgtcctcgccgccgaccacctcgcccaccgcgagttcgacgtcgcactcgcgctcctcgccgacatcgccggccgcgacccgggcaacccggtgctcctctcgcgcctcgcctacgcgcacctccagatcggcaacctcggcgcggcctcggctgccttccgccacgtggagtccgtggccgccgcgtccgaggacccgacgcggcatgccaacctcctggcacgcaaccgcgcgctggagtgcatcgtgggcaaggactacgcggcggcggtgcgggagtacgagcgctgcatcgaggcggaccccgcggatgccgtggccctcaacaacaaggcgctgtgcctcatgtactcgcgggacctcggcgacgccatcaaggtgctggagggtgccctcgagagggtccccacggcggcgctcaacgagacggtggtggtcaacctgtgcagcatgtacgagctcgccttcgtcaaccacggcgaggtcaagaggagccttgctgagtggatcgccagggttgcgcccgacgacttcgacacctcctgcacgcgcatgtagccagccatgtaggaggtactctgccttttgcaattcagcattgtagccagccatgtgtatggctgttatgtcaacatgctgaaatgtgattatctctgtttatatagcattccaattcaaccaatttctgtttatgtgcatgtgaattgtgacatgattggtatacatgattgaaaacaagagtgaattggagaccaacatgctgttgtgatcatacctgcgaagaatcccagtttttctcc

SEQ ID NO: 6052 - DNA, 1520 bp, Zea mays
gaagccggacccctaatctgatgtgcaccggagttcgaagccgaattcacgactgcaattgcaaaaccctagctaccgcttcgccgaattccctgtcctccgcccgcttcgccgaattccctgtcctccgcccgcttcgccgaatttcctctcctccccgcccgccgcccgtcaccgcggcttcgtctgcgcttgtccctcccgttccaaggagcacgtgcttctcgccgcgccgttcgcccgccgccgccgccaccggttcatcgccagctatgtcttctcaggtcgacagccgcagccagtccgccgggaagcgcgcgcgcaccgacggcagccggcgtgaggacgactgggtttgccccagctgcaagaacgttaacttcgcctttcgcaccacttgcaacatgcgcaactgcaaccagtccaggccagcagatcacacggccatgcagaccccgcctcgctatcccacatcaggaggttacatgagcccagggacgccaccgtcgatgtaccttggtggtggtgctcccccatatggctcttcaatgtttaacgggcctgcaatgacgcgctatggtatcacacagttccctgggggttctgcgtatccatatggatatggtggccgcatatcaatggggagcccctacgggccaatgcaaatggctgggccaaccgcatactctggtggatctatgatgggagcaggtggaatgtatggaatgcccatggacaggtatgggctaatacctgctggttctggtccaatgggcacgagagctggctcatattctgatgaagattctcagaagaagtctgcaggagctggccgtgataatgattgggagtgtccaaattgccacaacatcaactttggcttccgcacagtctgtaatatgagaaagtgcaacacacctagacctgaaaaccagggatctaagcctgatggtttaagagggtcaaaaccaaagacaccagagggcagttggaagtgtgagcagtgcaataacataaactatcctttccgaacgaaatgcaatcgtccccaatgtggagcagaaaagccatcacagacgaacaatgcaaatgaatcagcggaagatcaggacaatcagtgagtcctagaacagtaatgagggtcaagaaggtccagcgtcgtcgtcaaggttcagtctgaatgtggggtacatctgtgtcagtagtcgccgttacaagtttcttccccttgagaacttagttgagtcggggccttggagttggcaatggagtcttgccttccttaatcactgcggataatggtcaagaacatcaatttgttatgtggtttgtcaagaacatccatcttgcctttcctggctgaacttggttacttgtctttgttactggtactctggataaattaccatatgttatatgaatgtcttttatatgtgtcatagaatatcactcatctgttatgaagtatcacaactgtccccagtccgcgtgcaaggaaaaaaaaaaaaaaaaaagcggcc

SEQ ID NO: 6053 - DNA, 1398 bp, Zea mays
aaaatcaaaatgcgatgtcactgagttcgaaggccaattcacaacaaaaccctagctactgcttcgcccgccgaattccccctccgctcgcttcgcacgccgcccgtcgccgcggcggcgtctgctattgtccctcccgctgcaaggagcacatgcttctcgccgcgccgttagcccgccgccgccaccaccggttcaccttcagctatgtcttctcaggtcgacaggcgcagccagtccgccgggaagcgcgcgcgcaccgacggcagccggcgtgaggacgactgggtttgccccagctgcaagaacgtcaacttcgccttccgcaccacttgcaacatgcgcagctgcaaccagtccaggccagcagatcacacgggccatgcagaccccgcctcactatcccatgtcagggggttacatgggccctgggacgccaccatcgatgtaccttggtgggggcgctcccccatatggatcctcaatgtttaatgggcctgcggtgacgcgctatggtattccgcaatttcctgggggttctgcgtattcatatggatatggtggtcccataccaatggggagcccctacgggccaatgcaaattgctgggccaactccatactctggtggaactatgatggcagcaggtggaatgtatggaattcccatggacaggtatgggccaatacctgctggtcctggtccaatgggcacaagggctggctcatattccgatgaaggttctcagaagaagcctgcaggagctggccgtgataatgattgggagtgtccaaattgccataacatcaactttggctttcgcacagtctgtaatatgagaaagtgcaacacacctagacctgcaaaccagggatctaagtctgatggtttaaggggctcaaaagcaaagatgccagagggcagttggaagtgtgagcagtgcaataacataaattatcctttccgaacaaaatgcaatcgtccccaatgtggagcagaaaagccatcacaaacaaacaatgtgaatggttcagcgacagatcaggacaatcagtgagtcctaggacagtaatgagggtcaagaaggtccagcgtcgtcgtcaaggttcagtctgaatgtggggtacatctctgtcagtagtcgctcctgttgttacaagtttcttccccttaggaccttagtcgagttggcaatggagtcttgtcttccctaatcactacagataatggtcaagaacatcaatttgtcatgtggtttggtcaagaacgtcgttcttgcctttcctggctgagcttggttacttgtctttgttactacttactagtactctgggtaaagtgccatctgttatatgaatgccttttagttatctgtgtcatacaaaaaaaaaaaaaaaa

SEQ ID NO: 6054 - DNA, 3358 bp, Zea mays
  misc_feature (2536)..(2536): n is a, c, g, or t
ggaatcaacgttgagtcatcccgatccaccctcctcagtcctcaccgatgcggcatcatggacgccgccacccgtcgcgccgccagtgagcccaacggctcctccctccccgacgcctccctcctcctccacacgttccgacgacacctgccagcgccgacgacgagatctgctagcgccgacgtcgtctccagatccaccgttctgagtatctagccatcgagaatggacatttcggagggctctattgctgttcgtggtaggggggaaaacaaaaggaagtggatccctgttgaagatgatgaactgatcaaagcattggttgatgtttctttggatccgaggtggaggagtgatgggagtttcaagaacggttacacttcagtacttgaagctcgcctcgctgaaaagctacccgattcaagaatttctgcaactcctcatatcgattcaaggttaagatacttcaagacaaagtattctgctttggagcagatgttgaacaagagtgggttcacatgggatccgaccaagaagatgattcagtgcgagaaacaacaatatgagacacattgcaagaataatccagatgcaaaagggttgtatggagtctcctttccttactatgatgaactctcaatggtatattccaaggacatggccacaggtgaaggtgcggaagacatgacagatgctgttcaaaacttggaagaagagttagttcgtgtaaatgctaatgatgaagaggatggagaggatatgacatctgtagagacaccaaggcgttctgttgactcaacatcatctagctccaagaagcggaagaaagagtggaaaggaatgaagacttcatcaagtgacccgcttcttgatgtgttcaatgaagtgagtggtgatctcaaggttgccaccatgtcaattggaaaaatggcgcaagctatggatcgtgaggcatccaaccaagagaaggcaagagatgaggatccacaacaaaagctaagagagaaggcgatcaatgaggtccggagacttgaatttactggctcagaagttatcaaagcagctggtgtgtttgttaggatgccagatcaaatggggatgttgtttgcacttccagaaccactgaggagggaatacattgtcgacatgctacgtggtaactagaattttgtttgtagaaatgtacatggctagttttgatcttggtttaattcgctaattatttcatttattccagatgaagcagcaaggagagagagagaggaggtcaaagtgaaggtgctggtctagatgttgaatgatggagctttggaagttgtctgttggtttggttggtctcaatctgtttacctttagtgttcttcatatgttgctgttgaatgacggtgaatgatgataaaaactgaatttttatgatgttgaatgttgttgaatgttcacgaatggtgttgaatgtcgcattgtatctgtgggtagctttcaatgtggtttgttgaatgtcggtacctttcagtatggtaaaaactgaatttttatgagttttgattgttgttttatgttcacgaaggggatgatgttgaatgatggtaaatgctgaatttttatgttcacgaatgatgttgaatggtttcttatattaaaacgtgtattggaatgaaaaagtgttacaaaactcacattcttaatttcattacgttacattggtttccaaaacaaacagtgtattggaatcaaaaagtgttacaaaactccaccaagccaatcctgtaatggcattcattgatttggaatccaccgttttttaatttccattgtgataccattacccatggtgaaccaaacactacccgagtgactacaaacatatataccccgcctatccggtagaggggggggtgtttccgcttgtttccatccattttcatccttaattctgctctcaagtttggccggcccattatttgataattacggcatcagttattttattacccaaatcttcaaattttgcttacgctgtaaggctgattccaacaaagccccctctcatctcctcctatctatacttcctattcatttttaaatacttctccctctttcattcatccctctgtttcttttcatttccaaccattccccctattcagccccctttacgcattaaatgagctatttgaattgtatatatcatttttgaagtttaaaaattgtatagtatttatagtaccgtaatacatatcgttatcagctaattaaacatgaaaaagattaattacatacttaatagcagtgattagtgaatggggggagattagtgctccctcccttttagagggggaaattctcaaacaactgaatagagggggggagggagggtgggccgttgaaatggagagggggaggaagtacacggagattagagggaggggagatagaggtggagacttggagccggccattaaggtgataggaactgctgggttgccagcctatccgaaaatgaccactatagcaaatttaaagaaataccaatagntttttcctttctttttgtagcttccttgcagaagcaggtaacaaggaatcggatcaaattaaatatattaagtttccaagcgtggtgaaaacgttattctctactttaattttgtgtcttggtcaagattgaacacgtggagagatcaactcccaaatataatctactggcacctctgtttttttttcaaaattaaaatgaatatagcaacactaaaaatgcaaacgcgagggtgttaattaagccaccaccaacaatatcaacatgtatgtcatgcccgcctgcaggttaaaacatccacttctcatgtcacggtctccacatggaagcagggaagactagcgaattgcagtttttattattttagtacgacaagctgaattttagccagcatcaccacatatatttgtcccagaaaaattcctgttattttttaatttattgcctaataactgatgcgaaagcaacgtgatttgcccacccgtattaaatgtagttgacgtccacttcactagcttgtcaacacagagagaagagagagagagagagagatcaaacgagatgtaaaaatagttctcaacaacaaaagggtctattagaacccgcgatttgcggcgagaaatagacttgttgggatacgtattctacaaacaggtccccgttttggcgagttgggactggagcatggtgtttggccaagttggtggaaaagctcggaagagaaatcaaccaagaattaggaagttgttcactaggagccaaaaatacagctggagaaagaaaagatgcctagttccgaaccattttgttttgtccgcgtgg

SEQ ID NO: 6055 - DNA, 1371 bp, Zea mays
ggaatcaacgttgagtcatcccgatccaccctcctcagtcctcaccgatgcggcatcatggacgccgccacccgtcgcgccgccagtgagcccaacggctcctccctccccgacgcctccctcctcctccacacgttccgacgacacctgccagcgccgacgacgagatctgctagcgccgacgtcgtctccagatccaccgttctgagtatctagccatcgagaatggacatttcggagggctctattgctgttcgtggtaggggggaaaacaaaaggaagtggatccctgttgaagatgatgaactgatcaaagcattggttgatgtttctttggatccgaggtagaggagtgatgggagtttcaagaacggttacacttcagtacttgaagctcgcctcgctgaaaagctacccgattcaagaatttctgcaactcctcatatcgattcaaggttaagatacttcaagacaaagtattctgctttggagcagatgttgaacaagagtgggttcacatgggatccgaccaagaagatgattcagtgcgagaaacaacaatatgagacacattgcaagaataatccagatgcaaaagggttgtatggagtctcctttccttactatgatgaactctcaatggtatattccaaggacatggccacaggtgaaggtgcggaagacatgacagatgctgttcaaaacttggaagaagagttagttcgtgtaaatgctaatgatgaatagaatggagaggatatgacatctgtagagacaccaaggcgttatgttgactcaacatcatctagctccaagaagcggaagaaagagtggaaaggaatgaagacttcatcaagtgacccgcttcttgatgtgttcaatgaagtgagtggtgatctcaaggttgccactatgtcaattggaaaaatggcgcaagctatggatcgtgaggcatccaaccaagagaaggcaagagatgaggatccacaacaaaagctaagagagaaggcgatcaatgaggtccggagacttgaatttactggctcagaagttatcaaagcagctggtgtgtttgtcaggatgccagatcaaatggggatgttgtttgcacttccagaaccactgaggagggaatacattgtcgacatgctacgtgatgaagcagcaaggagagagagagagaggtcaaagtgaaggtgctggtctagatgttgaatgatggagctttggaagttgctgttggtttggttggtctcaatctgtttacctttagtgttcttcatatgttgctgttgaatgacggtgaatgatgataaaaactgaatttttatgatgttgaatgttgttgaatgttcaaaaaggtattgaata

SEQ ID NO: 6056 - DNA, 3020 bp, Zea mays
tgcatgcctgcagccatggatttggcgtcgcccttgcgaactcctgacgtgcaacgggccttgtttctggttccaggtgaaatattcgacggagccaaccaaccccaccaagtgtaagtttttctacggagggtatccatatccatttgtgcatctgctggctttctgattcgcgtgtggttctctttatttcgatgcagcaaccaaggccatgggccgtgacctacgtgttcacttcaaggtgagagattcctacctgcctcccgacctagattctgttcaagagatctcatgatatgtttgtgtcctacctgcttcccgatcgagatcctattcaagagatcttatgatatgtctgtgtcattttttttgctgcgttcggttatagcctgtttcaagagatcttatgatatgctttgtcatttttttgccgcgttcggttattgccttaggccttgttcgtttccgtcggattgcacccggaatcgttcccgctaatcaaagtttatataaattagagaaacaatccggataggaatcattccgacccaccaatccgacacaaacgaacaaggcctcagggattccacgccgtgagccgaccgccttatcgtcaccatcttcttcggtccggtcccagccaaaccttcctcttcttcggtctcctcgtcgccatctcgcttgtggccgccaccgcgccccatccctaccctaccctacccgggacatacattgggtacctcgaggccggccggggcctctgcttcctcctccctccccccctcgtctgccctcgagatccacaccgcgcgcgtgccacgttgtcttcgtcctccgcgcgccttcggtcaccccgccgcctgtactgtacttacatgcggtagtacggcgcaggaacaagaaggatttgccagcatgagcggggagctgcaggtgcatgcatctatcgttgggttcttggcttggttggggggtgaactgagtctggatgcgccgaacgggatgttgggggaggcgagagtgagagcacggtcgctcgcttgaggtgcggcgccgtctgccgtgcggtgtcgtggcggtctagtagaggaagctaggaagaggatgatgggagctctgcagctgcagagcaatggcgacggcgctgctgaggggctcttaccggacccgggctacgtcgaggttgatcctaccgggaggtatggcaggtacaacgagattctcggcaaggggtcctcaaagactgtgtaccgggccttcgacgagcaccggggcatggaggtggcgtggaaccaggtgcagctgcacgacttcctgcgcggcccggcggagctggagcgcctctacggcgagatccacctgctcaagtccctccgccaccgcgccgtcatgcggctccacgcgtcctgggccgacgccgccgcgccccgcctcgccgtcaacttcgtcaccgagctcttcacctccggcacgctgcgccagtaccgcctccggcacccgcgggccggcgccgccgcggtccggcactggtgccggcagatcctcgacggcctcgcctacctccacgcgcgcggcgtcatccaccgcgacctcaagtgcgacaacatcttcgtcaacggcagccagggccaggtcaagatcggcgacttcggcctcgccaccgtggcccgccgccgcggctcgccgcacgcggcgcgctgcgtcgtgggcacgccggagttcatggcgcccgaggtgtacgcggagggctacgacgagcgcgccgacgtctactcgttcggcatgtgcgtcctcgagatggtcacgctcgagtacccctacagcgagtgcgtgcaccccgtgcacatctacaagaaagtcacctccgggataaagccggcggctctgtacaaggtgaaagaccccgcggtgaggcggttcatcgacaggtgcctggcgccggcgtcgcggcggccgagcgcggccgagctgctcagcgacccgttcctgcagctggaagacggctgcggcctcggctacggagacgacgcggactacagcgccatgtacaactacctgcaccagcccgcgtgcctggaccaccaccaccatgccggcagcattggctccacggcgagcaacggggtggtgtccaatggcggcggcggcggcggcggcagatgggacgacgactccgaggacgaggacgacgatggcagcatgttccaaggcatcgaccagctgttcaacgagcacgaagacgacgagctgcacgtcgctggtgtcgacatcaccatcaagggcaagaggatgcaggacggacgcatcttcctccggctgcgtatcgccgacaaagatggcacagggagggtccggaacatctacttccccttcgacgcggacgcggacacggcgctgagcgtggccaccgagatggtggcggagctggacatcaccgaccacgaggtgacccacatcgccgagatgatcgacggcgaggtgggcgcgctgctgccgcactggaggccgggtcctggcatggacgacgacgacggcggcggcggcggcgccggtccggacacgtcgggcgctaccgaccgctgcaagaactgccggtccagcgcgtcctccgccgggtcgctggacgactacatgtcggcggcggcggcgcggcgcggctgccggtgcgcggagctgcacggccggttcgaggagatcacgttccaggccgacgaagagcaggtgcggttccagggctctgggtgcagctccgacgacggaggcgggcaggctgagcagtgcgccggggacggaggcagtaaggcttgaggacatccatggcaatggcactactgtaactgaacgttcagaccagccttgacctggttcctcgcaggagcaactcctgttttaaaaatctgaaaatgccatcagtgcagccgcacagctgcttgtaagtgaacttttttgtagctctggttgagcatacgatcgttaagacgggtatagtttgaagtttcaacaggcaagtgctttcactg

SEQ ID NO: 6057 - DNA, 2832 bp, Zea mays
gttagtgcaattgactgtctacagatctgcggtacaaatatccaagccagttggttgggcccgcgctcccgacgtgcctgccgaactatggcacacgccaccggtagtttcacacgccaagtcagtaaacgagagaagtacacgttcccggcgctaaaatccagcgtcaaagtcggaatcaaccgccgtgatctgaccagccacctctgttctattcaccagacgcccgccgcttctacggggaacgcctatttacgtggctcccgcgtgcacgaatgagccgcccaccgtcgatcacgcgccgcccgccgagcacgaatccagaagctcttgggaatcgagcgttcatggcggtcccctccatcagctgctccctcggacctccagctcccgtcagagaagcttccgctcgcctgaggcagccgtcgccgacgccgtggtaagttgctacgacgtctcgctcgccccagatcggccgcgccatgtccggcaagcccggcggcgatggccagacgtcgtcccgcaagagatccgaccgccgtgaccgtttcaccgttatatctgcagggcggacgggctgcggcgggcgtgcgtggcgggcgcggcggcgtgcgtcgtgttcgggacggcgggaggcggcggcggcggcgtggccgcgtcggcgccgccgcgcgacgcctccgtcgcggcggccccgcggtggagcgaccgccgggagtgcccgccgtggcgcgccaactcgctggagaacgtcgtgccggagaacctgccccgcccgtcggcgcgccggaggttcagcaccgtcaagcgggcgccgcggaaggcccccgcgctcgggcctcaggcggtggcgccgtcgccgttcctggcgctgcgatccggcatggacgactgcttcaccctctaggcgagtaggcagaggtcgtgctagggctgactattccgcagctgaatttgttatatttgttctgtatattgtagttcgaagcgaacggaaacagtaggatatataagcacgattctgttgtagttcccttgggttttctttcatcgcatgttgtccctgtctcgtatagctcctccgacatcaacgccaaaaagccacacggcacgaggccaaaagctgttgttaccttgcttctaccgctgtttacttggttttaatttgaaacagattttaccttttgaacattggtttgtctatatagattaaatatcttaccaagggggccccgcgctccagacgttcctgctttccctttccaccatggacctttcctagatacgcaaccacagcacgcgaaatgagctatcgccgctaccgctactgtccatcgtccaagtcggaatcgacggctctgatctgttcgccaaacagcgaccgtccacgggaacaccgtataaataatgacttcccgtgcctctgtccagtccaccgaagcttctcactagtaaatggcggctccctcctccaccgccgccaccatcatcagctcctgctgccgcctcgggcctcccgctccgcccgaacaagccgctgcaggcgctcgcaggccgcaggcgccggcagcaggcgtgtcggcgtcgcacgcgctgcgcggggcgtgcgtggcagccgcggcgtgcgcggcgatggggatggcgggcggcggcgacatagcgctggcgcgggacggggcatccgtcgccgcgtggaccgacgccatgggcgccgcgcgcaccaaggcgccggcgccggcgcggtggagcgagcgcaggcagtgcccgccgtggcgcgccaactcgctggagaacgtcgtgcccgagaacctgccccgcccgcccgcgcccaggaggttcgacagcgtctcggtctcggccgccgcgccggacttggtggcgccgccgtcctctgtcctcgcggcggtgcgccccggcacgggctgcttctcgctctgacgcgccgcgggcaactgtggagatcggaggttgtaagaaaaaaaagcgacaaatgtggaaattggaaaacgcaatatgtacactataggttttattgtctcggtatctcatgaattcttgccggcaacttttgtgttgatggaagtaatttgcccatacaccactactactactacttgcttgcacatgagcaaattttgtgagcgatggacgctgatggccgaggccaatttgaaatcctctggtgatgttacttggcctgttgctttcgtggaaaagcagaacagcgtggaaatgcacgaaaacaaaatggagaacgatcgctcggctcgggttggacgtacgacctgctttgggctgtgtctgtgtagtaccgttgtctgagctgaactcagcgagcgccagtagtacaacgagctttcagtagtacaagactgcgacaagaagaagaggagggagccacaccgacgaggtcagggtgagctcggtgaggcacgtatgagctgatcagggtacaagcaataaaatcaaatacaaatctccctaatgatcgccgatccacacgatacacgcgataaagatcatgaaatagtacttagatctgtagatttcttaaaatatctgcctaagctacaagctacgtatgtcagcatatatgaccaaaaattcgtagacgtaaagtagacccacgaggcctggataggattcgactgcgcgggatccatcgtcctcggccggcccaagtactttgaaaatctcccgtgagggtgagcccataagcagttttgtcagcaaaaactcggagcccagtcgaatcctgttcggcacggtcctcgccccctccctctccttggtttggcttccagcttcctttccgaactgagtaactgacgg

SEQ ID NO: 6058 - DNA, 1543 bp, Zea mays
gtcgcgaacttgttacgtgtcactttctctccggaggcgacgtgtcgagtggagcgacgtctccaccatcttcttggcttttcctccttccccgcccttccgaatttctccgcgatttcagcgcgcttcctcccgccggctcctccccccgcctccgctctcaccgcggccggccagccatggagcaaggccaggggccgccgccgccgaagccgcctgcgacggagcgcgacatcggattcgccgagcgggccgtggcggcggcaggcgcggccgtcgtgtccgccgtcctcgtcaaccccctcgacgtcgccaagacgaggttgcaagcacaagctgctggagttgtttataacccgatatggtcagattttaggtgctatccatcatgcagcactggtggaatcaatggtttaggcccatgctcggcctgcagtcctgaatgctttcagtacagaggaactatggatgtgttttctaaagtcactagacaggaaggaatttttagactatggagaggtactggtgcaagcctggcattggctgtaccaacggttggaatatatctgcctagttacgatttattgcgcaattggattgaagaatactcggaccgcaattgtcccaagcttcgaccatatgctcctcttatttctggctctattgcacgatcattggcatgcataacttgttgccctattgagttagcaagaacacgtatgcaggccttcaaagaatcgaatgttggagcgaagccccctggaatgtggaagaccttgataggtgtgctttcatcaagacagagcatcaagagccctgaaaacgtgcgaggataccacctcctatggactggtctgggagcgcaactagcacgcgatgcgccctactcagctatatgctggacagttcttgaaccaattagacgacatgtgacacgactattcggtgatcaaagcaacgcgacagttatattgggggcgaacttttctgcaggctttattgctggggttatctctgcgggcgctacctgccctcttgatgttgccaagacacgcagacaaatagagaaggatcctgaaagggtattgagcatgaacacaaggcgcatattgcttgaggtttggaggaaggaaggtgtggaaggtctgttcagaggcgcaggccctcgaatggggcgcgcaggcccgtcggtgggcatcgtcgtctcctcctacgaagttgtgaagcacctcatgcacaagaacacgagcaatgcagcagacctatgattcgatgagctcgattagcacgccctaatggcacaagtaggattaggaatgtcgctattcaaagaaacacatttttttacggtagtccatgacagataaatgttatccctccattccattacaaactgttacttctaagatgggtttttatgcatctagtggctagcttataacctatgggttatatcgcaccgagatctacgtatctagccacgtatgtagtggcttggattttatgtacaagtggcaaaggtttatgttctaactgattgctc

SEQ ID NO: 6059 - DNA, 2949 bp, Zea mays
  misc_feature (524)..(524): n is a, c, g, or t
tagtaatagtactttcaattaattattcattgtctatattttaacaaaatatactagtctctctacaatttgggtctattcggtggaccgaatagaccgaaccgaaattgtgagtctattcgggttcggttcctaaaatatttttggaaatttcggttctcatttttcagaacccgaaatttcacaaacccgaatagaccgaaccgaattaccctaatagaccgaatgcccagccctagtcaagctactcattcatgcactcctttgtggtacgaccaaaggaaaaaagaacctatcactaatttatatgcacatcaactccattgatacttagaactagacaatccttgacattcttgctcatcttttgaaaacttataattgactttcatcaacaaaaaacatataagtgtaatcaatctcaatgattgtgacctgactcaatttacctctacaaaacatatgataatcacaataatctagtgttgtattaatcattaaaaattaactagaggcttagatgntcttggataggttttcatctgacaaatagtgaatcacaagaggaaggagaataaaaaacccgaatttttcgataaccggaatgtccatccctctatgcctccgagctggtacagaagtttcactaaacaatccctgcattcatcgtggttcagttcctatacgttcgtcctcgctaaacatgactagttgtgcgctgccttcttgttgtcgtcatcatagctcgcacgtttagttcaaaaactgaactagtcatcgttaattcaatccttcaactattttttttttggtttagacgcctaataaatctatgtgacaccaaactgccatttcagttaggcagagtactaccaacagtccaacgaggacccaacaaagaaaacggtcactgtcagtctgagtagtcagagcatggaagggaagcgtagagcaggcgtaacaggaatcatgctgctacagtacagagcattggtctaatctccggtttggagctttccggagctccagctaacctgaaaggtgccgctcgggaagaaaaaaaaaggagtcgccattgccattatgtgcaaagctggagttcattttcctctgcgaggatactgtccacgctaaagctttaaaccttcaacggcaactttgcacaccgtgtcccgtatcgcatccccagttgtgcgatgggatatggcgaaaacagagcaacaggtctctaaactaaatcctgggcagcactcttaaccagtcaacagcaggtcaccaaccattcgatttcacacaaatgcacgcatactacaatcctaattccttacggtcaatttcacacaactagattgtttgcaatttcacgcaactatggaaaagatacacttcaattacaactcaacttacgctaactagtcgcatccttttatccaaaattatttatcaaatagacctcaggtctgcctccagcgtacggagtacgaaaaaatggctaataaggaacaaactgctgttaaatcttacttgcaagtgcaacagccacctttagaggcgttcgattagcaaacgctagaaattttttttttttttttgttcatatttagcaaccaatcaacactagctaccaattaagattaacaactacacacggctcgtttcttatctcaaatttggaactaggaagaagaaggaagcatctaatagttatcacgtcgtgacctctcggatctggaccgtcagtcagacgtccggcggcgagcagtcggggcatcggacgaggccgttctcgttacagacggcgcaggtgcggaagccgctgccgcccttggcgctgtaccgcttgtggctgccgttgcagctgccgcagagcacgtaccgctcgccgccgcaccggacgcatgtggcgagggaggcggcgacggcgccggccacgacgcgccggagctcgccggcctcgtggaggcgccggacctcgtcggcgccgccgaggtggcggcctccgacgaagacctgaggcagcgtgacgcgccgcggggccacggggcgcgggaggagcgccgcgagctcctggaggtagcgcgcgtccatggcgaggtcgcgctcgtcgacggcgacgcggagcccgcgcaggatggcgcgcacggcgcggcagtcctcgtacgtgctccggaccacgtggagcgaggtgaagtagagcacgacgcggcggtccgcctcgaaggcggcgccgccgccggagtacggcggcgcctggagggtgcggagcgcacggagggcagaggcggcgacgcggacccggtggaagacgcggacggaggaggagggggaacagggcgcggcgggcggcggggagagtgtcgcggcgtccgacaggagcagtgcctggaggtccttgagggagggcgaggagaaggacaggcgcggggaggcggcagctacgagcgcggtggagggagagttggaggtggaggtggcggatgaaggccgcgtcttcacccagggcagccacatgaggggaggtgtgcgagcggaagtcggagagagggacgaagaggcggggatttgttcgattttcagatcgggggctgacgggaggaagcacgcagacatgctgtgttttgcgctcgggtatcaggttaggtttggaatttgaagagggggccccggccggcctcgaggtgccctctgcctttttagcccttgcagccttttttcattgtacaggttaaggtcattgttggggacttgttctcaaatgctaagaattaagaacaaggcaacacaagaaatgttaagtgttaaggtccttcgtcctccataacaatatatcccttcgggatataaagcatctcggacgaaggttacgaaggacataccttcgtaagcataacaacgaagaatgaagcatttgcataaatcatagaatatgaaataaacatttgaatattg

SEQ ID NO: 6060 - DNA, 4074 bp, Zea mays
ctagcctctagccatgcacacccacgagctactcgcgttttggtgtgtttagcaacgcaaacgaaagaatctgaatattagtctggttctagttcagttcatgggtagacacgaccggcgaagcaggcaggccggcaaaaacaaacacgcaatggcaaccagcaggagcgaacgatgcgctgtcatgcgtcgtgcctctgttcccggctcgattcaggcacatgcgtggtctacacgttcctcccaccccttgttttggggcgctcctcgattcactccacgcgccaaacttagcatccctctcctcccgcctcccctccaccggtatcggtgtcctcctccggtctcccctccctctgggaaggcccttggatctctcgatctccaaggcctgccttccattgccatagccatcgaccgtcgttctcgtctcgtggtggtcttgtgcccctctccggtctcctgagcaagccaccactagtctggtcacgctcccctgctccgcaccggacgggcgggtttcatttggtgcgcgtgcggcgagctcgggcatggcgttccacgaagtggagacgccgcgtcgatgctgagacgccggggcatggtcggcgcgcagtgacggcggccggcggctcggtccgtccgtgcgtgcgtgcgtgcccagcattcttgcccctgtcgagtcatcggctcgtcgctcgctcgcgcccacgccgctcgccccgcgtccacagggtcgccgccacggggaggcgcagagggaaaaggaagatgagctgctttccgtgcttcggcggcggaaagggcaacaacgacgacgccgacgcggagagcccgggcgacgcggccccggcgtctaacatgacgccacccgcgatggtgcaggcgcccgccgcgtacttcccagctcccgccgccgctccaacggccgcggcgccgcccaagcccggtggcggtgagatggccctctctgcttcgatcggtttcttcatgcatctcgcttagcacgtccaaatctcgtcgcgcctgcaacgcccaacgaatttgatttgatctcgcgatgcagggaaccaggcgcacgaggcttccgccgatgactcggcgctgcggctcgccatcacggggcaggcgttcgcgttccgcgagctcgccgccgccacagaccacttcacgccgtacaacctcgtcggtgaaggcggcttcttccgggtctacaagggccggttagagaagagcgggcaggtacgtacgtgaactgccacgcctcacgtgtcgtcgtccatgcgtctctctgaatgaaatgtgtgatgcatggcgtgcctctgctacttttgctccggaccgcgcccgtcatccccctggacaagcatgggttccaggacaacaaggcgttcttgaccggggtcgccaagctcagccagtctccacctcgagaacctcgtcgacatcattggctactgcgctgacggagaccagcggctgctggtgtacgagtccgtgcccgccggcaccttagaagaccacctgttcggtacgtacgtacgtgcacgccggtatctggcaactggcaagctcctgcagaatttgtcagtttcgtcgtctatgtctctgctgaacaagctgccggcgcgcgccagatctgccggcggacaagaagccgatggactggtgcacgaggatgaaggtggcgcacggcgccgcgcaggggctggagtacctgcacgagacagcgaacccgccggtggtgtacggggaattcaaggcctcccacatacttctcgacgagaagctcacgcccaagctctccgacttcgggctcgcgcagctcggccaggccgggggcagcatgccggtggtggcgtcgcccatgatgggctccttcggctgctgcgcgccggagtacgatcgcacagggcaggccaccatgaagtccgacgcgtacagcttcggggtggtgctggtgcagctcatctccgggaggagggccgtcgataccagcaagccggtggacgagcagaacgttgtcacctgggtaagtattataagctacgcgtttttgctgcttcttcaacgttgcttttgctaatgagctgcattatattggcatggcatggcatggcatgcatctgcacgacacattttcaggccatgccgatgttcaaggaccagaagagataccatgagctggttgatccactcataaagaaggaataccctgccaaagcgttgaaccagggggtcgccttggctgccgtgtgcttgcaggaagaggactccgtgcgaccgctgatggccgacgtcgtcatgacgctaggcttcctcacggcgatgccgcctgacccaccggcccctgccgctccaccgcctgccgccgccccggagccgaaggaagacaaagaatcggaccattcagactcctcgtcatcttcttcttcagacgacgacgaagataacgaggaggaggaaaccgaggagcaatgataagggcgggtgtgttcagcttcgaaggcttcaaacgtggaagggccacgcagatgaagtggcttcgtgcacttggcgtgtacggagctcaatatgtgggaccttggagccacttggacttggtggttgtggcagttaaattggggtgttcacaagtgagtaatcttttttttttgtgatgacgccaagcatgtaaaaatgtgagctatgacatactgatgggttacacattttgcactttaatgtgtttttcgtatggtcattacaatttatacatggaaaatccacgtggaattacggcatgtttagatcaccgtcgctaacaccacgccacgccacacttcgcgcgccgcagttgtggcggccgaatcgactgccacaccttaggcgggatgtggcactggacgtcagcgtccaaacaggcctttagttcatgtttgggattgctccaaggtccagctctatcttggagctataaattataataaaattgtggatagtttaaaatatctttttaatctaaataataaataaaatgatttatctaaatatattttaaaggttcacaactctaactccacgattttctagaatatctaatgacctattaaactaactccaccaaatttgttggagctggaacagtcacaaacatgaccttaatagcacaatccttgttagaatatgatcttagtcttgttgagatgtttggagggcgtgtgcttgggttcaattagcggatctgtttttagtctgctttttatttacatatatttttatctatattgtaagccatatgagaagagagatacttaggtattccctaaattttgtaagctctcattgtgaatattatcggttagcgtctgtgtttttttttctaatggttttccccataatttttttggtattgtgtttgatacatattgcatttgtttactatcaagtggtattaaagctagataaaggattgaaaaatatagggttttaatcgatctacaagtttgtcgtgtcgttgggtatgtttagatctattttttggcgtctttgagacagtcaatttttgtgtcaccgtgatggtgacgacaatttatttgcaaaagctgttgttccaaataccatagattattctagacatgagagctttttggagaatacatctgtgcgcggactgtttggggccttccgacggacagtctgtgacacctcagtgtgtctcatgcagaaactatacaaatcacaaaaactctactgcagacttccaagaccaagcacggaccgtccccctttggaaacccgaaggtgccgagttcggtaaaattcaattttagcgttttcgcggaccgtccgggatgcatggccagaccgtctacgactactttatctggcatccgacgacgaatttaatgcacttatagccattgatatagtcgttgttgatgaccgttatctttctggccattgatgtgcagaggcggaccgtctgacccagaggcgcggaccgtccacatgtggcagaaacgtggcaacggctatgtggtggttgagggctataaattcaaccccaaccacatccattcaacacatccaacc

SEQ ID NO: 6061 - DNA, 584 bp, Zea mays
  misc_feature (540)..(541): n is a, c, g, or t
  misc_feature (543)..(543): n is a, c, g, or t
  misc_feature (563)..(564): n is a, c, g, or t
aagttccccgtccatctcctccgcggctcgccctcctccgcccccgcctgctcccctccatcgccccacaaatcgcttctctttcccgaaccttatttaaacccggaacggcagcgtccaaaacgaaaagatcctcctcctgtcctgtcctgcctctcatcgcgcacggcaggcagcacagcagcagcagcagcgtattgatggtggatggatggacgcccagtcccttcattactcttttttgctggtacaccaccaaaccattctactatttaattaatgtcgtattggagccgctgcagttcagttccactggccatctgtacaggaaactcgcaagctgcaggagtacaattttgtcgaaatacttacgccgccgctaatggctgacagcaattaggaggagactgccgggcctctctcttttttagtgacctccgggctgcagtccacgatgtgaaacatgtgatgatgatgatggggatgtttgtaaaaaaaaaaaaaaaaaagcttcccttgtcttgctacctcgaggggggnngngtcaggtaaggaacttggannctggaggagggaaaggagtt

SEQ ID NO: 6062 - DNA, 1046 bp, Zea mays
gagaagttgtggcgcccaaggccgaggcggcggggagcggcgcagctggtgccagcgagagcaggaggacgctgaggacgggggccgagggcgaggacgtgcgcgcgatgcaggaagctttgcagaagctcggtttttactctcgcctcgaggacatggagtactccagtttctcgtctggcaccgagcgagctgtcaagacatggcaggcaacggtaggagcttcagagaacggggtgatgacatcggagctgcttgagtggctattctcggggaagaccggggaagacgtgaaaaccaaagatggcacaaacggagcagcggttcctgctgtaacagggatcgcggaggtacgcaaaactacggttgcagaaaacggtgtctcgggagttggggtctccgagcacagagtgtttcttctcggtgaaaacaggtgggaagacccaaccagactgacgcataacaaaaagacagccagcaccggcacagttgcatctactaagacttgcatctcctgtcgaggcgaaggccgcctcatgtgcttagaatgtgatggaacaggtgagccgaacattgaaccgcagttcttggagtgggtcggtgaagatacgaagtgcccatactgtgaaggaattggttccattttgtgtgatgtttgtgatggaaagaaagtaatggcaagttaagtaaggcttagagcaagaattccctgccttgtctgtgttcggttcccatcccaccctggtaagcacgcctaggccaggcatcaacgccagacagttcgatctggggtcggatgcggctgcctagcgtcgctccccaggcgagggttgcagccagacacgctaataatatcagcatgtgtagatgctagcaaaatattcagttttatcacagaactggagaatgcgttcaaatggcagttcgagtggactgctgtcccgcagaaagcggagacataagcaacagtgtaacacttttatggtacaataggagatggaaaaatacgagggaagaagaggattcctttcccaaatcaggccggt

SEQ ID NO: 6063 - DNA, 3721 bp, Zea mays
ctcatgcaaaagcaccactgtcacgaatagcaattcaacgctcgttgctttgggtagcaaaagcatcctatgagcaaacaagtaaaatcaagtaatcaacacaccaggaatgcaaatatattgcacaacaatataaacgaaaatatgtagcatcaggtatagaaaataattcttagacaacaaatacatggtcataagaagaaaagtgaaaacaggtatagaaaaataactgaggtatcaatgtataatgttatgtactgaaaagcatagcacgaagaaggatagggacacatataaaactcatttttgcatgtcacatctacttccatatttcggagcaagcaaatagatggtttcattgaagatccagagtatcaattaagcctagatatggccaaacgggctgcccggcccggtccgacctgggcccggtgaagcccggcccgttttgggctcggcccatgaggcacggttagaaaaacgggccgggtcgtctaagcacgtggactcgatttcctgttcgagcccggcccgcagctggcctaaacgggccggtctgtttagcacaaaaaagcgggccgaaaagcgggctaagcgggccgataagcacgttttagtgtaaaaaagcgggcttaacggacttaggggtaaacgggttgtgtcgggctagcacaccgtctctagtttcctgtccgagcctgacccgcttattcgtgccggctcggacggggcccaaacagcgagctttgtgccaggctcgcgggcctcatgcttattggccatctataattaagcccaccctagcaatcatgcaacaatcatgaagttcattgctcctagaagggtctaaacgattaattcacaacagagactacaaatgaatatgccagtccagacaattcagggtgttaacaacgattgaaaaaatttaagaatagaagatattcatattgtacggatatgatggtgatgaattaaaattcaagacacccacaacaaatgccaacaagaaattcaaactgtaaggcgcatgatggtgataagaaaaaaatcaagagtactcaaaagaataattaccaatattgaccaactactaaaaactaccaattatgtgttgacaaacatgggaataaaattatgggcatgtttggttctatgcctaggatgccacgcctaagcttagttagctgccacatttgtggcttgcctaacctgccttagcttagcttgtgtttggttcatgtgttcgcctaagattaggcttgactttaaaaagtgtggcacctgtttggattgttgccacgcctaaacttaggcatacatgtcaatgtgtggcagctgtttggttgttcaccaaactccattcacgccacataaactaaacaggtgcatcacatgaacacatattcaagaatataagaatcttacaccactttaatcacatgcgcatgataagctaataatcagttcataatagctccacaacatgttcattacaggtgattaataggtctaaaatagattcaaaacagtctgaggtagttgctattacacacatacacacacacattcagctatgagcagcaccatccatctccttaagccttattgatcaacttcgaagacgtgcaaaagaatcaggcatcaccaccgccatatacatcacctggccactgagcaaaataacaggcaaccacctaaggaattcacagcaaaacagccagccaacaacaccacccttccatccacaaaagagtacctggttgagcctaaaacaagtgcaaaacatatcagctaagtacaagttgaaacaataaaactaatgatatgtgaatcacctaatcacttcacagtagtgttgaatcactcaaaaacttgaatacccgtgactgaaaatgttgtttcagctgaagcggataagaaaccacgcatgcccttttgatcctttgatgctagaaatgtcccaactatcagtttttgatcagtagtcaatgtcattttttcaagcctttgccataattcggcatcagagttcaaagaaggtataataggtggaggtggtggttgtttaagttcgttccggagatccatcaaagtagtgttgatttcatctcctatctttgccatgcggctccgtggtctcacatctcttttgactggtatggcatctcctcttggacgcttgattccagagctagatgagctctgatcgataacttgagatggaattttaggagatggtaaagtgtcagagtcatcacctaggtcatcctcaggttgaccatagttggagacatcattgcatatgtcatcatcattatcattatcatcgacaggttgactttcatttaggcaagtagtagcatccatggcaagagatccatcagcactactgtcaaggaatagctcctgcatttcattgaagaatttgatgggctttgaaaggagcctccttgctctatcctgcatccggttatatgtttgttagtaatatccatggaccatgctgtgaaaataaaattaaaatagaaaaacagaatacctttagtttttccttctctgattctgatatgattaccatagaccttgttgtgtcaaaagtgttaccactcttgtttaaggttgttgcaatgaacttccaattttctttgtaatgcctaaaatgtctctccacttgagttgctgttacccccatattgaattgtctattcaatgattctgcacacttaaagtggtgctgttttttaaccttaaaaccggcatgttgatcctttatgaagtccatgtaccaaccaagcatgaactttgtttgatcctcatcccatagaatggtcctctcacgagtacagttgtcaccgtcaaccttatccttccctttgcccatctgtgggcatcaacaatatagtagcagtataaactaaccacttaagatcggaaatatcaattacaaaataggcactttaggtcttaataatcaatacaaaacaactgcttaaggtccaaaacaacaatacaaacaacgacacaatacaaaaaataggtctgaaatacatcactacaaaacaaccacacaaatacatcaattgtgctccaaatcatcccacatctattgagctaaccgatcacgcatgttagcccattgttggttgtctctattcatgtcaacatgggagcgattgcttcttggaaggctttgaaaccaggtctcatcatcatatacataaatatcaggaccatcatctattataaagttatgtaatgcacaacaagccaaaactatcttcacttgagttttcaaagggaagaatggttgacttgttagtatcttaaatctatttttaagtgtgccaaatgcccgttcaattgttgttctaagagatgagtgacgtaggttgaacagttcctttggattttctggtcgtctagtaccctgaaactccttaagatggtaccgaacaccacggtacgggggtagtataccaggtcttgctgcataaccagcatcagctagaaagtaatgacctacaattggattttactataattagctatgcatttaaaagagaaaatatgatatatatttatgactttactaataccttcaagaatttttaagcccgaagggcatgacaatgcgtcttggagcacaaaggaatcatgagctgatccttcccatccagccaacacatacgtaaaacctagaacaaagtccaccgcagct

SEQ ID NO: 6064 - DNA, 2682 bp, Zea mays
cgtcctctaaattcggtactctatatctacagtgataacataattcatatacttattttttaataatcattttttccatattaatacattttgaacttatgtgtgtaacgcaaaaatgaatttatttaattctagaagtttgatatttccaaaatcaaattcgtacgcaattgaaaaatgatttttaattaaaatttgtatttttttaagacgtatcttcattaggatgaccaactttctatcgatgcatcaacagatgaagcaactgcaatttaaagtaaataaagctaaccaatatcctgcacacgcgtgcattcatgtttgttttcgaaaccttgtgttcatttgattccaaagaggcagatctacacaccataggaggaaacaaacccaaaatcgattctcttcggtggtgcttcattcgctagtggtggatgaacctattcagaaaatgtgtaaacaaagacgaagtactagacatctccaaaggaaaaccaagtatttaatcttgctcggcttgcatctagatcggaggactaaatcgaagacgacgataacgccgacaacgcgcgatgcttcgtttttttccaccaaacttgttcactggcggggcgcggcgaagtcatcttgcaatcgtgagtttcgacgaacctctgttgcaggggcttccccatgatgggccgcagtggcgacgacgccgaccaacgcctcctcccttcccttcctactagattcctcccgcctcgagcagtccgccgccggaaccatccgacaacggctgcttggttcgcagcttcgccgccgccttcgacaaagcacgacgcgaggtaggcgccgtcgtgatcaacacaagcgatgaagagaatgcggaatcttcaagcgcgggagggagaaccggctgccgtatagcggatgttcgaaaaccgccgcatttaggtgccgcggaggagcactaagggcatgtttggttctatgcctaggatgccacgcctaagcttagttagctgccacatttgtggcttgcctaatctgccttagcttatcttgtgtttggttcatgtgttcgcctaagattaggcttgactttaaaaagtgtggcacctgtttggattgttgccacgcctaaacttaggcatacatgtcaatgtgtggcagctgtttggttgttcaccaaactccattcacgccacataaactaaacaggtgcatcacatgaacacatatataagaatataagaatcttacaccactttaatcacatgtgcatgataagctaataatcagttcataatagctccacaacatgttcattacagctgattaataggtctaaaatagattcgaaacagtctgaggtagttgctattacaatacacacacaaatatgtatatataatggtgctaaacattcagctatgagcagcaccatccatctccttaagccttattgatcagcttagaagacgtgcaaaagaatcaggcatcaccaccgccataaacatcacctggccactgagcaaaataacaggcaaccacctaaggaattcacaccaaaacagccagccaacaacaccacccttccatccacaaaagagtacctggttgagcctaaaacaagtgcaaaacatatcagctaagtacaagttgaaacaataaaactaatgatatgtgaatcacctaatcacttcacagtagtgttgaatcactcaaaaacttgaatacccatgactgaaatgttgtttcagctgaagcggataagaaaccacgcatgcccttttgatcctttgatgctagaaatgtcccaactatcagtttttgatcagtagtcaatgtcattttttcaagcctttgccataattcggcatcagagttcaaagaaggtataatacgtggaggtggtggttgtttaagttcgttccggagatccatcaaagtaggggggatttcatctcctatctttgccatgcggctccgtggtctcacatctcttttgactggtatggcatctcctcttggacgcttgattccagagctagatgagctctgatcgataacttgagaatggaatcccggccggccgcgaggtgtcagagtcatcacctaggtcatcctcaggttgaccatagttggagacatcattgcatatgtcatcatcattatcattatcatcgacaggttgactttcatttaggcaagtagtagcatccatggcaagagatccatcagcactactgtcaaggaataactcctgcatttcattgaagaatttgatgggctttgaaaggagcctccttgctctatcctgcatccggttatatgtttgttagtaatattcatggaccatgctgtgaaaataaaattaaaacagaatacctttagtttttccttctctgattctgatatgattaccatagaccttgttgtgtcaaaagtgttaccactcttgtttaaggctgttgcaatgaacttccaattttctttgtaatgcctaaaatgtctctccacttgagttgctgttacccccatattgaattgtctattcaatgattctgcacacttaaagtggtgctgttttttaaccttaaaaccggcatgttgatcctttatgaagtccatgtaccaaccaagcatgaactttgtttgatcctcatcccatagaatggtcctctcacgagtacaggg

SEQ ID NO: 6065 - DNA, 1687 bp, Zea mays
cgggcgggcggcgcggatcgggggggtcgaatcgaatcgatggaccacaagccatgcgcggccgtccttgagccgttgctcccgtcgccggcggagggcaaggcggcggaggcgaagcggctgatgcggctggcggggccgatcgtcgccagctgcgtgctgcagaacgtggtcagcatggcgtccatcatattcgttggccacctcggcgagctccacctcgccggcgcttccctggccacctccctcgccaacgtcacgggctactgccttctcaccggaatggcgagcgcgctggacacgctgtgcgggcaggcgttcggcgcgcggcagcaccacctcctgggcgtgtacaagcagcgcgcgatggtagtgctcgggctcgcctgcgtcccgatcgcggtcgtgtgggcgtgcgccggccggatcctgctcctcctcggccaggacccgcagatcgcggcggaggccggcgcgtacgcgcggtggctcgtcccgtcgctggccgcctacgtgccgctgcagtgccacgtccgcttcctgcagacgcagagcgtggtcctgcccgtggcggccagctgcggcgccacggcgctctgccacgtgctcgtctgctgggcgctggtgtacaaggctggcatgggcagcaagggcgccgcgctcagcaacggcgtctcctacgccgtcaacctcgtggtactggcgctgtacgtgaggctgtcgggcgcgtgcagggagacatggaaaggcttctcgcgggaggcgtttaaggacctgtggcgattcgccgagcttgcctggccgtccgccatgatgatctgcttggagtggtggtcgtttgaagtccttgtgcttctgtccggtcttctgccaaatcctcagctggaaacgtcagtcctgtcgatttgcctaaatactggtgctctgctctacatgataccattggggcttacttactccataagcacacgcgtttccaacgagcttggcgctgggcagcctcaggccgcgaagatggcagcaaaggtagtcatgtacatggctttgtctgaaggactcgttatatccttgacgatgaccctgctacgcaacatttgggggtacgtgtacagcgacgaggaggagatcgtgacgtacatctctaagatgttgccgatcctcgggatatctttcttcatagatgggctccatagctctctttcaggggtgctcacaggctgcggaaagcagaagatcggcgcggccgttaatctcggagcgttctacttgctaggcatcccagtggctgtactgcctgcattcgtcttccatctcaaccggaatgggccccttggcttggcatcgtctgcggcagcgccaccaagctggggtttcttctgtttgtaacgtgttccgtagactgggacaaggaggcagtgaaggcaaggtacagagtgttagggtcatctctcccgttagcatgaaaaaaatgccagtgttacatggaaatcccatttgaaggcagttgaacagaacccggcaaagaaagtgtgggaacaaaaaactttctatagttggggacatctcaaagtcatagctatggggaaggcaagaagaaccagagccagtatttttggattcatctgtactgttaaattttgtagcactgcaatggtttttcaggaaatataattagctggattgagtc

SEQ ID NO: 6066 - DNA, 4407 bp, Zea mays
  misc_feature (3359)..(3359): n is a, c, g, or t
ctcgaggccggccgggtgccccctgtaggccggccggggacaacgcacgcaaaggctgatgcgtatcaacgtatgcggatgcaggggcagcaccgtccacctccaccatctttcctcttcctcctcgcctccaccccttcccttccatctcctcccacccggcgactcctcttcctctctgccgcgccgatcgattggcccacccatcgatcgagcacggggaagaagattccagtccggagtggtttcaattcggtcgggttcgttgcccgtgtgggtgggcgctatggcggcgatggatgcctcggcagataagaacgccgtcttccgcaagcttcgcgccaaatcggacaacaagatgtgcttcgattgcaacgccaagaacccgacgtgggcgtccgtcacctacggcgtcttcctctgcatcgactgctcggcggcgcaccgcagcctcggcgtccacgtctccttcgtcaggtcaacaaatttggattcatggactccagaacaactgaaaatgatggtctatggcggaaataaccgtgcgcaagctttctttaagcagcatggttggacagatggtggaaaaattgaagcaaagtatacttcaagagctgctgacttgtaccgacagttgcttgctaaagacgttgctaaaagctctacagaagatggaaacaatagttggccatcttccccagttgcagcatcccaggctccaaatcaagctgctgcatttccagatctcaagctgacagaggtgtcaaaagaaaatgtaagtgaaaagaaagattctgagattgttcgttcgcctagagctccaacccattctttcaagaagccgattggtgctaaaaagcctggaaataagactggtggacttggtgcacggaagcttacatcaaagccaaatgaaagcctctatgagcagaagcccgaggaaccagctcccgtcctgccatcatcggtgattgagagtactacaactaggagcaaatcacatacttcccgatttgattacgttgaaaatgcacctgctcttaagaatgggaatagctcagaaggcaaccacatgagtggacatgttgcacccccaatgtcgtcaaacttctttgctgaatttgggatggacagtggatatcagaaaaaatctacgtccagttcatccaaagtgcagattgaggaaagcagggaagcaagacagaaattctcaaaagcgaaatcaatttcttcctctcagttttttggtgatcaggccagttttgaaaaggacgctcaagtctctctccaaaagttttctggttcctctgcgatatcaagtgctgacctatttggccatccggcaaacaattctagcgtggatctcagtgcttcagatttgatcaacagaatctcgttccaggccactcaggatctgtcttctctcaagaacatggcaggggaaaccgggaaaaagttgacatcgatggcatccaacatcatcactgatcttcaggaccgcatcctctgagctttaaactcacagtaaacttctgcgttgtttcagtggctggcttctcccgtcgacccgggtgacaaactggcctggcctggcctgcagatctgtctaggagttcgtaggcgtctgagaacttcctggcaatctggcatatctgtctaggagttcggaagcatctgaaaagtggcatatctgcctaggagttcgggagcagctaaaatcttgaagttagagagagagagagagaaagagagagagagggtgaaagaagagaacttatgaccaatactgtaattggctaaagtcatgtatgcttctagagctgtaacgcaaatgtcttttgccattggttttatctcgggtttgagatatatacttttgctttgtaatgatacatacatgttttctaattatgcgtagatatttcttgccccaaaaaaaaaaaaaaaaacggactcatgagaataggggccaccaatgattacataatgtcttgcatcgattctgagaatatgcttgaaattagcacgacaccaagtcgcaataacccacgcaaaattgtgttgcaggttgaaagtccccagtgaatgtgtttggttgactccacaccttgaggttgtcgcagctcccgcgtgagctcacgactgacgacgttgtatagctagttctccgcatgtgccgtttaacaaatggcgtacgtcctcacgagaagttttccgacttattgaaagccagattgcctgctttcggcatcatcaccgtgtgtacatttgccgtaaagctcatacttatgcatttcgaaaatactacggaacattgaattaataaaataaattcttagagactgttttggtccttttcattcattttagagaaatcgaaatctactaatagagtaataatagatttgtctttttagattggaatttgtcattcacgtttttcccaaattcacatatacgtctgcttcaaattcataggattagatataaaaattgattatataaatcaccatgcttcctatgtttctattctataatttacaccatactcttcaactcacttctttgtaattaaaatacaaatttaagtatctcccttgcatgtctaacatatacaaatgtattttatatacaactatattagcttagttaatacgtatctaaattaaaattattgtaataatttttccactggtctaaacgggaccttagtgaaatctgaaattcccgtagaaaagtatgtgtttgtgttctaacaataaaaagttttctttctatatacattcaaaacatttatttctttattcatgtacagaggatgtgtgttgatatttttatgctcatttggatgcacttatttgccacacattatgaacatatcatgttaaaaggagtacattttttattgattatactgaacgtaagatataagatttactagctgtataaatcttgcagatccttatataagaggctcttttttctagcgtaattaatttttacaatgaataaatgcttgacattaattctgaaaaattgcatacacctgaaaatgttaggatacttttaaggatattttaagtaaacatccgaaggaatgaataggcgaatagaggaggtgaatgagagtgtacaatttttgtcctcgagcaactttgacttgaatcccaaattcacactctaacttccaaaactccaaatagcacacaaaagacattgaaaagtttctgggataaacacgagcctaacaaaacaaatggatcgcaaaacggacactaaacagtccaaaatgacccaaaattgagtgctaactcaggctgttttcagcatttcgaaaatcaatttttgaatatgaaatngatccgaacgaactctgattgagccgaattttccacacaccatgacagatgagtttctaaggtgtccacaaaatttaaactcaaatggatttgtaattcaatcgcaaatcagaaaatacaaactagacttagggtttagttatcctcattggtttgccttatacacacttgttcattactttgcaattacttgcttatgtgtgtagttgttttccttgagctagagtagcatagatgtagttgtagttctagtaactagttttaatcgctctcttttagtagctctatagtgtagttcgtgttagtgtagcttgtatggtgtgtgctctagactagaaaccaagctactagaattttgcaggggcttgctttgagggaactagagctagtgcaaatttgctagtagggcttcatattatacttatcaaccttccctctagtgttgttattttttagagaaaattttatacactattcgccccctctagtcataaagatcatttcataacactacatgaaactacttaacttcctagagccaaggccgtagaaagttatccatatactttcagaagttactagacctgtcggaagttaagccatcccatcgaaagttaagctcttaaaaagaaatgctcgaaagttagcttaactttctagagccctctcgaatgttagctaactttctacagccagctatgcctcttagaagttactggggttgacaccatccatagggatgatgtcattagcctagtaacttccgacgacttgtttagcctctaggaagttacctgactaacttctgacaacttgtctagcctctaggaagttagttagctctagaaagttaaagtgaccagcattaccaatgttgtttcattttcattatacaccacattccacaacataacaaatatactaacaaccatgccacaccacatttcacatataacatcttgaaagggaaataggcttacaccttttcctagattgattttggtggttgaattgtccaacacaaataattggactaactagtttgctc

SEQ ID NO: 6067 - DNA, 1746 bp, Zea mays
ctacaaaaagaggagacgcgcgcacgcaaacccggaggccgggaggcggagggcagaggcagcaccgtcccgtccacctgaccacctccaccattttttcctcttcctcctcgcctccaccccttcccttccatctcttctcacctggccactcctctccctctctcccgcgccgatcgattggcccacccatcgatcgagcacgggaagaagattccagtccggagaggtctcaattcgatcgggctcgttctggtgtgggtgggcaccatggcggccacggaggcctcggcagacaagaacgccgtcttccgcaagcttcgcaccaaatcagacaacaagatgtgcttcgattgtaacgccaagaacccgacgtgggcgtccgtcacctacggtgtcttcctctgcatcgactgctcggcggtgcaccgcagcctcggcgtccacgtctccttcgtcaggtcaacaaatttggattcatggactccagaacagctgaaaatgatggtctatggaggaaacaaccgtgcacaagctttctttaagcagcatggttggacagatggtggaaaaattgaagcaaagtatacttcaagagcagctgacttgtaccggcagttgcttgctaaagaggtcgctaaaagcgccactgaagatggcaacaatagttggccatcttcaccagttgcagcttcccaggcttcggatcaaactgctgcgtttccagatcttaagctgacagaggtatcaaaagaaaatgtaagtgaaaaggaagactctgagattgttcgttcgcctagagttccaacccgttctatcaagaagccgattggtgctaaaaagcctggaaataagaccggcggacttggtgcacggaagcttacatcaaagccaaatgaaagcctgtatgagcagaagcccgaagaaacagctcctgtcctgccatcatcggtgattgcaagtactacagctaggagcaaaccccatacttcccgatttgagtatgtagaaaatgcacctgctcctaagactgggagcagctcagaaggcaatctcatgagtggacatgttgcacccccaaagtcatcgaacttctttgttgaatttgggatggacagtggatatcacaaaaaatctacatccagttcatccaaagtgcagattgaggaaagcagtgaagcaagacagaaattctcgaatgcaaaatcaatttcatcctctcagttttttggtgatcaggccagtttcgaaaaggacactcaagtctctctccaaaagttttctggttcctctgccatatcaagtgctgatctatttggccatccagcaaacaattctagcgtggatctcagtgcttcagatttgatcaacagaatatcattccaggccactcaagatctgtcttctctcaagaacatggcaggggaaactgggaaaaggttgacatcgatggcatccaacatcatcactgatcttcaggaccgcatcctctaagcttaagttacagcaaagtaaacttttacgttgcttcagtggctggtcccgtcaaccgggtgacaaactggcctgccccgcagatctgtctaggagttcgagttcgtaggcgtctgaaaacttcctggcatatctgtctaggagttcggaagcatctgaaaaaagtgtaagctatttccttaatatgaaagcaggaaggattgccgctctcacgttaaaaaaagtcggcaagaaaaaaaaaaaaaaaaaaaa

SEQ ID NO: 6068 - DNA, 2426 bp, Zea mays
cctcgaggccggccgagatggtgatatcccactccatttccgttaccactttatgtaatgaaccaaacaccaccttaattttatctctgttatataaaacactatgttttagttataccgcgtgtgagaatcctacaaaaacccttctcaattttcctttcacaaacctgcgggtcctctccccagtcccgactcccacctgttctccacctcgcccccacttcgtccttctccatctagggttctctctgtttcctcctcatcggaattggagcttcgcatagagtgtccctcgtcatcgccgccggcaccgacgccggcagccatgtccatgctccttatacagaaacaacccctccctctctccgttcgtccccgcacgactctccgccagtgccgtctccccacgactcgattctccgccgccgccgccgactcggctagccgcgctgcccccttcgccgtcgaggactacctcgtcgccgcatgccacctaaccccggcgcaggcgctcaaggcctccaaggtgctctcgcacctcaagtcaccctcccgacccgacgccgtgctagccttcctctcgggcctcggtctctccgacgccgacatcgccgccgccgtcgcctacgaccccaagcttctctgctccgaggtcgagcgcacgctggccccgcgtctcgcggagctccgggatctcggcctctctccgtctcagatcgcccgcctcgcactcgtcgaccccgcgcgcttccgccgccccaccgtcgtctccaagctgcagtattacgtccctctcttcggttccttcgagaacctgctccaggctctcaggaacaacgcctaccttctcagctccgacctcgagcgcgttgtgaagcccaacgtcgcgttcctggtggagtgcgggctagatgcttgtgatattgccaagctgtccatacccgtccctaggctgatcaccaccaacccagaacgcgtccgggcaatggtggagcgagctgaagctgtcggtgtgcctcgtggcactgggatgtttaggcacgcactgctggctgttgcattcctcagcgaggagaagatcaaagctaaggcagagtttttgaagacaacatttcggtggtcggatgctgaggtgggcgttgcggtttccaagctgccattggtgctcaagcactccaaggacaggctgcgccgcatgtcagagttcctgatcaccaaggttgggttggagccagagtacattgctcacaggcctgctctgcttacatatagcttggaacgccgcctcatgccccgacactatgttgtgaattacctgaaggaaaatggattgttggagcaggaccggagctactatactgctgtccagatgagtgagagtgccttcatggataagttcatatgcccctacaaggaagctgcaccaagcctcgccctagattatgctgctgcttgcagaggagaggtgcccactaccttcttggcaaatgtttaacccttcagtgtaaagcaatgttttgacacttagcagtgagctggtaattttgtttctttccttgcctaactgctacatcccgcagctgtgtctttagaattggctctggtacataagatgtgagccatggttattaccagggctagatttatctttgctctctgttattcaagctgatcaagtattccaatttcacctgtcactgtatggtatggatttagtgggtgagtaccctgtatattgctctgcaactgttatcgatgcaatgtttctgaataaatatgcaggatgcacggttccaaacaaaaaaaaaaaaaaaagagctgtgctttctttctttggcaaagcattaggtggggagggcttggtgattaatcatgctactggactagtttctaaactggcggttgtaaatatgatatgattttgtaggttgatgcatcatatgaccattcccatctccttggattttattccccctttttaccgtgtaggggaaaactggaagccattttgaaccaaagacgattcagaaataagactgtctgggagattaatccactctggacttcacaaaagcacttgttatcggaaagttttgtattggattatcttaaagttggccaaacctgctacctacaacaaggctctttcggtgaaattctgaaagcaaattggcgaggaacacccattgctgtcaaacgcattcttccatccttatctgatgacaggctggtgatgcgcaggccaatgcagaaagtgttcactctgaagacgccccaacttgttcatacagtagtgtactttcagttattttgtttttgttattggtttgtatgaatgctgtagttggtttcatgtttggatatgcttgtatgattattaatctggaaatggtacaaacaattcagatgaacatttttagtggccg

SEQ ID NO: 6069 - DNA, 1040 bp, Zea mays
cccgggctctctctctctctctctctctctctctctatatctctcttctctcccagaccttccctccggccagcctcaatctcccgcgtgagctcctcgaacgcacacctctctcgatccgactgacatggccggcgcccagtcctggaggacctacctgtgctgcgtgggcggcagcgcggcggtcgaggacgacggctcgacgctgcggcggcggcggaggcgcggcggcagcggcagcagcagcagcaaggacagcccgaggtcgtcgtcgtcgcggatgtcgctcacgagcctcggctcgtcgtcggagacgctctcccccgaggacctgtcgctcacgctgtccgggtccaacctgcacgccttcacgtacgccgagctgcgctccgccacggccagcttctcccgcgccaacttcctcggctgcggcgggttcggccccgtgtacaggggcgccgtcggcgaggccctccgcccgggcctgcgcgcgcaggacgtcgccgtcaagtacctcgacctggagggcggcgcgcaggggcacaaggagtggctggctgaggtgttcttcctcgggcaactgaggcacaagaacctggtgaagctcatcggctactgctacgaggccgagcaccggatgctggtgtacgagttcatgagcttcgggagcctggagaaccacctgttcaaaagtaccaacggcgccctcccatggatgacgaggatgaagatcgccgtcggcgcggccaagggcctcgccttcctccacgacgccgacccgccggtgatctaccgcgacttcaaggcttccaacatcctgctcgactcggactacaacaccaagctgtccgacttcggtctggccaaggacgggccacagggcgacgagacgcacgtgacgacacgtgtcatggggacgcacgggtacgcggcgcccgagtacatcctgacgggccacctaaccgccaagagcgacgtgtacagcttcggcgtggtgcttctagagctgctctcgggccggcagtcggtggaccggtcgc

SEQ ID NO: 6070 - DNA, 1069 bp, Zea mays
cacgttgtcctctgttccatccccgttcgttccacgaaccaaaccaaacacgctccacaaaaagaggtcagtgtggacgcttgaccgcgaaaattatatagacttctactcggctgcatctttgctccggtcgatgcacgacaagaggagaatggggacggaggccgacgccgcagccgtggacctactccggtcgcagatcccgttccagaccgacggggagttcgttctcccgccgcgcggcgtcgggctcgtcctcgtcgacctctgcaacggcttctgcaccgtcggcgccgggaacctcgctcctgttgcaccaaacaagcagatcagtaagatggtggaagaggccgcgaggctctctaagctgttctgtgatagaaacctaccaatatttgcattcctggatacccattatccagataagccggaaccaccatatccccctcattgtattattggtactggggaggaggactttgttccagatctggagtggttggaaaaggagccaaatgtgactataaagaggaaaagttgtattgatgggtatatcagctgcatagagaaggacgggtctagtgtttttgctgattggattggaaaatatcagataaaaactgtcttggtgctcgggatatgcacggacatctgtgttttggattttgcaagctcaactctggctgctcgaaatattgaccgagtgcctccattacaggatgtcgtgatttattcaggggggtgtgctacatatgaccttcctgttgagattgctactaatatcaaaggagctcttgcccatccacaggatctgatgcatcatattggactctatatggccaaaggaaggggtgcaaagatagttgacagggtggttattgaaccttgaataaaaaaactttccctcgtcacagtgatgttgctagggtttccttccattgtaacaaccagatatatatatgcatcttggcagaaagttgttgagattttttataatgctagcgccaactttttttttttttttaaaaaaaaaaaaaaaaaaaaaaaaaaaaaaaaaaaaaaagggcgg

SEQ ID NO: 6071 - DNA, 1243 bp, Zea mays
  misc_feature (1202)..(1203): n is a, c, g, or t
  misc_feature (1212)..(1216): n is a, c, g, or t
  misc_feature (1218)..(1218): n is a, c, g, or t
  misc_feature (1222)..(1222): n is a, c, g, or t
ccggccggggtgataatggcaaatttctcgtcgaataggtcagtgtgcacgcgtgaccgcgaaaagttgtttcgacctcctcggctgctgctttccgctgacctcgccgtgccattgagatgtcatagaacctgccgagccggtcgcaggcgcgaggagaatggggacggaggccgacgccgcagccgtggattcgcttcggtcgcagatcccgttccagaccgacggggagctcatcctcccgccgcgcgatgtggggctcgtcctcgtcgacctctgcaacggcttctgcaccgtcggcgccgggaacctcgctcctgttgcgccaaataagcagataagtaaaatggtggaagaggccgctaggctctctaagctgttctgtgatagaaacctgccgatctttgcattcctggatacccattatccagataagccggagccaccgtatcctcctcactgtatcattggtactggggaggagaacttcgttccagacctggagtggttggaaaaggagccaaatgtgactataaagaggaaaagttgtattgacggttacatcagctgcatagaggaggacgggtctagtgtttttgttgactgggtgggaaaatatcagatcaaaactgtcttggtactcgggatatgcacggacatctgtgttttggattttgcaagctcaactctggctgctcgaaatattgaccgagtgcctccattacgagatgtcgtgatttattcagaggggtgtgctacatatgaccttcctgttgagatcgctatgaatatcaaaggagctcttgcccatcctcaggacctgatgcatcatattggactctatatggccaaaggaaggggtgcaaaggttgttgacagggtggttattgaaccttgaataaaaaaaacttccctcatcgtagtgatgttgctagagtttcctgtcttctcatccttccattgtaacaatcagatatatatgcgtcttagcataaagttgttgagatactaatgctagcgacaactatgttgacttgtcgagtatgtagagatgggctcatcattttttgggtgagcatgatcataagtgcctgagaaaaaaaaaaaaaaaaaaaaaaaaaaaaaaaaaaaaaaaaaaaaaaaaaaaaaaaaaaaaaaaaaaaaaaaaaaaaaaaaaaaaaaaatttccccccccccccccnnggggggggnnnnncncccnccccccccaaaaagggggggg

SEQ ID NO: 6072 - DNA, 1469 bp, Zea mays
gcacgagaccattacctagaacatcctaatcaaaaagattctgtttgtttcggttcgacagtaataatccggtcaagccgtagaaacttgataccgctgcggctgccccacgagggtgaatcgttacggttcggatattatcttctccgctccgcatcctctgtgtattttcaactcgacgcgttcgttcctatggcgggtccgaggaacagaggaaaccgcacacacccgcaaggatggcggtggcggctaggctctaccactcccgttcgccggagctgtagggcactttcggcgccatggcgatgtggtttggtggcagccggtctgcggcggccggcggatgccgtgaggccagcacatgcaatgcaacgctaggctatggctcaggcctcagggcggtggcgggcctggcggcgcggggagcgggttgcatctcgaccccttggcgtcgtgcactcatgacgagttgcagccaatgcaacatgggcataacagctgttgaagttgccgaccaaacagcaccttaaaaccgttcggttccataggaacaaagggctcctgttgcgccaaataagcagataagtaaaatggtggaagaggccgctaggttctctaagctgttctgtgatagaaacctgccgatctttgcattcctggatacccattatccagataagccggagccaccgtatcctcctcattgtatcattggtactggggaggagaacttcgttccagacctggagtggttggaaaaggagccaaatgtgactataaagaggaaaagttgtattgacggctacatcagctgcatagaggaggacgggtctagtgtttttgttgactgggtgggaaaatatcagatcaaaactgtcttggtactcgggatatgcacggacatctgtgttttggattttgcaagctcaactctggctgctcgaaacattgaccgagtgcctccattacgagatatcgtgatttattcagagaggtgcgctacatatgactttcctgttgagatcgctatgaatatcaaaggagctcttgcccatcctcaggacctgatgcatcatattggactctatatggccaaaggaaggggtgcaaaggttgttgacagggtggttattgaaccttgaataaaaaaacttccctcatcgtagtgatgttgctagagtttcctgtcttctcatccctccattgtaacaatcagatatatatgcgtcttagcataaagttgttgagatactaatgctagcgacaactatgttgacttgtcgagtatgtagagatgggctcatcattttgtggtgagcttgtacatatttcctgagattactttgtcctgccaaacatgcgccagttctccattggttgctaatgttcggctctgggattgtatattcgtatttaataaaagtacttcctcccaaaaaaaaaaaaaaaaaaaaaaaaaaaaagcggcc

SEQ ID NO: 6073 - DNA, 882 bp, Zea mays
  misc_feature (841)..(841): n is a, c, g, or t
  misc_feature (852)..(852): n is a, c, g, or t
cattgggtacctcgaggccggccgggattaagatctgtacccccggccgcgccggagtgtgcacgcgtgaccgcgaaaagctgtttagacctcctctcctctcctcggctgctgccttccgctgacctcgccgtgccattgagatgtcatagaacctgccgagccggtcgcaggcgcgaggagaatggggacggaggccgatgccgcagccgtggactcgcttcggtcgcagatcccgttccagaccgacggggagctcatcctcccgccgcgcgatgtggggctcgtcctcgtcgacctctgcaacggcttctgcaccgtcggcgccgggaacctcgctcctgttgcgccaaataagcagataagtaaaatggtggaagaggccgctaggttctctaagctgttctgtgatagaaacctgccgatctttgcattcctggatacccattatccagataagccggagccaccgtatcctcctcattgtatcattggtactggggaggagaacttcgttccagacctggagtggttggaaaaggagccaaatgtgactataaagaggaaaagttgtattgacggctacatcagctgcatagaggaggacgggtctagtgtttttgttgactgggtgggaaaatatcagatcaaaactgtcttggtactcgggatatgcacggacatctgtgttttggattttgcaagctcaactctggctgctcgaaatattgaccgagtgcctccattacgagatgtcgtgatttattcagaggggtgcgcttcatatgaccttccctgtgagatcgctttggattttcaaggggctcttgcccatcctgangcccctgtgcntgttttttggctctttttgcccaaggtagg

SEQ ID NO: 6074 - DNA, 3331 bp, Zea mays
gggccggggagactccactccacgtctgtgtcctcttcatcgcaactgcctctgcccgcccgcgccgcggtttgtttgtgtgtcggagaacctcccggctccccgcagtccccctggcctcgcagatccgcggcctgcttcgttgctgccttgccagcaagcagccgcgctcatcctcgcggacgccagcggcggggcagccccctctcctgtgatccactccggcgcccgtggccgcggttgctcccgtaggtgccgccgcctcctcctccccctcttcatcctcctcccagatctatccccgtgcccgcggcacctgccggcgtcgtgaaatcaagtggcttgacggcaaaaggaccctttcaatcaaagagaatttggtcgctgaggctggaaaaaatctggatgtgtttaacttttagggcttactatttttgagaggtggtctgacatagactatccacaattcagcgccaggtctcagggagcgacctaccccaaggtggggagttcgttccttttccagtaacgaggagggcaaactcatattccatcatgatggaagaggacatggaaaatggaaggtcgtatcaagaaagaccaaggactttttcaacagtacgaagcaagtcatctatcccgctggccttacgtttgttgatgaggataaatccccgtgccttgattattctttctcttttggtattcagtggtgtgctatatgtgggagccagtacatcaccaattgtggtctttgtgttctgtatatgtactctcagtctattcttctctctctaccttacaaagtgggttcttgctaaggacgaaggaccaccagaaatgtctgagatatctgatgccataagagatggtgctgaagggttttttaagacacaatatggaactatttctaaaatggcatttattctggcctttgtcatccttggcatttatctctttcgcactactaccccacagcaggaggcgtctggcttgggaagggcaacactagcctatattacagttgcttcttttcttcttggagcattatgttctggaatagctggctttgttggaatgtgggtgtctgtgcgtgcaaatgtacgagtttcaagtgctgctcggcgctctgcaagggaagcattgcagattgctgtccgtgctggtggtttctcagccatcgtagttgtttgcatggctgtatttggcgtggcaatattgtactcaacattttatgtttggcttggagtagattcacctgggtcaatgaaggttactgacttgcctcttctccttgtgggatatggttttggtgcctcttttgttgccctttttgctcagttgggtggtggaatatacaccaaagctgctgatgttggagctgatctggtcggaaaagttgagcagggaatacccgaagatgatcctcgtaacccagctgtcattgctgacttggttggtgacaatgttggagattgtgctgcccgaggcgctgatctttttgagagcatagcagcagaaattatcagtgcaatgatacttggaggaactatggcacaacgctgtaaaattgaagatccctctggctttattttgtttcctcttgtcgtccattcatttgatttggtggtgtcatcagttggaattctctcaatcagaggaacacgtgactctggactcatttctcctatcgaagatcccatggcaattatgcaaaaaggctactctgttactattatgcttgctgttcttacgtttggggcgtctactcgttggcttctgtacacggaacaagcaccttctgcatggctgaattttgcattgtgtggcttggtggggatcgtcacagcatatgcttttgtttggatttcgaagtattacacggattataaacacgagccagtccggcttttagctctttcgagttccacaggacatggaactaatattattgctggagtaagcttgggaatggaatcaacagcactaccagttctagtgataagtgttgccattatatcagcatattggctggggcagacctctggcttggtggacgagtctggcaacccaactggtggtctttttgggacagctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactaaagctactacgaaaggatttgccatagggtcagcagctctggcttccttcctcctgtttagtgcatatatggatgaagtagcttcttttgctcaattgccattcaaggaggttgatatagcagtcccagagatttttgttggtggtttattaggctcgatgcttatattcctgttcagtgcatgggcttgctcagcagttggcaaaactgcacaggaagttgttaaagaggtcaggagacaatttattgagaggcctggtatcatggactacaaagagaagccggattatggacgctgtgttgcaattgtggcatctgcatccttgagagaaatgataaagcctggagctctagcaattatatcacccatggccgttggcgttgtcttccggattttgggccactacactggtcagcctcttcttggagctaaagttgtagcctccatgctgatgtttgcgacggtcgctgggattctcatggcactcttcttgaacactgctggcggcgcctgggataatgcaaagaagtacattgagactggcgctcttggtggcaagggcagcgagtcccacaaggctgcggttactggcgacacggttggagacccattcaaagacactgctggaccgtcgctgcatgttcttatcaagatgctcgccacaatcacgctggtcatggctccgatattcttgtgattaaccaaccactcatcaagcttgctattaaccctgcggagatgtacctatgcgaccaggtagatgaggtgtgtgtgtgtgtgtgttacctgcatgtgatgatgtaacggtccaatcggtttgtgtcacgacatgctgtacccagagaaagaagcggcgatctatacccatgtctcacggtagatattatactgatgatgcaaatgccgtgttttgttactgaattagtggcctgaaagttgcgcttgttgattgatgaaacattatggtagcgtacttgtatgctgcatcccacaatggattttatgatgtggaccccgaatgttttgcttatacaatgtttgctatgcatgcatgtatgtgtttgtgttcattc

SEQ ID NO: 6075 - DNA, 2259 bp, Zea mays
  misc_feature (6)..(6): n is a, c, g, or t
  misc_feature (35)..(35): n is a, c, g, or t
atacgnacacgcgtccgcggaccgtggcgactggntatattatgtttggcttggagtagattcacctgggtcaatgaaggttactgacttgcctcttctccttgatgggacatggatttggtgcctaaattgttgccctttttgctcagttgggtggtggaatatacaccaaagctgctgatgttggagctgatctggtcggaaaagttgagcagggaatacccgaagatgatcctcgtaacccagctgtcattgctgacttggttggtgacaatgttggagattgtgctgcccgaggcgctgatctttttgagagcatatcagtagaaattatcagtgcaatgatacttggaggaacaatggcacagcgctgtaaaattgaggatccgtctggctttattttgtttcccccggggccgcgcccggttgatttggtggtgtcatcagtcggaattctctcaatcagaggaacacgtgactctgggctcatttcccctatcgaagatcccatggcaattatgcaaaaaggctactctgttactattatgcttgctgttcttacatttggagtgtctactcgttggctcctgtacacggaacaagcaccttctgcatggctaaattttgcattgtgtggcttggtggggatcatcacagcatatgcttttgtttggatttcgaagtattacacggattataaacacgagccggtccgccttttagctctttcaagttctacaggacatggaactaatattattgctggagtaagtttggggatggaatcaacagccctaccagttctagtgataagtgttgccattatatcatcctattggctggggcagacctctggcttggtggacgagtctggcaacccaactggtggtctttttgggacagctgtagcgacaatggggatgcttagcacagcagggtatgttctcaccatggacatgtttggtcctatagctgacaatgctggtggtattgttgagatgagccagcagcatgaaagtgtgagagaaatcacagatgttctagatgctgtgggcaacacaactaaagctactacaaaaggatttgccataggatcagcagcactggcatcattcctcctgtttagtgcatacatggacgaagtagcttcttttgctcaaatgccgttcaaggaggttgacatagcagtcccggagatttttgttggtggtttattaggctcgatgcttatattcctgtttagtgcatgggcttgttcagcagttggcaaaactgcacaggaagttgttaatgaggtcaggagacaatttatcgagaggcctggtattatggactacaaagagaagcccgattatggacgctgtgtcgcaattgtggcctctgcatccttaagagaaatgataaaacctggggctctagcaattatatcacccatggccgttggcgttgtcttccggattttgggccactccactggtcagcctcttcttggagctaaagttgtagcctccatgcttatgtttgcgacggttgctggtattcttatggcactcttcttgaacactgctggcggcgcctgggataatgcaaagaagtacattgagactggtgcccttggtggcaaaggcagtgagtcccataaggctgcggttacaggcgacacggttggagacccattcaaagacactgcaggaccatcgctgcacgttcttatcaagatgctcgccacgatcacactggtcatggctcccatattcttgtgattaaccaaccagatttatcaagcttgccattaaccctgcggagatgtatctatgcgacttgtagatgaggtgtttacctgcatgtgatgtaatgatccaatcggttttagtgtgactacatgttgtacccaaagaaagaaagaaagaaagcagcgatctgtacccaggttttaatggtccaatcggttttagtgtgactatatgttgtacccaaagaaagaaagaaatcagcgatctgtacccaggtttgacggtagatattattctgaatttctgacgggtagtgatggtgcaaatgccatattttgtgacggacgtcactgaactagtagcccaagtgttttgtgattgtttattgctgggaacattatgacatccgttgagcttagctgtaagaaaggaacgatccacgatggattttaggatcgtgactgggtctacaccgtaccttggacgcttcccattaacaaacaacctgatgtgttgtaatggtggt

SEQ ID NO: 6076 - DNA, 1320 bp, Zea mays
gacattcgtaaagttaagtttttctgcactctaggctaaacttcactgacgctacggaaggggtctcgaagagctgccaagacccacctgccacctccgatggacttcgccggccgggtatccttcctgctcttcttcctggtcgctggcactgtagcaaacgaccagatcttcaccacttcaggtttgccatttgggcgaagttcgcgtgagccaaggtaccgcgtcgagttccatcctgttgattcgccattccatccagataatggtcaggaatcggtaccaatggctagtcatgaggggaagcgttataagtgctttctaccagttgaagaaactaaaaccatgaagtcaatgctcccacaaaatgcgactaatattataatagaaagtgaaaggcgaattaagccaaaggagccggatgagttacttgaggttctcaaggatcagtgtttctacaggcacgaaggttggtggtcgtatgaattctgttattatgggaaaatcagacaggtccatgtagaggacagtaaggttatccaagaatttgttctaggcgaattcgatgatgacgcaactgctgcataccatgaaaatagcacctctgagttaactgacgatgaccatcacgtgaaagatatatctaagaggtatcatgttcacttgtatacaaatgggactgtatgtgatctcacagatattccccgggagacagaggttagatttgtctgctcggagcctactgtgctgattagttcagtcaaggagatctcttcctgcaaatatgttgtaacaattcaaagcccgatgctttgcaaaaacccgttgttccagcaagaaaaacgaacccttcccatccattgcaatgaattacctgctaaagcagaatccggtgctgaggatggtttgcttccaaaagaagcgcagatttccatcatccccgatcaggatgagctgcatggttttccagcttatgctacttgatataatgatatgccttcaatatttatttctggtgtagaaaaagcacagttttggaggcccagtggcaactgagcaacgcgatgtattactctctccgttcttttttatttgccgtggtttagtttaaaaattacgacaaatattggagaacggacccatagatcctacagcagcggctccttgtaaagcaggttgagacgatcattctgcagtgctaattatttaggaggattacgaaggtagaaagtttctcagtattagtaaatgtaacaagtttgagacagtaacatttgcttgaaatgtctagtctataacaaggacaatactgcattcttg

SEQ ID NO: 6077 - DNA, 1520 bp, Zea mays
aaatcaaaggcggtaaactcggcgtagacggagactgcagacgcccggaccacaggaacaccgaagtaccgaacactaccggccacacgctcgagaataggcggcggtgcaggtcctcctccatctctgtcgtgggttcaacttcactgtgaatacgctgacgctacgagaagtcatcacggaaggggtctcgaagcaaggtgcaaagactcacctgccgtctctgatgggctttgctggctgggtatccatgctgctcttcctcctggtcgccggtgctgtagcaaatgaccagatcttcaccacttcaggtgtgccatttgggcggagttcgcgtgagccaagttaccgcgtcgaattccatcctgttgattcaccattccatccagagaatggtcaagaatcggtaccaatggctagtcatgatgggaaacgttataaatgctttctaccagttgaagaaactaaaaccatgaagtcaatgcttccgcaaaatgcaactaatgttataatagaaagtgaaaggagaattaagccaaaggagccagatgagttacttgaggttctcaaggaccagtgcttctacaggcatgaaggttggtggtcgtatgaattctgttatcatgggaaaatcagacaggtccatgtagacgacgataaggttatccaagaatttgttctaggcgaattcgatgacgacgcgactgctgcataccatgaaaatatcacttctgagttagttgacgatgaccatcatgtgaaagatatatctcagaggtatcatgttcacttgtatacaaatgggactgtatgcgatctcacagatattccgcgggagacagaggttagatttgtctgctcggagcctactgtactgattagttcagtcaaggagatctcttcctgcagatatgttgtaacgattcaaagtcccatgctttgcaaaaacccgttattccaggaagaaaaacgaaccctctccatccactgcaatgagttgcctgctagagcggaatccagcgcggaggatgactcgcttccaaaagaagctcagatttccatcatccccgatcaggatgagctacatgatttcccagcctatgctacttgatttgcctccaataattatgtttgatgtagaaaaaaaaacaccattttggaggcgcaggggcaactgagcaacactatgtattaactatctcgtagatactacagcagaggctccttgtaaagcaggttgagacgatcattctgcagttcttattatataggatgattacgaaggtaacatgtttgggacagtaacatttgcttgaaatgtatatagtctacaacaagaataatgccagcattcttgaaatgtagcgcctaggtgcgagcacttttacgtgtgacgaacgatctgctgtcggttgagatgaaaaggcgttcgccttctattaaggatgtaaatggtacaaaaggatgtaaatggtacagatattatctgttcgtatttaaatttaatccggtttgagatt

SEQ ID NO: 6078 - DNA, 1878 bp, Zea mays
aattcggcgcgcccctccggctccgccgcgacggaatcagacggtctcctcctccttttctttctcccgtggactgcagcgccgccgggtagagatcccaaatctgcgcctcgaccaattcctccttcctccgagaatggtgatcctctatccagggtgtgttgctccatcagttcaccgtgattttctgcccagatgggtgctgctgaacaacagctcgagaatgtactgccatgtctttccagatagaacgaaaccgaaaaggcaatacaggcatcagtgggtgccttgcttctccaagggatcttcgttccaagatccactgccctctgtaaagcctttacgccttcttccagcagaggaactaaagacatatcccaacactgttcctgaggagatatttaacacgatcatactagatgactccgatgcattctatgtgctagaactgagcacgagtagagaatttagttcctctttggataaaaattctgcaatcttaatctgcctatttgatgtcgatggtgactccctattacaaagagtaccggcaatctatttgggtcaacctacacatggatttaagacagagcagcagatacccttccaaagtggttcagttgatatcgttactttcaaggggtcaaaactgaaaacgattaaagaagtctggatcggtcttgaatcaggtcaggttcatggagattagatggtttgagcttgaaggtaatacatggaccagttggtcagcctaaagaaataaatggaactccagaacagaagttcagcggtttgcagtacacttttgagaatgtaaatgtgtttcttggagatgatggagcttcagtagctgaagcaaggccgacggctatcactgatctctcaggagtcggcctttccgatcttcaacaagggctgttatcctcaagaagcaaagcttcaagcattaaggaagtaagagaggatgggttgagagagtacgccgaccttaaacaatctctgctgctctatgacgcatctatagtgataaccggcttctctaccttcatcttggcttcaaatgacagcgctgcctattcgttcctgataggcggcattggcgggttcctgtacctgttgctgctccaaagatcggttgatggtttgcctgtgattggttcaccttcagaagctggcggtgcacagccttcggtaaaaagtttcagcggtgtaaggaggccatggttgatactatcactagtactggttgcaggtgcagttgcactgaagtatggtgctggaggcgacagctttgcgctcacacccaccgacctctttgttggcactgcagggttcctagcaaacaaggttgctgttcttcttgcagcgttcatgcctatgctaagtgactcaaagagtgaagatggatctggtgacaacagttaattggacttctttaaaaaatatgttagtaatagtttcctatagaagatctgtattcaaggctggaacggaattagctgcaaagggcaagccctagtttctgaactggaaaaaagatccctctcatcttggtgactgggtcatctttgcaagggttcaattcacagcaagagttcaagtgttgtggcagtttgaagtcagaaacttaagttgtatttttcagacatgcaggacagctgtgtatcattatatcaagaagaataagaacaaaagtctaggaaactttgaagcacccttagaaaggcatgaccagtacagcagaagaaaaacagagacacaaaaactaaggacatggacataaactacggacatgaccagtacagctgttgtatgtaaaaatatgacatttgtgaggttaaatacacagtaactatcgaaacaaaaaaaaaaaaaaaa

SEQ ID NO: 6079 - DNA, 2251 bp, Zea mays
gaacgcgtccgcctcttgcctccccacacgaagaggcgggccgcccgccaccagctccacctccacggaatcagacggtctcctcctccttttctttctcccgtggactgcagcgccgccgggtagagatcccacatctgcgcctcgaccaattcctccttcctccgagaatggtgatcctctatccagggtgtgttgctccaacagttcaccgtgattttctgcccagatgggtgctgctgaacaacagctcgagaatgtactgccatgtctttccagatagaacgaaaccgaaaaggcaatacaggcatcagtgggtgccttgcttctccaagggatcttcgttccaagatccactgccctctgtaaagccttcacgccttcttccagcagaggaactaaagacatatcccaacactgttcctgaggagatatttaacacgatcatactagatgactccgatgcattctatgtgctagaactgagcacgagtagagaatttagttcctctttggataaaaattctgcaatcttaatctgcctattcgatgtcgacggtgactccctattacaaagagtaccggcaatctatttgggtcaacctacacatggatttaagacagagcagcagatacccttccaaagtggttcagttgatatcgttactttcaaggggtcaaaactgaaaacgattaaagaagtctggatcggtcttgaatcaggttcatggagattagatggtttgagcttgaaagtaatacatgggaccagttggtcagcctaaagaaataaatggaactccagaacagaagttcagcggtttgcagtacacttttgagaacgtaaatgtgttccttggagatgatggagcttcagtagctgaagcaaggccgacggctatcactgacctctcaggagtcggcctttctgatcttcaacaagggctgttatcctcaagaagcaaagctttaagcattaaggaaagtaagagaggatgggttgagagagtacgccgaccttaaacaatctctgctgctctatgacgcatctatagtgataaccggcttctctaccttcatcttggcttcaaatgacagcgctgcctattcgttcctgataggtggcattggagggttcctgtacctgttgctgctccaaagatcggttgatggtttgcctgtgatcggttcaccttcagaagctggcggtgcacagccctcggtaaaaagtttcagcggtgtaaggaggccatggttgatactatcactagtactggttgcaggtgcagttgcactgaagtatggtgctggaggcgacagctttgcgctcacacccaccgacctctttggcggccctgcagggttcctagcaaacaaggttgctgttcttcttgcagcgttcatgcctatgctaagtgactcaaagagtgaagatggatctggtgacaacagttaattggacttctttaaaaatatgttagtaatagtttcctatagaagatctgtattcaaggctggaacggaattagctgcaaagggcaagccctagtttctgaactggaaaaaagatccctctcatcttggtgactgggtcatccttgcaagggttcaattcacagcaagagttcaagtgttagacatggaggacagctgtgtatcattatatcaagaagaagaagaagaacaaaagtctaggatactttgaagcacccttagaaaggcatgaccagtacagcagaagaaaaacagagacacaaaaactaaggacatggccataaactatggagctttttggctttcgccatacagcacaacttgatttcatcttagaaacttgagttgtagtatagtatactcacatatcggacactgaactgttaagatgatataccgactacagctttgttgtatgtaaaaatatgacatttgtgaggttaaatacacagtaactatcgaaacaaaatgcttggcgttgctccaaatcagcatcgtcatctgagtattttcttgaactggaggctctagagcgattgtagattcactcaacacaacattagcagtatacgactgaaaagttcctgtcaagttccgctgaacagtaattattattttttaacttattatcttatacagatctgagatgaacaccatttcctaggcagaattatcattatattcaattgtaagtattttaccagagtccatagatctagtcaccgcccacagcgtggtacctagccaggtggctgca

SEQ ID NO: 6080 - DNA, 3519 bp, Zea mays
  misc_feature (840)..(840): n is a, c, g, or t
  misc_feature (966)..(966): n is a, c, g, or t
tatgtggtgctttcatatgtccaatgcatgttgaaaagacgagaggatggaataaccatcaaccaacctttggccaatcagaggtccttagtctaatttgggagatttagtgactaaggacacttgttggtactaatggtattggctgggacacttgttggccttggacacagaagtggtgctatcctcaatttacccagtttgttttcataacaaacccagctactgacagctcaatgacaccaaagtggggttgcatcagcaactcggtatctagtagctgacaccttaggtctttgttggtattgcaatatccttttttagatatagggccttagccccttgccttttatggcgacacatgtggcaacttgaatttcacagggcttagggcctgtttggtcacttaggtttagtcacttaggagctaaggatccaaacagaaagagctaaaagtgactaaaatggtaaaaaacattattttagtcacttttagctcttaaggagctaaaatttagtccctgtttggtttcattagtcttaggactaaagtttagtccctagactaaattttagtccctaccctgtttggttatagggactaaacagattctgaacatattaaatgtaatatataatgactgaaataccccttgccttgattcctgtgatcgtcgccatctcaactgtactgtgaacgccccctgtttttaactttttatatagtattattttggaataatagcaggactgcaggagtgccatgctatttccgtctctctctactttttttcccttccctgagccctcgagtgaaatactactggctagggtttagcnttcgggcgacggaagggttctgagcatgggcaagggtaaccggtggaaaaaaaaatcctgtagtcccttttagtacctctttaagggactagactagagactaaagccaactagtccctactttantctttctgtttggtataaaaaggaataaacgggactaaaaaccaggggctaatccaatcaaacgggcccttagtttgttttagctcctggatccaaacaggcccgcacctatgcagctccacatgtttagttcatcaacaactttattgcgtatgcagctaagcccattaatggttctttgggtccaaataaggcaactgtttattaggtcagttttgtacttgtacaatacttaattttaaaactatataccgtgaatacagacaggttttggtgttgtgataaagtagttggttactgcgtttgttttctgtgctcagtcgtacagatgaacttactagttgaactgagttctttttttaaaaaaaattgtatcttgaacaatgactagatgtctcactccacatacttttctctgacttcatgacctaacactgttgtttattgtatcagagagagacggttttgtgtgatcatgaaatacttgccaaaactaaggacacagttattttctcctaccttgcatgcggagcaagctcagaatctgcaactacttcagttaataacaggtcgtacagtggagcagcacaaagatctgatgatgtcacagtagatagtactatttctgggaagaaaaccataaggttttctctgaataacagaggtgctgatagaaacacagctgacagctcgaggacattgctatcattcaaacgcaagttgagtgagaggggaccacgagctggtaagcaacttccgcagaggccaactattgctgcagagaaattagaagatgaagacaagaagacaactgataagaaggtttgtaccttttacccccctttttatgtttcttttcctttgtctcattgtactgatatgtggagcagataactatgcaacagagagaaatgtttcaaaaggagctcattatgacatctgatcaagcttctacacagaacctacgccttcctaaaggatatgcttatgttcctcgggactctttatctaaagagaagctatggaaacaaaatacacagccccataatccacaggagcctggtggataggatcagttgaaatcaagccggttcatttctatcgaggaaggccataaaaaacttgtgcaagcttgttctttgcaactgaaaactacaagcggcaagcagggcaggccagcgctattgccacaagggtaacagcgaatccgtgatcttttttggaccgaagttgcataatggtgcagactgtgctatttgtgtgaacgtatggtgtggcaccataacaagaaggctgcctcccacccacccacacaccaggtaccttgaatatgaccagcaatatgggtgaattgacctacctgtgctataccaaagagagcgtgccaactgtatatatgagtttaatttgtgcgcagattttgtaaatttgccctgtacattcttttcctttgcatatgctagtttagttgtgcaggaaaaagggaattatgaatccttttaggttggataagaaaaggaattagcttggttctttatcatggttcagaagaaaatgcggtggtgcttgcggacaacattgggcaggagtgttggtttgatacatgtactctgtagggatggtgaaggtgccaaaaataaggtcatgccactgctttaacgcaactatttgttgttggttactgggaagtggtatcgtacaggctgagaaacaatgttttactgttttagataattgtcgccggtggctttccatgtccccttatgttattgggaaacactagtccctttagggctcgtttgatggacatgaaaatggagatcattgccgccttgggaagggatccccttgctattcaattttgaataacaaggggatctccttcatttcactgtccaccaaactaacccgaactggtttcgagatgtcaagatagcaacaatgttgaaataggcctgtaagttctttggtcgagaaggtatggtagctgacattattttttaatttatacatggggtatattgtatctgggacgggctgttttctgcttgccgtccagattatagccttggttaggcgtatttagtaatttgctcataatttagtggttcatgttttgaattcttttgctcgaaatctggaaaggtcgtgtctggtaaatataaaatccatttccaaattatatgtcatattagctttgttaagtcaaccatttgtgattttggtaactttaataaatgtgttgcaatacgtggggaagaccctacctcaaaatactaccaagatgtattcaattatcttggtatacaaaattaccgtaggattcatctattggggctgcggttgtcctagctcctggggctccatggtctagggacctaccttggctgtgcctaaccctatggggtacttgatctcgggccgagtggatcctctgtcgataattgccgggacgtagccctggtcgtctcactccgtgctggcccagtcggccctccccacggttacatttgtgctgtgcctgatagagggacccaaaatacacaatttcta

SEQ ID NO: 6081 - DNA, 2222 bp, Zea mays
cgacctgcaggagtgccatgctatttccgtctctctctactttttttcccttccctgagccctcgagtgaaatactactggctagggtttagcgttcgggcgacggaagggttctgagcatgggcaagggtaaccggtggaaaaaaaaatcctgtagtcccttttagtacctctttaagggactagactagagactaaagccaactagtccctactttagtctttctgtttggtataaaaaggaataaacgggactaaaaaccaggggctaatccaatcaaacgggcccttagtttgttttagctcctggatccaaacaggcccgcacctatgcagctccacatgtttagttcatcaacaactttattgcgtatgcagctaagcccattaatggttctttgggtccaaataaggcaactgtttattaggtcagttttgtacttgtacaatacttaattttaaaactatataccgtgaatacagacaggttttggtgttgtgataaagtagttggttactgcgtttgttttctgtgctcagtcgtacagatgaacttactagttgaactgagttctttttttaaaaaaaattgtatcttgaacaatgactagatgtctcactccacatacttttctctgacttcatgacctaacactgttgtttattgtatcagagagagacggttttgtgtgatcatgaaatacttgccaaaactaaggacacagttattttctcctaccttgcatgcggagcaagctcagaatctgcaactacttcagttaataacaggtcgtacagtggagcagcacaaagatctgatgatgtcacagtagatagtactatttctgggaagaaaaccataaggttttctctgaataacagaggtgctgatagaaacacagctgacagctcgaggacattgctatcattcaaacgcaagttgagtgagaggggaccacgagctggtaagcaacttccgcagaggccaactattgctgcagagaaactggaagatgaagacaagaagacaactgataagaaggtttgtaccttttactcctttttttatgcttatttccttccgtcactgtactaatatgtggagcagataattatgcaacagagagaaatgtttcaaaaagagctcgttatgacattagatcaagcttctacacagaatcaacgtcttcctaagggatatgcttatgttcctcgggattccttatcaaaagagaagctatggaatcgaaatacacagccacttaatccgcaggagcctggtggataggatcagttgaaatcaagtcggttcatttctctcgaggaaggtcatgagaaacttgtgcaggcatgttctttgcaactgaaaacgacaagcggcaagcaggggctggccagtgctattgccgcaagggttacagccaatccgtgatcttttttggacccaagttgcataatggtgcagactgaggtattcgtgtgaatgtatggtgtggcaccataacaagaaggctgcccccacccaggtaacgcgaatgatcagcaatatgggtgaattgacctacttgtgctataccaaagacagcgtgccaactgtatatatgagttttattagtgtgcagatttcataaaattgccctgtacattctttcctttgcaaatgctagtttagttgtgcaggagaaaaagaattataaatccgttttggttggataagaaaagaaattagtttggttctttatcatggttcagaagaaaatgcagtggtgcttgcgggcaacgttgggcagctgtttgcctgatacatgtactctgtaaggatggtgaaggtgccaaaaataaggtcatgtcactgcttttcgccaactatttgttggtgctaactgggaagtggtatcatacaggctgagaaactgtgttttagctcttgtcgccggtggtttccgagagccccctttttttaaggggaacagtggtctctttaccggtttttagatatcaagatagcaacaatgttgaagttgggctgtaagttcttaggttgagaaggtatgatagctgagctttttttttttcaatttacatgtggggtatattgtatctgagacaggtttttttcctgcttgccgtccagattataaccttggttgggcctgtttagtaatttgttcggaagcggttcatgttttcaattctattgctcgatgtctgcagagatcgcc

SEQ ID NO: 6082 - DNA, 2997 bp, Zea mays
gatttttaagaaaatatctggaaggacgtagatttataaattggtgctttggacacgacctagaatgcattatgtggaaagagaagccaagcttggaggcaggacaaaaacaaatgtgagggttgaagctaattagctggctggatgtgtggacgggcatttgaactcctttgtgagttgttggtgttgactccgcgggtgtgcttagaagacactaagggcctgtttggttcgtggttaactgtgtcacactttgcctaaggttaatcgttcaaattgaagaactaatcttagatagaaaagttagataaagtgtgacaagttagacagcgaactaaacaggccctaaatatttgcaaagaaataaagcaggggcaacctacttttctaaaaaaaagaatttaatcgaatgctctatcaaacgtcacgtttgtgcacgagaacacttgtgggccgtttgagacgaaagcgccacacaggctcaggaagcccaaatagcctatccgaacccagcacgagatgaaagcaaaccccacatagcctctctttctcgttccgtcgttcgcacgcacgcacgggcccccccggcctcacccagagcgcagaacccccaaccccacttgtcgggcttcggctcttcgcatcctgcccgtcccccgtcacagtgtcccaatcgcaacccccgcctgcagcacgcgtcacgccacgccacctctccccagggtccggcgatgtcggcgccctccgacgccgcggtggcagccgcagcgcccgcatccacgaccaccgccgccgcctccagcggtgggctcaccttcaagctccacccgctcgtcatcgtgaacgtctccgaccaccacacccgcgtcaaggcccaggccgcctgctccggggacagctcttccccctcctcgtccgccccgggggccgggcagccgccgagggtgttcgggtgcgtgatcggggtgcagcgcggccggaccgtggagatcttcaacagcttcgagctcgtgctcgaccccgtctccggaaccctcgaccgcgccttcctcgacaagaagcaggagctctataagaaggtgttccccgacttctacgtgctcggttggtactccactggaagcgatgtgcacgacaccgacatgctaatccacaaatcattgatggatattaacgaaagccctgtttatctcctattaaatcctacaatcaacctctcccaaaaagatctccctgtgactatctatgagagtgagttgcatgtcatcgatgggattcctcagctcatcttcgtcagatcaaattatacaattgagactgtagaggctgagaggatatctgtggaccatgttgcccatctcaaaccttctgatggtggctcagcagcaactcagttggctgctcatcttacaggaatacacagtgccatcaagatgctcaatagcagggtccgtgttatccatcagtatcttgttgccatgcaaaaaggtgacattccaatggacaattcgctgcttaggcaagtctcaagccttgtaagaaggctaccggctacggaatcacagaaattccaagatgactttttaatggaatacaacgacactctcctcatgacttacctggcaatgttcactaactgttcaagcacaatgaatgagttggtcgagaaaatcaacacaagctatgagagaccgactaccaggagaggaggccgaggtgctttcatgtagctcacctgccatgatcctgctgctgctttcatctgtgaggatttttcgggagtagcttatgtccctggtcattttttgcatgcaatctatcatgcgcaatcggctatacggcagctcttgagtcacttcaaactttctaggcaaaactgatgatttgctggaattgtatcagatcccacctgtgctgaagttgatatgtaaagttcctcacccagttattctatttgactctaaggctagtttggaaacttcaatcctcttcgggattagggtgtattaaaggctagtttgggaatctccttttcttaagagaaattagtttattttctcttgagaaaataagaatcattcggaaaaatgtagttcccaaactagccttaaacgtggaaattagttcatttctctttaaatccccttcaatcctggaatggatttgagtttttaaactggtgtagtttggagactcaaatccccttcgggatcttcgggattgaaggggatttgaagagaaataaactaatttccccctcctctggctagtttagaaactctaatcccctccgggattagaggggattgagggagaaattagtttacttctcttcaaatcgctttcaatcccaaaaggaatttgagttttcaaactagccctaaaagggatattaatgctggtttcgtcacattcacggtcaacaaaacttaaatcatttgttacgctgcttgatgtaacgctatgatcaatgagcagggcagagcgcagcgaccccatcatagtgggagaaatattttgtgaataattacattgtatacatcttatttcttcttgctgctaatggattcatggacgcaaaagtgaagattatataatttaagaatcaaccgagcgtcatgatattttagcttcccttttcactttgaatattacaatctcatgaatcaactcatcctagcttctcttttcacttccttttgctacgaagattacaatcttacgagtcaattcgacaccatgatgtcctagcttttttttcacttgattctggtaagagttctagtatgtgcctagctttagatgtcgactttgtttttatcttagactatctccaacaacttactcatttttataccattatccaaactctactttgtggttgggccaatctaaagtgcagaatactgcaaatcggtgtttttgggtaaactatgggctactgtagacgatcttatatgtgggcgatatgacttctcttaggtctcccttttggat

SEQ ID NO: 6083 - DNA, 1530 bp, Zea mays
cccaaccccacttgtcgggcttcggctcttcgcatcctgcccgtcccccgtcacagtgtcccaatcgcaacccccgcctgcagcacgcgtcacgccacgccacctctccccagggtccggcgatgtcggcgccctccgacgccgcggtggcagccgcagcgcccgcatccacgaccaccgccgccgcctccagcggtgggctcaccttcaagctccacccgctcgtcatcgtgaacgtctccgaccaccacacccgcgtcaaggcccaggccgcctgctccggggacagctcttccccctcctcgtccgccccgggggccgggcagccgccgagggtgttcgggtgcgtgatcggggtgcagcgcggccggaccgtggagatcttcaacagcttcgagctcgtgctcgaccccgtctccggaaccctcgaccgcgccttcctcgacaagaagcaggagctctataagaaggtgttccccgacttctacgtgctcggttggtactccactggaagcgatgtgcacgacaccgacatgctaatccacaaatcattgatggatattaacgaaagccctgtttatctcctattaaatcctacaatcaacctctcccaaaaagatctccctgtgactatctatgagagtgagttgcatgtcatcgatgggattcctcagctcatcttcgtcagatcaaattatacaattgagactgtagaggctgagaggatatctgtggaccatgttgcccatctcaaaccttctgatggtggctcagcagcaactcagttggctgctcatcttacaggaatacacagtgccatcaagatgctcaatagcagggtccgtgttatccatcagtatctcgttgccatgcaaaaaggtgacattccattagataattcgctgcttaggcaagtctcaagcctcgtaagaaggctaccagctatggagtcacagaaattccaagacgacttcttaatggaatacaacgacactctcctcatgacctaccttgcaatggtcactaaatgttcaagcacaatgaacgagttggtcgagaagataaacacgagctatgagagaacgactagcaggagaggaggtcgaggtgctttcatgtagctcaccggccgtgatcctgctgctgctttcatctgtggagattttttgaaagagctaatgttctcgaggcagttttttgcatacattctattatgtgcaacctgctatacgcaggagaggaggccgaggtgcctgccttcatgcaggctacccggaggcattttttttttcatgcaatttattatgcgcaagcggctatacggcagctctcgactcacttgctaccttctaggcaaaaatgatgatttgctggaactgtatcaaatcctgcttgaagttgatctgtaaagttcatgtctcagttaggccttatttggttgggtgtttgtatctaaagggattgtatcgaaagagattggagaggattaaattttttttagttaaaaaaaaaagaaaaaaaaaaaaaaaa

SEQ ID NO: 6084 - DNA, 1402 bp, Zea mays
ctttgatcctttaaaaaggccccccccttttttttttttttttttttttctttttttttttttttttttttttttttttttttatttttttttttttttttttttttttttttttttttttttgaagcctcttcttctttctcccctttttattctacgagtattcgtttcaaacacaaacatcatccagggttacattgatctcttcatgcactttggagttcatagcaaccagataacagttgctgcaaccgaccaccacacacgcccatcttctttccctttcccttttttttttgctaggaacgcattcttcttttgaagtttttttttacgaactaggaactaagtaatacaactatacacccttcaactaccacacgccactgtacatgtgtcaaggaacacaaaaatgtattgtcaagcatcacatccaagaacgaaaaaaaaaatccatcaatcggtgtcgtcatgtatcgaagctgagatttcctgcatcccacattgcgcgtctcagcgttccagcgtctaccatatacctcctaatatgccctttttctttcatttggacgaaaatgttcggctcttaggtcgtggtggcctcgcttcatgctcaggagcatcactcctgccactgttattcttgccccgcagtggctcggtttctgaactctcagggattcggattggtcggtgtctcctttcctcttgaggtatgagttcgttagaatccaacatccggaccacctggtccatgctaggcctcttctcagcattcaaatcgatacacctcagagcagtcaaaagggcacgtttcagctcctttgtcgaaggccttctctcaaggtttgggtccaccacttgttcagaacgtctgttggcaaccatcattttaagccagtcaaccaggtttacctcatttgtagggcgatcataatcaattggatctctacctgtaatagcttccaacagaacaaccccaaagctatagacatcactcttttcatttagaagtccactgttagcatattccggtgcaacatagccaaaggtacccataactcgtgtagcaatatggcttttaccagcaccaagcatcttggccaaaccaaagtctgatattttggcattaaactcatcgtcaatcaagatattgctggacttgatgtcacggtgcacaacttttggttcaattgcctcatgtaagtaagcaagggcctttgcagttcccagaaggattttcatgcgagccaaccaagtgagagaactgtactgggacaattccccatggagccaactttcaagatttccattattcacatactcatacacaagcatcctttgagtaccctcacacacagtaacccaaaagggaaacccggcccggccggcttcgaggtac

SEQ ID NO: 6085 - DNA, 3226 bp, Zea mays
  misc_feature (560)..(560): n is a, c, g, or t
gctataaatacacctccaaccaatccattcaatacataagagctaagcaatacctctaatacataagtgcaacactcccaagtgttcaaagcctcctaagtgccacaaaagagagaatcaagcaatagaactagttcctttatgtgaattctggtagtgccttgagacagtgctagaagaaagagtgtgtgctgcgttcttgtggtcattgagcttggagtttcgattcccatcgattgtaaaaggttaacaagaacatccaagattgtggagcgccttgtggagacttcgatctctccattgagttgaggaaagagagatggcccaagtttgatctttagaatcacttgagagggttgaaatagacctgatcttttgaaaaccttaattgagacgtaggtatcgtttgaaaaccgaactccagtaaacaaattgtcgcatctttatgtttgattgattgcaaattgttttcttccttcctcttaagttctcttgcattattcttcattacaatcacttgtgtttctcttaagtttattccgcacattgacaaaagcaanacattgcaataagaacttatctccctactccgattgaattataccttgctttaaccaactaattaggatcaagttttgtattatgtgtcaaatttcatgtttcgtttatttacctccctctaggtgaatatcaatatatcacatgtacgatatgatgtaaagtcaccaacaatatattgagacagaaaattcatcaataattaaaagtttattacacaactggattcatattagaatatgtttatacgagtattgtgtgagaatatgcatgcacaaatgagagaaggcaagttgtggagcctttttatataaactacaaatgcttagatctcttcaagttattagcccatgcaatagcacaggttgtgggactagtgtaaaaataaaaaaaatataaagataatataggacttactaaaattcaaggatgacatcggggtggggcacacgatttttggacccggtaggggtggggttgatttttcctctgcgagtctgcatgtttgaggacctgaactataacggtgtctggagcgggattttttatcccacccacgggtgctccacgggcctaaaaaacaacccacacggagcccaacccacataaaggcctaggtatataagatatttcccgccatccctccacgggtgatatttcaaatccaaattttttgaattcacacaaacaaaaataatgctctagaatgcagtgcacaatataattttatatatttcccatttatttaattaagaaaataatttaaatgtatagtccacataaaaagcactgattcagataaatcttttggagatctttatttaattctcaaactaggagatgttgggcgttacaacgtgggctgcagcggtctctttctgcgccatcacattttcctcttggaccaatgggcaagtgggatatgggccagtatgtatgcaccataattagccaatggcgcgcatcttgttatgaattctatagttttatttttattttggtccctgcaaaagttttgaatattgatactcttctatactctgcaaatttagttaaactttagaaaatttgaatagtaaataaagctgtcgcatcctcttctaggttctgttggaaccacacggactggattggactgtgagggtacagcctcatcagctgcgaaagtgggcaagaagcgcacaacagcacaacacggtaaccgcaaaactggaggcccatataagacgcacggcccgtcacgtcaaccagcagaggcccaccccgacgtccccgggtcccccgggcccggcattcctctcctcttctctccccgcgcccctccctctcccccaaaaccctaacccatcgtcgaccggtccccgctctcgtggcgccggcaagatgaccctcctcgcagccatcaccaaccccgccgccgactcccgctccggctccagcgagagggctcaccctatcgtgctcaccccgggtgtcacgccgccgccgccgccatcctccacgctccccaccccaataccgtcttccacctggtcgctctccccagccgaccccaccctcgccaccgccgcttcctacctcgcggcctcgcttgcctcctgctcctccctcccgcagctccgcgcccttctcaccacctttatcaccactctgtcacaatccctcgcactcccaaccccgccggcggccctccccgccgccatccgcgctgtcgccccttacttccccgccgcaatcgcctcccttgtggcctccaaggcggtaagcctcgccgggcacgacatcctccttgctctcgcggaatcccgcctcctcccgcacccgccaccggaactcatctcgtcgctctgcgacaacgaccgggtcgaccttgtctgcgtcttgctccgccaggccgccgacatacgttcctccgagatcctcgccgcgctccactgcttcctctcgccggcctccgacaaggcttacgacgccatgatggacgtcaagtgccgatggaaggacgccgcggtgcttgctgtcaacaggtgtcgggagaagagcgccgtgaagaggaagaaagctgacgctgcggcgaggcacgcggcgctgctgctcatgatggggcacgatgggttcacctccccagaggtgtgcctgcattacctatttgcatcagggaatgtggattccgtggtgcttggagcggctctggttgaacttgatggcggggaggtagtcaggttgatgagatatctcaacaagtggattcggaagtactggagcttctcagaagcgcacacttgcccggaggctgtgggaaacctcagattggagcagtgtgacagcgtgccgtcgtttggagcagtggctagggcgctaggagtgctgctggataatcatttttcacatcttgtgttgaatgctgatgtgagggaggacttgagggctgcggacttgatggtgagggagctcgctgccgaagcagagtcttctgggccaatcctagacttgctgcataggtttcaactggataagtgagagattgatcttattctgtcgaaactatttacttttgtacttccaaatgccgatgcatggaaatttttaactgttttattgcattgcagtgatgagatacatgttgcagcattgaatattgaagaactttgcaaagaaaaaaaaaaaa

SEQ ID NO: 6086 - DNA, 3210 bp, Zea mays
ccttctccgataagcaatataatcataacctagttaaatcatgtcattttaagttgatcaaaattataaaaaaccaatgtttatgatattaaataagtattactagaccgtcatgacatatatttttatagtacatatgttttgtgtaatgaatatcgatactcttatctaatttgtaaacttttgaatagtactcactccatcctaaattataatttgtttgactttttatgccaagtttgatcggctcgtattattattttttttgaaaaaaataaaaaatccaaacacatacttaaagtatattattatatgctaaacaatatcatagtaaaaaatagtaataaatatgaatatttttaataagataagtcggtcaaacttatgttaaaaaagtcaaacgaattataaattagaacgaatggagtagtagagttgtcataagtctctataaaggtatgaattttgtaaatataaatatgaatttgtaaacgaattaaaaaagttaaaaaaacgtatccgtttctcagggttcggtctggattgcccggacttgattgcattgtaagggtaaagtcccataagtctctagggccgagaaagtgagaggtccatttgagaaacacgtaaacagcccgacacggtaaccgcagagttggaggccaatctcagcctcatagcccctcgcgtctacaatccaaggcccacacgtctctttcctctccatataaatcacaccacgtccctacccccttggcctccccgtggccggccggggaagccctaaccccttctcgaccgttgccccctctcgtcggcgccggcaaggcggcaagaattcaagatgaccctcctcgcagctatcactaaccccgccaccggctccagcgagaaggcccatcctatcgtgatcaccccgggtgccacgccgccgccgccgacatcctccgcgctccccacctcaatcccgccctccgcctggtcgctctcccccgccgaccccgccatcgccaccgccgcctcctacctcgcagcctccctcgactcctgctcctccctcccgcgcctccgcatccttctcaccgacttcatcaccactctgtcccaatccctcgcactcccaaccccggcggcggccctccccgccgccatccgcgccgtcgcgccttacttccccgctgctatctcctcccttgtggcctccaaggcggcaagcctcgccgggcacgacatcctccttgctcttgcggaatcccgcctcctcccgcacccgccaccggaactcatctcctcgctatgcaagaaggaccaggtcgaccttgtctgcgccctacttcgccaggccgccgacatccgctcctccgagatcctcgccgcgctccgctgcttcctctcgccggcctccgagaaggcctacgacgccatgatcgacgtcaagggccgatggaaggacgccgcagtgctcgcggtcaacaggtgtcaggggaagagcgccgggaagaggaagagagttgacgctgcgacgaggcgggtggcgctgctgctcatgatggggtacgataggttcacctctccagaggtgtgcctgcattacctatttgcatcagagattgtggattccgtggtgcttggagcggctggggctgaactcgatggtgaggaggtaatcaagctgatgagatatctcaacatgtggattggcaagtatcggaggttcttggaagcttacatgtgtccggaggctgtggaaatgcttgaattggaccagtgtgacattgtgccatcgtttggagcagtggctagggcgctgggagtgttgctggataatcatttctcccatcttgtgttgaatgctgatgcgagggaggacttgagggctgcggagttgatagtgagagagctcactgcggaagcggagtcttctgggacaatactggacttgctgcatagattgcagctgaataagtgagagattaatattatctcttgaatctatataccttctgtagctctgaagccgatgtgtagaaattctgactgttttgttgcattgaagcgatgagatatgtgttgcgttattgaatattgaagtatattagtacatgttttggttggaaactgttgttttcagatttcattgtagtgatagtgtgatactgtagttggtaatattgtatattgtgctatgcttgcttaattgttgtgaaattctaacatctaattatgatccaatcatccagatccaaacatgtctgttgcagctatcctctttgattttgtaggaaataatgagtcgtcttaattatgaactgatctgaggcccaagcaaaaatcctgcatttggctgtttttagaataaaaggtttgtcctgctttgtttccaattcagtacaatacagttaggggtggtaatggatcgggatccaaatgttccttcacaaattcttagggccataaataaattttagttaaaaatgaatagaaatagagcctcatcctaatccgatccgatctttaaattttatggtgtaaaatttagagcccataacgtactataggtgcgcctgccacagtacttaacatcgcattactttgacattatgtgctccctattggttcccactgctcctcagagaagatgttgcagtttctgaggtaagaatcgccacaatatgcctggacaattagaattaagttttttgttgttgttattgtcgcaagcacactactcataataaaataaagaaataggatcatcgtgtgcttgagtgttttgaagaacagaaatagtaagaacttattaaatatatagaacatggatagaatacaaaatggtcaactcatctgattttaggtagatattatttcgtatttagagggttttgattttttttatatattttatgagtcctccctgtatcacccatctgtgacacctattgagttttgatcgtgttgagcattcagctgctatctcactatggttgttcttcaaaagtcctttgactaagtatttgcttgttaatggtctctgcaatcgctccctttgatgaatgcaagttatgcgattgtcttcttcttgtgcgtcgaattaaatcatcctttgacttaactgcttctgagatttgggatagcatgagagtgaaacaattggttctacgtatattttgtgaatcatatcaccaaacaatacaatcattatgacctgcc

SEQ ID NO: 6087 - DNA, 646 bp, Zea mays
gcaaaccaaaacctcatggtcttttgtcttgccttctcgtttgaagaacccgccactagttcttccagcagctgaaaggcgctcttgatagtgaaccgataaagggaaaaagtcagaagggtcgtttggagtatccgacagacagacagaacagtagagaatcgtttcgccatcagtgaccattacagaagcgctcgcttgcctcccaatgtggcccgtttccaccaatatctcgcggtcgccgacggggatcctcacggagaacttggccggtccggagctgctggcctcctccgccactgcggcggaggccctggcgaccccatgcctgggcggcctcctccgcgggcggcgtgagcacgggagcgaggcgtggagcggcggcgcggggaaggcgacgtggtggtggtggtagtgcgggggcggcagcggcggcgccgggaggaggaggtggagcgcggcgggggccgcgagcatctcgaggcggtgggggacagttctggaggggggacagggaggaggcgcggggtgaggcgaagggcggtgagccgggaagggacggaaggaaggaggcgggagtccacgcgggagacgggccggtggcgagtggcgacgcacccacgaaccttatcactcgtgccgaatt

SEQ ID NO: 6088 - DNA, 1530 bp, Zea mays
gcacgccgttaacctcgaagcagataaggcctaccggcggccgccgtgcccgtgctcgcgctcgaccaccgccggccatggtcggcgtcgccctcgcgccggcagtgtcccgcgtgccttgccgtcccggcgcttccttccacgcctcgcgcccctcctcttcggcgcggctcccggccaggccgcgggcgcgggcgcgggcgcgggcgccgccggagaggctcgtggttgtcgcgcggtactcgtcctcgtacgaggtcgagggcgaggaggaggaggaagatgaggaagggctcgggggcggcggaggctgggggaggagggaccgcgggcccgaccccgactacgacccggcccttgacatcgaacgcatcgagtcctcgaccgtaaggctattggacgaacagaaaagaatggttggtgtagtatctgtcagcgaggcagttcagattgcagacgataatgatcttatactggcaatattatcaatggatggggaccccccagtacttcgactctttgaggagagagattacaaaaaacataggtatgaacaacagaagaagaaaaagattcagcagaaaagatctgtcgcgaaacgcatgggcttgaaggagctgaaaatgggatacaacattgacatccatgattacagcgtgaggcttaaagctgcaaaaaagtttcttaaagctggcgacaaggttaagataattgtgaacctgaaaggacgggaaaacttgtataaaaaagaagctatcgaactccttagaagattccaaaatgatgttggcgagctggcgacagaagaaagtaagaatttcgcggagaggaatatatatctggttcttgttcccaataagatagctatacagaaagaacaggatgaattgaacaaaaagggtgctgtgagagaagagaaagaccaatcagacagtgatgaaccagaagagaacgaccaaccagacagcgatgtacccctgacagaactgctggaggaaagtatggaacccgaggcagaagtctcagcaaacgtttgatttgaactgtagaggccaaggtgccttgctgagattgaaacaaggtacagttgctgtagaattgcagctctcgtaaatacaaggcaggctggttcttttgtgtaacaaatgtatctgttaaactccatctccacaagctatccgataggcgccaaggcgtaaacaaggcttgatgatgtatgtcctccaagtctccaacccctcagcatcgaaggatgatgatacctgggaactggaaatcaccaccccttgcataaatggattgagacagaggttggatccggtaccaataataaagtaattgttaggacagacatttttctagcagcgtccagcacggtggacttttttttggcctcatttccaatcgtttttctttttgactccttgtagagaagaaagctgagacgtatctatttgacaagtgcacatgttattgcgagttttgagaccttctgtaagagcctacctatgtgttctggaagagttacca

SEQ ID NO: 6089 - DNA, 1058 bp, Zea mays
atggatgtcaatgttgtatccatgattacagcgtgaggcttaaagctgcaaaaaagtttcttaaagctggcgacaagttttcccgtcctttcaggttcacaattatcttaaccttgtcgccagctttaagataattgtgaacctgaaaggacgggaaaacttgtacaaaaaagaagctttcgaactccttagaagattccaaaatgacgttggcgagctggcgaccgaagaaagtaagaatttcgcggagaggaatatatatctggttcttgttcccaataagatagctatacagaaagaacaggatgaattgaacaaaaagggtgctgtgagagaagagaaagaccaatcagacagtgatgaaccagaagagaacgaccaaccagacagcgatgtacccctgacagaactgctggaggaaagtatggaacccgaggcagaagtctcagcaaacgtttgatttgaactgtagaggccaaggtgcctgagattgaaacaagtaccacgcaggtacagttgctgtagaattgcagctctcgtaaatacaaggcaggctggttcttttgtgcaacaattatatctgttaaactccatctccacaagatatccgataggcgccaaggcgtctgacaagtaaacaaggcttgatgatgtatgtcctccaagtctccaacccctcagcatcgaaggataatgatacctgggaactagaaatcaccatcccttgcataaatggattgagacagaggttggatccggtaccaataataaagtaattgttaggacagacatttttctagcatcgtccagcacggtggacttttttattttgtgcctcatttccaatcgtttttctttttgactccttgtagagaaaagttgagacgtgtctatttgacaagtgcacatgttattgcgagtttgagaccttgtgtaagaacctaccattgtgttctggaagagttattctgtataaaaaagtggtctttgttttaccaacaaaaagcaggacttcaaaaaaaaaaaaaaaaaaaaaaaaaaaaaaaaaaaaaaaaaaa

SEQ ID NO: 6090 - DNA, 2135 bp, Zea mays
cgggaaaccttcctgacggcgactgcgcagccgcacccgcccatcctcctctccatctcctctctttcgctgtctaccctcaccaactcctacctcccgagacaaattccgaggtcgacacaagaaaagggaaagaaccacaggtaattgccttcctgtgtcgggattgtagctccaatccactccgcgccggccgggtgcgctgccatccggatcagacgccctcgcatctctcgcccttccggcatcgtatcccctgggcggcagcggagtaaagatccgacccgcttgggattgtttgcttctcctttttgcggtgcgccgctggactccagtgctgcacatgctcgacgacggtgctgagctcctgcaatggcccgaagaaatgccggcgcaatgcagcgggagggttcggcggggtcggttaaggactggtcggaattcgacccttcgccgtctcccaagctggcgtactcgcagtcctacgtcgccatgagagggctgttgacgtcggtggcttctctggaccctgtcctgacgtcgagcagcctcaagtctctgtgggcagccttgtcatcgcacaggcacgctcggtccttggagaggccaaagtacaaggggatgaactggaagaggcccatgttccacctgcttgtgtgcttcttagtgggagttttcattggattcacaccactcttctctctcgatttatccagtaacatagattctgaaaacgagacgcttccgtttgacggggatgtggttaacagacagatgctggaacttaaaagtacaaggttggagccgattgtggctgcggcagagactgaagccgcccaagaacaacaggttgatgagagtcctccagttcctgcgatgctggatgatgaggcggacttcattgaagcgtcacatgtccaaccttctgttaatgattctgacattggtgcaaagaagcagctgataattgtgacaacaacttctgttcgaccacatcaggcttattacttgaaccgcctggctcatgttttaaaaaatgtaccacctcctcttctgtggattgtggcggaatggccgtatcagtcccgtgaaacagcggagatcctgaggtcttctggggttatgtacagacatcttatctgcaatcggaacagtacaaatataaggaagattattgtctgccaaaagaacaatgcaatttttcatatcaagaagcaccgtttagatggtatagtacattttgctgatgaggagcgagtgtactcagttgatttatttgaagacatgcgaaaaatcaggcgctttggtacgtggccagtagcgacacatgttggagccaggtacaaggtggttttggaagggcctgtctgtaggggtaatcaagtcactggatggcatacaaacaagagagggggtgtacctcgtcggtttccaattggtttctctggttttgcttttaacagcactatactttgggatccccagaggtggaacagccccactttagagtctattatactccattcaggtggcagaggtggcttgcaggagtcaagattcatcgagaagcttgtcgaggacgagactcagatggaaggcctcgcagacaactgcactcgggttatggtctggaatttggacttggaacctccacagctgaattaccctactagctggcagctgcagaagaacctagacatcgtcgtgccaataacataaaccgcgatgctgctgctgccctttttgttcgcgcctcctagtgagtgtggtggaatgatgacgacaatgcccatgccttcctgaacttggtagcgtccaggatcacgcgaagctgctctgccaagacctggttcgaataatgtggtactagtaacaacagttggaaagcgaagaagcctgcctgacaaaaggaaaaattctttctccccccgttgcgctgcattaccaatgatcctcaacatagataggcttgtatatttcttttccttccatttttcgattattcctgttcgttacatataccatgcatacatacatacatacataaatacatatacaccttcattcattcataagtacatacatacatcttacagtactttacagatgcgaaaaaaaaaaaaaaaaaagcggcc

SEQ ID NO: 6091 - DNA, 1585 bp, Zea mays
ttcggtccctcgaggccggccggggagaagatcccagacccagacagcaaggaaccttgagcctgccggcaactctaacgacgacgatggccgaaggggacggtccaactccagcccgcggcgctcgcgtcgtgctgttcccactgccgtcccagggccacctcagcccgatgctgcacctcgccagcgcgctccacgcgcgggggctcgcagtcaccgtcctccacacggcgtacaacgcgccggaccccgcgcaccacccggggctagccttcgtcgccgtgcccgacgtcatcccggaggccgtggcggcgacgacgaatggcatcgcgaagatcctcgccctgaacgccgccatggaggcgtcggggcacgtccgcggcgcgctcgcgtcgctcctcgcggaggaggcgggcggacagcggctggcgtgcctcatcttcgactccaccctcttcgccgcgcagaaggccgcggctggcctcgggctgcccacgctcgtgctgcacaccggcagcgccgccggcttccgtctgttcaggtccgacacctacaacatgctccacgacaggggctatctgccagccacagagtccaacctacacatgccggtaaaggagctgccgcctctgcaagtgagggacctgttcgacccaagcaagctccccaacaaggaaatcgtgcagaagatcttgggtcgcgccacggagagcacgacgaactcgtccggcgcaatcctcaacacgtttgaggctctcgagtcccgcgagctcgagatgatccgggacgaacttgccgacagaggtatcccacccttcgccgtcgggccgcttcacaagctcaccgccgccccctccgatggcgccgacgagactagtcttctcagccaggaccgcgtctgcatggagtggctagacgcacgggcccctggatccgtgctgtacgtgagcttcggcagtgttgttcatgtcaccccagacgagttggtggagatcgcgtggggcttggcgaacagcggcgtgccgttcctgttggtggtccggcgtggccttgtggtcggagtggacaagcaggagctcccggacgggttcatggcggccgtggagggcagggccaaggtgatcgagtgggcgccgcagcaggaaggtgctagctcacccggcagtcggaggcttctggactcacaacggatggaactccacgctggagagtatctatgagggggtgcctatgctgtcgaggcccatctttggagaccagttgccaacggcaaggtacgtgtgccacgtgtggaggattggagttttgctggagggtgtgctggagcggcgggaggtggagaaggccatcaagaagctgatggaagaagacgagggagttggtatcaggggaagagccaaggatttcaaggagaaagtgcggatgtgccttgagagcaatgggtcttctcaacttgccgtcgataagttggtggatcacatactttctctttgagttttttttttatcacacaccactgttatgtctgttcatggtttcgcctcaattaataactcctggtttatgatacgctggtggtttcgct

SEQ ID NO: 6092 - DNA, 4226 bp, Zea mays
  misc_feature (24)..(24): n is a, c, g, or t
tcttaatggatccttttctcctanagttagtgatgaaaaaatttctatccagtgcatccaaatattaatacaacagatactggtagtccaaaaccaagctctagtttcagatatgacggagtagcatcatctgccggtcgccatgatcgctcaggtagcatgtcagattcacatccttctgataactatgtacatgacactgtggatccacatgctgcaattggtcgaagtatcacagtcgagagtcaacggaaggatttgaatacaatatttttgaagccgccccgtgctgatccaacaggtcatgcccaaaacatccacttcccctttgatattgaagcggacacttcaatcagtgttgcaactgagatggttgtgcagctcgatctcacagatcaagatgtaacggcaattgcagaaatgatagatgctgaaatacgttcgcatattcctgattgggcagcagaggagtcaattgacaaccaaggggatgaagctgctcactctgagacccatagttcagaaggtgatgagggaacttctgaactgcgtgatgagatcggtgcctcacataacggttttgttcaagaacagcttccctctggacggaagtactggtcagactcacccaggagagacggtgaaatatctcaatcggtggtggaacatcaaattggtgatagtagtgccaatggaataccaaagaggaacaaagtagatggcattgtgatctgtgcacgagatgaggaggatcaatccttcggctcttccatccatcccgctgaagccatgtttgaacgaatatcatcatctgtggacttgtcgaacccatctgcggtcgacagcatgtctagggatgcttctgttggtggcagccctcactctttagacggtgaggaggagcacaattctgatcagcatctggcagcaggtgtcactgagaggttaatagacctgttggctcagcagcaagaggagcttcgtgcgctgcaaaggaagcacaaggcggacatagaggagatgctgaaaatcgtacctgcggaggatcgggaagagaccttaactctatgccacttgaaggcggaacagaaaaacagagccgccgaaccttagataaactgtctcatgtgcatgttcctctgtgtgctgttagatttatacatactcacaccaaggagttgttgtttacactttacagccgttgttgtgcaaaagttggacctctgttgtgcagaagataagtctgaagcctttttcattgttcttttttgacataatggagaagctgggggagtgcttgtcttggaggacctccaattcagtgaccgagcactaaatagtaatcaggttctttttgacataatggagaagctgggtttttgacggcaaagatgaagtttctgcccaccaaatgaaatctgcagatgccactttgatgccgctgcgtgcctgaattaacggttcataaggagtgcctcccttcctttttcttttgttttcttttttgtttcttctgtactttgacttgccaaggatatacatcagtgtttgagctgttccaaacttgcaatgacagactttaaagtgcaattattttccggatcaaaaaaagaaaaaaaaaaacacaacagggcgcgcacacacacacacatatacagatagataaatatatatttctctgaatgcaaacaggcaggatatgcatacagatagatgtatgtatgtatttgttaattgcaagtgtggcgtggaggctgctgaggaagtctccatgcactcccagtgatgaggtagcagcagatctggattctggagtgggcagtggatgataaaacaagcatttgcgcaacacatgcgttgctccagatctcccacatgcatatgcctggctgccccagctcttcttttgagtggtgcatctgaatctgtgtacttgaaacctgaggctctgcgacccagctggttggtgttgggttaggagctgcgcacatagaaactggatctgtgttgcattctacagtggcagggccaccttcccccaatgctgtcagtcaccacatcttcgtcttgggatcaataatcccctccatgtatggaggaaggagaggatgtggagacttcttgaccactataatgctgttgctgtcctctcactttcacacgacgctacaaaagactgcaccgacatccatcagcgcaaatcaaggaggagcagtgaactgaaatgcatggatacaatacaacaaacaagagagaaaactaaacagaacaaataattcaataccaaaaccaccgagctctgactggtcgttgcctttaatttcttatatatacatacacgtattcaaagatgatgacgatgatgataatgatccatccatacatacatacacagtacgtatatacaatacaatacatgcatgtatccaacaaacagcccatcatccaacacacgaatccaatgcaattatatatgtcctgtatccagcagagccgatcgatctgaatagaatagtttagtgatggcgaaaggcatcgtagctctatgatgatggtgatgatgagttcgtcacccaccaccgtacgctatcatccatgcatgttcttcttcctccttcctcccctctctgcaagcagcaaattaagatggtcgtcagtcgtcactatataagcatcgcgtgccccgcccccgccccggcctctctctctttccttttcctcccgtcccatctctctctctctcccccttctacatgacgttgtcgatgctgtagcggcagccggcagtgtatagagctagccatgctggaccacctcgtgtcgtcctacacgcaccgcagtggcggcgaccagcccgcggcgccctcgccctgcgacctcgcgtccgtggacgacgtcccgggcaacggcggccacaagcctggcaaggccgtgaccgcgtccgtgtaccgcgccaagatcgcggggcactcgcgggtggtgacggtgtcgtggtcccgcgacctcctgtcgcacgcgttctccgtggccatctccggcgcggacggcgcgtccgcggagtgcagggtggagctgcggccgtggcagttctggcgccgcgcgggctcgcggcgcgtggagctggtgggcggcggctcggcgtcggcggccgtgcgcgtgctgtgggacctccggcgggcgcggttctgcggcggggtgcccgagccccggtgcgggtacttcgtggcgctggaggccgcgggcgaggtggtgctggtgcagggcgacatgcggcggcggcgcgcggaggccgaggccgtgcccgtggcgcggcgggagcacgtgttcgggcggcggcggttcgcggccaaggcgcggttcgatgagcagggcgacgtgcacgacatcgccatcgagtgcggcggggagggcggcggcggcgacggcgacgtggagatgaccatcgccatcgacggcgaggaggcggtgcaggtgaagcacctgcagtggaagttcaggggcaaccagtcgctgaccttcagccgggccaaggtggaggtgttctgggacgtgcacgactggctcttcagcgccggcaccaggccggcgctcttcatcttccgccccatcgtgctgtccagcgcgtcggcgccggcggggatgctcgacggcggcgcggtggtgcccgccgccaccacgggcttctgcttgtacctctacgcgtggaagctcgactaaagctgctggctagctagctagctacgccgatcgacattgcagtgtctgctgtctctcccctgccgccgccgccgccatgcatgttgtcggtcgatcgatgggactgctgtctgtgtcaccagacaatgcaaaaatgcattcctgtgaactcaagattatgagtaaggaactttttttttcttttcgttttgtaattttggaaagatatatatatatatataactattaattggatatataattcttaaaaaaataaagaggccattgccaccctgtttcattgcttgcaattgcaattttgcaaatgtgttgaggaagaagaccaggagaagatcgagcatgcagcagctagttaccaacttagagcatctctagtagactaactaaatgattaaaatttagatatttaacagtaaaataactttccaataaactagccatctaactaaccaactcatccggctctccaaattaccccatcactaactaaacttgtctagccactccag

SEQ ID NO: 6093 - DNA, 4413 bp, Zea mays
tatgtccccgttgcaacgcacgggcactcacctggttgataataataataatagttcggtgcctttttctagcggggaggaggcaggcggcgcaatctggcaccggccatcacgttccctccggccgcttccccctccctgccctccctttccccagatccgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacacggctggcgcggattccgggcagtcacgggaaggatgatgctggactcctctgactgtgcctctgctgccgccgccgcggagacggggcaggtgcagccgcagcgccgcgcggtgggggccgtgcccctggcgcacgacggcggctacgccagcggcggatgggagaggtaatgtatgtgcgtgtggtttgagaggcttcaagtaatgtaacctgtcggcacttgcatgtcgtggtgcggaacggggcatgtgaaccggttagaatgctgcatttgtgtgcagttttgcattgtgttttgtgttgcctgcagtataagggactaattggcctgaacactgaaacatgcaaatgccccttgtgctttttgttacttactacagatgtgccacattttactattccataccacacattagaactaaaaagatattctaagatgtaagtgagcggttggtgccatgcctttttagacagatcgttcttattaataacaaacagaaatgtagagtccttttatttattgtagtattttactgctacgatgctgtcattttaccttccagtaaaacctctatgttaattattgtgagtggcatatttgattggccaagtactgctatgaagtatagctgcaaagcttgaaatgaagaatatgtaccgagtccattttgtaatggttgttataggtagaatataactcatttttgtttgaaacatagtgataccagagcaccaaatataacattgactattttctttgtgatcttattaggattcaattttctacaacatttatagccattgtttacaaactgtatagtcaaccctagtcgctgttggaccggccaggtgatcagaccaactagccgagcctagtcagtcctagtcccctatatattgcaggacatatacatactatgctatatactgtatagtatagacaataaagcctggggtgaaacaattctacatctatgagcactttgccaatgttatttattttggtcatggatgtcatatgttctatggtcaagaaagcatctgatgaaggattattgcaaccactagcatgacgggccttgcaacactgcatatctttgaatagttttgactgcagaaaactgaacctgggccctgagcggctttccaaatccatgtgcaccctgcggtaaaagctttctttaaagtggccattgtctcagagatcggcaatggcaagaacaaaattttctggatgacaggtggttacatggctagagcctggatcaattagtgccaatttttttggatcagtcaacaacaaagcatgggaaaggacaatgtatgaagctcttactgagatgaattgggtgcaaggcatatggggtgccattacagtaccccatgtttagggctggacgaaaaactcaaagctcgttagcttgctcgactgtccatcttggcttgactcggctcgttgtaattttctaacgagccaagcttgtatttcagctcctaagagataacgagccagcccaagatggctcacaagtcgctcgtgcgccaaatgagctgaagcgtcaccagaaattacccgcaaaatgacacagacagcccaatagctggcccgatgagaagcgaagttccttgtctattcctaaccctgagccaccagccgctgcacaatgcgcccccatggttcactcacccatatcccctctcacttgccctcttacctatcccgtctttgatcgtgtgaaccaccacccggagcccaccggccacctgctgctctagtcgtatcgtcccactgctctcattgcagccttgaagctgccagaactcaccgaccccaacactatggatccacattcgtgcagactgcatccatttgtggataactagcaagcaagtcaagaagaggccaaattcgggcaagcactggctgcggcaaagatttgagcatgacgatgtgctcatctggctacccacgaggagcaggtgtgaagttgttgatgactttagaaggtgaagccgcgaagggcacactaaaatctcaatgcgagagccaagttacttatgtacatatttttttttctcaaacgcgcaggagagctgcgcatcattatattaagaagaagaaaaggtccaaaatagacctggacaaaggccaccaaataagaggtggttacatagtttgctaaggggctgttacacagatgactatataaaagactagtaactatcgcgcgccccgcgcacgtaagaaaactgacagtataaatgataatactattataaggtatttgacattgtgctttattatcttgtaccggaaccccctcgtaattatttttcttcatgatactattataaggtatttgacattgtgctttattatcttgtaccgaaaccccctcgtaattatttttcttcatgagcttgcggcaaatctcacgcactcattccctaaaatccttacaatttccttcacttaattcccccacattcaattttctaatctcacaacttccttccttagtagaagcaaagtaaacaagggaaatgataggctggcagccgctccattagcctgtccccacttccatgcttgaggaggcgaggagcccaacaatgacatgcggcagcagcaggttgcaaaagcacagctaattcctggcccctgcctcccttctacaacactgcctgcagtaacggaggagcaaatggcagcacatggacaatgtcgtggctggaccgcagcggcgtttgagggggagtctaagatttggaaatcacagaacagaggagatccaagaacgtgctgtggagaagaaagggctagtacctgttcgaagagccaagcagaagggcaaggagcatggcctggcaggctggggctagcgacaacgccggtcggctttttttacgtggacaacccgggaggcttgaagatcacgcgtatttttctcccccctgggtcgggcgtcatatagaagcttcgtgaggcttgataacgatccagtagagtgggcggtcgtgttcgtggatttccaatcaaacggctgaaaaacaaaagactgacgtggacactatgaatggccagccttgttccctgctttaatatatagaaatgaccaggtctgaactccccctgagttaaggccacagacctctcggccctgcagccccagctaaacaccacatcttggcatcgtccctaatgtcttgactcttgagtaatcctagagatgtccggaatagccccatcaaagacacaggagtttctgtgtttccacaaccaccaggccactaggatcacagctgaattgaaacctttcttttgtgccttttgaactgtcgttcctgacctatgccaccagccttgaaaactagattccgcagtttctggagtgaggtactgcagcccaataagagacaaggtatgaaaccaaatttccctagcaaaaacacattgtaacagaatgtgttgtatagtttcttcttcctgatcacaaagaaggcattttgtgggatggtccaaacctcgacgagccaatcgatccgctgtccagctgcgatttaaagaagccaaccatatgaaaaatttacatcttgtaagtgcccaacttttccagacccttcctgccggttcaaaggtgaccatcccctcaaagaaacgatgataagcagatttagaggagtattcccctgaggcagaaggggtccagcggtgttggtctgaaactcctgggtgaagttggaagccttgaatcaggttctagactatgaagtactcagatagaaattgagctgatatgcttcctgagatatcatttacccagccattttcagtcaaggcatcctttactgttctactttggagaaatctgttcggaacccgagagacaaggaccggagccaagtcacacagagcctgtccatggcgccatcgatccgtccaaaatgaggtttgggatccgtctcctaccaaagaaaccactgaacatgcaaacatggatgcagcattggggtgtactctaattttcaaatcagtcca

SEQ ID NO: 6094 - DNA, 4333 bp, Zea mays
  misc_feature (108)..(108): n is a, c, g, or t
  misc_feature (125)..(125): n is a, c, g, or t
  misc_feature (140)..(140): n is a, c, g, or t
  misc_feature (148)..(148): n is a, c, g, or t
  misc_feature (150)..(150): n is a, c, g, or t
  misc_feature (233)..(233): n is a, c, g, or t
gtagcacccgatccttagtccaaaaaccaggccatctgagcgctagcaaaccaaaatctcatagctaaactttacctagacgacgtcgatttttctacaaaacgacanccaagaatgagaggagnttttttaaaaaaaancacacacncncaatcgggcacgattagatctgattttgaaagtttgaattttatatgtgtatatatgcaagtgtaccagttctttgtttaccngccggatatcatgtcatccctttttgtgtgtactagtcaggtgttttctccgtgcttcaagataacgggttgtccgcagttcgcagcctctaaaacatgtgaataccaactcgacagcgccatgatctatgtatagcagatacgcagctacagactacagtgattctgattcaatttgagcatgtttattcttttgtttttctgtttttaggcatggcagccactggcacaatatatagcctaacgtgtctcttcgtggccgagcctgcctgcagggttggcgttcggccggccgtacgcaccgtacggcggcgcggcgccttccttccctaccctacaacgacgatcgacgatgtgctagccaccccgaccgacacatccatccagcggtgcccaccatggcccgccgccgccgcctctcggcgtcctcgttgccagaggcggctggtgccattcccagtgcgttgcctcccgagctccggtggcctttcgcgcgcctcgaggccctcacccaggacgagctccgggaatccgtctacgagatcttcttctgcgcctgccgctccgcccccggcggcggcacacgcccatctgccgccgccagaggcagcaggggaggcgcggcgaccccaacgagaccaccaccggaggcgtcgtctcctacctccggtggagcaaagaacatggcggtgacgagccgcctgaagcgcgcgctcggcctgcgcgcgcggaacacgaggcccacggtgggggcgggcgggcgccccttgacgtcggcggagatcatgcggcggcagatgggggtgagcgagcagaccgacgcccgtctccgcaagaccctcgtgcgctccctcgtcgggccccagatgtccaggaaggtggactccctcgtgctccccctggagctcctccgccacctcaaacccgccgactttttcgacgccggcgagcaccgcgcgtggcagctccgccagctcagggtcctcgaggcaggcctcgtctcccacccctccgtgccgctcgaccgcggcaacgcctcggcgtccgctctccgggacacggtccggtccgccgagctgcagacgcggcccgtcctcgacgcgcgcgccctgtctgccgtcgtggcggcgctgtgccggcggtccgtggacgcctgccgctgggccgacggctaccccctcaacgtgcacctgtacctgaccctcctccgcgccgtgttcgacgccagggacgagacggtggtgctggacgaggtcgacgagctcatggagctcatcaggaagacgtggaacgtcctcggtctcaacgacaccatccacaacgtctgcttcacgtggctattcttggagaagtacgtgacgaccggggagacggagccggacctgctgtccgcggcgctggcgatgctcgagcaggtccgcgacgacgcccggagacaggccgaggccggcacgctggaggcggcgcacctcagggtcttgtcggcgactctggcgtccatgcactcgtgggcggaagaaaagctgctggattatcacgagtcgtttggtgacgaccaaggagctggtggctccattggtgccatggagaatgccgtgtcccttgctgtcttggcggcagcgatgctcagccaggacgtgccgtcgtctttcgcagtggcggtggcggctgccggcggcgatctctcgtcagctagatcgccttcgtcattctcagccagggagagggagatagtggaacggtatatcaagtcgtcggtgaggcgtgctttcaccagggtacgtatatatgttgccctagactatatatatatacgtatccagcatatctcctgctggcgcatgcatgcggcatatatatgtaacaagcaagcatgtgtggcggcggcatggatggcagctgcacgaaaccggcaccgccgagaagatggacagcatgatcgtggaggtggacgaggacccttgcgagaccctgatgtatgtggcgtcgcagaccaaggagctggcaaggctggaaaaagaggtgtacgaccgcgttgtccggcagtggcacccgtgcccgacggccgtggccgccgccaccctccacggttgcttcggcgcgctcttgaagcggtacgtgtccagaatggcggcgtgcggcctgagcagcgagactgtgcgcgtcctgcacgcggcctctaagctggacaagtggttgctacagatggccagcgaggacgacccgccgccagaccagccgccgatgaccccctacgacgtggactccatcatctttggcctggtcaagggctggatggacgagcggctcaaggtaggggacgagtgcttgagaagggcccaggaggcagagacctggaacccgaggtccaaggccgagccgtacgcacagtctgcggtggatctgatgaagctggccaaggtcaccgtggatgagatgctggagatccaggtggcgtcggcctgcaaagaggagctgctgcaacgccttgttgacggcatcgatcacctcgtccaccagtacgctatgctgcttgcctcgtgtggtgcggtaactacttggcatgctaatatgctatgatgctattacagacatgcatgcatctctatcatgagtgacgacactgacaaccgaaaccacgatgaaatgcagggtccaaggacagctacgttccacctctgccgacattgacgcggtgcaaccaggactccaagctcgtgcagctctggaagaaggcggcgccgccgtgccaggtgggcgacctggaggctctcgactgcggcaggatcgacattgtcacgagcagcaagaagcccaggctggaggcgagccggtcgggacgaggagagcgagaccacgcggtgcgccccgccaccagccgcggcacgcagcggctctacgtgcgcctcaacacgctccactacctcctcgccgtcctgcacagcatcgacagggcgctctcctcctcccagctgcaggccccccagcggcgccgcctcgcgaggagctcggccttcggccacgcccgccccgccctcgacgcggccgtccaccacgtgtccgagctcgccgcgtaccgcctcgtcttcctcgactccgcccagtttttccaccaggcgctgtacctggggggcgtcaccgccgcccccgctcggcccacgctccgcctcatgaagcagaacctcgcgttcctctccagcgtcctcaccgagcaggcccagctgccggccgtgctcgaggtgatgagggcctccgtggaggccttcctgacggtcgtcctcgctggcggcagcgggcgggccttcgcccgcggggaccacgccgccgtggccgcggacttcgcgagcttgaagcgcctgttctgcagtttcggggtcggggaggaggcggtcgagagggagacggtgcgggcggaaggggtgctggcgctcatggccgttccgacggaacagctcatccatgagttgctcggccactatgcttccactccgatgagagcggcgggtgacgagttaccgcagctgccgatgatgccgatgacgcccacggcgagacgctggagccggtccgacgccaacaccgtgctccgcgtgctgtgctaccgagacgatgagcctgccaacagattcttgaagaaaacctttaatctgcccaagaggaggtagccgattacgcagttctatcgccggcccataggatcggattggatctatcattcgcgacccaaagggcctgttcgtttctgttgggtttcacaaaaattattccggctaatcaaaccttatataaattagacaagcaatctacataggaattgttccgagtgttcaattctctggaaccgaacaaggcctaatactttttttgaaagcacgttcttattatacacatgtaacaggaaagcacgtagacggtggtgtaggtttggtgaggtgagaaacgggaggtcttgccttcctattgatttttcatcgatctgtgttgtttttatttacgccattggccgacattatttaatgatgtcatgagccatgtggtatacatgagcatgcatctccaccgcacctaacatgttcatgttagggctggttcgttttcag

SEQ ID NO: 6095 - DNA, 1845 bp, Zea mays
gacggccctgttcggtttcccggaacggagatccggaataacttctagccggattacttctctaatttatataaattttgatgagctggaacgaatccggttttattcctatgcaaacgaacgggccctaactattaactaatttactaaaaatagctaatattttaattattagctaggatgtttagatgtctctaactaattttagcactaatattagcaccagtacattcaaaccccccatagtagctcacttgctttgttttgtgctctgtccattcacctgcagtcgtgaaatgtatgaagctatagatctgctagcttatactcaaaaccccctatagcaattactgatcattttacaccctgttttctgcggttaattttttcttttttgttagcccaagtttgcagcataccaacggttcttgggggcagagatgggtttttgttagcccaagctgcacgtattatattatcacttatgttctgcaatattttgtacagtgcttgtacacgaaaaagcataccaacggttcatggggcagagatgggtgcatagtccatgtccatccaagcacgcacccgacgctacgcctccttccgttccgtatccattggccccgcccagtaaatttcggcccacacccgacgctacgcctccttccgcattggccggcggagccacagcactcagccagcctctccatctgacttcagtccccacgcgctgttccatccaaccctagccaccgttggtgcctcggcggcatgccctcgtttgccttcgtctccgctcggtacgccgcggatgcggaggcggacttcctccgcatctccgcctcgcaggaagaccttctcgcccgcgcccccttcatcaccttcgacccggaggaggaggaggaggaggccgaggtgtccagcacgccgcctctcacacaccaggccccgcagaggcagggggaagagggcatcgccatgtgctccatgcccttcacccagcctccctccccttctccggctccctcccctcccttggggagtccgagtcgggagcgtttcccctccctcggagactccgagtcggaagcgggtcacttgaaagccgcggaagagggtctgcacgaggaaggtgagaggagccaagctcaggactccgacgccgagctccagcagcccagccccagccccgaagtcgaccctctggccagggccgtgctcgtgacccccaccactccttctgcattcaccagtgatgaggatatcctcgagctcgctcgcagccgcgacatctagagttgcctatgtcacggtgactaagcagccccttctgttatgccaatcaatccatccatccatatgctaataaatatggtgtggttggatttttatgcgtttccatcaactacttatgactgtcttgttcggttcatgttgcaagtcgcagtattttgggcatgtggaagttaactatgccgtgcttgattggcacaagaaaactcactgtattttgggcatgtggaagttagctatgccgtgcttgattggcacaagaaaactcactgtattttgggcatgtggaagctaactatgccgtgcttggttggcacaagaaaaaaaaaaaaattttgggcatgtggaagttaactatgcttgcttgattgttgattggcacaagaaaactcactgtattttgtgcatgtggaagttaactatgccttgcttgattggcacaagaaaactagctagccatgagcatctcatcattcactctcttcactgatgcagtgtgttgttagcagtagagtaacctgcaagattactgttttgtgttctttaattcgg

SEQ ID NO: 6096 - DNA, 2247 bp, Zea mays
cacaaattctggtattcaaaaaacatgggagtagcattttgtgctggaaatgcgctgcagcctgcagagggtggctgtcctgtcgggcgtgtacgcactgcttccacatgcatctccctcacctctcgccatacctaccccccctccagtgaccagtcacgcacgcgcgcgcgatccctcgcctacctccggtccctgcccgcctgttgctgtatttatgtccgggtcccccgggcggccgggcgggagcatcactgccgtgtagtgtagctagagcccgtgcactggtccggattcgcagagcaaaacggaaatgatcacggtggcagcaccggaggcgcagccgcaggtggcggcagcggcggcggcggttgcggcgccggaggagaccgtgttccggtcgaagctgccggacatcgacatccccacccacctgccgctccacgactactgcttctcgagggcggcggaggcggcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatggtcctgctccagaactccgtcgagttcgtgctcgccttcttcggcgcgtccttcctcggcgccgtcaccacggccgccaacccgttctgcacgccgcaggagatccacaagcagttcagcgcctccggcgcgaaggtcgtcgtcacccactccgcctacgtcgccaagctccggcacgacgccttcccgaggatcggcacggcgagcggcggcggcggcgtggacggcaatgccctcctcaccgtcctcaccatcgacggcgacgcggccgacaccccggaaggctgcctggcgttctgggagctgctcacgtccggcgacggcgacgccctccccggaggtgtccatctccccggacgaccccgtggcgctgccgttctcgtcgggcaccacggggctgcccaagggcgtcgtgctgacccacggcggccaggtcacgaacgtggcgcagcaggtggacggcgcgaaccccaacctgtacatgcgggagggcgacgtcgcgctctgcgtgctgcctctgttccacatcttctccctcaactccgtgctgctctgcgccatgcgggccggcgcggcggtcatgctcatgcccaagttcgagatgggcgccatgctggagggcatccagcggtggcgcgtcacagtggcagccgtcgtgccgccgctggtgctcgccctggccaagaaccccgcgctcgagaagtacgacctcagctccatccggatcgtgctctccggcgctgcgccgcttggcaaggacctcgtcgacgcactccgcgcccgcgtgccacaggccgtcttcggacagggatacgggatgacggaggccgggcccgtgctgtccatgtgcccggcgttcgccaaggagccggcgcccgccaagccggggtcgtgcggcacggtggtgcgcaacgcggagctcaaggtggtggacccggacacgggcctctccctcggccgcaacctccccggcgagatctgcatccggggcccgcagatcatgaaagggtacctgaacgacccggaggccaccgcgaggacgatcgacgtccacggctggctccacaccggcgacatcggctacgtcgacgacgacgacgaggtcttcatcgtcgaccgcgtcaaggagctcatcaagttcaagggcttccaggtgccgccggccgagctcgaggctctgctcgtcgcccacccgtccatcgccgacgcggccgtcgtcccgcaaaaggacgaagccgccggcgaggtccccgtcgccttcgtggtccgcgccgccgacgccgacatcgcggaggacgccatcaaggagttcatctccaagcaggtggtattctacaagaggctacacaaggtgtacttcaccccctccatccccaagtcggcgtccgggaagatcctgaggagggagctgcgcgccaagctcgcggcagccgcgaccgcctgaggagcttgacgctcaggttccatgccttgctacgtgcaactcgtttggtagtggcgtttactgccaatccagtgtatgggtacaggcgtgaaacatgaggtaccgagaatgtactatcaatatatgctttgtatgcgagtgcttcgtcaggtaaattaaggaccaccatttattcccgtccaaaaaaaaaaaaaaaaaa

SEQ ID NO: 6097 - DNA, 1246 bp, Zea mays
agcttgggcagttgggttccagaactgcgcctaaggtttcttgcacgcgcaaatgaagcggcagccaccacatcctcgaggcggcggcggcgcggcggtcggcgagagcggaagcggcggagggttccataagggggaggggaaagggaaagggaggtggggcggcgggtgccggcggcggaacgagcagcggctgggtgtcggcggcggcggcggggccctctccctcgctgctttcgccagcgccaagtcccggactaccggctacaacccggccgtcatcaagaagcaaaaggagttctacaagaatgctaaactaatcagcaaatacaaaaggacaaagaagcaacaaagtcagtcaaacgaccatccgcagattccaatccatgaggatggtggcgacaatgcccaatatgtaccgaaaccgcgctaccaaggcaagaagcgcaccgcgcatagtttgaaggaagagtacgagaagaaacgcgcagaggatgagaaggctaagaaagagcaggatgcagcagttcaggcgaagagggaacaccgggagaagtccgaggcaaagcggagggaactgagggagaagatgttcaagaagacgagatctggccagcctgtgatgagataccggatcgagcatctcttggagacggcactgagcaaataacacgatgccaccgtcatcttggcagattttgtagttccgctgtccaatcgatttgttggttttaactgactttgtcacctttttagtttgcaaaaatggacaatctaagtgacaaagccagttaaaaccaacaaattggttgggctgcggaactacaaaatttgttggtcaatataccaaggcgatggtggccccacctagagctaggccagaaaagcctcatccaccggcagcccttaagccgtagtagtagggttctattctgttgtcggcagcccttaagaagagactgttcaccagtggagacacttccacttaaccaataaattacctgtgaaatcaatcattatgtcgagcaaaatgtgcgccggggtttaagttcaagaaagtaaatcagatagggcacatacctatgaatataatgggcttctctactgaggacttgatcgaaagtacacgtccattaattaggtcttcttgctgcctgcagaacaaattccatataactaactacttgtaagataatgatccaatagagatccttcatttttaattgcaataaaaaaaaaaaaaaaa

SEQ ID NO: 6098 - DNA, 1220 bp, Zea mays
aacgcatacggcaactcctctctccgctgttgctctcttcccgtcgcgctttctcctcgtgcggctactgggtaaccgccgccgctgccgccctacgccaggttctcaggtcattgtcagtccccttacttcgccggctcattcggcggcgacgagcaccagaaatcctagctgctttgagtatggaggcgctgtttgggtgcaacaaacatggcggggacaaggccgctgatttggcctcgtttataatcgtgcaggctgccttggaggtgccaaggttacttgggctccttgccatgattcttcataatgaaatctttacatctggtggagatcagaatttgattaataggattctgagcaaaaacaaaaatgcaactgatttcgagaacaaggatgatggagagtctgatgatgataatgatgaggagggagacgatgaggatgctgaaaaccaagaagatgatggtggtgatgagggatcagatgacaatgggaatgaggaggaagatgacgacgacgatgataacgatcctgcagccaacggtgaaggaggaagtgacgacgatgatgatggtggagaggatgaagaggaggatgatgacgacgatgatgatggggatggtgacaatgaggaagatgaggaggaagaagaggaagaggatgatgacgatgatgtcccccaaccacctactaagaagaggaaatgatagatggctgtgatttggttggctggttgcttacatgcaggaatgctccctgttcgcccctgcctagcagtctcctgtttagtgggtagggggttttagcttgatcgtggacaattcatagcctagcttggaaacaaaaagaaacatttaattgtgcatgtactattaaaccattcctttaatcatgtatctcagattgctaccaacccctgtgatgctccgaatggtttctacattgtgtttgcttcagttttgttgcaacttgcaatttgacaatgttctgatatactttgcttgtctatttcggtcacttgtatgttatgcttggttgcaaggacagagcagaatttgccaaagtattccgggaggaacgtccccttcggtgacgacctttggagtttgtttggtgagaaagtgattggaggggattagggaaaaatgaactaattgctaccgcaattcctttcactatatgacaaggtcttcggcatgctacgcatgaccgcgcgt

SEQ ID NO: 6099 - DNA, 1026 bp, Zea mays
gaacgcataccgcatgtcctctctcctgtgttgctcgcctccccaactccccgtcgcgctttctcctagtgaggctactgggtgaccgccgcctctgccgccctacgccaggttccaggtcttcgtcactccctttcattatcttcgtcgtctcattcgccggcgacgagcacccaccagaaatcatagctgctttgggtatggaggcgctgtttgggagcaataaccatggcggccacaaggccgctgatttggcctcgcttataattacccaggttgccttggaggtgccaaggttacttgggctccttgccatgattctgcataatgaaatctttacatctggtggagaccagaatttgattactaggattctgggcaaaagcgaagatgaaactaatcctgagaacaaagatgatggagagtccgatgatgataatgatgatgaaggagacgatgatgatgctgaaaacgaggaggaagatgatggtggtgatgagggatcagatgacaatgagaatgaggaagatgacgatggagatgatgatgatcctgcagccaatggcgaagggggaagcgatgacgacgaagatgatggtggagaggatgaagaggatgatgacgacgacgacgatgatggggacgatggcaatgaggaagaggaggaagaatctgaagaggatgatgatgatgatgaagtcccccaaccacctactaaaaagaggaaatgatcaacggctgcgacgagtggttgcttatacgcaggaatgctgcctgttcgtccctgcgcagcagtttactgtttagtgggtagagttttttagcttggtcgtggacaattcatagcctagtttggaaacgaaaaagaaacatttaattgtgcatgtactattaaaccattcctttaatcatgtatctcagattgctatcatggtttctaaattgtgtttgcctaagttttgtattgcaatttaacaatgttcttgtgcaacctgatggtcgtggtacgtaaaaaaaaaaaaaaaa

SEQ ID NO: 6100 - DNA, 696 bp, Zea mays
  misc_feature (1)..(1): n is a, c, g, or t
  misc_feature (46)..(46): n is a, c, g, or t
  misc_feature (62)..(62): n is a, c, g, or t
  misc_feature (74)..(74): n is a, c, g, or t
  misc_feature (76)..(76): n is a, c, g, or t
natgtgtgtacagcgaacggcatgtgctgctgctactactactgtnaaaggctgcttactgngcttgcgttctntnttctgcaacccaaattgagtgtaaagatgcatgtgctgccggccggggtatatttgcatcactgcctgcttctggaatcaggaaaggagatcaccacttcactcaagaaggcaccctcccttgccactccttttccttgagatgacgatgacgacgatgaagaagcagcagcagctcctcctcctcctttctctcatgtttctcgttgctgtgacagcagccgctgttgctgccgatccacatccacagcaggtgcaggtgcagcagcagcagcaagcacagatgaggattaacagggccaccagatcccttcttcctcagccgccgccgaaactagactgcccgtccacctgctccgtgcgctgcggcaacaactggaagaaccagatgtgcaacaagatgtgcaacgtctgctgcaacaagtgcagctgcgtgccgccggggaccggccaggacacccgccacctctgcccctgctacgacaccatgctcaatccacacaccggcaagcttaagtgcccctaggccttcgccactcatgttatgtacaatgtactatcatcacttcaataaataaataaaaaaacttctggttctggaagccaaaaaaaaaaaaaaaa

SEQ ID NO: 6101 - DNA, 2124 bp, Zea mays
ttccgggtccgcccacgcgtccgccaaaacatagagtgtcgacttttctattggtgtgattgggggcactaaatacctaccacattgcactcagactacatatactgtgtttgtgtgttgtatgccgtatgcgtgtgtgagcttgcgcaaattggacatctaggccgtgcgtaccctgcgatgaaaggcgccgtcatcggcgcatcgaccgtcctggtcgtggcggtggtggccaccatctgcgtcgtttccttcaaaggcagcggcgatggcgggagggccgaggagggcgagatgtccacgtcggtgaagtccatcaagtccttctgccagcccgtggactacagggagacgtgcgagaaggcgctggaggcggcggccgggaacgccaccagccccacggagctggccaaggccatcttcaaggtgacgtccgaccggatcgcgaaggccgtgcgcgagtccgccctgctcaacgagctcaagcacgaccgccgcacgtcgggcgcgctcgacaactgcggggagctgctcgactacgccatcgacgacctccggacgacgttcgacaggctcggcggcttcgagatgaccaacttcaagagcgccgtggacgacctccggacgtggctgagctccgcgctcacgtaccaggagacgtgcctggacgggttcgagaacaccacgacgcccgccgcgggcaagatgcgcaaggcgctcaacagctcgcaggagctgacggagaacatcctggcgctcgtggacgagttctccgagacgctcgccaacctgggcctgccgagcttccaccgccggctcctcgcggagcacgcccgcggcgcgccctcgtggatgcccgacgccaagcgccggctgctgctggtctcccccggcgagaagggcttcaggcccgacgtgacggtggccaaggacggcagcggcgacttcaggaccatcaacgcggcgctggccaaggtgccgctgaagagcgccaccacgtacgtcatgtacgtgaaggccggcaagtacagggagtacgtgtccgtggcccggaacgtgacgaacctggtgatggtcggcgacggcgccaccaagacggtgatcatgggccacaagagcttcatgatgaacatcaccaccaaggacacggccacgatggaggcgatcgggaacgggttcctgatgcgcgggatcggcgtgaagaacacggcgggagccaagaaccaccaggcggtggcgctgcgggtgcagagcgacatgtcggcgttctacgagtgccggttcgacgggtaccaggacacgctgtacacgcacacgagccgccagtactaccgcgactgcgtcatcacgggcaccatcgacttcatcttcggcaacgcgcaggtggtgttccagaactgcctcatccaggtgcgcaagtgcatggacaaccagcagaacatcgtcacggcgcagggccgcaaggagaggcggtcggtgggcggcaccgtcatccacaactgcaccgtcgcgccgcacccggagttcgagaagagcgtcggccggttcaggaccttcctgggccgcccgtggaaggagcactcgcgcacgctctacatccagtcggagatcggcgggttcatcgacccgcagggctggctgccgtggctcggcgacttcggcctcagcacctgctactacgccgaggtggaaaaccacgggcccggcgccaacatgaccagacgcgtcaagtggaggggtatcaagaacatcacctaccagcacgcgctgcagaagtacaccgtcgagagcttcatccagggccagcactggctcccacagctcggcgtgccattcatcccggggctgctgccgcagcagcaatcgggcaggatacactgacatctaaggaagatgatatatgatcggcaggctgcgttgtcgatatgacgtggcactaacatgtacgtaccatggtttagtttgttggttggtttatgctattttgactactactttttttatatttgataaaaaaatgcagtacaaaattaactaccctgaacactgtttggaacttggattgccccgaaactggtaataggttattaataataacaaaatggaagaagtcatatttttctc

SEQ ID NO: 6102 - DNA, 1459 bp, Zea mays
tatgaagcgcagccgcgcaggtttgcaaaataattggaagaacctatgttctcgtgacttgagcgactgagggagaccactagagccaggctcaatcggtgtaagccagaggtcttttgggccacattttttggctgaaatgtattttgggctagattttttggttgaaaaaaatctgtatgcaagagaatttttgggttgcgcctccgccatgacacaggtggcccggggcccaaatcggtctatgcatataggtgcaatgtatagtattttatttatatggtcaaaaaacaaattttgtactgtagacaatattatttgtagagtgtagtttgaatatgagcatgtgtatggataagctgttgggacggtcttaaccgcacaagtgacaaatcacgttcatcggtgtccactccagtactccactggtcgttgtctccacaaatccgcgtcatttgtagccaaaaccctcgccgtcttatcaacccctcgcccccgtcgccctccccgtgatcagatcgagagagcaggcccgattcaattcgacccgaggcgccgcgaccggaaggaatttcgcgagtcgcccggaaaaaaagccctagccagatcagcgatggcaacgcacccggcgtccccgaccgccggcgctggtggcgacaggtcgccgtccggaccgccgccggtgcgcctgtctgcggcacaggcggtggcggcgatccagcctacctcaccgcggtactttttctcctcgctggccgctgcctctgccgcggcgtcctccccgcaccgccgcatcggcatcgccgtcgacctctccgacgagtccgcctttgccgtcaagtgggccgttcagaactacctccgccccggggacgccgtggtgctgctccacgtccgccccacctctgtgctctatggtgccgactggggctccatcccggtctccgtcgacgacgaccccgacgtcgacatcgccgagggtgcggtacgcgctgcggccgctgaggaggagcctgaggaggcgaagaagaagcgggaggaggagttcgactccttcacgtccactaaggcgcaggaccttgcgcagccgctggtcggcgcgcagatccccttcaagatccacatcgtcaaagaccacgacatgaaggagcgcctctgcctcgaggccgagcgcctcggcctgtccgcgatgatcatgggcagccggggattcggtgcctcgcgcagggtcgggaaagggaggctcgggagcgtcagtgactactgcgtgcaccactgtgtctgcccggttgtggttgtgcgctacccagatgatgccttcggggatgagctgcgaacggtacctgaaaatgagcctgtgtatcatgcggcgccggaggcccagaaaggttcgtcctatattcctattgcttcgtcttctacttagcactgtttcatccattgggcctgtcctatttaa

SEQ ID NO: 6103 - DNA, 1213 bp, Zea mays
acactccatagggcgattgggatcctcgagactcgccgtcttatcaacccctcgcccccgtcgccctccccgtaatcagatcgagagagcaggcccgattcaattcgacccgaggcgccgcgaccggaaggaatttcgcgagtcgcccggaaaaaaagccctagccagatcagcgatggcaacgcacccggcgtccccgaccgccggcgctggtggcgacaggtcgccgtccggaccgccgccggtgcgcctgtctgcggcacaggcggtggcggcgatccagcctacctcaccgcggtactttttctcctcgctggccgctgcctctgccgcggcgtcctccccgcaccgccgcatcggcatcgccgtcgacctctccgacgagtccgcctttgccgtcaagtgggccgttcagaactacctccgccccggggacgccgtggtgctgctccacgtccgccccacctctgtgctctatggtgccgactggggctccatcccggtctccgtcgacgacgaccccgacgtcgacatcgccgagggtgcggtacgcgctgcggccgctgaggaggagcctgaggaggcgaagaagaagcgggaggaggagttcgactccttcacgtccactaaggcgcaggaccttgcgcagccgctggtcggcgcgcagatccccttcaagatccacatcgtcaaagaccacgacatgaaggagcgcctctgcctcgaggccgagcgcctcggcctgtccgcgatgatcatgggcagccggggattcggtgcctcgcgcagggtcgggaaagggaggctcgggagcgtcagtgactactgcgtgcaccactgtgtctgcccggttgtggttgtgcgctacccagatgatgccttcggggatgagctgcgaacggtacctgaaaatgagcctgtgtatcatgcggcgccggaggcccagaaagaaaactgagggaagtgcagggcggctcggcgacgaggggtggagaaagcagagaggccgtcacgtcgtcagccagccagccctagcgtaacacaccggtgtcctctcccgtggccactctgcatctgtaccaggaacctgtatatcatggacgagtccccgctgtttcgcttcatgacatgtgtgttggtaaaatgaagacttcaacttcaatgtttttggcgtgcatgggccgccgtgttcttcttaaaaaaaaaaaaaaaa

SEQ ID NO: 6104 - DNA, 3090 bp, Zea mays
tgtgtgtctacatcttgcgttcatttgtgcgtggagttttgactcccattgaacttccaccaaagttttggaggcttgtaaagctagcaagagacacctaagagtgtggtgatccttgcggggtcttaagtgatcattgagaagaagaagagctcgccgatcttgaggatcggttgagggaaagggttgaaagagacccgtccttatggactcctcaacggggactaggccttcgagggccgaacctcggtaaaacaaatcattcatgtctcgtgtgtttattgcttgtgatttgtttgttctctccctttctaagttttcttgcgctactctttgctagcattattttgtgttgcttcaagttaaattctcatttagagaagcaactccttgcaagaaagaacttgtgtttattttcttcttaactaagccctcttgcattattctccactaacatttctaatagtattgttattgattaaattctgcattctttgaaaacaatactcattgcaagcaaaggttttagtttcatacttcgataattgtgaatcttgttctaaccactaatcaagggatctagtttgtatttagagctataattttcaggtttcgcctatccaccccctctagtcgactttcagccatctatacctatccccgtcaaaactaccggtacacgggctcaacaatcctacgaacaggcctcccaaacacgcatacaaagagctcgtgttgtctgtgaccgtgggctgcctgtccccttgaaaccgaccggttggtttgttcccaaacgatgccaggggaaccggcgtccgtggctgagatggcctgccgccagggttgaatggcatgtgcctcgccataagatcaaggatacccgctagacctggtgaatagtcggttttaaataaaatcaaagatgcttgtaaatttaataagaatgacaagagaattaaatcatctagcctaaattgagttaagtttggtttgcaaactagggtgagcaagtgatcaattagactagcaagacaacgaagaaaacaataagcacaagtgatgaaaattacaataatgaaaacaacaaaagagacaccgaatttttattgtgatctcagtgatttgccgacactttttgacatttggtgtccatgctatggaagccaggatattagatgctattttatattaaggacatcaacgtttatattatgtgttgacaggtcacacgatgactgatatcctcacatccatatccctcctaatatagcatatcccaaaactcaacgctagcttgcttcttgttggccagccattaatagatcgatggaccaaattaattaagcgactactaaacggttcactgtgcgccccacgcgtccgcccacgcgtccgcccacgcgtccgaagatgctaagttggctccgacgcttccctaacgatgtgatccataggaaggggggcagctcgggccggaggacctcctcctccacctcctggaggaacaagagcagcagcagcttcaccgcgcggatcatccgttgtgcgtcctccgtcgttgacacacaccaccagcaccgtggtgatgatgatgacgacgatggcgatgaagacgacgagtacgacgactgtcgtctaccgtcgtcgcctcctaacaacaacgctagaagaaacaccaccaccactgctgtcatctcggcccgagccttctccttccgcgagctagccgatgccgcaggaaacttccgccaggacaacctcatcggagagggaggcttcggtcgcgtctacaaggcccgcctgccaactcgggtgcagcatgctgctgatgacgccgatctgcagggccttccggtggccatcaagcagctggaccgcaatggcttccagggcaacaacgagttcatggtggaggtgctcatgctcagcatgctgcaccaccccaacctcgtcagcctcgtcggttactgcgccgagggcgagcagcgcctgctcgtctacgagtacatggcactagggtccctcgaggaccacctgttattgctgcgtgacgatggccatggcagccctttgccctggcgcacgaggatgaagatcgcgctcggcgcggcgcggggcttagagtacctgcacgaaagcgctgtcatctaccgggacctcaagtcctccaacatcctcctcgaccaagactacgcgcccaagctctctgacttcggcctcgccaagctcctccccgccccgcgcaccaccgactcctcctcctcctcctcaagcagcagcagcagcggcggcggcaaggtgatgggcacgtatgggtactgtgcgccggagtacttgcggacagggaagctcagcgtcaagtcggacgtctatagctttggggtgctactgctggagctcatcaccggccgtcgagccatcgacgccagccggccggatggcgagcaaagcctggtgggatgggcggcagggatgtttggtgactccacgaggttccatgagttgctggaccctcggctggtgatggcgattcgaggacggcctacagcatcacagctgaagcaggccgtgggtgtggcgtcgatgtgcttgcaggaacaccacgccctacgtcccgtcatggccgacgtcgtcgtggccctttccttcatcgctaatgattcccctgcttctcccccctgctagctcagctcgatcaaaaaaaaaattgcatcacaatctctcgctcctcctcattcctctgtgtatctcactttttcttgttgtaaacattgagaagaagaattacatggcaaattaaacctagttatatttttcattcacggattagaatgttaatgcatgcgtatgtatacacgtacgtatttgaaaatgagaacctaactagtggcggagatcgaggtgacataattcaaggggaaattgtcaattgctgatcatcaagttggcctaccttagagtttgagagtctacccgttgagcactaaaaatgtccttgtggacggtccggctctaaggccggacggtccgtggttcggactgtccatcgtagcggggcaggtcgtccgcgcgtacgtagaatcagttggg

SEQ ID NO: 6105 - DNA, 1674 bp, Zea mays
cctgccggatggttacgcccctgtttgtacctgtcggtggatgcagccattatggtccaggtcatggcgagtacgaaacacgatcggccagagtgaggagccgacgaaggatcccgcacggtggcggtggaccaggctgtgttgcggcgtcaccgtcggtgttggggcctcgcgtgtgccacagctcgatcgctgatcgctccagactccagaccaccaggagactctctcagacagcataagctcacatcggcaataaaaaagcatccccgtctcccctgattctctccgcccagctcagctcagctccccgccgctcctctccgcgccccttcatcccggatctcggcatgggcaccgccaccaccaacggctcggcggagcaggcgtccgcgcccgtgccggcgctcaagttcctcatctacggccgcacgggctggatcggggggctgctgggcggcctctgcgccgcgcgcgggatccccttcgcctacggcgccggcaggctcgagaaccgcgcccagctcgaggccgacatcgacgccgccgcgcccacccacgtgttcaacgccgcgggcgtcacggggcgccccaacgtcgactggtgcgagacgcaccgcgccgagaccatccgcgccaacgtcgtgggcacgctcacgctcgccgacatctgccggggccgaggggtcctgctcatcaactacgccacgggctgcatcttcgagtacgacgccggccacccgctcggctccggggtcggcttcaaggaggaggacacgcccaacttcgtcggatcattctactccaaaaccaaggccatggtagaggaattgctcaagaactacgagaacgtatgcacccttcgtgtgaggatgcctatctcatcggatctctccaatcctcgcaacttcatcaccaaaatcacccggtacgataaggtcgtcaacatcccgaattcaatgacagtactggacgagctccttcccatctcgatcgaaatggcgaagagaaacctcacgggaatatggaatttcactaaccccggcgtggtgagccacaacgagatactagagatgtacagagactacatcgatccaggcttctcctggaaaaacttcaacctggaggagcaggcaaaggtcatagtcgcaccgaggagcaacaatgagcttgaccagaccaaactgaagagagagttcccggagcttttgtcgatcaaggagtcgctggtaaaatatgttttcgaaccaaactgtaaggcgtccaaggcttgacaagtggaggtgcgcacagctgtatgttgacgctatttgttccatctgaattgacattactctctccgggaactctcaataagcacaccccctgtttcgtgtgcaatgcatttgaaacggttaggtttctcataggagatgtcatgctgccatactcctttgtactttcagattattgaacggagcggggcaagcaaggtgtaatttagctcaactttcgcattggctcctggcctcctggggcgttatcataccgtgcggttggaatgaactgaggagcttcatgcctgcctgcttctgttgtgccatagaatttgtagttcgcgatgtttcatttgtaaccttttattgaatatgacttttaatgggatccttagcaatacaggacccctgtttcctt

SEQ ID NO: 6106 - DNA, 957 bp, Zea mays
ccggccgggaaatcccggtctggtctaggctcgggacccttgaggacggccgcctaaccacacaatcactccaccagatctccccgccccgcggccgtggcagcgtcggcgaggaagtcggcatgagcgtgttcggcggcgacagctgggcgcgtgatgcgcagcagcggaagcggcgtctcgacgagctcttgctacccatcacggcgccctcgtctccctcgacgcctgattccttcaagaagctccccaacggcaagctcgcctgcctcgtctgcccccaccgccccgtcctcgacaccccgctcatgctctccatgcataataaaggtgcacggcacatcgctgcagaatcgaggctgagggagaaagaattatctaagaagcacgaaattagcaagagactggctctctcttcagatgtttcccattcaaattctggcgatccacggaccagcgtttggcctaccaatatcaaagaaaaaccattgattgaggagacccggagggcaattctggaagcacagtcgagcagattcaatgatttccaaggcaagaaggtatctcgtgattcggaatggatgacaattacttcatcctttgactccaatgttgcttcttctgatgttcccaaggaactgtccactggaaatactggatcacgagaatggagctgtaagggacaatcttttgctggaaatcagactcaagacaagttattttctgacagacaaacagaagttcgaaaagcgccaggagcaagaactttggttcactgcttcaggctggaaacgggatggccatggaagatggtacagagatgaaaatgtgagttacaaaaatttgctctcgacgctattcatgagatgtgcttttctgtgctgaaactagaagtatctacagttcccagtattaacataaatatagtacatatagggatgaaaaaaaaaaaaaaaa

SEQ ID NO: 6107 - DNA, 1990 bp, Zea mays
ttgggtacctcgaggccggccgggttcttcaggaacttgcttctcagctcaacctgcgcgttaatcagtttgagattgtaaatttttatgttgttggagcttctgggctaaatatcacaatggatatagctccctatactggaattagctttgctgctgatcaagtcaaggcaatgaattattcacttactctgcatacagttcggattgatcctgtgttggtcggggactataatcttcttaatttaacttggttcaggtcattggctccagcgccagctccagcattcacaatggcacctagggcctctccatctacagcatctacctttccaagacagagtgagggtccaagcaacaatagacatgcaagcctgatcacagtggttattatatgtgttggttctctaattggagtcttgctgattgttttaacaatatgcttctgcacatttaggaaagggaaaaagagagtgcctcatgttgaaactcccaagcaaaggacagcagatgcagtttctacagtggagtcccttcctcgccccaccagcacaaggttcctttcatacgaagaactgaaagtggcaacaaataacttcgagccttcaagtgtgcttggagaaggtggttttggccgtgtcttcaagggggtactgggtgatggcactgctgtcgctataaagaagcttactaacggagggcaccaaggagataaggagtttttagttgaagtggaaatgctgagcaggttgcaccaccggaatcttgtgaaactgattggttattacagcagccgtgaatcatcacagaaccttctttgttatgagcttgttcccaatggaagcctagaggcttggcttcatggtacacaaggtgctagccgccccttggactgggacgccaggatgaggatagcacttgatgctgccaggggattagcatacctccatgaggattcgcagccttgcgtaatccacagggatttcaaagcatctaatatattgcttgagaatgatttccatgctaaagtgtccgattttggtctggcaaaacaggcgccggaaggtcggacgaactatctttctactcgtgttatgggaactttcgggtatgttgcaccggagtacgccatgacaggacacttgcttgtaaaaagtgatgtatatagctatggagttgttctacttgaactactaactgggaggaggcccgttgataattgtcacagccctctgggcaggaaaacctagtgacttgggcacggcccaattctccgagaccaagatagattaggagagctagctgatcccaggcttggcggccagtacccgaaagatgattttgtgcgggtgtgcacaatcgcagcagcctgcgtttcgccagaggcgaaccagaggccaacaatgggcgaggtggtgcagtcactcaagatggtgcagcgctctgtggagttccaggaatctgtgccaacacctcccgctcgccccaacgtccggcaatcgtcgacgacctatgagtctgatggcacctcgtccatgttctcttcgggccccttctcaggcctcagccccttcgagaccgaaaccattccaaggactgcggttttctcagaagatctccatgaaggtcgatgactggtggggggtggctgccttgccatcgccgagccgagccgtttctctagagcctgtagccatgtagtcaagcattcaaaggctggtggtccaattggcctggccagccattgggaggaaaggggtacctgtaaattccatttttctgcgccgtctcaaaagactactactagattattacaacccacaaggacgttctctggctttgtatggaagaaatggttttgttcgaagttgctgctgtcctcagtccatagctcctgaattacgcagacagacagtcctaactcctacatgcagccaaacgcccgttgtgtgggtggacatgtttgtagggtttctcaggggtaccgagc

SEQ ID NO: 6108 - DNA, 652 bp, Zea mays
gtctgatgccctggcaatgcaatctttcgttcttggatgtcagtgagaactccgtccgtgatattgagaaggaccaaatatttattgtttgaatattgaagggactggcttgcaatatctgcagctttgttgatctcgggcccgaacatagttggcccagcaagggaaacactgtaaagagaagaggtgtatgctgacatgatgccttcaactccaaccacctcagagtcatttgtagctgtattcaagttaaagcaatgtgatacataaccatgtacccttgctccaaaaccccacgtaggaaatcgcctatcattgtcataaaactgcagaacttcgccaacccccagcattgcctgttgatacgaattaggtctgccagaggggtcaatgtagtgcaaggactggggtacacgtgggtctccatttgaagcagtaaaatctatagccaccatgaaattgagctcaaatccactggatatataatctaagaaagtatgctggactgtttcctgaaacttgtccacaaacaattgttctttcatctttctttgtcccttgtggttgtaaaaatttgctgcagactttgaggtatatagattttcaagctgagtaatagttgtctggaaggcccctatcagttcatggtcac

SEQ ID NO: 6109 - DNA, 898 bp, Zea mays
tctcctccactcccgagtcccgacgcatctcgccgttcttcggctcatctgcgacggccgtcgtcgcactgtaccatcaccggacatgccgtctccgccgcggccgctcgcgtcgctatgccgcgcccgtctcgtgctcttcctcgtcccggcgctcctgctgctgctcccctccacggcgcgcagcgcgggggacgaatcggcgagggcgcttagcgtcggcgaggagctcgtggccgagaccatgccgctgcgccacggccgccgggtctacaggatcgacgggctgcgcccgtccgcgtggtacgaagtcaagatctcctacccggcctccataccgtcgagcttttccattcggcttgtggacgactggggcagcaagaacaggaggctgctcaacacggagaagataattttcaaggctgagagcagcagcccggtttatgttcttgtcactgtggaacctgagggcgtggtggcgaagccaaacgtgccagagagggagcttgcgctttttaacattgtttgcgatgagcttatgctcgggattccacactttgcctggtgggctgggattgcagcgctgctttgcatcgtgctggcggcactggcgccactcgttctcccgctgcacaagcttctgagctgcgaaggcacggagctgagcagaagtgatgccgctaagatgtcatgactcgcgagagatgatgcaatgcaggcaactgtagcgatcttctccatttctgacatttgaagcttggttgttgtaccattggagttaggtgctgtacgcgtccacgccagtcctgtatcgacggagtcacggagcaagtgttggacttcactacttcagtctctgttgatatagagtatatttttgacaaaaaaaaaaaaaaaa

SEQ ID NO: 6110 - DNA, 466 bp, Zea mays
atctcgccgttcttcggctcatctgcgacggccgtcgtcgcactgtaccatcaccggacatgccgtctccgccgcggccgctcgcgtcgctatgccgcgcccgtctcgtgctcttcctcgtcccggcgctcctgctgctgctcccctccacggcgcgcagcgcgggggacgaatcggcgagggcgcttagcgtcggcgaggagctcgtggccgagaccatgccgctgcgccacggccgccgggtctacaggatcgacgggctgcgcccgtccgcgtgataccgtcgagcttttccattcggcttgtggacgactggggcagcaagaacaggaggctgctcaacacggagaagataattttcaaggctgagagcagcagcccggtttatgttcttgtcactgtggaacctgagggcgtggtggcgaagcaaacgtgcagagagggagcttgcgctttttaacattgg

SEQ ID NO: 6111 - DNA, 1676 bp, Zea mays
  misc_feature (16)..(16): n is a, c, g, or t
gcacgagaccattacntagaacatcctaatcgaaaagccacactgttcccgttttttttgttaagctctcgcttaacctaaacgccgggagcacaacacaagtgctcggcgaaatgacgagcgccggggcggcgacaggcgccgcgctaggcgcgcggacggcgcggtcctgcgacggctgcatgaggcggcgggcgcggtggcactgccccgccgacgacgccttcttgtgccagacctgcgacgtctccgtgcactcggcgaaccctctcgcgcgccgccaccaccgcgtccgcctcccctctgcgtcctgctcctccccaccgcgcgacccggacgcgccaacgtggctccacggcctcaagcgacggccacgcacgccacggtccaagccaggggggagcaagagcaacaagcatgaggcgactcccagctttatcgccgcggctgcgtcgtcggcagcggtccccgacctcgaggcggaggagtccggctccggtatcctgggcggtaacgacgaccaccacgggttcctgcaggatgacgacgaagaccttctgtaccgcgtgccggtgttcgaccctatgctcgccgagttctacaaccccgtggccgacgagggggagcagaagccggcctgcagcctgctgatgccgtctctcgcggaaacatcgccggagttcgcctccggcggctcggcggaggcggacgggctctccgtgtcgttccacgtcccggacatggagctcgctagcttcgccgcggacatggagagcctcctcatgggagtcgacgacgacgggtttgactgtttgggtttcttggacgaagagaaacctcaggtgaacgcggacttggacgccatagtagcgccggcgcctgaaccagaggacaagaaacggaagcggccggagatgatactcaagctcaactacgaaggcgtcatcgcctcatgggtccgtgacggcggctcgccgtggttccacggcgagcgtcctcacctcgactgtcacgagctatggtcggacgacttcacgacgggtagccgggaactcctcggcggagccgtgacaccggtgaccggtggcgagcgtgaggcgcgggtgtcgcgatacagggagaagcggcggacgcgactgttcgccaagaagatccggtacgaggtgcgcaagctcaacgccgagaagcggccgcggatgaagggtcggttcgtgaagcgcgccacgcttccgccgctgccaaggccgccgccgccgcagcagcagcagcagcagaagcagctgccacgcgcaccgccacacgtgggcatggtgctcccaccacctccggtatcgaacgggcgcttgtggttttgagaccatatgcatgcatggaagcatgcatgaagcaacgtatgtgcgtgatgcatcgatgcatctatctcgctcgtagcatgcgcatgttctttctactctacttttaattcgtgcgtgcgaattagggcaccccacaagataatgctccctgcttacgactgaaatatatttgtttgtacatgtgcagaatagttaagaaagtatatttatagcctaggtttgttgtttatcttttctagttgttgtaaagaaggatgcactaaatacaagggaagggtgtagattttgacaaaaaaaaaaaaaaaaaaggcccctagggcc

SEQ ID NO: 6112 - DNA, 2640 bp, Zea mays
ggccaccactaaaccccgccggtaaccaccagcctccgggtcttgtcagccgcccggtgtcccggcctcagggaaaacgaacagcaccagaaccgcgcgcgcgcgcgggcgggcgccgtgatggacctcgcgtcgttcatcacgtccgtgctcacgtcgttcctcatcttcgtggcgctggtgctgctgttcacgtggctgtcgcgccgcccggggaacgcgccggtctactaccccaacctcctcctgcgcgggctcgacccgtgggcgggccgcggccgcggcacgcgcagccccgtgggctggctccgcgacgccatctccgcctcggagccggacgtcgtcgccgccggcggggtcgacgccgccgtctacctcgtcttcctctcctctgtgctgtccatcttggtgtactctgggatcgtgctgcttccggtcctcctcccagttgctgcaacgggtggtgccctaagtaccatccctatccctaccaacaaatcagcccaatcggctcagaacttctcgtcaatagaaaggctcggaatgggcaatgttgctgagaaaagtatgaggctgtgggcatttctgttgtcagtctattgggtttccttcgtcacctatttcgtcctatggaaatcctacaagcacgtgtcgaatttgagagctactgcaagatcagcaccagatgttaaaccagaggagtttgcggtgttggtgagagatatccctagaccgtctccagatgaaactataaaggactctgtagactcatattttcgagcccttcacccaaatactttctacagatcaatggttgtgacagatcacacaaaggctgataagatataccaagagatcgaaggtcacaagcagaaaattgctcgcgccgaagtcgtatatgcaaactcgaaaactgaaagtaatactgagggcacaaggcctactcataggactggattccttggtcttattggtacaaaggttgacaccattgaatactgtagtgagcagattaaggaattactgcccaaactggaggctgaacagaagactacccttcatgagaaacagcagcgggctgccattgtcgtcttcaatagtaggtctgccgcagctttcgcatctcagactctccatgctcaagtgtatgataaatggacagttatggaagctcctgaaccacgccagataatatggtccaaccttccaaggaaactatatgataggcaaatcagacaatgtgtggtttatggcattgtctttctcatagttgtgttctatatagttcctctcactgctatcgctgctgttacaaccctggaaaacctggaggcgaagctgcccttcctgaagccagtggtggagcaaccagcaatcaagacggtcttggaggcctaccttccccagattgcactcattgtgttcctcgcattgctacctactcttcttatgtttctctcgaaacaagaggggatcccttcgcagggccatgcagtcagggcggcatcgggaaaatatttctatttcatcgttttcaacgtcttcctttgctatacgcttggaagcacattgttcaaatctttgacgaccattatcaatcaccctgctgagattgtgaatatgcttgccaagagcctgcctggaagcgcaacgttcttcctcacgtttgttgcgctgaagttcttggttggctatggccttgagctctctcgcctggttcctctcatcattttccacctgaaaaggaagtacctatgcaagacggaggaagaagtgagagcggcatgggctccagtggatctgggatataacaccagggtaccaaatgacatgctcatcgcaacagttgttctgtgctactcagtcattgcgcctttgattattccgttcggtgttgcatactttgccctcggttggcttatagcaagaaatcagatcctgagagtttacgttcctagctacgagagctacggacgaatgtggccacacatgcacacgaggatcatcgcggctctgatggtttaccagaccaccatgatcggcttcatctccctgaagaagttcgcctacgcgtccgttctcgtgcccctgcttccagccagcataatcttcgcctacgtctgccacatgcgcttctacccggcgttcgccaagactcccctggaggtggtggtgcggcacgacctgaaggagactccgaacatggaggccatctacaccgcgtacataccgccgtgcttgaagcctgataagctcgaagatctggacgcgttcgaggacgcccagtcgcgcgccacctccagagtcccgtctatttagctgtgcacatcgtcgacttccgcggaagacttgaagaaattctgttcacttgtcattacattcgtgtgggatttctgatggatttcaatgcttccacgttgaaccctctggacttgtttcaggataggaatctgatgtgaagaatgtacatatgctcgatctgtgtgtctgctgagcgtgtgtggatgtggactgctgtaggtaggtagatgctgtggatattggagggttctaagttgtcttcatttccatccatccatgcgcgtgtgtttactgcaaaaaaaaaaaaaaaaaaaaaaaaaaaaccggacgcccgcggcc

SEQ ID NO: 6113 - DNA, 1757 bp, Zea mays
cattgggtacctcgaggccgccattattttcctggggctgctgcgccgcgcttctctctctcgccttctccctcttcgcggcgatccgggttccgctgcaacggcccctgtcgactgtcgtcttctcttctccctcacggcgctcgatccctccggattgccgcgtagcgggatcagtgattcagctggttgaacagaactagtaaagatgtcatcagaagggaacaaagatgtgcctaatgaagctttgtccgtggatctgtcatcgatttctggtgcaaagcgcaagcgtggccgcccaaggaaatatgagcatcctgcatatgaactaccacagaaggtacagcccctccaaagcgccccgcctcttcactgctcacaagatggctcaagtatggccagccatacatcaggcggctatgctcatggtagttggtccgcacaacctaggaattcggttaatgcttctattcaaggtaattctggcaaggatgacgttctcggcaagcattttgttggcaagctgaccaagaaaatccctgggttttccctcattacggtaaaagtgaaggacaatcaggtgctcaaaggttgggttccagatgaaattaatctccgtccaataacacctaaggatgaccttgccccagagctacccatgcttcgaccgagtcatgttcggaagcgagcatcagcaatccacatgcaaacagctcttactgtgccattgcacttggaggatattacacttgcaaagcctctgcagatgaggaggcctgtcgaggaaactattgctaagcactctgtgcctcttgctcctaggccttacatgggttctggtgttgttgcgccagtacctatatcagttgcacttgcacccaataatcctgaattgacaagtttgaccaggcaggatgctgaacttgtcatcccacaatcatcagttgctgcagtgccaattacatctgttcctccatgcaagcaactggctaatcaaaacgagtttactgaaaagaattatgttgatgagtttcagaaagattcagaatctcgaaatgtaaccaaggagttaccaggggaaaggcaacagcttaatgatcaagtgacagatgtggttacagaatcttctgctctttctcctggcaggtcaaatccagaatactgatgcaacagtgtctgataagatcaagataacatcaggcgccagagatcagccaaatcctgcaaatagtgagcagcatgagcagcagagttctaaggaaccatcagacatcacagaacaatatgagcagatgaagacagagaccgatgtccaaaaaggagttgatgcctcaaagtcagatgcctcagttccagatgacattcagcctgcgtgtgatgaacaagaaatcaaggttggctgtaaatgaaagtagagatcaagattcaagaaacacaacacagatcatgatgtttctgtcaggcgtattgggatgtggagctggagttttactgaatggcccaatgctttaggtgtaggcccatttttttacattttagattaagtagagatacatatttttttaaaaaaaaccaacaaacagcagtgtagcacagatagaatcgcaaacgagaaaaaaggagacagaaacatacttggtcttttcaattttaggaagatggcatgccttaaaagttaattttgaactcctaatcttgtaatataactttgggcccgtttggttcctttagttctgagaccaaaaaaaaaaaaaaaa

SEQ ID NO: 6114 - DNA, 2364 bp, Zea mays
ggtttaggttccctccccgccggcccgggacgctccctcctccctcctccctctctcttgccttctcccttgcggcgatccggattccgccgcaacggcccctctcgccttctccctcgcggcgctcgatccctccggattggcgcgtggaggggacagtaggtttagaggagagaaacaagtgccgattgacaccaatagggtattcttaccattttcagatcagctggttcaacaaaactagtaaagatggcatcagaagggaacaaagacgtacctcatgaagctttgaccgtggatcactcatcgatttcgggttcaaagcgcaagcgtggccgcccaaggaaatatgagtatcctgtaaatgaactaccacagaaggtacagcccatccagagcgccccacctcttcttcactgcacacaagatggctcaagtctggccagccatgcatctggtggcggtgctcatggtaattggtccgctcaacctaggaattcagctaatgcttctcttcaaggtaattctggcaaagatgactttcttggcaagcattttgtgggcaagctgaccaagaaagttcctgggttttcgctcattacggtaaaagtgaaggacaatcaggtgctcaaaggttgggttccagatgaaattaatctccgcccaataacacctaaggatgaccttgccccagagctacccatgctgcgaccgagtcaagttcgaaagcgagcatcagcgatccatatgcaacctgctcttcctgtgccaatgcacttggagaatgttacacttgcaaagcctctgcagatgaggagacctgttgagaaaactattgctaagcatgctgtgcctcttgcttctaggccttacattagttctggtgttgttgcagcaatacctatatcggttgctcccatcaatcctgaaatgagaacttcggccaggcaggatgctgaacttgtgatcccacaatcatcagtttctgcagtgccaataaaatttgtttgtcctgcctcggtaccatgcaagcaactggctaatcaaaatgagtttactggaaataagtctgttgatgaggttcagaaagattcggaatctccaaatgtaaccaaggaatcaccaggtatgctttgctggattggttacttgaattcttgaaactgttttgccccacagactgcatttcccatctgatttttcaatctcacaagtcttatggatgtcatattaatgcttgtaaatttgtacttctgtagtgaaagctgaaaaaccaaacattgctcttgtggatgtagtggccaaggattctctaggtaaaatctagtttatgtgctaccatttatataaaattataatgaaagtcgtctctgggttgaaagagacttcaattaatgtgctacaggggaagggcaacaacttaatgatcaagtaacggatgtagttagggatttttctggtaagatctagaattctatacttgaagtatatataactgacatattgcatgtagtataagtgctcttactcctggtaggtcaaactcaaaatgttgatgtgacaatgtctgatgagatcaagatagcatcaggtacaatataaattatactcccgatttccaattcaatattattttattaaaacttaaaagtgatcattaagtggaggatttcatcaggtgccagagataagccaaattctgcaaattgtgaacagcagagttctaaggaaccatcaggtgatatatgatcccaatattttacacactttttaaaaaactggccatgatcttataccgtgggtttgaaaatttagacatcacagaacaatctgagcagctcaagacagagaccgatgtccagaaaggagttgatgcctcaggtaaaaatgaaacctacatctctccttttaatgtttctagtggcatcctaatcttgattttatgataaatattgcgatgactgaatagttttgtgttgatcaaatcaaagggaatgcaatgatttgattatacccttttatctgcacaaattaaaaagttgtgctaaatataggaatttgtaattttgttgaattgcatccaagatgtctagttctcttgtacaacaagagcaacaaagacttttagtctcaagcaagttagggtagtctagagttgaaacccaacaaaaaccaccaaggaggtattctcttgtgtattctcctactaagcccatgccaaatttgttacaaaaatttgtacccgtgtgcaatttgttatctgccatgcataactagactggatggtcatggctcaaactaacttactttttgcctacggctgaaacatttagacaggcagcttaccatataaatgtcacctcc

SEQ ID NO: 6115 - DNA, 1232 bp, Zea mays
cttttctgtttctttttctcctcctccagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggaaggtagagaggaggaggaggaggtttcccgcgcgtccggaccagcccaatggttccatccgagatggggagcgtcgccaccgccgtcagcacgcctgctgcggacaagctgctccatgggcctatctctggcaagaagtgcaagaaaccaggcccgaggaagattcataaggctgagagggagaagcttaaacgagaccacctaaatgatctctttgttgagctgggtaatatgctagaagcagataggcagaacaatgggaaagcatgcatactgactgacactactcggatactaagagacctgcttgttccagtagactctcttcgaaaggaacatagcgacctacaaaacgaatctcattatgtaacaatggagagggatgagatgcaggatgaaaacggcgtgctccgcaaagaaatttcagagcttcaaaacgagttgacaatgcgggtttcaggcagtccagcaggttggggccatggcaccgccagatcagatccccctcttcctcactcaaccgcagtgttctcgtcggagcaggcgatgcaaccacccaccattgcaagcgttgtattcccgttgcagcagccactggcaccatcagcaatgaccaaaccacctcatgctgcaccaccactcgaactgaagctctttccagaagtggcatctgccgaaggccatgagccgtgtgaagaccacaaagctcccaaccatgtggcacgaccacaggcaaggtacccaacgcaatcagcctcatggcccgtaaacctgttctctggccttccacgaatggaagatgagcaatgcagtagcagcacaagcggcagcagcagagaggataacacagatatagaatgagtggatcagctcctacaatcaaagagtctctgttttgagtctagtggatgtaaatttgaatctcctttttggatttcagaacgatagattatactctgttggaaataggacccctcccattgcaagtctttgttggaatctctataaatgcgaatcaatcttactggcaaaaaaaaaaaaaaaaaagcggcc

SEQ ID NO: 6116 - DNA, 1180 bp, Zea mays
agccttcttcttttctgtttcttcttctccccctccagccgcccgtcctctcggtctccgaccacgactgtgcgccttcctaagtaaccctagctcggcgccctccctccgcgacatccaagcccggcaatctcatcgtcgcgcttgcaccgttacgcagtgcgacctctgcgtcttcgaatccaggtctctgcaggaaggtagagaggaggaggaggtttgtggcaggatttgaccagcccaatggttccatccgagatggggagcgtcgccaccgccgtcagcacgcctgctgcggacaagctgctccatgggcctatctctggcaagaagtgcaagaaaccaggcccgaggaagattcataaggctgagagggagaagcttaaacgagaccacctaaatgatctctttgttgagctgggtaatatgctagaagcagatagacagaacaatgggaaagcatgcatactgactgacactactcggatactaagagacctgcttgttcaagtagactctcttcgaaaggaacatagcgacctacaaaacgaatctcattatgtaacaatggagagggatgagatgcaggatgaaaacggcgtgctccgcaaagaaatttcagagcttcaaaacgagttgacaatgcgggtttcaggcagtccagcaggttggggccatggcaccgccagatcagatccccctcttcctcactcaaccgcagtgttctcgtcggagcaggcgatgcaaccacccaccattgcaagcgttgtattcccgttgcagcagccactggcaccatcagcaatgaccaaaccacctcatgctgcaccaccactcgaactgaagctctttccagaagtggcatttgccgaaggccatgagccgtgtgaagaccacaaagctcccaaccatgtggcacgaccacaggcaaggtacccaacgcaatcagcctcatggcccgtaaacctgttctctggccttccacgaatggaagatgagcaatgcagtagcagcacaagcggcagcagcagagaggataacacagatatagaatgagtggatcagctcctacaatcaaagagtctctgttttgagtctagtggatgtaaatttgaatctcctttttggatttcagaacgatagattatactctgttggaaataggacccctcccattgct

SEQ ID NO: 6117 - DNA, 726 bp, Zea mays
  misc_feature (604)..(604): n is a, c, g, or t
ctgggccccgcgccgggccggccgtgggcattctggcctgttcttaattattgccaggacaggagaaacaaacaaagatgaggcctcagctgatactcgtcggcactctggctgttctcgccatcctcgcagctctcggcgaaggctcgtcgtcctggccgtgctgcaacaactgcggtgcttgcaacaggaagcagccgccggagtgccagtgcaatgacgtgtcggtcaacgggtgccatccggagtgcatgaactgcgtcaaggtcggtgcaggaattcgtcccggcatgggccccggccccgtcgtcacctaccgctgtgatgacgttctcacaaacttctgccagaacagctgcccggaggcgtagttgctgggtggtggtgtcttcttctgacgccatgcgacgccaccagtttgcttctctccagctccgtcagacaagaaatagataaataaataaatgtcgccggccgctctgttcggtgcttgctcttgttcgtcgtcagagaagaaatagataaataaataaataaatagccataaaaaaaaaaaaaaaaggggaccaaaaaaacaaaataaaagaataaataaaaaaaaaanaaaaaaaaaaaaaaaccccaaaaaaaaaaaaaaaaaaagggccccccaacccccattttttttccctttaaggggggttaattggccctttgggcgaaaccggggaaaaagtggttcccggg

SEQ ID NO: 6118 - DNA, 844 bp, Zea mays
ccggccgggggccctggggggccaaggtggtcctccaggaaacatcctggattttcctctttcatatattcatattcaccgtcagtacgcgtgtatgatttggctttgtatttgcttcttgtacaagagatgaacaaaagtgcaccggccccgccctcgatcccctcctctatatatatatttgggagcagcccgcccggccgggaggaaggaaatctatccaagcaacaaacttggcattcttgcctgttcttaattattgccaggacaggagaaacaaagatgaggcctcagctgatactcgtcggcactctggctgttctcgccatcctcgcagctctcggcgaaggctcgtcgtcctggccctgctgcaacaactgcggtgcttgcaacaagaagcagccgccggagtgccagtgcaatgacgtgtcggtcaacgggtgccatccggagtgcatgaactgcgtcaaggtcggtgcaggaattcgtcccggcatgggccatggccccgtcgtcacctaccgctgtgacgacgttctcacaaacttctgccagagcagctgcccggaggcgccggcgccataggcgggtggccggtgtcttcttctgacgtacggcatgggacgccaagtcgagtttgcttctctccagtttcgtcagagaaaagaaataaataaataaataaatgtcgccggccgctctgttcggtgcttgctcttgttcgtcgtccgtgtattagtactctcttttttctttttctttcttgaataaagagccatatgctgcatatgccatgcaaaaaaacaaaaaaaaaaaagcgccccccccggccaaaaaagcggcc

SEQ ID NO: 6119 - DNA, 951 bp, Zea mays
  misc_feature (876)..(876): n is a, c, g, or t
tcgaccgcccgcgcggccgctggcctgttcttaattattgccaggacaggagaaacaaacaaagatgaggcctcagctgatactcgtcggcactctggctgttctcgccatcctcgcagctctcggcgaaggctcgtcgtcctggccgtgctgcaacaactgcggtgcttgcaacaggaagcagccgcctgagtgccagtgcaatgacgtgtcggtgaacgggtgccatccggagtgcatgaactgcgtcaaggtcggtgcaggaattcgtcccggcatgggccccggccccgtcgtcacctaccgctgtgatgacgttctcacaaacttctgccagagcagctgcccggaggcgtagttgctgggtggtggtgtcttcttctgacgccatgggacgccagtacgcaaccagtttgcttctctccagcttcgtcagacaagaaatagataaataaacaaatgtcaccggccgctctgttcggtgcttgctcttgttcgtcgtcagagaagaaatagataaataaataaataaataaataaatagccaaaaaaaaaaaaaaaaaaaaaacggcggggggggcgccgcacgccggccgggttataaaaaaaaaaatacacacagggggcgccgggtacccaattcacctttattggagtcgtattgaccccccatcttggggtgcattaaccccccctaataggcgcattacaactctcttatggcgcgcgccacgcccattcctctcgcggccactgtggcgttttttttcgcgcgttttcgccgccatctggggcccctaatcgaaatgttgatatgcctcccctacaagatccccctcgttttctactcgccaccctgcgtccgttttcgcggangtgaaatcgcacgaaactcccggactccataatcttatcccgccccggttctcttcctccccccacctccctttc

SEQ ID NO: 6120 - DNA, 807 bp, Zea mays
  misc_feature (6)..(6): n is a, c, g, or t
gtatcncctcgaggccggccggtggcccgcgggcggccgacccgccggcgaggaaggaaatctatccaagcaacaaacttggcattcttgcctgttcttaattattgccaggacaggagaaacaaagatgaggcctcagctgatactcgtcggcactctggctgttctcgccatcctcgcagctctcggcgaaggctcgtcgtcctggccctgctgcaacaactgcggtgcttgcaacaagaagcagccgccggagtgccagtgcaatgacgtgtcggtcaacgggtgccatccggagtgcatgaactgcgtcaaggtcggtgcaggaattcgtcccggcatgggccatggccccgtcgtcacctaccgctgtgacgacgttctcacaaacttctgccagagcagctgcccggaggcgccggcgccataggcgggtggccggtgtcttcttctgacgtacggcatgggacgccaagtcgagtttgcttctctccagtttcgtcagagaaaagaaataaataaataaataaatgtcgccggccgctctgttcggtgcttgctcttgttcgtcgtccgtgtattagtactctcttttttctttttctttcttgaataaagagccatatgctgcatatgccatgctcaaagcactgttggttggttttggttgtttgatttatgggctaggccctaccgtgaaattttattaaattctataaaaatcttaaaatctcatgtatagaaataacaaggaaatggtggaacaaatagtcttatattgctagtccaaaaaaaaaaccacccgta

SEQ ID NO: 6121 - DNA, 1069 bp, Zea mays
atcaacactccacatgctctcactcccactcccgtccctaccaccccgctccccgccatggcagcactcctcctcctcccgctcgtcctcgccgccagcctaggcttgggcaatgccgacccggctccggccaccatcgtgcacaaggacggcacgacctgcaccctctgcgcgtcgtgcgacaacccctgcaacccgtcctactactacccgccgccgtcccctcccccggcgccggtcaccacgccctgcccgcccaccacgccgtcctacccttccccctccggcggaggcggaggaggcggaggccccgtcatctactcgtccccgccacctcctgctgcttccggcggcggcggccttggtggcggaggcttctactacccgccgcccaccggcggaggcggcggcagtggcggtggcgcgtcgcagcagggcggtggtgtgtacccgacggcggcgccgccgccgcccaacccgttcctgccctacttccccttctacttctacagcccgccgccgccgttgcactccggcgcgcgggccctggccgccacctcgccgtccgccgcgtctctgctgccggtgctcctcctcacaagcatgctgctgctgctgctgtgtcagacgccgtgaggggtcgtccagatctgcagagcgagccatcattcaatgcgtgctgcatgcatgcgcgcatgcgctgtttctagtttctacaaggcggtgatcgatccagctggcgattcaattgtggttgggggtggcctgtgtattctaccggtactgaattgtaattgttgtcttttttttacgattcggttcatttcctcgtcctctttcttcttctctttcggattcgtagcacagattgtacaaggaggggggcagcagttagtaataatctatagcatacccttttcatgaagaagtctgttcgcctagctctctagctttctttctcacctctctctctctctgttctacatgggatactgtgcctattttaaataattgttttcattatgaggttggtaaaaaaaaaaaaaaaaaaagaaaaaaaaaaaaaaaa

SEQ ID NO: 6122 - DNA, 1299 bp, Zea mays
ctcgaggccggccgggacaacatacctgcccgttgttctgctaaaccaccaggggcaaaaagttaagagataaacggatagaacaggcgtggagcgcgcgaccccgtacgtctccaccgctgcaggaactccccccctccccggcggcccgcgcgcccaccaaccatggcagtcgcagccgccgcccaccacctgcccgttgtgccgcaccgccttgtcccggtccggcacaccagtagcagcccgccgccgcatccggcctcccgctgctccgccgcggggaagccgcccgtccagctccacgcggcgcaagcgagggcgtctgggttcgccgcgcgcgtcgcgttcaacccttccgggaactacgacctgtccctctccatgggcgaagacgagaccccgcaggtccagcctccgccgccgcctacccaagggcgcttcgaaatcgttatcaacaacgacaacatccgaacgctcgacctatcgccagtcgaagcagcactcggcgacttgagctccttgacaccagctgcttcaagaaccctgctggaccagaccgtcgggttcaccatcagctacgagagggaggacgagtacgacacgcgggagctgtcggagttccccgacatacggctgtggttcgtgaggctcgacgccgcgtacccttggttcccggtcgtgctcgactggagagccggcgagcttgccagatacgccgcgatgctcgtccctcaccagatgagcatgcggatgggcgtcgtcttcaacccggaggcgctggagctgttcgtgatgaagaaggtgttcgccgtcgacgcttggctgaagcagcagagccatcccaaaccgaggctgaagacggcggacatggcaaggatgctcggcttcggcgtcggagatgagctgttcgacctgatcgagaagtaccctgtccatcgttcgtgataaaaaaataattaaacaacaaagctgagaatagggatccgatcccacacacagaagaatcagtcgtctggtcggtgctgctgcctgctgctcataccatacccacacccttgaagtagaaactaaggcacgtttgctttgctccaggagaccaggagcgctctgatgttgtcgtgttcctcgcgtcgccttctcggcctgttgtactcagtagcgccgcagagtctctagcatgagacgacctcgaggagtctatgttgtcgtctatggatggaacagtcagcatagaccaaggccgtgacctttcctccggtgctagccctttcgcatgtatcggataaatttggttctgct

SEQ ID NO: 6123 - DNA, 5650 bp, Zea mays
  misc_feature (2564)..(2564): n is a, c, g, or t
  misc_feature (4755)..(4755): n is a, c, g, or t
tgtatccatctcctcggcaacgcaacagccaacagcaacaggcaacacagacaagagagaacaacagaaaggcaaaggccaacacgaacactgcgacagcccagaggcaggtagaacgttacgctacagagtccgtcgccacaggcggaaacggcaccctactttcatgtggtcaggcggcccagccgttcggagctgcacctggacctgggcatctcactgacatcttgcgccagggccaggtggcatgaggccagctaggaaagaagccagcacggcagcaccacacgtgcattggcggccctggccagaccagaccctgacctccctctgatggctgatgctgagttgtttgagctgtgaccacaaccagcagcggcggcagcggcgcgctctcctcaccgcttgcgtcaccggcgtcctctccccagtataaataggcggcaggccgctcgcccgctcccacatctcttcacggccacatcatcactcgctcggcgccatagccatcggcctcactagctgtctagctagcttccagccgcagcagcttgtcgtgcagataggccactcgctggggtacggttgtaaggttgttgttccgtgactctcgcacaatgccggccatggtggtggaggaggatctcatcagaggggcggcgcccgagccggagccggagccgcacctcctggtggtgaccttcccggcgcagggccacatcaacccggcgcgccacctcgcgcggcgcctgctgcgcgccacgggggcgcgggtcaccgtctccacggccgtgtccgcgctccgcaagatgttcccgggcgagcaggcgggcgcggagggccaccgcgacgccgcgggggtgtggtacgtgccctactccgacggctacgacgacggcttcgaccgcgacgcgcacgacgccacgcactacatggagcagatcaagctcgtgggcgccgccacgttgggggccgtcctcgaccgcctccacggcgtgggccgccccgtcacgctccccgcgtacgcgcgcccgctgtccggcgcggccgacgtggcgcgcgcccgctccgtgcccgccgcgctctactggatccagccggccaccgttctcgccgtgtacctccacttcttccgcgccacggacggcgtcgaccgggccatcgccgcggcgggcggcgacccgtgggcgagcgtccggttcccgggcctcccgccgctccgcgtccgcgacctgccgtcgttcatcgtctccacccccgagaacgacccctacgcgttcgtcgccgacgcgttccgcgagctcgtcgagacgctgggccgcgaggacaagcccagcgtgctcgccaacacgttcgacgcggtggagcccgaggcggcggcgtcgctgcgggaggctggcgtggacgtggtccccgtcggccccgtcgtctccttcctcgacgacgcggcggcaggggccggcggcgccaagaacggaggcaacaacaacgacctgttcaagcaggacggcgagggctacctcgactggctggacgcgcaggcgccgggctccgtggtgtacatctcgttcgggagcctgtcggtgatgagcaagcggcagatcgaggaggtggcgcgggggatggccgagagcggccgcccgttcctgtgggtgctgcgggaggacaaccgcagcagcgagggcgccggcgccggcgccgcgccgctggccgactgggagggggagcgcggcatggtggtggggtggtgcgaccaggtgcgggtgctgtcgcacccggccgtgggctgcttcgtcacgcactgcgggtggaactccacgctggagagcatggcgtgcggcgtccccgtcgtgtgcgtgccgcagtggacggaccagggcaccaacgcgtggctggtggagcggatcggcaccggcgtcagggccgccgtcagcgacaaggacggcgtgctggaggccgacgagctgcggcggtgcctcgacttcgccacctccgagatggtgcgcgccaaggccgccgtgtggagggagaaggcgcgcgccgccgcgtcggaaggcggctcgtcggagaggaacctcagggcgttcgtcgcgaagcagaccgccggcggcaagaactaggcctggccgtctcgctagacctcgcgcgcgtcgtcgcatcgcatgcatcattggcttttcccccacaaggccacaacagctagctggcattagatagtgctatgctatacaaggcgtaggatatggtcatatggaaatctacgactgtacgtacattgttgctgctgctggatttggttcgattggaattaattactaaacgtctgttatttttaccaaatatatatatcgatgtacatgcatattcatgaagtgtttttttctttaaaatcattgttcttcgtcaaactcatggtcatggtatatgacattcaaatactgctagctggtctctcagatcctctatcacgtccactatttcatctcatatttaaaactttactaaacagtctcaaataatatcatatacaattatatttctctattttatcctatctatattgnaaacagtccactcgctgtcatgtcatgtcggccgttggctgcgctctcgcctacattttcaatttcctctagaatttcctacgagtaaggctattcctattgcacagtttcaaaatcatgtaatatatgtagaaagacatcttattaaaaaagaaaaggaatagtagtgttgaacggagggatgaggaaggataaagagggatgagatgagatcattctaactttacccgcgtttggattggaggtccaaaatgagggtcaaggaatattcttcaaaatggtggatgaggttcattccttaaaaaataagggacatggtcagctcaaggttgatcacgttccatccctcgttgacaccgaaccatgcaaacacttgttgttttagataaggtttgagtcaaactacaaataacaattttattttgtagttttgaaacataatgtttatatacaccaatttctcttaacaagtattttttataaatgtattaagactttatctatattttaacaaaaaacattagtcaaagttatattttggagacagtgtcgctatcctaaacgacaactacaccggagagagtaccactttggcacgagatcatatgcacgaaaatctgaaccatctaagtggcccacaattaatactcttatacacatctatcattcattgccttgtggaaactacaaaataacatatgatactatacactgggacaatagtattgtatgatgtggcaactttagatattgtgacaagaaacaattgattgagaattgcctaattagtactatacgtttctaaagatttgttttacgatttcaggaccacattaaggattcctttcaggttcaaaaccttaaacattttctccgagattttatgttccaaacagtgccttaagttataggctacttaatcagttaaaacaacttctactccacacacacatgggtccaagatgaaagctacttattatcccatcattttctttgattgtaggcagcttgaagacaacttttgccaattgctgtggcccacagagatctccaggtttgagtgtgacacgaggcttatcgctaaacatgaccctttttttctttcggaaaaggaaatgtggttacttgtatacactagtatgcacgtatctctctctctatgtaagtgtacgcacatgtacttggacttgtttggacgtgtcccaataacttggtcgacatgttctttttcgcattgacggcggttgacggtggttgacggttccaaggacacgcgccgatgcaagtcgacgattggaatgaagtagcacacacagaggtgtaatagaagaggtgagactagatgcgttggttgctattaggtgacaacacccataggtatttatagaagaaaaccacattcgattctaataaaaatgcacaccatgtaaggattcacatcacataaggatctattgatccaatccacaccagataaatgtgtcgatgattcttatcagataaggactgtacaataaacttatcatattagtactctgccataagcggcaaaacaaaactacaaaaagtaagctgcaggcgtgcaaggcttggaacccgaattcggcagaccatttacgcgcatgtcgtgtacccacgtccttcgcctcacccgactcgatgaggcgaacatgggcatgtgttctcttctacccgtaatacctaaatttgtaaatcatgtgataagagaataatttctttatctttatgtgtgagttatatctatttaccatcacatgtgaacgctacaattacaaacaagtaattaacaaaagacattgaattgatttatgcatcatgttgagttttacatgattgcgcatctgtggataatgaaataaaaaaatgttaatagtaatgagttaatgggtccatagaatctaaacactaattagaaaaacaaaaccataaaaatagagaaggaaagaaagagatattatacaatacaaaataaaaatttataattaaaataactccatcacattgtgatataatcaaatttaatagttagcggaagtacaacctcgccacaaagatgaatttaaaatttttattgaaatttgaatttgaaatggaaagaaaagaaataggagaaataaaatgggaaaagaaaaagagttaatgtgcccttgggccgttttccctcacttcngcccacctaacctccccttttacctcgcgcggacctgttccacttctttcgcggcctggtgtgcgctggcgggtgggctccattggccagtcaccagtcgttgcccacgcgctgacagaagctgcgtcacggggcccacttgtcatccgcgagttagagatcgtcaacctcgggccgtaacagcttgatcgattccctcgcgtggctgtcgggatgaactccgcgccgcgagattcaagccagcggactcggactccttggttcaggctttaaaccgcgtgcaccgccttcctggtgcccgtgcgtgtggcaccaacaccgagggtccgctatcgccgtcgcggtgagaaaacataatcggataggttctagccaccatggaaactgcgctaccagtgtcctcgggatctcgttggctaaactgggtgcctcactgagtccccggggatgtgcccgtggtaccgtcacaaggaatcagggcctatatggtcgaaatagtgcggcaatgggtggctgaccatcacggagttgggtcttgccgtggtctgggtgcgccacatcaccatctctggtaagatcctactaaccgaatcatagtagacttctcgtggtttttcgcccaagcgtgtagagtatggaggtgtggggagagttcgggtgttcggcagccatggcgccgccgcatggatgggtgcgccgccgtgggtgtccatcgggaggtggaaggcaatttcgtggccacaagatccctggggaacggctaggattagtctactagtaccagttcgactgggtgaccgggaccgtcgatcggtgtatgcatggtgaagattagatcgcgccttcattaaattgtgagcgttgatctttgatctaacgggtgccaattgcgtac

SEQ ID NO: 6124 - DNA, 2477 bp, Zea mays
  misc_feature (2420)..(2420): n is a, c, g, or t
cattgggaccctcgaggccggccgggcccgtcccatgcggccttcccagcctccgacgccccacctccgatgcacgccttgtgacgtcacccgtgaaccaggcccacagatcccacccgcccgcagtcccgcggcgcgccccgacaccgtcctgtcccattggcaacttgcgcgctactctgactcggagtggccgctactctaccccacccacacccttccgcccgccgccactaaaccctagcgggacacccgccttgctcgcgccgcctcatcctctcactcctctcggacccccggtggccggtgcagagctgcgcgaccgagaaccgaatctgtgagccatgtcgaccaacaagggcagcgcggccaagggcggcggagggaagaagaaggaggtgaagaaggagacgaagctcgggatggcctataagaaggacgacaacttcggggagtggtactccgaggttgttgttaacagtgaaatgattgagtactatgacatttctggttgttatatattgaggccatgggcgatggaaatctgggagctactgaaagaattctttgatgcagaaattaaaaagctgaagctcaaaccatattatttccctttgtttgttactgagaatgttctacagaaggaaaaggaccacattgagggctttgcacctgaggtagcttgggttactaaatctgggaaatctgacctggaagcaccgattgcaatccgccccacaagtgagactgtcatgtatccgtacttctccaaatggataagaagccaccgagacttacccttgaggtgtaatcaatggtgtaatgttgttagatgggagtttagcaatccaactcctttcataaggagccgtgaatttctgtggcaagaggggcatactgcttttgcgactaaagaagaggcagatgaagaggttctccaaatattggaactgtaccgaaggatatacgaagaatttttagcagttccagtttccaaagggagaaaaagcgagatggaaaaatttgcaggtggcctttataccaccagcgttgaggccttcattccaaacactggtcgtggcatacaaggcgcaacctcacactgtcttggtcaaaactttgccaagatgtttgatatcacttttgagaatgagaaaggtgttagggaaatggtttggcaaaactcttgggcctacacaacccgctcgattggagtgatggtgatgacacatggtgatgacaaaggcttagtattaccaccaaaggtggcgccaatccaggtaattgtgattccagtgccttataaggatgctgacacaactgccataaagggagcctgcgaatcaactgtttacacactcgatcaatctggaattagagcggatcaggacacccgtgaaaattactctccaggttggaagtattcccactgggaaatgaaaggtgttccattgagaattgagattggtccaaaagatctggcaaacaaacaggtgcgtgttgtccgccgggacaacggtgcaaaggttgacatccctgtgaccaatttggttgaagaggttaaagtgttactggatgagattcaaaaaaatctgttcaaaacagcccaagaaaagagagatgcctgtgttcatgtcgtgaacacttgggatgaattcacaactgctctgaataacaaaaagttgatcttggctccatggtgtgatgaggaggaaattgagaaagatgtaaaaactcggacaaaaggggaacttggagctgcgaaaacattgtgtactccatttgagcagccagaacttccagaaggtaccctgtgctttgcatctggaaagccagcgaagaagtggtcgttctggggccgcagctactgattgcctgtgctgggattatttctggattcagttctagtgagttatgtagctttgaagtgtcggatacaaatccaaaaatccatttacattgcgttttacatcgacttgcagttctcatgtcatcactgctgacaaaagccatcgatttcctgtggaccatgctattcgagtttgaatgttgcaaggatgagaatacgtacattcttttactggcgtgcagtgttataattagaaaaaacgcttcatatttgattgcaacacataattctgatcggaatttaactggatctctttatctcttattaaagtagaatttgttatggagggccggcccgcttcccactaggtccctagtttagcctgtttcaccttttggttttgtaataatattgcattaggaatggcctacggttttaccaaattacaatcgatgtctccagtgtaggtcccactcgacaatgatcggtgaaagtgtgataaagattcctttaggcatgccatagtggtgcagaattgagtgtataactgttgacgtctttttttggccanacactaataagaaccggtggtggtgctctttgcacggcggacggtccatggcccggg

SEQ ID NO: 6125 - DNA, 2142 bp, Zea mays
gggtacctcgaggccggccgggacaccttatctaggctcttctcttctctgtgctctcggcctctcccgcataccagccgccggcgccggcctactccgcccgacgcccctcctcccccaccggcgacctccgcccgacgtaccttcttcccgcaccgccgcccaacgtccgggtcgcccccacgtatccatgccttaggtgccggctagcccctaggcaaggcggtacccctccgcccagaggcgcgcccaggcgagcgcggaagagcgccttgttgaacactgaccaggacacccgcctcgctcgcgcctcatccttctccctgattcccggtacacagctgcgcgaccgaggaccgaatccgtgaaccatgtcgaccagcaagggcagcgcagccaagggcggcggagggaagaagaaggaggtgaagaaagaaacaaagctcgggatggcgtataggaaggacgacaacttcggggagtggtactctgaggttgttgttaacagtgaaatgattgagtactatgacatctctggttgttatatattgaggccatgggcaatggaaatctgggagctaatgaaagaattctttgatgcagaaattaaaaagctgaagctcaaaccatattatttccctttgtttgttaccgagaatgttctacagaaggaaaaggaccacattgagggctttgcacctgaggtagcttgggttactaagtcagggaaatctgacctggaagcacctattgcaatccgccccacaagtgagactgtcatgtatccatacttctccaaatggataagaagccacagagacttacccttgaggtgtaatcaatggtgtaatgttgttagatgggagtttagcaatcctactccattcataaggagccgtgaatttctgtggcaagaggggcatactgcttttgcgaataaagaagaggcagatgaagaggttctccaaatactggaactgtacagaaggatatatgaagaatttttagcagttccagtgtccaaagggaggaaaagtgagatggaaaaatttgcaggtggactttataccaccagtgttgaggccttcattccaaacactggtcgtggcatccaaggcgcaacttcacactgtcttggtcaaaatttcgccaagatgtttgatatcacttttgagaatgagaagggtgttagggaaatggtttggcaaaactcttgggcctacacaacccgctcgattggagtgatggtgatgacacatggtgatgacaaaggcttagtattaccgccaaaggtggcaccaatccaggtaatcgtgatttcagtgccttataaggacgctgacacaactgccataaagggagcctgcgaatcaactgtttacacactcaatcaatctgggattcgagcggatcaggacacccgtgaaaattactctccaggttggaagtattctcactgggaaatgaaaggtgttccattgagaattgagattggtccaaaagatctggcaaacaaacaggtacgcattgtccgccgggacaacggtgcaaaggttgacattccggtgaccaatttggttgaagatgttaaagtgttattggatgagattcaaaaaaatctgttcaaaacagcccaagaaaggagagatgcatgtgttcaggtcgtcagctcttgggatgaattcacaactgctctgaataacaaaaggttgatcttggctccttggtgcgatgaggaggaagttgagaaagatgtgaaagctcggacaaaaggggaactcggagctgcgaaaacattgtgtactccatttgagcagccagaacttccagaaggtaccctgtgctttgcatctggaaagccagcaaagaagtggtcgttttggggccgcagctactgattgcctttgctgggagtccttttggattcagtagtgaaccatgtaactttcgagattttggatacaaatcggaaaatccatttacattgtttttacatcgacttgcagttctgatgtcatcacagctgaaaaaaagccattgattccagtggacattacttccgagttttgatgttgcaaggatgagaagacatacattccttttactggtgtgcagtgttgccaagtagaaaaaacgcttcat

SEQ ID NO: 6126 - DNA, 2248 bp, Zea mays
acattttttactgcgagaggctcctcgtcccactttgcattgcacccccgcaagctctcttcactctccccagctcaactcaaatgcaagcaaagatcgagcagaaacggcagcggctgctgggcatcgcgcccgatctgccgctgcacaagctccagctcgtcgtcgccccgaccgcggcctcgctcccggcgctcgccgtggtcgccctcctcctcctcctcctcgccacggcgcgccgtccgtgctccttcctcgacgcgtaccgctccggcgtcgtctccctgccttccccgtccagaacctcgccgccccacctcgggcgctctgcggccgccaacagggtgccgagcgggtgcgacatcttccgcccgggccagtgggttcccgacgacgacgcgccgtactacaccaacctcacctgcccgctcatccaggagcaccagaactgcatgaagtacggccgccccgaccgcggattccttcgctggcggtggcgccccgatggctgcgacctgccccgcttcgacgccgccgccttcctggacgccgtccgggacacgtcgctggcgttcgtcggggactcgctcgccaggaaccacatgcagtccctcatgtgcctcctgtccaaggtggcgtaccccaaagacgtctcgacgacgacgaacccagagttccggacgatgcgctacgaggcgtacaacttcaccatggccatcttctggtcgccgttcctggtccgggggcaccagccggacccgcggcgccacatgtgggacatctacctggacgagccggacgcggcgtggcgcgacgccgtctcgggcttcgaccgcgtggtcctgtcggcggcgacctggttcacccggccggccatgttctacgaggccggcggggggcgcgtccgcgtcgtggggtgccactactgcctggtcccgggcgtccccgaccggacgctgcgctactcgctgcgcatggcgctccgctccgcgctccgcgtgctcacggggccccggttcaacaggacggtgatcctgcggacgctgtcgccgacgtcgcacttcgagggcggggagtgggaccggggcggggactgccggcggacgcggccgttcgcgcccaacgagacgcgggtggcggggctggacctcgacctccacgcggtgcaggtggaggagttctccagggcaagggccgaggcggaggcgtccggcggggggacgaggctggcgctcatggacaccacggcggccatggtgcttcggccggacggccacccgagccggtacggccactggccgcacgagaacgtgacgctgtacaacgactgcgtgcactggtgcctccccggccccatcgacgcctggaacgacatgctgctccagatgctcctcgcggacccatcttgatgtccgtgtgtttcttccgctagctccaatttgtcccaggaaaacaaactaatttgagcgcgcaaatttacaaaactagaccggaactaactgagctgagcgtgcacgaatccagcggccacagctgggtaaaatgccgtgccactatggcaatttgtatcagcttgatctacagaacaattggccgagcaatctccttcgtcggcctatacttgtttgtctgcgttttggcctgggttaattgagctactgatctgaaccgtttactcctccatcgggcggtccgaaagatttgttcagatgctagggtggcatttatgtgtttacaatgttagtgccatggcatagcggatgcgtgcgtgcgtgcaggttgcgcagatccagggacaaactggccgtgagcgaacaacaaccacatgccatgttgccatgttgggagtacgactttaccgtggcccacccagcagtagcacgtcgtcgaggacatccagcgcacacggccagacgggcctccggccggaatgtctaccttgccttggagaaccggacgcggcttgggcgccaagagtcacggggctgggctacgcgacagttgataggaaattagaaaggatccaaggcatcgaagctcgatttctacaagctgccggtactttccacctactgagtcaatggaagtcagatactaaccaaatgcgctgtttcggcgcgcgtaaagcacatgcaggaatctgtggtgtgaccagatgatgctggatgaccagctcgagctctgagcagctcggagctctgagcagctcggattcggctcgcgatgctcgagtgaatcgagccgaatc

SEQ ID NO: 6127 - DNA, 1873 bp, Zea mays
  misc_feature (1107)..(1107): n is a, c, g, or t
acccactcgaacccgggcacctctagatcgacctgcaggaacgtctatatggcaaaaaccatacgtacgttgaagagatccgtacgtgtccaccacgccttacctgcccggccgcctgtcgtaaccaaagccagctgaccacacgtacgtttccatatcaaccgctccgcctgcatgcgcgacggcgtgttcatatatactgtaataaataaatcccagcgggaatgagcagcccacagaaaatcatgcaacgattcatgggtttctactccacacaagtcaggttcatttcacgagtaagtaaagtacaactgccttctaaaaaaacacttgccatttttcgttattttcgtctcgacttgttttctcactactgtcactggtgagggactgagggtgacggccaaggccaacccagcagctagcgccataaatacgcgcccttgcttgtttccaaggctgctgtgacgtccgcaccgccagcgccacccgcgtcgccatctccaccaggcatccacaccaccaccttgggcgccgggcccttccatgctttccttcgctcgtcgacaagaacaagatatactagtgctagctgttctgtgctgcggtcgtcgtcttcttatataagacgccaacgacgcatgtcctcggagcctgccgaggccaggatatagaggcgtcgccgggccgggccactgcacggtcggcggatatggctgtcgaagcgcacagcctcctcttagcaggagggcacaagcaactcaccagcgcgggatggccttggacgaccggcgacgaagctagatgcgcgacggcgcgaccgagccaccagcaggctttccagctccagcaggcctcgtgtgtgggcgtgggcgtgggcctgccggcggcggctccggtctcgtcggccgcggcggcgccaccagcgccgatgatagcgcagcagtacgctgctggcggacggctgttcgtgggagacgcggcggagagcggcgtcacgttcggaggaggaggtgcggtgcagcaggaggcgccccggaagcggaagcgcgccgagcaggggcagacgccgccgccggttcttgggaccggcgcggccgacgtggncggcgcagtttcaacagcagctcgtcgacgtcgaccgtctcgtcctccaacacgccgccttgccgtgggcgggcccggcggtgccggccaatgcctcgatctgcgcctgcggggccggggttgtctagtacgtgcgtcgtcatcaacgattcaacgtgcactgactgtgactgatggagaggtggcgtgttaatttttgcggcggctttgaacaattgcagaccgccaagatgtgggcggggctcaccgagcagcggcggcggcacgcccggcaggtcgtggccaccgtggaggccgccgcggccccgcggctgcgcgcaaaggaggaggagatccggcggatgcggcgcgtcaactgggcgctcgaggagcgggtcaagagcatgtacgtcgaggcgcacatgtggcgtgacttggcgcagtccaacgacgccgcggtcaccgcgctccgcggcgagctgcagcaggcgctcgacgcccagcagacgcgccgccgcgccgacgacgccgactcgtgctgctgcggggagaacgacgtcttcatcaccggagcaggcgcggcggagaacgaagaggaggccgggaccgggtcgtcgtcgtcgggccacgtcagcggggcgtgcgccgtgtgcggcgacaacgcggccgacgtgctgctgctgccgtgccgccacctctgcgcgtgcgcgccgtgcgcggccgcggcgagggcgtgcccggcgtgcgggtgcgccaagaatggcagcgtctgcgtcaacttttcgtg

SEQ ID NO: 6128 - DNA, 3735 bp, Zea mays
aaactgagacggtgcgacaaactgagtggcaaacctaatatgctaagtcatcaaagcatcgaaatttcagagtatcaccgggtagatacgaacattcaggcattgaatcagaaactgagtcactctatcacaagttgattaagaagacaaaacatgtataatcatgatgaaaacagtacctgttgactcatagttcgaacaataaaacacacagttcagatttgatcggcatattatgaaaagcaaattgacaaatgacgttagcctgagtaagaagatgacacatggaaataaacaatagaggaccagcagatataatcaggaagtggcgcttatctgcataaacttaagaccccttgtgaactgaattcgtgacgcagtatgataggtagaaaagaacattcagttccagccacccaactgccgtgaacctatttgatgctaccatcgaaggtcgaggtgctcctccaacttcgaatgtacctcgcaaggccattccgtcgtcggggacctgatctgcagcgccaccgcctcctcctcctccggcactgttgaaatctctcccgcctccaccggcgccgcatatatgcaggacaaatcggcgaggatgcgtggccgcaaaaatgttggggaggttttgcgggctctgttggacgggagaaaacgagatttcccccaaaacaacgttttttcgggagcttttcgcgtcttcttggagttgttcttatctgctaaatgaattggcagcgtcctgccaatatttcttcaaaaaatatagtataatttatgcttatatgtattatctgctgaatttttaactagaaatgaaatgattgttttcagaaagcatccttctctaccgtggggttcgacctgcccgactggttcaggaacccaaaggatggttatccttgttccagtttggtcgcccctggcgatgatgactttgtgctcccggccaaatcagacttctcagaacaacaaggttgctctgccaccggtggaggatccagtccactgtcgatccttgccagctgccctgcatcccatgaagatgccgaatttgaggccgacatggatgaggtcagcaggattttgagatcccggtttgcttctccagaggctattgtgatcaccatggactgctgccctgtcagggtgtcagcacgccttgtcagcaaggtcctgagcaggttcagcaatgattgggtggccgcatttgggttcttcatgtgggccggaactcaggaaggctactgtcattgtgctgattcatatgacatgatggtagacatattgggcaagttcaagcagtttgatttgatgtgcggtctgatcggccagatgcatgagattggggggttggtgtcgctagcgaccatgacgaaggtgatgaggaggctatgtggagccaaccgatggagtgacgccattgatgctttccataaaatggaccgctttggggtggcgaaggacacaaaggccatgaatgtgctcttggacacattgtgcaaggagaggagtgtgaagcgtgcaagaggcgccttccaagctttgaaggggacaattcctcctgatgaaagtagcttcaacacattggttcatggctggtgcaaagcaaggatgctgaaggaggctcgcgaaacaatgaaggagatggagcggcatggtttcagtccttcagtaacgacttacacctgcctgatagaagcgtactgcatggagaaagattttcagacggttgatggtatcttggatgagatgcacacaaaaggatgcactccaaatattatcacatacacaattgtgatgcatgcgctagggaaggctgggaggacacaagaagctttggatacttttgacaaggtgaagcaagatggctgtgccctagatgcttctttctacaactgtcttatatacatactatgcagagctgggaggttgcaagatgcaaattttgtggtcgaagaaatgcaccgaactggaatatccccaaacttgactacctttaacaccctgatttctgctgcctgtgatcactctctggctgagaacgcacttaaattgttggttcagatggaggaacagtcatgcaacccagatatcaagacgtacacccccttgctgaagctctgctgcagaaggaaatgggtgaagacgcttctgttcctgatatgtcatatgttccggaaggacatcacccctgatttcagcacatacacattgctggtgtgctggctatgccggaacgggaggctcacccagtcctgcttattcttggaggagatggtgctgaagggctttactccacagcaggcgacctttgatcttgtgctggagaagcttaagaacatgcacatgctttcagcagtgagaaagattcagcttctcaggatgcacacagaaggtactaggtgtaggagcggtgttccatcttatttgagagaggatggtcacgatagacactgttatgctgtattgtcaaacactagtgaagctgaatcttcaatagatggaaaagaggtacctagagctgtgcatatactgtaaaaactactgttgatctctagccttttacacttgaatattgtacttctcattgtatgctgctcgtatttttctctttttaataagaatttatgtatatgcccatatcaaccaaggatggttagtttttttttcctcgcaccttaatcttgcctcgatctgtagtaatatctatctttttacccttaccaattgacaagggcagtatatgcttgtttttccttggattttttcaccaccatattgcatagccagactgtttgtttcgttgtaatgacatttacaggttcgttattagcatatacaaatttcggtgcagtaattctcactgtgtatatgcttttcaggatattcagggacatcatttactccccacataataaaactgaagcctaacaatttacttgaaaccatcatgtgatgtgcctaagttatattcagggggtatttttgtattcatgattaagtgaactgctgttcaagaacatacttatttgttgaaatgttgtggcgtatccatgtggcttacaaagtccagccattctccagaccttatagtcaactttcaacaactgaatttccatggagttatagccacatttgtctattaaaacggagcaccaagagagagttatatgccgttttttacttatagaacaggcttgaaacatttacgcattgtctttccacttctccagcattttaaccttttatcatccttttcttagctgctctgaaacatccattttctctgtgccatcaatggatgcttagcacagatcgcttccacatatcacatgatcaatcagtactgggcgtatagcatattgttcagaaggtaattttggaaactttggagaatgtttgttcagttaaagacgaattatctttgcttgctttccacttgcactaacgggccgtttggatctcttcattttggatgaattggaatttacttaataaagtagactatttagcttggaatttgacattccacaactttccaaagtctaaatataagcctatatcaaattcgtagggtggagggatagaaattgattttatgtatctccatgatatgtttctactctttaatttataacatgctcttcggcttacttccctgtagcagaaatataacacataaatacctccctcgtatggctaaaagtggtacacaaatatatt

SEQ ID NO: 6129 - DNA, 4338 bp, Zea mays
  misc_feature (1666)..(1666): n is a, c, g, or t
  misc_feature (1903)..(1903): n is a, c, g, or t
  misc_feature (1985)..(1985): n is a, c, g, or t
  misc_feature (2139)..(2139): n is a, c, g, or t
  misc_feature (3745)..(3746): n is a, c, g, or t
  misc_feature (3808)..(3808): n is a, c, g, or t
  misc_feature (3826)..(3826): n is a, c, g, or t
  misc_feature (3877)..(3877): n is a, c, g, or t
  misc_feature (3905)..(3905): n is a, c, g, or t
gttcaatatgttgtataaaaaggtgtaaccttaaaattcaatgcaaacttgcaaagatattaacaattaagtcagtaaagagaagggcaagagataccatccttgagaaatctaccaaacatgtatatacatgcgctagtaaacatccttctcttatcacctcaaacagataaaaataatttaaagttgtccagttggtagcatcttaggtcttatccctgctacttgcatatttgcatcacaggttgtgattcttttttgctcgacctccagaccacaaagaaggccaacttggagttttgatttgacttcggattttatttttaagttatttactggcaaaaaaaatgggtatactcagtgctacaggcttctggccacaaaaaataaccaagttattgataaccttcatgtgaacataaaaaaactcgatctacaggtggtaagacagccctgagcattgtattaagaagacttcacataggtcaagaaaaccccccgaacccctaccccacccatacaaagtggcatcgtagcccatgtgagaacgaccggggccaggccttaaacctatgcttggtgtgggacagttgatgggatttttttaaccccagcttgaaatctgctcccacatggagtagaacttagaacctgagtgctactcggaccacctaaccaactcagctagaggccatttcgcaaaaaaaacatagatattagtatcttcgttaaacagtgttacaaagatccaatttacactccacagcatgatgatttccatgtgcagcacaccatatgtgttggaatgtgggccaaaagttcaatacccagaactggtaaatcaaacaatgtaggtacacaccggcacagttctgtaaatgagagatgtctattctggttaggcctgtcacaatcagtctctcttcatttcttagtaccttccatagtcactttggtaaccttcataaccaaagcatcacaaaaagcttcaagacccctcagagcacgtaggaacaacaacccacaaaatcatcacaaaagcctctatccttaagacttcagacactgtaaaccccaaccactagcctcaaattgcccagtccacttcattcctgtgcaaccatgcttcccacagccccaaaggctcacaacccttaccccctactaaccattgtcacgatgcccccctacaaatttacacctagaaatcatacatggaggacattcagtgagaagagcatgtcatattatcgcctcaacgtcaataactatgcatacataacgaatgagttgcatggttcatataattcaaccacatttatacaatgaacaaaatttagcataaattctctagcgcagcgttccagatcatccgcagaaacaggagcttgcccatttttcaatcccagttttagacagatagtgtgagccgcagagttcccagcaaggggaggaagtttggctacacgtctggatcttcttggcacaaagttgggtgggatatccctgaggaggaattactcgttcgcccagctgatggtctgctgcaagtttcgtagagtggtttatcccacagggtcgtattttatctcacaatgaataattttgatatactggtttggaatgtgaggggtctgaatgaccctcatcgtagggattctcttcnatcattaataaactgtatgatgcctactattgtgtgtattcaagaaaccaagctgaattctatttctcactgggatgttgcttcctgtcttggttcagagtttggggattttgtttacttgccttctagtggtactagaggaggtatcttgatagcctggcgtagagggctcattactgctatagactccaaaattcttaatcattcagtgtcagtctgttttatgaaagaaaacancactgcttggtggttttcgggtgtctacggaccccatagagatgaggagaaattggcttttctagaagaactctctatggtnagaaccagttgtcctggcccctgggtgattgcaggggacttcaatatgatccgatgtgctgaagacaagagtaattcaaatattaatagaaccctcatgaatagcttaaatacttggattaataatctctccctcaaggagttgcctctaactngaagaagattcacctggtcaaatcaaagagatgttcctactttagtcaagctggacagagtgttctacacttctgattgggaggatttatttccgcttgcttccctgcagagttctgcctctaatatttctgatcactgccctctgatcctcaggcttaatgtgacctttaagggaaagaagcgttttcattttgagagtttttggccaaagatgcaaggctttcaggaggtagttgctaattcctggaatgcctctatcttggctgcttgtcccatggagagattatctattaaatttaagagacttgctaaggatctgcattcctggagtcataagtctgtgggtaatgtttctactcagcttgcattggccaagatgaccctacatcttttggaaattgcccaagacagcagatccttgtggtcggctgaagagtggttgaggaaaaaactaaaattattatgtcttcatctttcttctttggaaagaaccattgctagattaaggtctagagtgaactttatcaaaacaggagatgcaaatacggctttctttcatgcgcaagccaggttcaggaaaaagaagaactttattcataaactgatggttgacgagaacattgtttcttctcaagaggctaaacagcaggttatgtttcagttttacaaggatctgattggtaaagtgtttgagcgaaattttactcttaaccttgctaattttcataaaggcaatttggagctctcgcattttgataatcccatatctttggaggaaattaattctgctattttaagtcttcctagtgataaagcccctggacctgacggtttcacagggcgcttttataaatcctgttgggatataatcaaatgggacccactggcttgcaatcttatttctccaacaaggatcccctggaaggcttgatttgttgaattcagcatatactactctcattccaaaacacgttgaggctattcttccgggagattttagaccaatcaagcctagttcacagttttgctaaacttatcacaaaaatcttggctaacaggttagctcctgaactggataaaatggttagcacaaatcaaagtgccttcattcggggtagatgtattcatgataactttattatggccagtcaaactgtcaagatgctgcaccataagaaaatccctgctatattcttgaagctggacattaaaaaggcctttgactcagtgcattgggcatttcttctggaaattcttcgacatttgggttttggacaggtttggtgcaatctgattttgaacttactatggacttcatccactcaagttcttgttaatggagtgcctggacagcctataaaactcaagcgtgggttgagacaaggcgatcctctgtctccccttttattcatcttagttatggatgttcttaatagtctattcatcagggcagatgagtgtggattattacacccccttgctgacagaagcattagccaaagggtttcaatgttcgcagatgatgttgctgtttttgtaaaaccagtttctggggacttagtggtggtcagagaaattttgaggtgttttggtgttgcctcaggnnttcaaactaacttgcaaaaaagtttctcctacccaatacagtgcaattttgagagaactacnttggctgtccagaccttngggtgtgcctcaaaaaactttcccacaacctatcttggtctccctctgagnagcaaaaaacttagtgctggagacctcnctcactggatagagaaaattgctgccaagcttccaggatggaaggctgaacttaatcttgcggggagaatcactcttatcaaatctgtactctctgccatcccagtttacttatttactgctcttaatgctccaaaatgggttataaaagccattgaaaaaattcaacggaacttcttatggaaaggaagaaaggaggctagaggaggtaactgccttgtatcttgggataaaatcactcggcctattgatttggggggcctcggaattcctaatctccaaaagatgaattgggcccttcaattgtgatggctttggctacaaaaaactgctccttctaagccttggagtggcctggatcttaaaatatcatcccaagcccgtgctttatttcaggttgcagtgtctaccactattggtaatggtatttcaac

SEQ ID NO: 6130 - DNA, 2001 bp, Zea mays
ctgcatgttctgcccgcccgccattgccattggccgagccccgggcgatcgatcgctgctgctccaacccggccaaatatagaggatgcggaagaagcaagagtgcgccgccaatgtatagagaggaggaagtgagaatattctcggcgccgagtcgtccattccattccatggaagagcaacttcttcggctacaaactctccctgctcaacggcttgcatccgtgttccatgcaaagctttgacgaggctctaccgtgctagatggttagttccgttccatggggcgcggcgcggggaagtccgagctcgccaatagaggctcaatgggcctcgttttggttacacgagacaagggccccttgcgacagcaacgagcaggccaagatttacaggaaaggccggcccaatataaactttgacctctgaccgagaaccaccacctcgaggcagaaacttctctgccagaagggggcaaagctcgcggcctcgcgtcgcgccggtcgttccggtccaacgcggcgacgccaaaggctgccgtccccgggcttcctcctccccctcaccccttcccctcgccaaaccacaggaagaagcgagcagggcatcgagttttctcgatcgatggcatcggcgcctgccgattcctacgggtgcgcggcgtgcggcgcgcccctgaacctgtcggcggcgcacctgtacccggcggacttctacttcgaggccgggaacaagggcacgctgtccttctcgtgggtggacgagtcgcgcctgcggttcgcgcccgaggaccgcatccgccccttcttcgagaccctcaactactggggcatccagcggaagcgcacgcgcatcagctgcgacgcctgcggccacctgcttggccacgtctacgacgacggtccgccggccatgcagggcaccggccagttcgggatggggcccagccaggtcatcccgcgccgccccaggtaccgcttcaagatcaaggccatcgccgccagctcctcggcacctgccgccgccgcctatgaaaagtgatgctccatagatttcttcatctggttgcgtgtcctgtgtgctgtcggtgctgtggttcgtgacttcctgtaaattacgtagcttcctgcaattcgcgtcctgcgttgttttctttagaaacagtgtgtttgaaatggcatgcgactgaaactatgattgaaatggcatgcgacttctaatatacacacaagacagaagatataaataaaaaactatgattgaaatggcatgcgactgaaactatggcaatctcgaaggcggcgatgaaaccttttggatggtacacaggaattttaacagcatgtataactcaattaaatgggttgtcttgatgagtatctaggagacatgtttttcacgaagagtttgtttctatctaactctctatacatattatattttgactgtatttataatttatggactcatggttgtatgtgtctcttatcttaggaagccgaacgggtggattgtacatgtccgtcctaagacatagatgaaaagaaaacattagcctatctgtcatggtattttcctctaatatttcataggaatttcaaaggaactcataagattcaagcctcctttggagtgtagtaaattttactgttccttgaactaatttatgtgaaattcatgtatggttactgtgttctaaaggaggcatcaatcctttattccataggaaaagcttcctattggaattcaaatcctctaaaatttctcctcgactccaaagagtgtctactttaggctatgtttgagactgctttagctctaaaaactagtaaaattggtggaacaggctattaaaagctttaaaaatcgtaaagttgaagttatgaactttggagaacatttagataaattattttgtttattatttagataaaatataatttttaaaactatttaaatttatattgtaaactacaactttacattgatgaaaatgtcaga

SEQ ID NO: 6131 - DNA, 5009 bp, Zea mays
  misc_feature (585)..(585): n is a, c, g, or t
  misc_feature (923)..(923): n is a, c, g, or t
  misc_feature (1275)..(1275): n is a, c, g, or t
  misc_feature (1278)..(1278): n is a, c, g, or t
  misc_feature (1287)..(1287): n is a, c, g, or t
  misc_feature (1309)..(1309): n is a, c, g, or t
  misc_feature (1491)..(1491): n is a, c, g, or t
ccctggtctaggctgtttggttcgttccagaggagggctgggatccggaccgcttacttcccctcctctgatgatgatgatccattaatgccacagctcatgtgtggtgtggctgtgacttgtgatgagtgagcgtgccccttcttcctcctccagcctccagctccaggtgcggtgtgaggtcccgctcctgctcctgtcctaccagcgtactactccagtagtacagtggagtagccgagtgcatttaatagctggacacaacattttacctgagacacatgtatttccaggctgtttctcatcagtatcatatacttctttcacttttcagcttctgtgggtgaacctcataatggacacacttggagctcttgcattagcaaccgagcctccaacagacaaccttatgaagagaaatcctgttggtcgaaggcatgtcaaatgatccaaaatttcttgttgacaacattgtgtccaatacctatatactatgctttttgaatttggaaacatttttacccatacttttctactgcagggaacctcttgttacaaatatcatgtggagaaacttgtttgttnaggttagtattccttcattatacaattggattctgttaaaaactctttgttgttctgatatgtttggaattttacacaggccctttaccaagtagcaattcttctgattttcgattttgatggagtaaggattctgcgtctgcagaatgaaagccgatctgatgctgagaaggtaacaaatactttcatcttcaacacatttgtattttgccagtggagtatttgttcttcaataatttaagaatcataacagaacattagtggacgaatcttgcttcaccttttagacaaatacatactgacattggattgttcccaaaagaaaagaatcaatattnagttgactataaattgatagtagttttcccccaaaagggactaatgtgtaccctagccttgatactacatggatatttttcttcacgtaaggactcgttataagctattcattgctttaccatagtcgaatttcaggtatggcataagttatgtggaagctggttatatgcgcttcacttggtctgtttttggtcaattttcagtggctcactatttttctttgcattttggtttgttccagtaatttaatgtggccagctttaacctcctagaatctaggcccttgactgaccatatattaacctgttgtcttgcttgtacgaagttgaaccataccagagtgaatttgcnatnaaaatatanattattttgatgatttatggcncgtgttaactccatgtagatctggaacgaaggtttgagttaacttgggtgtgttttttttatgccagatcttcaatgagttcaatgcacgaaaacccgaggaaaagaatgtcttcaaaggggtcacgaagaatcacctgttcatgggaataatcggtataacgacagtatttcaggtaacanacgatatagattctctccattggtatcacctctgtccatggttataaagttgctctcgtctttggcagatactgataattcagttcctggggaagttcttcaaaatagtgaggcttggttggagactatggttggtttcagttgctatcggccttgtgaggtatgcacttcaaaatttggcaacctattatggttctgtaaaccttttttttcaattcttcgaatacatcacatcctttatgcacaaccttaccatcctgacttgatcattgcgcatatgaagacaagtcacttattccacggaacccttgtttcaatctaaaactgaacgtgaagccttgtttcaatgtcaaatctggtgtggatgctgacatctttggttcgtttgatgtttccagttggcccctggcttatgtgggtaaatttattcctgtgcccgtaagacctcttccggactatttcaaaccccgctgttgttggaaaccgccgcgccgaggtgagtctctggatgtagttggctttgttccttttctgcgtcagttccgatccagaactcaggtattaatcggtaatgcagacgaggaggaaggtgggcagagctaaagcgcaacgagtgggcagtgtaaataggcacgtgataaaaaaatggagataaattgccctggttgattccatggtagcagcatcctggggatgtacgcataagatggcaggtagtcggcctcgtcgttttcttctaggagaagcagtcggaagaaaagaagtactatacagaagccaaacttgtctacccctatccagctggtgtgtctgctatgcggcagcgaaacttgagtcattagattgtagcctgaatgaaagcagcgctagcttgcgatgtagcagtacctttttttccctggcgatatcatctgactgtaaatttgtaaatgctttcggactacgagttgttcttatttttcatccacctcttctctacggaacgtttttttctatataagaaaataaagtcaacagagcagttctaaaacgactgttttttttttcctgaatcacagtttagatacgtatgcaaatcaccatcctaccctacgaccataatcgaatggctgagactcagctggcattttgactgagactgatggtattgacgaagaagttatcggccttactgtctatacatgggtatatcgtctattttccgtgccttgttgtcgtcgtaaatctttgaataaattcaataaatcttgagccatcgttaaatcttgaaataaatctaaggacatttgaacacccacattttaaattaaatcgagaaaataaatcttgacgctggaaaccaagcccaactgcaactagttgacctatgctctctcaactacgctaaaccaagctaatctatatggcctactgcgtcctctagtgcacaggcgtcgtcgtttcaacgccatcccattctccacatggcaagtccctccgccgtgacaaaaccttagtttgaaaaatcaaatttccttcggaattgaaggggatttaaaaaaaaaatgaattaatttctccatcaattctctctaatcccaaaggggattggagtttccaaactatatatcctgaatgaaaaaaaatgaacgaaaagcgctttttttagtttggaaataccgtcattatgctatcttattgcatatctcgagtccaataatacttaatacgagtccgcaccttttgtgaaaaccatagttaggtcttgctaactatggtaattaggccgttgacgaacccaagatacgtacacgtacgcttgcaacttaatgttctacatttccatataataatataataaataaatacaaaaatcgaaagaagtgacgtggttgctttggtataaaaataagcgctgctatggccggcagagttcgctcgtcagaggcggccatgcatcgaggtcgaggaactcggcggggtccaccgtcaacggcgcctcctcctcgtcgtcgtcgtgcacgctgacgcgacgccgtccgccgctgctcaccgccaccgtagcagctgcagctccagctccagcggcagcgagaggcggcggcggcggcggcgccgtgccgccgtgcacgtgcatagtggcgagctgcgcccgcgtagtggcgagctggcgctgcacgtcgcggatctcctgctgcaggcggtggatgatccccgtgcagccgtacaccgggtcctgcacccggcagtgcgcctccgtcgccatcgtgtccgccgcccggcctcgctcctgcaccggcaggctctgcaagcaaacgtacatagaaatggcgcgcacgcacacgtacgagtgtcatcatcgtatcgtatcgcacccccaaatattttttgcccatatagatatacagtaataactaataataagagctaaaatgaaaagcctcagtgactgacgagagtgacgacgcatgcatgcatgcacgctgcacctgcacgcacctggagcactctggtgacgttgctggtgccgaagacggcgtgcacgtcggcgtacctccgcggctgcgacgccgggaagtagggcgccaggacgcagccgggggcgcacctccgccggaggtacttgcacgcggcgcaccgccggctcgcagccgcactgccgccgccgctgtccggatgctggtccatttccatattactgccgccgccgccgccgccgcccgccgccgacatgagaatctagccgagatcacagcagatctcgtcgtgaggcgctgctgagatctttgcggatcctccaaagatctggagacggatacggtgtgatctcccggctatatatgctcgccggccaggaatgggaagctcaacggctacgtgcatgcctgggcttccaattgaggaggaggagcgagggaggtcgaacggagagccggccccggaatggaaagctctcaacggctacgtgcatggtgcgcctgctgccctgcttgctcttgctgccggcagcggccgcggaggaaaggaaacggcggcgcacgtgtgcatagcatgcacgacggtggaccgacaagacgtgtggctttaatctatattggtttttattacaatattttatctctatagattgtagatattttctataaaattcaaatacagattcatatatatttattaaccttcttgttgtagagaaaataatgaataaaacaacttatgcaaaattttattcttatttaaaataatatgcttgataatatagaaaaagatcatataaattttaaaatattaaatttgtctgaataatttaaatatccgatttcattgctgtccgtgatgcaagaaacctttccaaggctcttcctgtaagacaagacgatctcaatggctgatcgctcgtctcgccactggactaataacacttttctggttcagtacaacatgtgctagactgttgttggtcacttgttctcaaaatattgtgaataaagaataagacaagataatacaactgttaatgattaaagacattcgtcttc

SEQ ID NO: 6132 - DNA, 1316 bp, Zea mays
gcacgagcgcagtgtcctctggtgatgtgcccctaaatgctgttgagcttctgtgggtgaacctcataatggacacacttggagctcttgcattagcaaccgagcctccaacagacaaccttatgaagagaaatcctgttggtcgaagggaacctcttgttacaaatatcatgtggagaaacttgtttgttcaggccctttaccaagtagcaattcttctgattttcgattttgatggagtaaggattctgcgtctgcagaatgaaagccgatctgatgctgagaagataacaaatactttcatcttcaacacatttgtattttgccagatcttcaatgagttcaatgcacgaaaacccgaggaaaagaatgtcttcaaaggggtcacgaagaatcacctgttcatgggaataatcggtataacgacagtatttcagatactgataattcagttcctggggaagttcttcaaaatagtgaggcttggttggagactatggttggtttcagttgctatcggccttgtgagttggcccctggcttatgtgggtaaatttattcctgtgcccgtaagacctcttccggactatttcaagccccgctgttgtcggaaaccgccgcgccgagacgaggaggaaggtgggcagagctaaagcgcaacgagtgggcagtgtaaataggcacgtgataaaaaaatggagataaattgcactggttgattccatggtagcagcatcctggggatgtacgcataagatggcaggtagtcggcctcgtcgttttcttctaggagaagcagtcggaagaaaagaagtactatacagaagccaaacttgtctacccctatccagctggtgtgtctgctatgcggcagcgaaacttgagtcattagattgtagcctgaatgaaagcagcgctagcttgcgatgtagcagtacctttttttccctggcgatatcatctgactgtaaatttgtaaatgctttcggactacgagttgttcttatttttcatccacctcttctctacggaacgtttttttctatataagaaaataaagtcaacagagcagttctaaaaaaaaaagccaacagaccattatacgaaaagctactctactagatacaatgaatgatcatgaactactcgcccaaatgatagcctcgccccttcactgccacttctcgtcctcctcgtgtaacttgcatctaggcgcatgtaccgacatcctcttatctcggagccagactctgacttcctcggctgccattcaaacgttccatagaccttgtttaggtagaatgcacttccctact

SEQ ID NO: 6133 - DNA, 3122 bp, Zea mays
  misc_feature (910)..(910): n is a, c, g, or t
cttgtcttctgatgatagctgctgccatatcactaaccattgggtatgactacagaggtattgtttttgagtttttttatcactcatgttgtttgaactaaaaatcatgctgtcctttattatacatattaccttacattttcttctctttaccactattcattcagggtgttgatgaaggatggtatgatggcggaagtatctttttagccgtttttcttgtgatacttgttactggtaatgggtttggattacacgtaaacttgttttcagcagcaatgttctattgttaatatttatcatcgtcatatctccagcaacaagtgattataggcaatctctacagtttcgacatctgaatgaggagaaacagaacatacaagtggaggtgagtgcggctatgccacgtgaactcccattcattggttatatttctgatttgctatctctattggttaggttgttagaggtggtaaaagatttggagcttcaatctttgaccttgttgttggtgatgtagttcctctcaaaattggtgatcaagtaagatggtatattaatttttcgactgctatttcatttttatgtgtagaaccatctgtttatcccattttcgcctccaggttcctgctgatggtgtcctgatatctggccattctcttgcaatagatgaatcaagtatgactggagagtcaaaagttgtaagtctatcgacaacagagccatttgctgttcccaattctgcatttattggattttcattattgggtgatattttaggtccacaaggatcaaaaggcaccattcttgatgtctggttgcaaggttgcagatggctatggttctatgttggtgagtccagaaatctcaagcactttgacaacatctagaaatgagaacccttgttttncatgtcactgtgctctatagtattttattattatcattttaatattttatttttcatggataaactaactatgacttcttatacactttgcttatcaatttaaggtaacaggggtgggtacaaatactgaatggggtcagttgatggctaacctttcagaagataatggtgaagaaacaccattacaggttattctctgtaaggatagtgcaaattctcgaatggacaattactgaaggctctctttggtttatgctttgaccctttttaggttcgcttgaatggtgttgcaacttttattggtttggtgggcttgtctgttgctggtgcagtacttgttgtgctttggataaggtattttatttttactaaatattactacttaaaaaatatgtacctctctctctctctttctcactgaatttgaaaccaacttcaggtattttactggacataccgaaaatcctgatgggacacctcaatttgttgctggaactactggtgtgaagcaaggatttatgggggcaattagaattttgactatcgctgtatgtaatcctaatgttgttaatataaaagtataaaactagtactatgaacagatttaagtggttcttctcttgtttatccacaggtgaccattgtagttgttgctgtgcctgagggactcccattggcagtaacactgacgtatgaattcttatgtaaattccattaacttctcaggtaaatgactatctgaattttttcaggcttgcatattccatgaaaaagatgatgcgaaacaaagctctggtaaataaaaattatttttatgcatatatttattaaaaaaggtacgacaggagaaagaatatgatttgatttttgtgtctttgctctggtgaggcggctctcgtcatgtgaaacaatgggatcagctactacaatatgcagtgataagacaggaacccttacattgaataagatgacggtcgtggaagcatattttgctggaacaaagttggatccatgtgatgatgttagccagatgtcagacagtgcagcgtcacttattattgaaggaattgcgcagaacacaacaggaacttcactagtccccccccccccccgagcagctgaacttactggttcgcctactgaaaaggccattctttcttggggccttaagatagggatggatttcgacgacgtgaggacaaaatcttcagttattcatgtttttccatttaactcggagaagaaacgtggcgctgttgcagtacagttagatgatggtgttcacatccactggaaaggtgcagctgaaatagtgttatcatcttgcaaaagctggctttccgtcgatggctcggttcagtcaatgagtgctgagaagcacgatgaattcaagagatcaatcgaagacatgggagcaaattcattacgctgtgttgcttttgcatactgttcctttgacattgaaaagatcccaatggaagacataacaagctgggagttgcctgaggatgacctgactctgcttggcatcataggaataaaggacccctgtcgcccaggtgtaagggatgctgtacgcctgtgcactactgctggtgttaaggtgcgcatggttacaggagataatattgaaacagctaaagctatagctctggagtgtggaatactagatgcaaatagtgttatttcagagccagttgtaatcgagggaaaagtgttccgtgagatgtctgaaagtgcaagaggagaggccgccgacaagataattgtgatggggagatcctcgccaaatgataaacttttgcttgtccaagctttaaaacgaaaaggccatgttgtagctgttactggtgatggcacaaatgatgcccctgcattgcacgaggccgatataggtctttcaatgggcatttccgggacagaagttgctaaagaaagctctgacattataatcttggatgatgacttcacgtcagttgtcaaggttgttcgttggggacgatctgtctacgctaatatccagaaattcattcagttccagctcaccgtcaatgttgctgcacttgtcattaatgtggttgctgctgtgtcctctggtgatgtgcccctaaatgctgttgagcttctgtgggtgaacctcataatggacacacttggagctcttgcattagcaaccgagcctccaacagacaaccttatgaagagaaatcct

SEQ ID NO: 6134 - DNA, 1685 bp, Zea mays
tttttttgccgataatctgatgtcaaaagcaaaatcatgaaattatgatggtcataatgttctatttctgaagtttattgttagacagtaagtttccggtgcaatcaaacaatttattgttactattatccttgtaggagattgcggcagcgagcgttgatggcggtcaattcgaggcagaaccgtgcaccactgtagtgtggacgtctacaatagagtcttatatagtagttcttggctaagatttcatctctgtcggtcacatggagtagaacatgtttgtttgtgttcatcttcactacattttgcttaccagacatattttatttccttttcaaaaacatgattccgatgtcgaacatggctgtttcaggtcagaggatcttggtgatcactgctgccacatggtcagataggccatggtattagcgaagatagagctttggtataaacaaatgattggaatgaggcgttctgagctccaaaaggctgaagccaagttaccgggaaagctctagctgagatttctattgtcactggcagtgtgcttgttggcgagctctctctcctgtcagtccttgctgcaggccaacttgtgaagagccacatgaagtttttgaaacgtgcttccatccacaggtttgatcctcaaacgagactgtggactggttatttgggaactactcggataaggccatttgcataaggctcatttcccccagagagacaatgtgtgtattatggctcaagttattaaatgaactgaaattcagaaaaagaactgaaatagttcgccttgtccaaacgaaattacagtgaacaccaaatggagcatgtttgagtcctgagcggcaatgatagagttatgtgaacaaatggagcatgtttgagtccagagcaaagtttccaacgcatccttctctttgtgacagctgaaaaaggaactagggaaagggtgcacgtttgacggttgggttgaaggacctatcatattcctcgaacatataaatatgagtttaactcagaaaaatatgtagtgatgcgatgaaatctaggagaaggacacctccatggtgtgaccacattctctcatatgggaagggaacaaggctactttcctacaacaaggcggagcttatgttatctgaccatcgcctcgtgactgcagtttgaatggcagacgttgaaattttctgccccaggagaagatgcaagtgttgacgccaatgggagttcctacgacctctcaacgaaattgcagtacgtatgaccaaagtgtcccatgaatgtggactgtttactgtgcaatacaagagtggaagaaacacgagaacatctggcagatttcgtgaattaagttgtaggctaaacataaatacaagatttttgttgtgtacaagaacacctattccaggcacaagaaaggaccagccaggcaatgtgtccagtcgaatcggtgggcatggtcgttagatgaggagattttgtatttcggttggcttgttacttgttagcttcttaggtacttttgataactgattacagcagtcgataggttgagagtttgttgcttcattcaaacatgcgtgtatgattacacacaagctaagctcctttgtcgtgacacctattacagtttccaagaataatattgtactttacttcataaaaaaaaaaaaaaaaaa

SEQ ID NO: 6135 - DNA, 2003 bp, Zea mays
agcccacgcgtccgcccacgcgtccgcggacgcgtgggcgcgcccccgctccggaactacttcctcggtgatcgccacaaccggttcctctgcccgcgccgcacgcccgtcaggcaccgcgcctcggacgccgacagggtcgcgtgcctcgcgtgtgatctcgacgagatctactccgcggccttcaacggggaccgcacgccatacagccccgccaagtttctatatagttggtggcagcatgcatcaaaccttgcaagctacgagcaacaggatgctcatgaattctttatttccatccttgatcatatccatgaaaatataaaggatgatcaacaaaagtcatatgcccaaggccatggggattgttgcattgctcacagagtgttttctggtatcctgaggtcagatgtcacctgcacaagctgtgggttcacatccacaacttttgagccctgtatggacatttccttagacatggatgcaggagataacagttcttttggtgttgcaaacacaaagtcgcatgtgcgcaatggagagcgaggcttggctggcgtgaattccaaggtattaactctaatgaggtgtttggagaggtttacaaggtctgagagacttgatgccgagcagaagttcttctgtgaacactgcaacgagaggcaagagtccctgaagcaaatgtccattcgcaggcttccattagtttcctgctttcacataaagagatttgagcattcgtcagtcaaaaaggtgtcgaggaaagtcgatcactgtttgcagtttcccttttcccttgacatggcaccttacctgtcgtcatctattctcaggagtagatatggtaaccgtatatttcctgcagaagctagtgacgcggacgcagtttcagaagtgtcgtcagaattcgaaatatttgcggtgatcacacatagcggtaagctagaagctggccattatgtgacatatctgaggctaaacaatcattggtacaaatgtgatgatgcctgggtaaccagagttgaggagcataccgtcaggacttctcaggcatacatgctcttctacgtgcagaagacgttttactacaaagcttgtgaaagagcagccacagtctgatctgaagcaaacattgatgacacaactccagaccaccataaatttatttgtcaccgaatcagatacacatgtagtaagtagttcgtcaatcaagagggaaaacgggcgccgtatccacagcagcacagccatggcctgtcaaatcttttcgttctccactgacctatagttccaatcagagagaagctttttcggcggattttttctttacagacagacatctgcccaagcgaagatgcttgaatttatgcattgagttatattgtgctggctaatggatatgttgtggcgatttgcttaatactcaggtgcttcaccgtttggtacctgtggcggtgactggcgaggatgctcttaaccagttgcgcttgtgttcaatacaaggtcgagcaaggaagatgagtataaaacgtggaaagaaaacataaagggaaccgattttttttaatgtgttcctttcagcaattgcattcttgttctactgaaggtagagggtttcttgctgataccgattgttgtgtatttgctcccttgccttttttcgcttggtctttgtcttaatggatgagctgaaatctatagcagttgtcatagtgcccactaccccccaaaatgtagggcattacagtgctgagatgagcaggaacatgcagatgtcatgcgggtcgcgttttgccatctcttgtcgcttgaaaatctgattggagctctggtatgagttggcgtgaactactgtgagtgtgaggctaatcctagattcccacccatgtccatgtgtggtatactggtataacaatctgaggtcagtgccctgtgccagacggcatcaaggtagtagtactgcattattagtgggcgctcactactagttaggcgagctgcag

SEQ ID NO: 6136 - DNA, 2714 bp, Zea mays
ctcgaggccggccgggacgaaatgtgactgatccaaccggacacctaagcgtccaaagatgactagctccctcgtcatcttctaatgtcgttaaatcacctcgtcatccacattgggtcgcgttgcgcttgatcctaaggagcacctgccacatctggccatctctcagtctcacacgcgctgccatggacggatccatgtggtgcgctgccaactacgtgcctctgacgccgctcagcttcctggagcgcgccgcgatcgtgtacggcgaccgcgcggccgtcgtttgcgacgataggcggttctcgtggcgcgagacgagggagcggtgcctcgccggggcagccgcgctcgcccgtctcggcgttggccgccgcgacgtggtcgcggtcatcgcctcgaacgtaccggcgatgtacgagctccatttcagcgtgccgatggccggcgccgtcctgtgcacgctcaacacccgccacgacgcggccatggtgtccgtcctgctgaaacactcggaagccaaggtcttcctcgtggagtcgcagttccacgccgtggcccgcgacgcgctcaggctcctcgccgacggcaaagacaggcttcctctcgtcatcggtctctgaccccagcagcagcagcaccggcggcggctgcggcagcaacgacggcagcgtcgcggagtacgaagcgcttctgcggagcgcgccgcgcgacttcgaaatccggtggccggccgacgagcgcgacccgatatcgctgaactacacgtcgggcaccacgtcgaggcccaagggcgtcatctacagccaccgcggcgcgttcctcaacacgctggccacggtgctcgtcaacgagatggcgaccatgcccgtgtacctctggaccgtgcctatgttccactgcaacgggtggtgcatggtgtgggccaccgcggcgcagggcggcacgagcgtctgcatcggcagcgtgtcccccggggtggtcttcgaccacatcgtgcgccacggcgtcaccaacatgggcggagcgcccacggtgctcagcatgctcgcgaacgcgccggcggcggagcggaagctgctgccgaggagggtccgcatctccacgggcggcgcgccgccgccgccgcaggtgctggccaagatggacgagctcggcttcgacgtcgcgcacgggtacgggctcaccgagacgtacggcccggcgacgacgtgcgtgtggaagcccgagtgggacgcgctgccgcccgcggagcgcgcccggatgaaggcgctgcagggcgtcgctcacgccatggtccaggaggtcgccatcaaggacccggcgagcatggagacgttgccctccgacgggcgcgccgtgggcgaggtgatgctccgggggaacacggtcatgggcgggtactacaaggacgcggcggccacggaggaggccatgcgcggcgggtggctgcgcacgggcgacctcggcgtgcgccacccgaacgggtacatccagctcaaggaccggtccaaggacatcatcatctcgggcggcgagaacatcagctccatcgaggtggagtcggtgctgtttgggcaccccgcggtgctcgacgccgcggtggtcgcgcggcccgacgaccactggggcgaggcgccgtgcgcgttcgtcacgctcagggacggcgcgagagccaccgcggacgacatcatccgcttctgccgggctcggctgccgcactacatggcgcccaggacggtggtgttcagcgacctccccaagacttcgaccggcaagacgcagaagtatctgctccgggagaaggcgagggccatgggaggcctgcgcaagccagatcgaagcaggctctagttgacctgttgctgggaacaggccactggctgcattcctggcagcctgctgatagtgatagttttatcttggtcaactacgcttagccatcatcgatcaaggggcagcattcagtcatgccctcgtgctttcacagccaccacgttgcacatggacttgtacggtgaaatagtattgcaggacttggccattcatggaatgctttattggatcatcccaattctaataaatacgtattcacccacagatgcaaactttaatgtttgctttattcaaacagctagaccaatcgccaatgaatagaccacaacagcaatctgagtatctcacagtggcatataatacaccatctactgttctaacgtctatagcaagcagatgaggatcagcgacatgaggaaggcgatgagagacgtcctcaacacggacccggcaaactccgctctcgcagctcctccgtctgaaagaccaaaagaacccaaccatcagaaacctatcaggcacacagattgttagcggatgcagagttgcagggcgtcactcactctggcacgcagtctcatttgcaggcacaaggctggtatgtatggtgagggacgtggtgttggtataaccgctgtaagcgcacatcctggacgcgcaaccggtgccgttgacctgcccgagcgtcaggcctccactgcacggcggcaccgccgggcaccttccgcctttcaccggagtgcagtctagactggcaatcatcacacgggaaagggaaacaactgtgagtcgccgtgccgtcgccgatgaaaagagacggcagagctgaaagactggagcttactgctcgtagttgctcgcgctgcaggcatgcaagc

SEQ ID NO: 6137 - DNA, 2207 bp, Zea mays
  misc_feature (924)..(924): n is a, c, g, or t
cctaatggagtaaatacccatcgggtatcgggtcgcgggtacccattgccatctctaagggagagagagttatccagcaatatgaactatggattttgatggtgtgttaagtctagatataatttgtttggaatatttagggctagtttggaaacttaaatcacctctgaggttcttagggattgaggggaatcctcgggaatcaaggagaagatttaagtttctaaactagcccttagggctagtcaatagaggttatgtacttatgtgtgtatatgatttgcctggtgggttttgtaaattttaaactgatgcattatatatatactcatcttaaataatattccctctgtaccaaaataaaattcgttgtagactaatgctggattcatcaaagatctgaagggtttactttatatatgtgttgttttagttctcagtgtttatgtctatatttaaatgaataaagataaatctagacacttttaaaatacatacattaaatattgtatgaatataagataaattttaatttagaagagaggaaatactattttagaacgaacgagtagaaaaaagttatattttctattgggccaacgagtccaaaacacacatagggaaaggccactaggtcatcgaaggttgcctacgcatacgcaaccttatcatcatccgcccttgggttttctatccgatagtccggcgccgcgcaggcctctcgccctccgcgcggctccacaggagagcaaaaatggcgaccctctccatggtctccgtccccatcgcaccctcctccttgtccctttccacccggggccgcagctcctccgcatccttccccgctaaggttagtgccgccttctgctatacccctatacccccctgcgtccagggagcttgtctgattggggtgtcttgttntttctaaccctgtacggccttgttggaatggggtgtaaattagttttttagtttcactctaatctatatcaatacatattgattgtgctgaatacgagagtatccaaaaacaaggcctacttgggatggtcgtgtcaggagcgttggaaggatgggtcttctgtgaactgctaattttcaatacattggtaggaaatggcgcgtgttggttcatgcatatgaattttctagcgcattgtcagtaatgctagtgtttcatggtacagcagtatgactgattctagtagcaaagaaaaggatgtttctttagacttttgatgtggatctgaaattctgaacctgattataggagctgttgtttattatcgctgttgcattgtgcgcacagcctgaatacgacacaaacatgaacttcgatacatcattaatttatccccatctgaatgacccttcatacccaggctcatgttggtggtttattttgcggtttttgattgtgctgtatgttgggtggcctgacagaagggaggaatcggtcacggtggcttgcggatcgagtgcatccgtattggtggtgttgagattccaaaccacaagagggtggagtactcgctgcagtacatacatggcattggacgctcacgctcacgccagatcctcctggacctcaatttcgataacaagatcaccaaggacctctccgaggaggaggtcatcaccctccgtaaggaggttggcaagtacatgattgagggagaccttaaacgtttcaaccgtgtggcgattgagaggctgaaggagattaggtgctacaagggcatccggcacaagcttggactcccagttcgtggccagaggacaaagaacaactgccggacacttaagggaaagagggcttcagttgccaagaagaagtcacccgcctcccaggatgaataaatcgtattgccatgtattgaagttctctctctctctctctctctctctctctctctctctctgtgtgtgtgtgtgtgtgtgtgtgtgtgtgtagcgctactactgctgggtgttttgtttcgagcttttatgctgccattgacaaatcatggggtagccatcagctgctgcagattttgtagcaatgacatactagctcatatgggtcggttctataaatgaagatcaaattcttgtttaaaaaaaaaaaaaaaaaaacgtggccccctatgctcgatgcaaggagtccagactgctcctgacgaattactatttaccagatccagtgttctggggattattct

SEQ ID NO: 6138 - DNA, 2103 bp, Zea mays
tcgaggccggcctggcgaagaggagcacgggccgaggcatacgcaaccttatcatcatccgcccttgggttttctatccgatagaccggggacgcacaggcctctcgccctccgcgcggctccacaggagagcaaaaatggcgaccctctccatggtctccgtccccatcgcaccctcctccttgtccctttccacccggggccgcagctcctccgcatccttccccgctaagaagggaggaatcggtcacggtggcttgcggatcgagtgcatccgtattggtggtgttgagattccaaaccacaagagggtggagtactcgctgcagtacatacatggcattggacgctcacgctcacgccagatcctcctggacctcaatttcgataacaagatcaccaaggacctctccgaggaggaggtcatcaccctccgtaaggaggttggcaagtacatgattgagggagaccttaaacgtttcaaccgtgtggcgattgagaggctgaaggagattaggtgctacaagggcatccggcacaagcttggactcccagttcgtggccagaggacaaagaacaactgccggacacttaagggaaagagggcttcagttgccaagaagaagtcacccgcctcccaggatgaataaatcgtattgccatgtattgaagttctctctctctctctctctctctctctctctctctcgtgtgtgtgtgtgtgtgtgtgtgtgtgtgtagcgctactactgctgggtgttttgtttcgagcttttatgctgccattgacaaatcatggggtagccatcagctgctgcagattttgtagcaatgacatactagctcatatgggtcggttctataaatgaagatcaaattcttgtttacatccatttgtattcctctgtcccacctatgctcgatgcaaggagtccagactgctcctgacgaattactatttaccagatccagtgttctggggattattcacctgccactggtatacctgttttcatccctgcacgagatgatcatgtggcgaagagttatgattcgagatctctccccttaacaaatgtagttgaaaaaacaagttttggctacccgtcgatggttatgttttttttcttgataaggacgatggttaaattgtgtttggtttcaaataaagatgatttgaatcacttgattgaagccattaaggtttcctggcattcatcagcccccaacttgcagagcacggatgacggatgactgtgaatttgtgatcccgtggtgtgctatttgccgaagcttgcaccggtgcacggacaccaccacctgctcccccatccggcggcacccgggccgccgcgcccgcgcgctctatccaccactcaaataaacgcgatatgctctgccttgctggcctgctattgaaaatcacacgacttccaccgcaatcgcacgcaaaaatcccgctcgagcttccaccgtctccctccgcttccccgtgcggcggtgccgggtcgcgccgtgccatggcgcccgccttctcggtctcgtgcgcgcccggatcctcgcgcccgctggccgccagccccggccccagcgtcgtcgtcgtcgcctcctcccaacttcccgcgtcgtcgcggagcagcgaacgcaggagagcaccaggcctcgcgctcgccgcggccccgggtgtcggcggtagggatggcggtggcaggtggagagcaggcatctcgtccttccccttcctgccgccgttcttcacagggaacaagggggagaaggacgctgagaaggcgatgaggctcaaggaggagctcctcgacgccattgcaccgctggaccgtggcgccgaggccacgcccgaggacaaggagcgcgtcgagcagattgttctgcaactggacgaagaaactagtagctacgagggacgcaccgtgcatttggtaattggttgatggcagagactcacgtgtatttttttttctttttttgcttcagattgttcagcaactggaggcggtgaaccaggtcaaggagccgctcaagtccgatctcgtttacggcaaatggaagcttctctagaccacctccacgagtaggctgcag

SEQ ID NO: 6139 - DNA, 1191 bp, Zea mays
cctcgaggccggccgggggcctccggccgtccggcatgggactcccgcggccggcccgggcaaaaatcccgctcgagcttccaccgtctccctccgcttccccgtgcggcggtgccgggtcgcgccgtgccatggcgcccgccttctcggtctcgtgcgcgcccggatcctcgcgcccgctggccgccagccccggccccagcgtcgtcgtcgtcgcctcctcccaacttcccgcgtcgtcgcggagcagcgaacgcaggagagcaccaggcctcgcgctcgccgcggccccgggtgtcggcggtagggatggcggtggcaggtggagagcaggcatctcgtccttccccttcctgccgccgttcttcacagggaacaagggggagaaggacgctgagaaggcgatgaggctcaaggaggagctcctcgacgccattgcaccgctggaccgtggcgccgaggccacgcccgaggacaaggagcgcgtcgagcagattgttcagcaactggaggcggtgaaccaggtgaaggagccgctcaagtccgatctcctaaacggcaaatgggagcttctctataccacctccacaagtatactgcagccacagaggccaaagtatctgaggccgtttgggaagatttaccaatcaatcaacgccgacaatttgagagcccaaaacatggaaacttggccctactttaatcaggttactgccaacttggtacctctgaattctagaagagtggcagttaaatttgactacttcaagatatttggtttgataccgatcaaagcacccggaagtggtaaaggtgaacttgagattacttatcttgatgaagagctcagggtttcgagaggcgacaagggaaacttgttcgtactgaagatggtcgacccagcatacagggttccattataataatgttatgataacatttaggagtcagctatgtgtaacattcttcttcctcgcatgaagactgaggtaatgtaaggcgtgtaaatattaaatatcacatctgaaagataaattttttggggggaaaaaaaaaaaaaaaaaagcgcccagtaagacttccgcgtccaaaatgaggcccaagatttaagcatagacgatagagaacatgtcgtgtgaagactaacacacatcaatgtatagaaaatgcaatgataatccattttgatcc

SEQ ID NO: 6140 - DNA, 891 bp, Zea mays
cattgggaccctcgaggccggccgggatcgaaggttgcctacccgcccgcatcgtcatccgccctgccggtttctatccgatagaccggggacgcacaggcctctcgccctccgcgcggctccacaggagagcaaaaatggcgaccctctccatggtctccgtccccatcgcaccctcctccttgtccctttccacccggggccgcagctcctccgcatccttccccgctaagaagggaggaatcggtcacggtggcttgcggatcgagtgcatccgtattggtggtgttgagattccaaaccacaagagggtggagtactcgctgcagtacatacatggcattggacgctcacgctcacgccagatcctcctggacctcaatttcgataacaagatcaccaaggacctctccgaggaggaggtcatcaccctccgtaaggaggttggcaagtacatgattgagggagaccttaaacgtttcaaccgtgtggcgattgagaggctgaaggagattaggtgctacaagggcatccggcacaagcttggactcccagttcgtggccagaggacaaagaacaactgccggacacttaagggaaagagggcttcagttgccaagaagaagtcacccgcctcccaggatgaataaatcgtattgccatgtattgaagttctctctctctctctctctgtgtgtgtgtgtgtgtgtgtgtgtgtgtgtagcgctactactgctgggtgttttgtttcgagcttttatgctgccattgacaaatcatggggtagccatcagctgctgcagattttgtagcaatgacatactagctcatatgggtcggttctataaatgaagatcaaattcttgtttaaaaaaaaaaaaaaaagcggcc

SEQ ID NO: 6141 - DNA, 1750 bp, Zea mays
cctagtgttcctgtcgcacatgttccttgatcaataaatagtacagcgataaattgcagaatggttgtgttccctgcgaaattcctacgtttgtgattgtcgctttgatcaatggtatcttctgtctgagctgaaggctttgatgccaccacgccacgcgcactcagaggacaggacagcacaaggctcaccaagtcgcacgactcacgagacgtcgcggtccccatcggcgcccagtcgtgctctggacgcaacgcagcggccgggcccggcgagacgtggatggcagcaccgtcagtcacgcgcgtggataaacactggacgcgcccgcgcgtgcgagaggcccaagaaacccacagcagccgctagccgtacgatggcggacaccggtgacgtcgccgccgccgccgaggcctcggcgcgaccggcgggcagcagcagcacccagccgctggcggggcgcgtggcgatcgtgacgggcgcgtcgcggggcatcggccgcgccatcgccacgcacctgtcctccctcggcgcgagcctggtgctgggctacgcggcgcgcgccgacgaggcgggcgcgctggcggcgtcgctcccgcgcgcggtggccgtgcgggcggacgtctcggacgaggccggcgcgcggtcgctcttcgacgcggcggacgaggccttcggcggcgcgcacatcctggtggccagcgccggggtgctggacgacacgtaccccgccgtggccggcaccgccaccgaggccttcgaccgcgtgctcgccgtgaacctgcgcggcgcgttcctgtgcctccgggaggcggccaaccgcctccgccgcggcggcggcgggcgcatcgtcgccgtgacgtcgtccgtggtggggagcctcccgccgcggttcggggcctacacggcgtccaaggcggcggtggaggcgctggtgcggaccatggccaaggagctcgggggcacccgcgtcacggccaactgcgtcgcgcccggggccacggccacggacatgttcttcaagggcaagagcgaggccatggtgcgacacgccgtggagacaaacccgatgcagaggctcggcgagcccggtgacatcgcgccggtggtcggcttcctgtgcaccgacgccgccgagtgggtcaacggccaggtcatccgcgccaacggcggctatgtgtgatgtgatctttagctttcacagcttcttggtgtccatcgtcgttttcctttgccacgcactgtttcgccatcttgttatctttacctttaaccttattatcattctagcacaaattcataggaatattttctcgaggatcgttgggcggccggcttgacggccttgacctcggctagtggtcattgccataatgccaggtcagccttcaatcatgacagaaatagctcgcccatccaggatccaacatagaatctaagatcatctcaatatatgtaacatcacaagtgtaattatacttagagcaaggttatgtagacgggttgaagatatgccacgtcagatttatgatgatatagaagaaatagaaatagagagaaaatggaatcggactatttactaatagccagctctcaaagcaaggtgctcagtggtagccagcttaaaataaaatgctcacaaactccaagacagattgtaagaggagacaagccaagtattaaatgtacagcttgtgttagtgtatgactagtatgtgacacggcaataatacaaagcccgttataggtt

SEQ ID NO: 6142 - DNA, 3234 bp, Zea mays
tacgtgcatgcattgtgtttgggtccctcgaggccggccgggatccatcccgagcaagcaagtaatatggcttggtcttgtgctcgtccgatgagcatcgccctcgctgccgtcctcctgctgtgcggcggcgcgtggctgcagcaggcggcggaggcgcgcccccaccacatggacgacgacagcagcatcgacatggaccgcggcagcgacgacttcttctccatcgtggggtactcgccggaggacctgacgcagcacgaccggctcgtcaggctgttcgaggagtgggtggccaagtaccgcaaggcgtacggcagcttcgaggagaagctgcgccggttcgaggtgttcaaggacaacctgcaccacatcgacgaggccaacaggaaggaggtcaccagctactggctgggcctcaacgccttcgccgacctcacgcacgacgagttcaaggccacctacctgggcctcctgccgaagaggaccagcggtggccggttcaggtacggcggcgtgggcgacggcggcgacgaggtgcccgcgtccgtggactggcggaagaagggcgccgtgacggaggtcaagaaccaggggcagtgcggcagctgctgggccttctccacggtggcggccgtggaagggatcaaccagatcgtgacgggcaacctcacgtcgctgtcggagcagcagctggtcgactgcagcaccgacgggaacaacgggtgcagcggcggcgtcatggacaacgccttctcgttcatcgccaccggcgccgggctccgctccgaggaggcgtacccgtacctcatggaggaaggggactgcgacgacagggcccgcgacggcgaggtgctcgtcactatatccgggtacgaggacgtgccggccaacgacgagcaggcgctcgtcaaggccctcgcccaccagcccgtcagcgtcgccatcgaggcgtccgggaggcacttccagttctacagcggggtacgtacggcaaactctgattgcatttgcagctggactagactgggccattgatgatctctgattgcacgatgcatgcagggcgtgttcgatggaccgtgcgggtcggagctggaccacggcgtggcggcggtgggctacggcagcagcaaggggcaggactacatcatcgtcaagaactcgtggggcacccactggggcgagaagggctacatccgcatgaagaggggcaccggcaagccggagggcctctgcggcatcaacaagatggcatcctacccgaccaaggaccattgatggatcatggacgacggagatcatatctatcttcccttccctttcatccgactctttcgatttccatcgtttgcccccttttcctgaatgtgtgtgtttttttttatatattactgtgtcaagtaatttctcgatggatcgatcgaggaagaacgacaaacatgcactcaagcacgagcgcagcaatgtcatctttctcttcatttggtgcgttgaaatgacgaatatcaaataaagtggtttattttttgttgtcttgctggtgcaaatacatatgcattttttctatatgcatttttcgagtttgagtctctatattgcatcccaaagtttgcatgtgatgtgagtttatatgtgaaatatgaatgcgctgcagaaacaccaaatgttaattttttctgaattccccggatcagtttacgagggtatgcactaggggtcctaccggtaaaggcatcagtgggccgatccacgataaagcaagagtgagtgcacccttacaagaataagtaccaaaatatcatagcagatgtatttaaattatgctgagcaggagacgttatgataaaaatttagacgctacgacttgcaacagataaatgagcggagtcatggaccctcactcttgtctacctaggttcgccgcggggtaaaggatgtgtatattagtatataggatactcgagataagcactagaagataacgacgactaagttggttccagctgtgaatccggacttggactcgataactcgaacttggtacaaaaacttagactcgggtccaatgggagtttggggtttggcccactcatcgaaaccagatcgacatgtgcaaaaaataagaaaattaaagtcgacacttttccttatgcttgaaggcttctagttatggtatttttatatactaagggaacctgtatgtaatctcggaggatataactcctagatggtaggccgaactataagaacaaatcttagcctgtcacacatattttaccaagtatcattcatgtcctccttcgacataaaagaggggtaaagcacctcgcaagaaaagggggaatagttatcgagaaactgaacgtagtgtattatcttgtattatctcgcatgaaagccaaaaccaatataaaaattgttgaatatcaaaatgaccaaaatgtgatacgtagcattccaactgtgtggagtcgcactggtcgagcacagatgggtaccgactgccaatttggctgaatccagatatcccccctctcaatcctcgctattcgtactttctatccatatttaaatacctccatttgaaagattattcacaatagtttatcttatctgcaaccattcttcatatccatctccttatttactttttagctgagatatttgatttttctaagtagtttttggagttttaaaaatctatatagtatttatagtacgatgatacacattgttatctgataattaaatttgaaagaattaatttaatgtaataattaatgaatgtggaagattcaggctctccatttattacggcgtgaccttcaccctcgcgaggtagaaggatgggagggaggaggcgatgatgttcggtgaattgttggagcggacactatcgccgtggttggtacatcaaccaaccgatctggcgattgaacatgtgatggcacgacaccgtcccaggcgatagcgtccgttacagattgggatcctctgaatttgtggatgggtcactgacacgcgggactgagcaggactgggtcccacgtgcagtgacacaactgcacaaatgcacaaattcagaggacctgcgtccgtccgttaccgtgccatcccgtcccgcgttgatatggtgggcccgagcaaagtaggcaggtggtggtgagaatcggagagcagatgaaattcagtagtcgattagggggcgtaagagttggactcgattaggtc

SEQ ID NO: 6143 - DNA, 1663 bp, Zea mays
cattgggtacctcgaggccggccgggaagagaccaagcttcagccttggcatcattccccttttgcgcaggtgcgcgccttggctttgcttccaagcaatgcccatgcagcagctagcagagcacgatcgatgcgtatatatatacgtgcatgcattgtgtttgtttcattgggacctcgagccggcgggaccatttcacaagcaatccatcccgagcaagcaagtaatatggcttggtcttgtgctcgtccgatgagcatcgccctcgctgccgtcctcctgctgtgcggcggcgcgtggctgcagcaggcggcggaggcgcgcccccaccacatggacgacgacagcagcatcgacatggaccgcggcagcgacgacttcttctccatcgtggggtactcgccggaggacctgacgcagcacgaccggctcgtcaggctgttcgaggagtgggtggccaagtaccgcaaggcgtacggcagcttcgaggagaagctgcgccggttcgaggtgttcaaggacaacctgcaccacatcgacgaggccaacaggaaggaggtcaccagctactggctgggcctcaacgccttcgccgacctcacgcacgacgagttcaaggccacctacctgggcctcctgccgaagaggaccagcggtggccggttcaggtacggcggcgtgggcgacggcggcgacgaggtgcccgcgtccgtggactggcggaagaagggcgccgtgacggaggtcaagaaccaggggcagtgcggcagctgctgggccttctccacggtggcggccgtggaagggatcaaccagatcgtgacgggcaacctcacgtcgctgtcggagcagcagctggtcgactgcagcaccgacgggaacaacgggtgcagcggcggcgtcatggacaacgccttctcgttcatcgccaccggcgccgggctccgctccgaggaggcgtacccgtacctcatggaggaaggggactgcgacgacagggcccgcgacggcgaggtgctcgtcactatatccgggtacgaggacgtgccggccaacgacgagcaggcgctcgtcaaggccctcgcccaccagcccgtcagcgtcgccatcgaggcgtccgggaggcacttccagttctacagcgggggcgtgttcgatggaccgtgcgggtcggagctggaccacggcgtggcggcggtgggctacggcagcagcaaggggcaggactacatcatcgtcaagaactcgtggggcacccactggggcgagaagggctacatccgcatgaagaggggcaccggcaagccggagggcctctgcggcatcaacaagatggcatcctacccgaccaaggaccattgatggatcatggacgacggagatcatatctatcttcccttccctttcatccgactctttcgatttccatcgtttgcccccttttcctgaatgtgtgtgtttttttttatatattactgtgtcaagtaatttctcgatggatcgatcgaggaagaacgacaaacatgcactcaagcacgagcgcagcaatgtcatctttctcttcatttggtgcgttgaaatgacgaatatcaaataaagtggtttatttttaaaaaaaaaaaaaaaaaaaaaaacgcgtgggggcgcccggtacaaaaaaaa

SEQ ID NO: 6144 - DNA, 2106 bp, Zea mays
gcgtaccgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcatccattccgagcaagcaagtaatatggcttggtcttgtgctcgtccgatgagcatcgccctcgctgccgtcctcctgctgtgcggcggcgcgtggctgcagcaggcggcggaggcgcgcccccaccacatggacgacgacagcagcatcgacatggaccgcggcagcgacgacttcttctccatcgtggggtactcgccggaggacctgacgcagcacgaccggctcgtcaggctgttcgaggagtgggtggccaagtaccgcaaggcgtacggcagcttcgaggagaagctgcgccggttcgaggtgttcaaggacaacctgcaccacatcgacgaggccaacaggaaggaggtcaccagctactggctgggcctcaacgccttcgccgacctcacgcacgacgagttcaaggccacatacctgggcctcctgccgaagaggaccagcggtggccggttcaggtacgacggcggcgaggtgcccgcgtccgtggactggcggaagaagggcgccgtgacggaggtcaagaaccaggggcagtgcggcagctgctgggccttctcgacggtggcggccgtggaagggatcaaccagatcgtgacgggcaacctcacgtccctttcggagcagcagctggtcgactgcagcaccgacgggaacaacgggtgcagcggcggcgtcatggacaacgccttctcgttcatcgccgccggcgccgggctccgctccgaggaggcgtacccgtacctcatggaggaaggggactgcgacgacagggcccgcgacggcgaggtgctcgtcactatatccgggtacgaggacgtgccggccaacgacgagcaggcgctcgtcaaggccctcgcccaccagcccgtcagcgtcgccatcgaggcgtccgggaggcacttccagttctacagcggggtacgtacggcaaactctgattgcatttgcagctggactgggcgggccattgatgatctctgatggcacgatgcatgcagggcgtgttcgatggaccgtgcgggtcggagctggaccacggcgtggcggcggtgggctacggcagcagcaaggggcaggactacatcatcgtcaagaactcgtggggcacccactggggcgagaagggctacatccgcatgaagaggggcaccggcaagccggagggcctctgcggcatcaacaagatggcatcctacccgaccaaggaccattgatggatcatggacgacggagatcatatctatcttcccttccctttcatccgactctttcgatttccatcgtttgcccccttttcctgaatgtgtgtgtttttttatatattactgtgtcaagtaatttctcgatggatcgatcgaggatgaacaacaaacatgcactcaagcacgagcgcagcaatgccatctttctcttcatttggtgcgttgaaatgacggatatcaaataaagcggtttatttttttttgtcttgctggtgcaaatacatatgcattttttttctatatgcatttttcgagtttgagtcgctatattgcatcccaaagtttgcatgtgagtttatatgtgaaatgaatgcgctgcagaaacaccaaatgttaatttttttctgaattacccggatcagtttacgagggtatgcactagcggtcctaccggtaaaggcattagtgggcggatccacgataaaacaagagtgagtgcacccttacaagaataagtaccaaaatattagagcagatgtatttaaattgtgctgagcaggggaccttatagtaaaaatttagacgctacgacttgcaacagataaatgagcggagtcatggaccctcactcttgtctacctaggttcgccgcggcgtaaaggatgtgtatataggatactcgagataagcaccggaagagaaagacgactaagtcggttccagggggat

SEQ ID NO: 6145 - DNA, 4304 bp, Zea mays
  misc_feature (2311)..(2311): n is a, c, g, or t
  misc_feature (4155)..(4155): n is a, c, g, or t
cccctcctctcgcccacaaaattttgtctccttccctccccacgtttccacccctcctcccaccactacttctgagctccctgcggctgcggctgcggcttggtgcttgcttccctcatctctagcctgtacactggttgcggttggagtggttgccagtgtcctcaccacttgctcctctcgatccactcccccacggacatgagcgtgcaaccatacatctaccggtgattgcttccttcttctgccctgaagctgaaaactcggcctgccgcgcctagcctgaccttgccttgcctgggggaaaaacttctgttttgctgcttccccgcctccgctgctgtgatataaaagtggagtcccagcggagggaagattgctccgtcgccgcggtttcgcttcgcggcgggaaggggccgtgaaggaatcttgcaccgagattaatccctcctctgcccctccatttccggccggctgtcggtgctgccttccgcagcaaaaggtgggatctcgcgtccgccggcggtggcattgccggatcgagatatctccagcggcggcctgcgtatctccgtggccgatctgcgctgcggcttccccgggcggtgcggactgctgcggtgaggagcgttgctctgcgctgtggtccaagcgagggggcgggggggactgcacgccaggtgttcgacgaagaacccggcccgaggcagccatgagggacttcccttcctgcttcggcgagagcggcgtccagatcgcggacgcgtcgtcttcgtcgtcgtccagcgccggcaagggcgcggcgcagaacctggtgacctgcctctaccagacgcacttctcaggcaggccctgcgtgatctcgctcacgtggagcaagagcctgatggggcagggcctcagcgtcggcgtcgacgacctgtcgtccggccactgcctgtgcaaggcggacatcaagccgtggctcttctccaagaagaaggggtccaggagcctcgacgtcgaggacggcaaggtcgagatcttctgggacctgtcgggcgccaggttcggcgccgggccagagcccgtggaggggttctatgtcgcagtggtgttcgacctcgagctcgcgctcctgctcggcgacatgaagaaggatgcctacaggaagaccggagccagccagtcgacgctgaatgccgccgcgttcgtggcgaggagggagcacatatatggcaagaagatctactctgccaaggcgcagttctgcgacaacggccagttccacgacatcgccatagagtgcgataccgtcggcttcaaggatccgtgtctcgagatacgagtcgataagaagcccgtgatgcaggtgaagcgcctggcgtggaagttcaggggaaaccaggcgattctcgtggatggcttgcccgtggaggtgttttgggatgttcacagttggctctttgggtcaacggcaagcaacgcggtgttcatgttccagacacgccaggcccctgagaagtcgctgccatggtcctactcgcagaattttagggagtcccagctgcaaggccttggtttctcccttatcctgcatgcgtggaaggttgaatagtctgttcttcttcttcttcttttgcaggatcacaatttgcttctgcacctgcctcattttctttgctttgctgctaacaaaaaaaaagacgttttgttgagtgtctgttcatcagaatgctatggaggctctccaatatatgtctttctgttttgtttttgttttgccatctcttataaacgctttggtttgatagctggcaagctatgtgatgttccagtggattttccactctgttccttctcacccttcttcttgtgtcttgggtgaggataatcctgatgatcaagtagtccaacggtggcaatgctgtagaaagagaatgttgttgtcattatgtaaagtatatcaaacctccgattattcgtcggcgatagttacgcccaacggcttgagttccgcgtgtcctcccttttctttgtcttgtgatctctcacaaatcacaattgttactgcctttttaagagaattattagtcttgtgatctctcacgtagctttgaactggacatgtgaaaaaagctaggaggtttaaggaataaaggcacgtgaagacgtgggcatcaaggtttgtaacaatgacgactgcctttttgtgcttatccgtcggcacctgaacgtgcctaggttttctaggagtctgatcattctgatgggtatcctgaaagttgagatagaacaacccaacctagtctaagagattcttttcgcggcntccttttgtgcaattttcagttcttttatttgttgtgataattagcgttcagcaaaacggtgagttgcttgctcctgtgtagaaactgtcatctagtccagctgttattgaatagaaaagttgtagagtatacatctcgatatagcattgaactctgtggagaagttcgaggtggagttttaaggaatcaagacacgtgaatacgtgagcatcaaggtttgtaacattggcagctgcgcttttttgtgctatctgtgtctgtgggcacctgaatgtgccctgtcttatgtacaaggctgctcattcgatgagaggaggatcctgaagttcagatgaaacaatatataaattctatagccatactcttccaaagagatcgtttttgtgccgttttagattgtctttttagcatttttcttttggttttaagcatttttaccagctttgcacacccaataagttgaatgcaggtatagtgcttttcacttgagaccgtattgacgctgagaatgggccatggaactcaacagtttctccaactgatggaccacttgagctctgatagatacttaaaagtaaagaaaaataaacgaggcaatatctttgagccggcaacaattaattggacctctcttgcaaggtgtttatttgagattataatctagtcatatttataatctaacttattttaaactaagcgttagtttaaaataagttagattatataatctaggtagattataatccaaacaaacaggggcttagccaccagtttttcttcactgataagaacaccacttcagacttatcatttgcatgtgcagtgtttcctaattttcccattttcagttagcgtttccctttcagcttaagattgccaaatatcgtcatcgcctacatacaggaatattcactgaagctgccgagcaagtcgtgggctccgacaatggatgagcaatgttaaaccaatgaagccacgggttaacggtctagtaggtgggcagttatgatctttgagttggttttatatggttatgggataccacagcggaaaacctctcgtatactagcaacctcgtaaaacataatcactgaaactaaactgggggggctagatgttttcacttgccatatgaaattttgttgcaaagctgcctctgccttgctgttgtgctgtccgaatcaatcttaaattattcgctaattttcctctctatctttgccctctttccagtgctggggctgccaagcatttcttattttccctttcaaataaagtgcccaggccaggatgtggttcttgatcgcttcaccctttcaaaatgcaagcggaaccttcctgcagaaatttcatgtaaagcgtcacctacgccttttccgtacagaaagctttgcgtgtcccgtcccgtctaggccagctagtagtgtgttgtgttattagtgcatgcccactcatcgcaccaatccagtatgggcgcaactcgattggtttgcctaaccttttgaagcttatgcgattgtggggtctccggtaagtgcggacaaatgcatggccgcctccggatggcgacctttgagaagaaccccacccactgatggttgttattgtctgctgatcgctaccctgactgtgagttcgtttgttttcctgttgaagtcgtttgactgcaatgcgaactctttagttcaggcaattgttcttggttctctgcacccgctgagttttggccgtatgggcgcctaagtatactacctttaaaatttctttccttcctaattaaaaaaagacagctttttttaaagcaaactacatctaaggccctaagcttgtaaatttgtattgncttgatctctaaactcttaacaaacacattttagtttctatacttttatgataatgttatctaggtccataaacttgttttcaacagtttatttatccaaaacactacactgcagactacagttgtgaagttcgaatatgagaacgtgg

SEQ ID NO: 6146 - DNA, 1977 bp, Zea mays
atctccatgagttgagcagcctgagcagatgaggtgaagtgagttggctgccagcgcgccctccccctcctttggctgtactgtatcccccctcctctcgctaaccctttgtctccttcccccacaaaaccacctccgccccctcctcccaccagtacctgtgagttgtgagctccttgctgcggctgcttgctcccctcatctctagcctgtacactggttggagtggttgccagtgttctccccacctgctcctctcgatccactccatcccctttggccatgggtgtgcaagcatacatctacggtaattgcatgcttctcctgccttgaagcggaagccttagccttagcctgccgcctgggggaaaccttctgtttcgccgctgccgctgctgtggtataaaggtggaaggctgatccgtcgacggacggagtcccggcggagggaagattgctccgtcgccgcggtttcgcggccaagaaggtggcctacgcggtggaaaggggcggggcggggccgtgaaggaatcttgctccgacgccaatccctcctctgcccctcgattttcgggcggttgtcggtgctgcctttcgcagtaagaggtgggatctcgcgtccggcggcggcggcggcggcgttgctggatcgagcaacctccggcggtggcctgcgtacctgcgtggccgatctgtgcgtggctgttcatctcttcgccggcattgcgaggcgggctcgccgggcggtgtggattgcttgcggtgaggagtgcggaggagaggtgctgatccaagcggcgggcgggcgggcggctgcacgccaggtgttcgacgaaggaccccgaccgggccagccagccatgagggacttcccttcctgcttcggcgagagcggcgtccagatcgcggacgcgtcgtcgtcgtcgtccagcgccggcaagggcgcggcgcagaacctggtgacctgcctctaccagacgcagttctcgggccggccctgcgtgatctcgctcacgtggagcaggagcctcatggggcagggcctcagcgtcggcgtcgacgacctgtccggccactgcctctgcaaggcggacatcaagccgtggctcttctccaagaagaaggggtccaagagcctcgacgtcgaggacggcaagatcgacatcttctgggacctgtcgggcgccaagttcggcgctgggccagagccggtggaggggttctatgtcgcagtggtgttcgaccttgagctcgtgctcttgctcggcgacatgaagaaggatgcctacaggaagactggagccaaccggtcgatgctgaacgccgcgtttgtggcgaggagggagcacatatacggcaagaagacctactccgccaaggcgcagttctgcgacaatggccagttccatgacattgtcatagactgcgacaccgtcgacctgaaggatccgtgtcttgaaataagagttgacaagaagcccgtgatgcaggtgaagcgcctggcgtggaagttcaggggaaaccagacgattctcgtcgacggcttgcctgtggaggtgttctgggacgttcacagctggctctttggatcaacggcgagcaacgcggtgttcatgtttcagacatgccaggcgcctgagaagtcgctgccatggtcgtactcgcagatttttagggagtcccagttgcaaggtcttggtttctcgctgatcctgcatgcgtggaagcttgaatagggctcttttttttttttttgcaggatcacaatttgcttctgcacctgcccccttttctttagtgctagcagaaaacgttttgttgagtctgagtgcctgttcatcagaatgctatggaggctctccaatatatgttctttcgtttcattttgtttttgctttgccatctcttataaacactttgtttggatagctggcaagttaggtggtgtccctgtggctttgccactctgttccttct

SEQ ID NO: 6147 - DNA, 973 bp, Zea mays
ggcttgctctcttgcttccctcatctctagcctgtacactggttgcggttggagtggttgccagtgtcctcaccacttgctcctctcgatccactcccccacggacatgagcgtgcaaccatacatctaccggtgctcgcggccggccgcgccccggaagctgaaaactcggcctgccgcgcctagcctgaccttgccttgcctgggggaaaaacttatgttttgctgctaccgctgctgtggtataaaagtggagtcccagcggagggaagattgctccgtcgccgcggtttcgcttcgcggcgggaaggggccgtgaaggaatcttgcaccgagattaatccctcctctgcccctccatttccggccggctgtcggtgctgccttccgcagcaaaaggtgggatctcgcgtccgccggcggtggcattgccggatcgagatatctccagcggcggcctgcgtatctccgtggccgatctgcgctgcggcttccccgggcggtgcggactgctgcggtgaggagcgttgctctgcgctgtggtccaagcgagggggcgggggggactgcacgccaggtgttcgacgaagaacccggcccgaggcagccatgagggacttcccttcctgcttcggcgagagcggcgtccagatcgcggacgcgtcgtcttcgtcgtcgtccagcgccggcaagggcgcggcgcagaacctggtgacctgcccctaccagacgcacttctcaggcaggccctgcgtgatctcgctcacgtggagcaagagcctgatggggcagggcctcagcgtcggcgtcgacgacctgtcgtccggccactgcctgtgcaaggcggacatcaagccgtggctcttctccaagaagaaggggtccaggagcctcgacgtcgaggacggcaaggtcgagatcttctggggactgtcgggcgccaggttcggtgccgggccagagccccgtggag

SEQ ID NO: 6148 - DNA, 998 bp, Zea mays
gaggaagatgaattggtaatgaggagaatggaaaacccgatgagcacattgacgaagaacaaaaatataactcttctgatgtagagaaggagaagcacattactctgtctaccaatcgattaaataaggaaaaggctcttacattggctgttggtgatgaagatactgacatgcttgctgatgtgaaacagatggcagctgcagcagctgcagcaggacaagcaagttcatcatttgagaaccagctccggccaattgatagatatgcaatgcgctttatggaactctgggatccagtaattgacaaagctgccttaaatcatcaaataaatgttgaggaggaagaatgggagcttgatcgtattgaaaaattcaaagaggatttagaagcagaaattgatgaggaccaagaaccactttcttatgaatcatgggatgttgattttgctacgacagcctatcggcaacatgttgaggctttaactcaaaagcagttgttagaagaacaggaaaggcaagctcaggaagcaacaaaagagttggaggagaagaatgataatatgagcagtcaccacagaaagtcaaaaaagaacaaaaagaagacaggcaaactcaagcccctgaaaagagtgcgtctgtcgcctgaatcagaagtcatactggaggaaacctctgtagataatgcaccctcacctgagcttacaagtgatgaatcgccacaccattattgtaacaagcgtaagaagattacggttgccactgaggaaaatagtaacagcagaagtttaaagaagctcaagaaaactactaaatcaagttttatttctgaagccttgtcacctaggctgaaggaggaccttaatgattcagattcaaaatcagtgggtagaactaaaagtgatggcagatttttcatcccttgcatgccagtgaaacgtgttattgtaataaagcctgagagattgaaaaggaaaaaaaaaaaataaaaagaatttccg

SEQ ID NO: 6149 - DNA, 805 bp, Zea mays
  misc_feature (79)..(79): n is a, c, g, or t
ggccgcgtcgccgcgcgcacgggctgcgacgccgccgcgtccggctgctggacggggaccgcgccggcgcggaccgtcntgcaggtcaccgtccacgacggggggaacctggaccaggccacctacagcgtgtctctcgtggacggcttcaacgtgcccatggtggtcagcccgcaggccgtcggcggcgggcagtgcccggcgctcgggtgccccatcaacctcaactgcgactgccctccccagaaccgcaccgccgagggcgccgcgtgccgcggcccgccggagtacttcaagaaccggtgcccgctcaccaggaccacgcccaccgacgtcgagcccgtgccgcagagctgccgcgccccgggggagctcaaggtcatcttctgccaggcgaccatcgtcacatgcggcggcgaagcagagcgcaccgtcctcgccgacagctagacagatcgagccgtccagctccattcgcctccaggctccgctgaatccttacagtaattgtcatgctttcttttgctccatgtgtttgttagctttggcttcgacgcgcgtgtactccggtggttttattttagaaatcagcagtgaagcaaaataattgtcttcggatatgttaaactggctgagccattcaaaatccaagaagcgcaagtaaggtgcatctcaatgtggttgtggttggcgaatggggacgatgaaaacgcttacggccgtgctgtagcaagttttggcatatattccttgtttctaccgagagaaaaattaaataattattaacacatagacaattataatg

SEQ ID NO: 6150 - DNA, 2133 bp, Zea mays
  misc_feature (1133)..(1133): n is a, c, g, or t
  misc_feature (1342)..(1342): n is a, c, g, or t
  misc_feature (1353)..(1353): n is a, c, g, or t
  misc_feature (1487)..(1487): n is a, c, g, or t
tcggccgggttgttcagaagctggagccatatataaagatgtacatgtgaagagttagagaatgaagggactattgatgttgaaaaaaccattgagaagcaattttcctcatggtttaagaagcatattgcaagattgcgatttgttgagggagaaggcattgatgacgacctatatgcattggcatgtgaaccggatttgcgagttcgaattttttctgcatgtcttgttgatggtgtccagtaccacaccgttgaccgtgagagaaatagaagaacccaaaacagtggagtcatggttgagggcactcataataatgaatgcattgatttttatggctgcttaaaagaaataattgagttgcagtataactcagatttgatggagcatcggacaccattaatgcattgattccagtgtgattggtttgacactcatagcaagaaagttaatatgaaatgtgatggatattttagaagcatcaaccacagtagtcgctggtacaaaaatgatgcttttattttagcagcacaagcaactaaggtattttatttgcaagacatcaagaatgctggaagctggaagattgttcaaaaatttacacataggcacttgtggagtgtggctgaaaacgacattgatgaaatacctagtgcctcaggactgtcataccaagatgatacatgtgtaggttttgaagtgcaagttaatgaaggagatacggagatgattgaacatcaggatgctgacggttctgttaatgtcagtgtaagtgtggttgatgaatttcgggtgcaacgacaagaggaagtgcaagaggatgggacaagcgacgatgaagatgaaactggatggcaatatgctagtgataatgaagaatcaacaactcttgtcaatgataatgatgatttcagcgataacgagtagcatatttttgtttgatttttaagaagtgaactcgctactgttatttgtgagaagtgaactctatgttgttctgtgtttgatttttaagaagtgaactcgctactgtaatttgtttgattttttaataactgaactcgctactgttactcgtgcccggtttttaataactgaactcgctgctgtccaaaaagcttgtgaacactttntgataaatttcagttcagaccaataaaccttgtaaacatgagtctgtttcagaaagtaattttctctaggtctgaactgaacacctgataattttctccagttcagaccaatatagtgtaaggatggccgagccagggagacaatgcagagctgaaaagtctgtgttgccaaaactgaaaacacctgaaaacagaactgaaaacagatntaaaatgaacntgaaaacttaactggaaacacctgaaaacttaactgaaaatgcagagctttcggttcagtcaaatacattgctgtcgaattgtgttagcagatcagtcaaatacattaagctgtcggttcagttaggaactgtnattttttataaactggaaatgcagatcagtcaattacattaagctgtcgaattgtgttagcagatcacctgaaaacttaacagtaaattagagcttgtagtttgatcttgtggaccttctacatctgcttgctttataaataattctgcgccgagctgttcttgttctccagtagtgagatggatcacaaagaatgccatcagcattatcatgaggtctgtgtggtgggtgcagcctttctgaatgttcaggttggcaaacgacatacaaatggaaaatgccccactgatttgatcgactccatctgccatataaatttcttttgggctgattataggtgtgagtgctgcatgaaaggttctgctaaaattagagcccttctctcttttttgagcctgacaccggttgtggcaattttatgtgctaataaatagccagtggcataacaaggcaacatgtttttttggtatggttactcttgtgctgctcagtcacagcgacactagcaattgtagcagaaacagagacccaatcagtcacagcgacactagcaatgatgaagtaatgtaactatgttggaaactcaggaatagctatactgagttataatggcatatcagaacagaaacagaggctcaatcagaaa

SEQ ID NO: 6151 - DNA, 5794 bp, Zea mays
gagccatattgaggcaaccagtgacgaattgcttggggcctatacgagggccgaagattatgcaatgaccttggccttcgaaggccgaggcaagaaaaggttgaatagagtttttgacgtcattggttcactacaacacatgtggccttttatgacgaacatcccatgacaatgaatattttcgtcattggctattttgttttatgacggttttttttgtggcaagacaactttatgacgaattttggtaagcgtcgctaataacattgaaaaaacgtcataacactagtcaatcgctatatcatgacgaatatcttgttgtcataagacactaacagtaaatgtcataactatatgacagttctatatcgtcataagatattacaaataagtataaaatgtcaattgtagttattaacaaaaatcaatatacatgttgaaaaatgcctataatttagaactcacgcccatactacgctacaaaaccgagggaaaaaattatataaaaatcaaaatgtttaaatcagaaaaagataaaaaaaactgtgcttcaaggatttgaactctcgagctcctatgtagtgcaaaagaacatcttttctccactaaactaaacaaggtatctgttaaatttggacatataaacaatataacgtatatcaccaaattatttacatcctctacacaatctccatccattagttctcctcgaggccggccgcgccgggatttgtacgagttcggcattgtggtcgccccggctgggattcctcctccacgtagctctcctcttcacgtcacacaacgccggaggcctgtcgtgcagccgccgctagagacctgtcgcgcagccaccaccgaaggcctgtcgcgcagccgccgccgccggagacctgtcgcgcagcagctgccgccgggcttgggcgctgctagggggacgaggactccataggtgatccgcgggggatgggtcgtgggcgctgccaggggacgaggactccgtaggcgatctgcgggggacgacaagaattgctctgctttgcacgtgctgccagtctgcctgtgctaccagatttcaacctcgacatcgacgcgcatcaccaatttgttgcgcctgttgttgtattctgggtactccgtagatagaaaagacagattatttgatagtgatggacaaatcttggatcaatgcaacactatttagcaagccacacctagaaggagttagtgagttcatgaagcttgtaatagagcgatttaaggcgaatgaagagatactttgtccatgccgcaagtgtttgaatcggcttagtggacatagaggacaggtggaggaccacttatatcttcatgggatggctagtacatacactaggtggatgtatcatggagaagccatggatgacataattaatgaaatggtgaccacgaggatgaacatgtgagtttcaatgatgatgttggtatgaatcaagatgaagaagatcctgatgataggattaatggtatggtagaggagttatacacagccgaagatcaagataaaaggaaatctatgtttggagatatactagaggagatgaaacaagaactttatcctggtgcaacttatacaagattttcttttgtggtgaagttgcttcatattaagtcattttatcgtatcagcaatgttggcttcactgcaatactgaagttgttgaaatcaggatttcctaattgctcccttcctccatcttttggagaagcaaagaaacttattcgtgcactaggacttgggtatgtttcaatccatgtgtgcgtgaataactgtgttttgtttcggaagaactatgcaaagcacgatcaatgtccaatttgcggtgaatcaagatggaaagatacaaataaacggatccctcaaaaggtattgcgccattttccattgatccctaggctaaagagaatgtttgcttccaaagaaatagcaaaacaggcacaatggcataagttcaagaggaaacatgtggagaatgagcttagtcatccagctgatggagaggcatggaaagattttgatagaaaatatggtcagtttgcagaagatgcaaggaacattagacttgggctcgctactgatggtttcaatccttttggcaaaatgagctcatcatacaacatgtggccaatatttcttataccatacaactttcctccatgggaatgtacggaacgatccaacttcattatgggcctactcattcctggcccaaatggcccaggaaaggattttgatgtctttatggaaccactcattgaagagttgttggagctttggaaaggtgtcactacttgggatgcattgagtggaagcaattttgaactacatgctgcagttatatggtgcattcacgactatccagctttgagcacattgtcaggtcgggtcacaaaaggctattacgcttgtgtgcattgtgacaaaaatccttgctccaaaagaataaggaacaagatatgctatgtttatcatcgacgtttccttccaaaagatctcatttggaggagaaataaaagttttgatggtcatagtgaacaacgtgagaaaccagaggaatttagcatagatgagttgatgcaacaattggagagggtaaaagatgtaagaccaggaatacatactaaaagcaaaaagagaaagagggaagtagaaggtcaatgttggaagcgaagatcatgtctatgggatttgccatattggtcaagtttgaagttgcgccacaatcttgatgtaatgcacattgaaaaaaatatatgtgagtactttcttggtacatttcttggcattgttggaaagacaaacgagcaccattaatgctaggcttgatttggaggacatgggcataaggagacatttacacttaaagcataatggggactcgtacagtgttccgcatgcaccatacacaatgaataaaacacagaaggttgctttttgtgactttttgagaagtgtgaaattccccgatggctatgtttctaacttagcaacatgttttagtactgatggatgcaacctccaagcattgaaaactcatgattgtcatatccttcttcaaagaattttacctgctgctattagaggaatcatgagtaaggacatatatgaagcacttgctgaattaggtattttctttcagcacttatgtgctaagacattgaagttggatgttttacaaagaatgaaagttgaaatcccaatcattttgtgcaagcttgagaaaatatttcctccttctttctttgatgtgatgctgcacttggctattcatttacctgacgaggcaatcctaagaggaccagtgcaatatgggtggatgtatccagtggaaagaaggttgtatacattgaaacgttttgtaagaaatatggctagacctgaaggatccattgcagaagcatatgttgctaatgagtgcttgacagcttgctcgaggtacttcgatgatgttgacacacgacacaatcgggagggtaggaacaaagagcgtgttgatttgagcagaggcaaattttatgtttttcagcatggagttgaacttcttggagcaccaagaattacatacctccaagatgattatgataagatggtttggtatgtcctaaacaattgttcggaggtcgagccatatataaagtacgcatttccttatacgtttgtcatttttatatgaattgttattatcgcctctaatatataccatatcaggatgtataaggaagagttagagaatgaagggattgttaatgtggaaaaaaccattcagaagcacttttcctcctggtttaagaagcatgtgagtttcaagttcatatcctcagcatcaataattgacttgttttcaccatggattttttatgtcttcagattgcaagtttgcgttttgtcgagggagaagacattgatgatgacctatatgcattggcatgcgaaccggatttgcgagttcgaattttttctgcatgtcttgttgatggtgttcggtaccacaccattgaccgtgagagaaatagaagaacccaaaacagtggagtcatggttgagggcactcataataatgaattcattgatttttatggctgcttaaaagaaattatcgagttgcagtataactcagatttgatggagcatcggacagttgttcttttccggtgtgattggtttgacactcatagcaagaaagtcagtatgaaatatgatggatattttagaagcataaaccatagtagttgttggtacaaaaacgatacttttattttagcagcacaagcaactaaggtattttatttgcaagacatcaagaattctggaagctggaagattgttcaaaaatttacacataggcacttgtggtgtgtggctgaaaatgacattgatgaaagacctagttcctcaggactatcataccaagatgatacatgtgttggttctgaagtgcaagttaatgaaggagatatggagataactggacatcaggatgctgacgaatctattaatgtcagtgcaagtgtggttgatgaatttcgggtgcaacgagaagaggaagtggaagagtatgagacaagcgacaatgaagatgaaactggatggcaatatgctagtgacaacgaagaatcaataactattgtcaatgacgatgatgatttcagcgataacgagtagcatgttttttgtttgatctgagagaagttaactctatgccgtattttgtttgatttttaagaagtgaactagctactgttatttgagagaagtgaactgtatgctacaatttgtttgatttttaagaagtgaactagctactgttatttgagagaagtgaactatatgctgcaatttgtttgatttttaagaagtgaactctaactgatgtaatactactgctacaccgaatacacatttcagatttcagaacatacacatttcataacgcatttctatgcaactcagatttcagaaaacacacatttcagaacacatttgtgtgcaccacatatttcacatttcagattgtagaatacatttcaggtttcagaacatagatccagccatgcatcagtagtgcacagcctgtttacaagacccctacatttttctacccaatgacatctccctttttcttcttctggttatgaaccaattcctgcagccttccatagatgacttccttttcatgtcgcatagcttgtgtctgaaggcctgatcgagcatgcaaattttgtgatccgcttctaacaccttgtcgtacacaacaccaactttgtgatccatgtctttcagctagtaaactgaacatggcgtgtaactgaaactgcacatggcgtgtaaacgagttaattgactttataacactctcgtcgcgcggtttcgccggattactactccgcagctccgcttcgccaggatggtattatggagcacgcgcacacgctaaattggtatggttagtatcccgcccactataaccggttgttttgttgcgtttaatgaacgtcgtatattcctgtgtactaatctatccctagcgacgctgcccaagctcctgtccagttttgaccgtggcgctccctgcccactgcccactggtgcccgcgccgccaccatttggttcctgcgtcgtcaacctctggttccctcgctgccgccatctggtgcttgaaagtaactgaactgaaactgaactgcagctggtcaaactatgtgtatgtatgaaacttatgtgtatgtatgaaactattgtgtatgtgtgagact

SEQ ID NO: 6152 - DNA, 1155 bp, Zea mays
ccggccgggaccttggtgccgctatcctaagcgacaagttcctcgtgccgacgccgatgaaggaggagaccgccgacgtcgagttcatcgggaagaggaacgcccccgctgcagccgagccagagctgatgctaaacaaccgagtgtacacctgcaacaacgtccagtgcccgcgcagtgactacagctacggattcctggaccggaatgcccgcaacagccaccagtacacctgcaagcacaaggatccaacccctcagagcaccgagaacaagccgccgtcagcaccgccacagccacaagccttccagccggccttcagccaacccaaccaggcactgaacagtgtggatttcagcctgcccatggacgggcagaggtccatcgccgagctgatgaacatgtacgacaacaacttcgtgccgaacaagaacccgagcagcgacagcgtcgccgtcatggagaggccaaacgcgatgccccagcagaggatccagatggacgagggtttcttcgtacagggcaacggagccttcgacgacgtcaacagcatgatgcagcagcagcagcagcagcaacaccaggcgccagtgcagcagcagcagcagttcttcatccgcgacgacacgccattcgtgagcgagatgggcgacatcgccgccagcgcgccggagttcaggttcggtcctggtttcaacatgtctagcggcgtcgactactcaggcgcggcacagaggaacgacgggaccaattggttctactgaagaataaataaacctgtagggctgagaaaagagaaagagagagagaaagcgtcgttataagctttgggtctctccatggtgctcctgctgctccatggttctcctaagttgtcgagtctatagggtcttggtcgtataggtttctgcagtagctgcaaggcggctggaacttggaaactggtttatacttgtactccctaccggaatttggctctttgctgagtgccatattctttgccgagtgttttatttcgggcactcggcaaagacctctttgtcgagtgtcacacaaaaaagacctctttgccgagtgtcacacataaaaccctcggtaaaagataacactcggcgaagaagctctttgccgagtgttttatttttgacattcggc

SEQ ID NO: 6153 - DNA, 880 bp, Zea mays
gcacgaggtccagtgcccgcgcagtgactacagctacggattcctggaccggaatgcccgcaacagccaccagtacacctgcaagcacaaggatccaacccctcagagcaccgagaacaagccgccgtcagcaccgccacagccacaagccttccagccggccttcagccaacccaaccaggcactgaacagtctggatttcagcctgcccatggacgggcagaggtccatcgccgagctgatgaacatgtacgacaacaacttcgtgccgaacaagaacccgagcagcgacagcgtcgccgtcatggagaggccaaacgcgatgccccagcagaggatccagatggacgagggtttcttcgtacagggcaacggagccttcgacgacgtcaacaacagcatgatgcagcagcagcagcagcaggcgccagtgcagcagcagcagcagttcttcatccgcgacgacacgccattcgtgagccagatgggcgacatcgccgccagcgcgccggagttcaggttcggtcctggtttcaacatgtctagcggcgtcgactacccaggcgcggcacagaggaacgacgggaccaattggttctactgaagaataaataaacctgtagggctgagaaaagagagggagagagagagagagagagaaaagcgtcgttataagctttgggtctctccatggtgctcctgctccatggttctcctaagttgtcgagtgtcgagtctatagggtcttggtcgtataggtttctgcagtagctgcaaggcggctggaacttggaaactggtttatacttgtactccctaccggaatttggctctttgctgagtgccatattctttaaaaaaaaaaaacacacccccccac

SEQ ID NO: 6154 - DNA, 851 bp, Zea mays
  misc_feature (793)..(793): n is a, c, g, or t
aggccggccgggatgcataacagaagtttcgaaccctgggatgtagagtggaatctcttccctcgcaggataaggtgcctcggccgtaaacagagtgggtgttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccagtgctccagatcctgcgctcccctcctcgagcccaagaacctgcccgatgagttcgaggccgtgccggcgacgacgacgccgccgctgccggacgccgccccgaagctggggatttctaacaagttcatccgaggcctctgcggcgacccgcagaccgagcagctggccttcgagggctacaggagggcgctgctgcagcccgagttccggctggagaagaagacggccaacgcgctgaccctgcagctgatcagggagaagcagtggggctccctggagctgctggtcgaggacttcagggcccacggcgtgctcccggagaagcggacgtgcgcgcggctcgtcgcctgctgcatcagggcggggccggttcggcactcgccgacgcggtgcctcggggtcgtcgaggcgaagaagggagcccccgctgccatggccttcagcgcggccatgcaggcgtacaacaggctgcacatgtacccggagaacggtgcttctgtacgcaaaggccgaggggtgggccgnctgccgctgaaaacgcgacgcctaccgtgccgcgatggcggcgtgcggcgcgctgggc

SEQ ID NO: 6155 - DNA, 3380 bp, Zea mays
  misc_feature (85)..(85): n is a, c, g, or t
  misc_feature (3236)..(3236): n is a, c, g, or t
cgtctgcttaagatattacgtatccacatttcattggttggtaggtagccacaacattaccgggcctactgacctatggctctcngaagaagttggttttcctcaaaagaaaataaatgtagcagccagcaccacggaccacataccagggaggatagcttggtacgaagacaaagctgttggttgctttctaccagggagtaatgtctttcagtctaattttgcatcctaacggtttagatcttttcctcctgcttcgtgctgtgtggcgtgaaaagtttgtttactggtggctgtcattcatgctgcgcgctacgtggaccaaacgaacgtctttcgaatctaaaaatgaggcaggcgatttttcaccgcatttcgcccaaaaaaattgctccttccgcttgaacacacacacgtggccacactctgcccatgcataacagaagtttcgaaccatgggatgtagagtggaatctcttccctcgcgggacctcgtggctggcccccgaggcgggccggggttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgaggcctctgcggtgacccgcagaccgagcagctggccttcgagggctacaggagggcgctgctgcagcccgagttccggctggagaagaagacggccaacgcgctgaccctgcagctgatcagggagaagcagtggggctccctggagctgctggtcgaggacttcagggcccacggcgtgctcccggagaagcggacgtgcgcgcggctcgtcgcctgctgcatcagggcggggagggttcggcctcgccgacgcggtgctcggggtcgtcgaggcgaagaagggagcccccgctgccatggccttcagcgcggccatgcaggcgtacaacaggctgcacatgtaccggagaacggtgcttctgtacgggcaggcgagggtggcccgcctgccgctgaacgccgacgcctaccgtgccgcgatggcggcgtgcggcgcgctgggcgagccggacatggtggcttcgctgttcaagctgtacaggtcccacaagtggtacccctccgacagctgcgtggagacgtacgccgtcgtctgcgacgcgctgggaaaggctggcagagccctggacgctctgcggtccctgcgcgagatggaagcggatgggctctcgcccgacgccgccatctactcctccgtcatcggcgctctggcagacgctcgagagaaggcggcggccgaggacctgtaccacgaggcgtgggacaggaagatgcttggagaccccgacatgttcttgaagctgaccatcatgcacgccgaggctggtctggttgagtcaacgatagaggttgccaaggacatgaggcagatcggcctgagggtcacggactgcatcctctctaccatcgtcaacggcttcgtgaagaggagaggcctgaaaccggccatcagagcgtatgacaagctggtcctcatagggtgcgagcctggccaggtcacctacgcatcagtcatcaacgtgtactgccggctcgggcgcagcgacagagcagaggccatcttctccgagatgatcgagcgaggcttcgacaggtgcgtggttgcctatggcaacatgatctcgatgtacggcaagatcaggagggcgtcggaggccacgaggctgctggccctgatgaagcagaaggggtgcgagcccaacgtgctggtgtacaactccctgctcgacatgcacggcaggctggggaactcgaagcaggccgagaagatctggaaggagatggtgcggcgcaaggtccggcccgaccggatcagctacacggccatcatcctggcgaacaaccgggcgggggagctggaccgctgcatggagctctaccaggagttcagggagaccggaaggaaggtggacatggtcatggctggcctcatggttggggtgctctccaagaccagccgcttcaacgagctcatcgagctgctcaaggaaatgaacgggacaaagctggaccggaggctgtacatgagtgtcctgagaagcctccgcgatgccgggctggaggttcatgtgaagtggctccagagtaacttcaccttcatggaagagaaaacttgatgccaggtgcaggtacttgttcctgtgcacgcatattcagcacccaagtatatcgggcgcctgaagaaaaccttgctctgtacatggaaaccgaaaaaaaaggtaaatatttgcttgcctcagtgctccattccgaagcttgtacgctattgctgcacaattccggcattcattggctcaagtgaatagcgatgtaaatgtattttaagggaagccaactttgtaccagtaacgatctgattccgaaattatcgaacagattgccaagttcagtaactctgcatgtaagatttgctgaaactgttgtaccatagccactaggggcaattgtaactttgtatctataatgaaaaaaaatcatattattttggtaccaaaaaaaaaaaaaaaaaaccggcctaacatcatgaatgtcatattgttgaatacttattttcaattgctacatggcaatatgacattaaaaacaagggaacacaagtgaagttcaaaccttcatccataaattatcacttctctgaaagggtaatttaaagacgaaagtatgaagaaggatgtgaatgaaacaatgtttaaatggaaagatcataaaatacgacatgaaagactcatctcgaatgcctccgtaattttattacatctttcttcgtactccctccgtttctttttatttgtcgcctagtagttcaaatttatactaacggacgacatatattaaggaacggagggagtactaaatacatttacaaatatgccttcaatttcttaacgcaagatagctcgaagatgcttcgaaggctaagcagaacgaagctacgaatcacttgtcgcacaagccttcgactccttttcattcgncacttttcgtccgaagtctttttccatgccgaagctaacgacttcagtttgcgccttcgccacttgtatgcatgtgaatgaagcattacctttgttgctttagtcgaaggccggcttcacctttcttcactctatgtccgaaac

SEQ ID NO: 6156 - DNA, 2564 bp, Zea mays
  misc_feature (1794)..(1794): n is a, c, g, or t
ttttttttttttttttgcaacaagaaaatcgtcttatttaagagacagatattgtacattttggaaaccgtcctattaagatttaaacaaaatgacttacaaggcagtatattcttaaaaaacaatgaacaacacatcaaaaagacaatatcatggctacgaagagtgtttcccatgctcttcacaaaaataatgaacccatattattctttagtcgaggataatacaaataatatcttgggacgagtctgataccctagcagcctcggcaatcctgagagccatgatagatttgtatgttgcgagctctgtgttcgtcatgagaattggaccttgttgcgcagtcgaatagctctttgtacaacctattttgccgcacattcagcttgggcaactctctgcaatgctacctcctcttcatcattgtcatgcaataaaatttcaagctttccatgaccaacttggctttttgtctcttgaaagatctctttcgcttcatgacagacttttgtgatagatgccctcgccttatgggtgcacccaatatatgtgaatcgaatgaagtagaaggcatttcagtaatattctcttacggcatcaaggagcctgcaagtcatcacaatacagagttagcagttcagcataaataatttcacatttttactagttcacttgctcctacttaagcaacccttagttattcggtactttaaaatcaatttaaggaaaaagaatgcatgtctctatcaaaaacaagtgctttgattaccaagcacctgcttgatcttcttaaaagttaaatacataatgcagtgcatgtataagtagtagaaagaatagaaatgcaacagacttgctcatacccaggtctaagtagtagaaagacaatgtatacttttggtaggatgcagagcataaaaatagttgcaagttttgtgaaattgaaaggtcgaagaattaccagtagatcatatgaacaaaggtcatattttagtaaatgtagcaaaaaaacagtgaagaatagaacttgcacactttctttatagacctgaaaagggaacttcctgcttagtgatgcaataacaacatgcccgccaggcagtacacagatatccctaatagctttagtatcaggagggggtagatcttctccattccatgtccatgaaacatgctaatctgttgaaactaagaattgatatgcgaaaggtgaatattcaccaaagtttgctataaacattggtactcacatgaagtcattaagcaaaacttgtattaagagttaagacatgtgcctttgtaagtttgtgttcagcacaaaatccatgtacccttccccaagtgaacacgatttgactggatgcatctattacccacaacccgagctccatcaaccaaaaactcattatacaaaacatgcagcaattatgagtcagtgaatgataaagttccttcataactctactgctatagaccccttccgtgagtgcagttccactcattgtagtcacgattctcttcaatgttgtaactatgttttgaagtgtgtaccaccacacatttccatagagcaaaatcgagatcccatccatgaactaatccattatgcaagaacaaaaagatatcaaccaaacaaagccaagtggatggacagagtgcagacactgaaactgtgttatactgttataccttaatcatatgctagacacatctccacacatctctggagaaaactacatccattatctcaacaaacgtgtattgaattattaaaatatggaaaaaggatttacnataatctttgatgaactttaaagccttacccaggaattttgtagtgccatcagcatggacaagtgcaaatgttgttggtctgctaattacatgcttatcctccgctgcaatagattgaatttgtttatttgtattccaattccatgataatattcagtccctccctaccaaatcatagtaagaaagaaatacacaaaaactcttgattcaaactgaaccaccaaatatttccgtcagaagcataaatccccagcccaggcgcgtgagcgcgtccgcgtgtgccgtgcgggttcgggatgactcggccgctctcaggtgtaggatgttgccgccgcttctagaacatgaaccaccgctcgtacatgaccatctccaaacaacccatgtcgtggtagggcagtgcgtcgccatcgatggccaccaagtcgcggaggagttcttcactgagaccgtgtgaatgggagggagagggagagtgggagacgatacgaaccagtgcggtgctagtgcagctaaagggagaggggtattcgttgcagcgagggacgggcctccgttacagcgagggacaggtgtgctaatacgagtgacgtggcttcaacgagtggaggcctagaggtttaatttgagggatgagggccgcgacggtggcggcggcgcaggagcggggagcccgaggtctgaagccgggagaggtgggaagggaacaggaacgggaacgctcaaaactcaaaagtgaattcgggtccattttacttagtaatgttgtg

SEQ ID NO: 6157 - DNA, 1175 bp, Zea mays
gacttacaaggcagtatattcttaaaaaacaatgaacaacacatcaaaaagacaatatcatggctacgaagagtgtttcccatgctcttcacaaaaataatgaacccatattattctttagtcgaggataatacaaataatatcttgggacgagtctgataccctagcagcctcggcaatcctgagagccatgatagatttgtatgttgcgagctctgtgttcgtcatgagaattggaccttgttgcgcagtcgaatagctctttgtacaacctattttgccgcacattcagcttgggcaactctctgcaatgctacctcctcttcatcattgtcatgcaataaaatttcaagctttccatgaccaacttggctttttgtctcttgaaagatctctttcgcttcatgacagacttttgtgatagatgccctcgccttatgggtgcacccaatatatgtgaatcgaatgaagtagaaggcatttcagtaatattctcttacggcatcaaggagccagtagatcatatgaacaaaggtcatattttagtaaatgtagcaaaaaaacagtgaagaatagaacttgcacactttctttatagacctgaaaagggaacttcctgcttagtgatgcaataacaacatgcccgccaggcagtacacagatatccctaatagctttagtatcaggagggggtagatcttctccattccatgtccatgaaacatgctaatctgttgaaactaagaattgatatgcgaaaggtgaatattcaccaaagtttgctataaacattggtactcacatgaagtcattaagcaaaacttgtattaagagttaagacatgtgcctttgtaagtttgtgttcagcacaaaatccatgtacccttccccaagtgaacacgatttgactggatgcatctattacccacaacccgagctccatcaaccaaaaactcattatacaaaacatgcagcaattatgagtcagtgaatgataaagttccttcataactctactgctatagaccccatccatgagtgcagttccactcattgtagtcacgattctcttcaatgctgtaactatgttgtgaagtgtgtaccaccacacatttccacagagcaaaatcgagaccccatccatgaactaatccattatgcaagaacaaaaagat

SEQ ID NO: 6158 - DNA, 1827 bp, Zea mays
cggccgcgtgggtacatttttacctttccctatttcatagtcaccctttgcaattaagggagtacaataatgtcattttactgcgtagacgtgtcgcacacatcttctcttcgtagaagcttcttatgtctcctctccttcgaagtcctctttatcgacgacaaagctttgctttcaatgccttcggcttcatgcacctttggctcattcagatctaccgaagctttttcaaggagagcggtgatcttcctttggccttcattagctttctggacctgaaaaaccatctaaatattgatttcatcattttggaccttcgactagagacctccccaacaacaaccaaatagaaacaattgctggtttacaaatgccattaaaccctggttagagaagtgcaaatataattctaatgcagtcttagacatacttcacgcgagtgtgaaatgtaacgttatatacttgtatactgaccttgttacttaatcattgtgatgttttataatttttttgttatgatttcatgtttaatagctctgtacagcatgtgtgatgataacattgttacttcctgtgatgttatatcctctctatgtgagtggtgatggcctcatggtaagtctacttctagttctatgtgtttacattattttaattttggcaatcttcacaatctaaaagtctgtcagaacaggtcatggaagtccctgaaatatctcctatgtcagaatacttgtccactcatgatgttattctttctgtggatggtctgaaaataaccagaactgatgattggatcaagattctgaaccaaggtactacagcgaaatctagggatcctgaattccttgaaggctctcatagatatgttgccactagttctaccaagggttattgcgtgcccgattcatggatagatgcaagcaaaaatctctggcagataagagacaagctgccttgcccagatgaactgatagccttcgaaaaagttatctgtaacgtctcaaccattttgacagagaagactagcataggtagtgaccagaaggaagttgagggaaaatattgtttgattgcgaaagatgtagtaaagcttagaagatgtggaaacggatggcacaggactgaagatgatgaaagtagctgtgcatgttttgaggatgagcactgtttggtacctgttctgaacccaggcttttcatggattgaggtctcctatgccaggccatactctttgagatgtttacaaaaaggaggaaatttgttatcatcacatactgcaaatagtaactttggacagagtccttgtgaaggatcttttgtttatgtgggtgatctgtcatcagcagcacgttcggttaggttatcccgctaccgacctcgatgggcacttctacttttcattgcagacatcccatatatcttggaaaatggtttaagtagcttgcttcatgcatctgcagcattggctgtaatcaattgcctaccggtgtattttctggatggtgaagcgattctggagactaccttaagctatgtagcttggtttaccccaagactgcaacgcagaattctaaaagtatgcagcgtggtgtggacgggtttattagtcattactttctcaagtatttgttattccacagtgctacattatggcgtatagcaaataacccatggaattttgtcttgaacaaagagaagatcattttaatggaacatgccaactgtactctgtccattgtaaattataagttgttttgacttttatatacacagcttttgttaggctaaaaaaaaaaaaaaaactcgaggaagggcgccggtacc

SEQ ID NO: 6159 - DNA, 2019 bp, Zea mays
ccggccggggattgctggcggccccgcaagcgaagagaactttcaaaccaaacgagcagtcgtgtccaattcaatcccccgggtaatccggtgagcgcgcgcgtgtatatatattatatacacagggctgccgccgccagcagccgtcgcgcctaccgccacctgactccctctgccttctcgtcgctctgctcctccgttgccgtgaccctaagggaggaggacgaggaggaggaggaggaggggaaggaacggagggatggcggaggagacggtgcaggagctgcgcgcgagcttcgcgtcggggcggacgcgccgggccgagtggcgggcggagcagctcaaggggctcatccggatgatcgacgagaaggaggccgagatcagcgccgcgctccatgaggacctggccaagccgcacatggagtcctacctccacgagatatcgattacaaggtcctcgtgcaagtttgccctcgacgggctcaagagctggatgaagcccgagaagatacctgcggccttaaccacgttcccgtcctctgctcaaatcgtgccggagcccctcggtgtggtgctcatcatctcagcctggaactaccctttcatactctcgatcgacccagtcattggagcaatcgcagctggaaatgctgttgttctgaagccgtcagaaatagcgccagctacctcgtcattgctagcgaagctgctgcccgagtacgttgataactcctgtattaaagtcgtggagggaggcgttgcagaaacaacctcactcctggaacagagatgggataagatcttctacacaggtaatggaaccgtaggacgcatcgtgatggcagcagccgcaaagcatctaactccggtggctctggagcttggtgggaaatcccctgttgttgtggactcaaatgttgaccttcatgttgccgtcaagaggatcgttgttggcaaatggggatgcaacaacggccaagcatgcattgccccagactacatcataacgacaaaatcatttgcgccagagctggtggcctccttgaaaagggttttggaaaggttttacggggaggatcctctgcagtcagcggacctgtctcgtatcgtgaattcgaagcacttcaggagactgacggaattgatagaagagaaaagcgttgctgacaagatcgtgtacggcggcgaggttgatgagaagcagctaaaaattgctcctacactgttgctcgacgtcccccaggattcagcaatcatgaccggggaaatatttgggcccttgcttcctatcgtgacggtggaaaagatcgaggagagcttcgacttgatcaacgccaggcctaagccgcttgccgcctaccttttcaccaagaacaagaagctgcaggaggagtttgtggcggacgtgcctgcaggagggatgcttgtgaacgacaccgtgctacatctcgccaacccgtacatgcccttcggcggcgtcggcgacagcgggatggggtgctaccacggcaagttcgggttcgactgcttcagccacaagaagggggtcctggtccgcggctttggcggcgaggcgaacgccaggtacccgccctacacgacggagaagcagaagatcctgagggggctcatcaacggcagcttcatcgcgctcatccttgccctcctgggcttcccgagggagaagcgttagatgggccttctaactgggcccagtacaagcgttttgttcgtgttcgatggatggcacagtatatacactgccatgtgctgccaaatagatgcaaaccgtgcttgtgttacacggctgtgtaatgcattatattgttgcattgacatgtgggttaccgaattgtacgtaagggagttgcattaataagtgtggtctgcctgtcaattatcaagtgttcacaatggatacttcgacggatgcatcatgcattcatgcatggatgtggcatataaaaaaaaaaaaaagtccacaaaaaaaaaaaaaaactagttcctagtccgcga

SEQ ID NO: 6160 - DNA, 2315 bp, Zea mays
gcagtccactcagaccgatgggcgatggcgaggaagggggaaggaaaatatcaaaaggaatcgcccccctccggcccgcccccatcgcccgccgcacgtcacgacatgcccttctccctgctagtgctgccaccgctcccgctgaaaaagattattagtttttcatttctatttttaataattgaacctcttctgccggttcttctccctccttgagtactacttcctggcaatttatcttctccaacaaggtccgacatcaacaagtgattgctcgcggccccgcaagcgagagagaacttttcaacccaaacaaacagtccaatccaattcctagggcaatccggtgaacgtgtgcgtgtgtatatacatacacacggccgccgccgccgcaggcctcgctcctaccgccaccggactcccctttcgcgtccgcttctcttgttgttgctgtgctctcctgttaccgggacccggaggaaggcaggaaggaaggaaggaaggaaggcggggatggcggaggagacggtgcgggagctgcgcgcgagcttcgcggcggggcagacgcgcccggccgagtggcgggcggcgcagctcaaggggctcatccggatgatcgacgagaaggaagccgagatcagcgccgcgctccacgaggacctcgccaagccgcatatggagtccttcctccacgagatatcacttacaaagtcgtcgtgcaagtttgcgctcaaggggctcaagaactggatgaagcccgagaaggtacctgcggccataactacattcccgtcctccgcccaaatcgtgccggagcccctcggcgtcgtgctcatcatctcagcctggaactaccctttcatactctctatcgacccagtcattggagcaatcgctgctggaaatgctgttgttctgaagccatcagaaatagcgccagctacctcgtcactgttagcaaagctgctacccgagtatgttgacaactcctgctattaaagttgtggagggaagcgttccagaaacaaccgcactcttggaacagagatgggataagatcttctacacaggtaatggaactgtaggacgtatagtgatggcagcagccgcaaagcatctgaccccggtagctctggagcttggtgggaaatcccctgttatcgtggattcaaatgttgatctgcatgttgctgctaagaggattgttgttggcaaatggggatgcaacaacggccaagcatgcattgctccagattacatcataacgacaaaatcatttgcaccggagctggtggcctctttcaaaagagttttggaaaggttctatggggaggatcctctgcaatcagcagacttgtctcgtattgtgaattcgaagcagttcaaaagattgacaaatttgatagaagaaaaaagagttgctgacaagattgtgtacggcggcaaggctgatgagaagcaactaaaaatttctcctacactattgttagatgttcctgaagattcagaaattatgacaggcgaaatatttgggcccttgcttcctattgtgacggtcgaaaagattgaggaaagcttcgacttgatcaatgccaagcctaagccactagccgcctaccttttcaccaagaataggaagctgcaagaggagtttgtggcgagcgtccctgcaggagggatgcttgtaaacgacactgcgctacatctcaccaacccgtacatgcccttcggcggcgtcggcgacagcgggatgggctgttaccacggcaagttcggcttcgactgcttcagccacaagaagggagtcctgatccgcggctttggcggggaggcgaacgccaggtacccgccctacacgacggagaagcaaaagatcctgaggggcctcatcaacggcagcttcatcgccctcatccttgccctcctgggcttccccagggagaagcgttagatgctccggcctctttttggtttcggtacagcctttgtagtccctgttcgtcgtcaggtgcacagtatacaccgtcatatgctgtcaaatagatgcaatgcaacgactgcgcgccgtgcttgtgttgcaagcgtggataatgcatatattatattgtagcattgacatgatgtgcgttattgcattttactgtacgtaagggagttggataaataagtgtgatttgtttgtcaattattcagtgttgagaatggatgatacttgcatacagtttaaaaaatgaaactactgttgaaggacatgctgtaaactacagagagaatgaaaataaaaaaagggcggccgctctagaggatccaagctt

SEQ ID NO: 6161 - DNA, 2826 bp, Zea mays
tgggaccctcgaggccggccgggccgaggtccgctgtagtttagtggtgagaaccctcgttagatgttcctgaagattcagaaattatgacaggcgaaatatttgggcccttgcttcctattgtgacggtcgaaaagattgaggaaagcttcgacttgatcaatgccaagcctaagccactagccgcctaccttttcaccaagaataggaagctgcaagaggagtttgtggcaagcgtccctgcaggagggatgcttgtaaacgacactgcgctacatctcaccaacccgtacatgcccttcggcggcgtcggcgacagcgggatggggtgctaccacggcaagttcggcttcgactgcttcagccacaagaagggagtcctgatccgcggctttggcggggaggcgaacgccaggtacccgccctacacgacggagaagcagaagatcctgaggggcctcatcaacggcagcttcatcgccctcatccttgccctcctgggcttccccagggagaagcgttagatgctccggcctcttgtcggtttcggtacagcctttttagtccctgttcgtcgtcaggtgcacagtatacaccgtcatattctgtcaaatagatgcaatgcaacgactgcgcgccgtgcttgtgttgcaagcgtggataatgcatatatattgtagcattgacatgatgtgcgttattgcattacgtaagggagttggataaataagtgtgatttgtttgtcaattattcagtgttgagaatggatgatacttgcatacaaaaaaaaaaaaactaaaaaaaaaatttttttttttttttttttttttttttgccgaaattaaattggtaaatctcttcaataccttgtctggaaggtccttcattccgagtacatgtgcaggacatgggaggattcctctttcctcatgccaaagcaaagtgctaaatagacaccaccagagacagatttattcaaaacttgttttctgaatccatttcatcaccaggtcctaacactctgctaaatatttggattacagaaatctgtactactgctagagccagccctagagaaacagagcagcatcagtaatgccatttaggcctcagctcctcttcttcctctgtcagctcttgataccggtaccattgcgacgctgctttgccgacaggtaatggaggacgcatgaagacctcaaccggtttgggcacatgtaccaccagatgcagctcaccgccatcataaacttcctcagcgctgtttgaaggcacacctgatggctccacagaaatccacccaagcccagagatcgcgatgtcacaggcaggcctgtcacgttcctcatattttatcttcaactcgcgaaccccttgaagccctgtccatccttcagctctctccttaccagttggcggagtcaatgtgaccccaacttcagtctcgtaaaattgatcagcttctgttgtcgggaccatattaatctttagcttcttgggcccatagaatgtcagccgtgaacgtggaagagccttgataacatcaatgcggactagcccagcccagaacaatgaattcccgctcaattcaacatctgtatcattagcctgaacataacatcatgttcggaaaacatcgccctttcaaacgactttgtggtgcaagagaaggcagatcatcagcatggataactgctgcctgcctatggtgaaggtggactccaggtgtatcatacaatttccctccgcctaaaaatgcttcaatttgaatagggccaagggttgttccaggaacagcagactgtattggcttgtatttttgagctgccgctgctaccgggtccttgtacgccattgttcttagcattgcactgataaatgcagattttccaacatttgcggaacccagtatatatacatctcggcccttcctttcctgatgaatctctgatataacccctgtgataccgaccaatgactttgagcttgtcaaatggacactaaggacgttaagcttcttcttgacaactgactcgacaacccagtcgcctatacaattcaaatcagtatctctgggaaggagatcaacctttgttatcacaagtataataggattagcaccagcaaaatcgcgtacacgtgccaggaaacttccattgaagtcaacgatgtcaaccaatttgactatgagcgctttctcgtgacggaggtatgacagcttctccctgagctgttccgcagaaacaaacttcttgccccctggataaccgccgtggccaccaacagcagtaaccatgtggccatgagacagcagcttgcacctcccacatagaacggttctaagttggtgatgcctcttcttcagttggtacgtgtccgggtcgacgtatcccggcgcggcctcctccgccgtctgcagcggggcgccgcagccgtagcaggatgcgaggccggagggcttccgtgccaaggcccggcgcttttccttgcgtcggcgccgcctgtcggcgtcctcgggcgcgagcacgcgcgcggcggcctcggtggccagctggcggccgaggaagcggtccccacgcgtgggcgcggcgggccccgcgccgtcaggcggggcgggcggcggagcaggagcggcggctagggaggtgcggtgggcgtgggtcttgagtgggggaggtagcggcggtaatgttttggggaaggagaggaaaggaaggtgcggtgacgccatggacgatggacgatggacggcggcgtggcggagcagccgcagagcagtgaaggtatcctctccttaccttatccgggccggcgcaacggaaggg

SEQ ID NO: 6162 - DNA, 3935 bp, Zea mays
ctctctttgtgtgtgtatatatatatatatatatatatatatatatatatatatatatatatatatatatatatatatatatatatattattaataacgctacgtgataaaggaaaaaaaaggaggcggggtgtcgtgtcatgcttcgtggatatactaataataatgctacgtgacatgcatgattggtgtgctgtaattaagctttagatgaagagagaacaaactagcttgggacattttaaaaatctcgttcgattcggattaaagccggttgttttaactgctgcaatccatagagagagagaaaaacacaccgtacaaacggtagaatccggtacggattaaagttaagcgaacatgctttaactgaaaagggatgaaaatagtttttttttcaacaaaaaaaaaaaagcttctagctgccagcacaaacagagaaatgaatttgccctgattttcaccgaaagtcagtcagttagtatttggaatggccgatgcagacgatggcttgtgagtggttcgtctcgaacaagctagagtggaggtggagctagacctctccataaaattaagtaatcaacccaacagagtatatacaagcgggcccatgcctaagcaagcaaaagtcggcactgtcaacctcggagtgggcgtgggcgtctcgcagagaccaaacccgggacaaacacctacacacacacacgtgtgcgccgcctctactcggcaacatgtactagtaggctacacacatctactcctaccagagttgacgacccatgcatgcgatgtacaccaactcctcaacgcccaaaagttggaccgcttcagatctgtttctcaagcgatgacggcggagaaactcttgtgttcattccatgagtttattcagagctcgtttgttccttattattataacctgggttcaaaccccaaccagcgcgtagttttaggttctttttttttttaaaaaaaagaacaatccgtggtgaagaaggtccaatccgagattctgtagtaaaagcaagaaatagcccagcccaagagccacccaaaagtgcctttacgagcgagcgagcgtgcgtgcgtgaggatgacatgtcgctgacctcacacatcatggctccattattgcgtccgccccacttcccgccgcgacagacaactcgcgccaacccaccacgacggctgcggctgcctccctcccttataaaccccggccgcaccatcccggcagcaggccaagcgcaccaccaccaccacagacatcatcagatcaccacccagtgcagcaaaagaaagaaagaaagaaagaaaagaaaaaggcaggcgcgccaaaatggacaacggcggcagcaacggctccgccaccgcctccgcctgctgcaacggcaaaattaaccgcgggccgcacgtggcgatgctggcgacgcccgggatggggcacctgatcccgctggcggagctggcgaagcggctggcgtcgcggcacggcgccacggccacgctcatcacgttcgcgtccacggcgtcgcccacgcagcgcgcgttcctggcctcgctcccgcccgcggtgtcctcgctgtccctcccgcccgtcgacctctccgacctgccccgcgccgccgccatcgagacgcgcatgtcggaggagtgcgcgcgctcggtgccggcgctgacggccgtcctcgccggcctcaggcggagcacggccggccgcctggcggccttcgtggccgacctcttcggcgccgactcgctggacgcggcccgcgccgcgggggtccgccgcaggtgcatcttcttcccatccaacctgcacgtgctcacgctcatcctccacctgccggacctggacgccgccgtgcccggcgcgttccgggacatgccggagccgctgcgcctgcccgggtgcgtgcccgtcccggggcccgacgtgctcatgccgctgcaggacaaggccgacccctgctaccgctggatggtgcaccacggcgccaagtaccgggacgcgcacgccatcctcgtcaactcgttccacgccgtcgagccgggccccgccaaggtcctgcgccagccggagtcgggcggccccagccgccggtggcccgcggtgtacccgatcggcccgctcatccacgccgacgccgggcggaaggacggcgcgtcgtcgtcgccgtgcctggagtggctggaccggcagccgccccggtcggtggtgttcgtctcgttcgggtccggcggcgcgctgccggcggagcagatgcgggagctggcgctggggctggagctcagcggccagcggttcctgtgggtggtgcggagccccagcgacgggggcgccgtcaacgacaactactacgacgcggagagcaagcgcgaccccttcgcctacctccccccgcgcgtccgggaccgcacctgcgccgccggcgtggggctggtggtcccgtcctgggcgccgcagacccaggtgctggcgcacgccgccacgggcgccttcctcacccactgcggctggaactccgtgctcgagagcctcgtctacggcgtgcccatggtggcgtggccgctctacgccgagcagaggcagaacgccgtgctgctctccgacggcgtcggcgctgcgctccgggtgcccgagtcgtccaagcggagggagattatcgcggacacggtgcgcgaggtgatgcgcggggaagggaagggcgccgcggtcagggccaaggtggccgagctgcagaaggccgccgccgaggggctccgcgacgggggcgccgccgccgccgcgctggccgaggtggtacaggggtggacgacgacgacaggtggaggagagaaggactaggtggtggtgactggtgatgccgacgcgattggcgcctgccacctgccgcctgccgcctggtgccacagcgatcgtcctcatccagaccaactccaacttgggccgggccaaacgattcgtttgttccttgtccttgtgtataactttggttcacatgctttgcttgctgtatgtaatgtgacctacaggcctgcactttggcacgtagttaattagtagagtactcctagatagctgatctgtgtcatgacgatacgatgtagaagaaggctaccgcttttaattaatttggcactttgtaacttacaactatactgttgggccaggagcattattctcccgaagatcctcatatactacaggagtaatgctgaagattggcttcagcctatgccgttgacagacgtggacacaaagacaacaacttgaaacaaatattgtgcgtgtataaaagagtgaggtaaagtaatatcccttaagataggatcatgtgctttatgtttaactcacgtcccatgttatcctcaattatattttatgttccatatgattgtttacccttcatcttcatcctctttattctatcttctcctcgagaatgggagactaaaagaacgaagatgaagcctaatctaatcgtattgccttgactcttaatgcctaaaatcaagcgaccaacatatactagcggctgcgcacgcacgccgtgccatggcttgcaattatgtacaacatattgttaatgtccaagaaaaaaaaacactttcacatatagatccacattcaattcggtttgatgttaattagcttgatatcttatggagtcgggacccttcgtccaacgaatttattgagagagccaacatcacagtaaaaaaaaagttactatagccataggaccgtaggtgtaacgcaagcactatatagtgtgtgcagttaggctggccgcagcggtaggcatactcgaacggctccaacgcaacgtagcctcctctccgcccccataggctgtctccagcaatgttcttattggggtctactttatcgccgaaggtcctataaaaagaaacaccttcggaaaattgac

SEQ ID NO: 6163 - DNA, 1704 bp, Zea mays
aaaaaaccctcttcgaagttcgatcccagggccgctccggcggcggcggcgcgttgagatggctgacactgacagcgcggagaccgagaaagagaagatggtagcggatgatgggggcaagcccgcagagctctcgaagagcgcgaggaagaagctgcagaagcaggagcggcaggcggaacgtaaagcggcccgaaaagcggcggagaaggagcgacggcgcgccgacatagagcggcggaggcgtgagtgggaggacgctcttgccgccgcgccgtcggatgaggcccgggccgagatggtggcggcgcggcgggagacgcggcgcgagcgggtgggccggcgggcggaggagcgcggggcgcgagctgaccggctcaggcgcgcggctgagggcgcgggccagaaggtggtgctggacctcgagtttgcggaccttatgaggcccaacgagattcatagcctcacgcagcagattatgtactgctatgcagtgaatgggagatctgcaaacccagctcacctgtggctgacaggttgcagtggtgaaatggcgacccatcttcagagaattcctgggtatgataagtggatcattgaaagggcggccaggccttatattgaagcatttgaagaccgtaaagaaaacctcgtgtatcttacagcagatgctgagacagtgcttgatgatctagacatgtcgaaaatatacatcatcggcggcctggtggatcgaaacagatggaaaggcataacactgaagaagtcagctgagcagggaattcaatctgcaaagcttcctattggaaactacctaaaaatgtcaagttctcaggttcttacagttaaccaagtgtttgagataatgttgaagtttgtggaaacaagggactggaagacggcattcttccatgtgattccacaaaggaagcgaggagaagctgagaccagagatgacgtggaaaaaggaggcctggatgacaacgatggcgccgccgaaggggctgcagatggagaccattccgaggaagacctgaacaagggcttcggtgaggaggaggacgatgatggggacgaagagctggaagaggaagaagcagatgtctccaacaagaggcagtgtgttagagttgaaaacggggaagctggggatgccaccgtagcagaggtggaaccaaacaacggcggcggcggcgggggcggggaccgctgaacagtgaacagcaccaccacgtttgtcgctaactcgctattttcacaacagcatcggtattggatttttgagcgttgtctctggcatttttcatgtattttagggctagtttggcaaattcatttttccaagtgattccgattttcctaaggtaaaatgaactaatttccttggaaaaatgaaaaaaaaaatcactagtaaaaatgggattgccaaactgtcctttattagacaatttctgccgtactctactcggaactgaataactgaccagcttagttaaagttaaagcaggccaatgaatcgagcaatggtgacaggaactgatgaacagcgaagctcacgtttgtttctctttcgtatatgacagcattagtttttgttttcctttttttccagcgttttttcctggtatttatgtattttaaacaatttatgttgtgtatttggaactggcgatcttgttgctgtcattttactatagtgcgtcc

SEQ ID NO: 6164 - DNA, 665 bp, Zea mays
gcgccatggtcgccgcccgcgaccgcgacgactggatcaacagcgtcgtggccgggctaggcaccggcgcgctcttccgcgccgctaacgggccgcgctcggcggtcgtcgccggggccgttggtggggttcttgctggcgccgccgccgctgccaagcaggttgggaagagatacctccccgccctctaaatctgattgcggtacttgtctctgccctgccatgccgtgatcaagggaaatcatttcgtcgcgtggatgttatttcttcgttctcgttaattatttgggaagagtcatgttcttctcgacattcctatatattgttgacatccatatgctggtactatatatgtcaaagaacgatctgatctcaccagatcacgaaatttttggtccacattgcaatgtaacattagacgctagctggtatcgacacaataatactgctttttccattatgctggagaacccatgacattgtgaaatgtaatgctgagtgtagtgtagttttgctagattgtcgctgttttcctatatctctttaaagacgaaattcttcgcctgcccgatgtatgtaaaaaaagacatgccttgatctcagtgagatgttttatacgacaaataattgtacttctcgggagaaaaaaaaaaaaaaggccccta

SEQ ID NO: 6165 - DNA, 1559 bp, Zea mays
ttccggaaaggagatgaaccgaaagttcgaggtgtatgagaagcagatgaaagcggccaggaagtctgggagcaaggccgcacaggataaggttaagggccaggcgctatcaaaggctgctaaagaggccgccaagaacaaggggaaagggaagagtgctgcagatgacgatgatgaccagaaacaggtagctgtgccgcggaagtggcgtgactacagtgttgagttccatttcccagagcctacagagctcacaccacctctccttcagctcattgaggtagggtttagctaccctggtaggccagacttcaaactctcaggtgttgatgttggcattgatatgggaacacgtgtagctattgttgggcccaatggagctgggaagtctacgctgcttaatttacttgcgggtgatcttatcccaacagaaggggaggcaaggaggagccagaagctgaggattggacgatactcgcagcattttgttgacttgctgacaatggaggaaaatgcagttcaatatttgttgaggctccacccagatcaggagggaatgagcaaagcagaggctgtccgtgctaagctcgggaagtttgggttacctggacacaaccatctcactccaattgttaaattatctggcgggcagaaggcccgagttgtgttcacttctatatcaatgtctcaacctcacatactcctgcttgacgagccaacgaatcacttggacatgcaaagtatcgatgcattggcagacgcgctggatgaattcactggaggtgtcgtcttggttagccatgactcacgattgatatctcgtgtttgtgaggatgagcaaaggagcgagatatgggttgtggaggatgggactgtgaacagatatgatggcacgtttgaggattacaaggatgaactcatggaagaaataaagaaggaagttgaagaataatgctgctccaagttagttgtgctttgctgtttatttatataataggctgttttcttgaactgaaattgcatgtactattactgagttctctttactctggtttgcagagtattcatatatggttccaactttgtaaaaatggggcatgcttgttttatgttatacaagagaaacctgagaatatggtattatttgtttgtatattttgttgtgacatatatgtgactggacgaccggtgcagcacttctcgatcttctctcaagattatagaagccgaacaacgataatataacaattgtatgcccttttcttaacctttagcatgactgcataactactctagcagttaaagcttcttagactgtctccagtagagcttgtaaattaggggacacggtattatagatgacaatgtttaatactgtttacggagagaagtttgaaataggtgataagatagaggatataataggagatctgttggagatagcctatgaagctgtttacatctgggaaggcctttttttacctgtggctttgtgaggagcagctttagtcatgttttgtttcaaagtgctaagccatatctgttgactgttgtttcta

SEQ ID NO: 6166 - DNA, 2093 bp, Zea mays
cccacgcgtccgggtacggcctcgtcggccccaacggcatgggcaagtccaccctgctcaagctgctggcctggcgccaggtccccgtgccacggaacatcgacgtcctgctcgtcgagcaggagatcatcggcgatgaccgctcggcccttgaggcggtggtcgccgctgacgaggagctcactgccctccgagccgagcaggccaggcttgaggtctctaatgacgctgatgacaacgagcggctcttggaggtgtacgagaagctgaatctccgggactctgatgccgcccgtgcccgagcgtccaagattctcgcggggctggggttcgatcaggcgatgcaggccagatccacgaagtccttcagtggtggctggaggatgcggatttcgctcgcccgtgcgctcttcatgcagccaacgctgctgctccttgacgagccgactaaccacctggatctgcgagctgtgctgtggctggaggaatacttgtgctcgcagtggaagaagacattgatcgtcgtgtcccacgaccgcgactttctgaacacagtgtgcaatgagatcatacacttgcatgataaaagcctgcatgtctaccgtggaaactttgatgattttgaaagtgggtatgagcagaagaggaaggaaatgaaccgaaagtttgaggtgtatgagaagcagatgaaggcagccaggaagtctgggagcaaggccgcacaggataaggttaagggtcaggctctgtcaaaggctgctaaagaggccgccaagaacaaggggaaggggaagagtgctgcagatgatgacgatgaccagaaacatgtggctgtgccacagaagtggcgtgactacagcgtcgagttccatttcccagagccgacagagctcacaccacctctccttcagctcatcgaggtagggttcagctaccctggcaggccagacttcaagctctcaggtgttgatgttggcattgatatgggaacgcgcgtagccattgttgggcccaatggagctgggaagtctaccatacttaatttacttgccggtgatcttacccctactgaaggcgaggtaaggaggagccagaagctgaggattggacgatactcgcagcattttgttgacctactgacaatggaggaaaatgcagttcaatatttgttgaggcttcacccggaccaggagggaatgagcaaagcagaggctgtccgcgctaagctcgggaagtttgggttacctggacacaaccatctcacgccaatcgttaaactatccggcgggcagaaggcccgagttgtgttcacctctatatcaatgtctcagcctcacatactcctgctcgacgagccaacgaaccacttggacatgcaaagtatcgatgcattggcagacgcgctggatgagttcacaggaggtgtcgtcttggtcagccacgactcgcggttaatatcccgtgtctgcgatgatgagcaaaggagcgagatatgggttgtggaggacgggagtgtggataaatatgacggcacgtttgaggattacaaggatgaactcatggaagaaatcaagaaggaagttgaagagtaacgccgctccaaattagttgtgctttgctgttatttatagaacaagctgttttcttgaactgaaattgcatgtactgttagcgagttttcttactctggtttgcagagtattcatgtggttacaactctggagaacaatatggggcatgcctgttttatgttatacaaggggaacctgagaatatggtattatttgtttgtatcttttgttctgacatatatgtgactggacaggagcagtacttctcaatctgctctcaagtttgtagaagctgaacaacgagaaatgaagatatgacttgtatgccctttcctttacctttagcatagctatactctggcagtaaagcttcttcgagtgagagtgagcagaagctgtgttcatctgggtctgggaaggcctctggctgtctgaggagcagctttgggcttgccctcctgtgaatttggtagactagctgtctgaattctagctttcgaccaaattatctgcaggcatgca

SEQ ID NO: 6167 - DNA, 760 bp, Zea mays
cggcccgacgcggattctccggctctccgctgtagggttttctggtcctggtaggcgagctggggaagacgcaaggtactgcggctgcgcgcgaggggtcgtcggacgaccgacgaggacgagcggcataggcgcgtgcatggcgctcacgaacttcatcctcacggtggtgggggtgggcgcggcggtgatgctgctgcggaaagacgtcaagcagtcggccaccgtcttccgccgcaacgtgcgccacatccgcaactggctcgaggaggagtccgccgccgccgccaaatctactgaacagtcttcagtgaaggagttggagtcccaagctgccaagaaagacgctgtgcccaaggacgacaaacattagatgatcttacaccctgtttcttgtaatgcgttggcagtttgaggtccaggattttgaattggtcctttaaaaaaatgtatgtgttgtaggacctttagttctgttggaaattttactgaataatggaagacatcttaggttcaaggttctgaaatgggatcttatatctcaatgagattatgatggtggatatctgcacatcatgtctaatctttgtcgagtcttcctgtgcttcagattaaattgtacctggaaaaaggtgtaccatcctcactctacattaatctgacaacccgttatacatgtaatccgataatggtccttgtattcagtatttgatgacataagcattgattgcgtataatctatttttatcatgtctttcaa

SEQ ID NO: 6168 - DNA, 785 bp, Zea mays
attgggtcccggcaggccggcgggggggaaaccggtaccatccgccgccgcagccatccgcttcttctcttcggttcagctctcgagtttccaggatgaaggtaatagctgcctacctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaagggaaaggttatcctctgtgccttcaggtggtggtgcaattgacatgggagctccagcagctgtagctggcggtggcgcagcacctgctgaagaggcaaagaaggaagaaaaggttgaagagaaggaagagtctgatgaagatatgggtttcagcttgttcgattaaaacaccactgccagtttacagtttctctcgcgaatggtctcacaatattcgctggtttccacaaaataagattgtcaatagctactacgtacttatgctattctgcatgtgatgtacgagtgtgcatcttcaagaatctttaagttgaatggtcccataataatattgataacaatgtaaattgtatgtcctgtacgtactttggtatcgcgacatctcagtgtgcatcttcaaggatcataagttgaatgttatcattaaggtcagtttggttcagataaatttaattgttagttagagcaaaaaaaaaaaatgcggccgcgccacaactgagttcgatattgtgac

SEQ ID NO: 6169 - DNA, 737 bp, Zea mays
agaaaactggtaccatccgccgccgcagccatccgcttgttctcttcggttcagttctcgaggcatttctgcagtttccaggatgaagctaatagctgcctatctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaagggaaaggttatcctctgtgccttcaggtggtggtgcaattgacatgggagctccagcagctgtagctggcggtggcgcagacctgctgaagaggcaaagaaggaagaaaaggttgaagagaaggaagagtctgatgaagatatgggtttcagcttgttcgattaagacagcactaccagtttacagtttcttcgcgaatggtctcataatattggccggtttccacaaaataagattgtcaatagatactacgtacttacgctattctgacatgtgatgtacgagtgtgcatcttcaagaatgtctaagttgaatggtcggtggtcccataatgatgttggtaccaatgtcaactgtatgtgcctgaacgtcctttggaatcggcgacatccgcagtgtgctctcccaaggcttcataagttgaatgtgatctctaaggtcagtttggttcagaataaagataattgctagttatagct

SEQ ID NO: 6170 - DNA, 2572 bp, Zea mays
tcgggtatttatgtttaatgctatagagtgacggggacattgatgaagatattatccatagaattaaagtagggtggatgaagtggtgtcaactgtcaagcatctggcgttctatatgacaagaaggtaccatagaagctaaaaaataagttttataggatatcgattaaacctgctatgttgtatggtgctgaatgttggcctacaaaaagatgacatgttcaacatataatgttaggctatctctagccgctcttttatcttattccctatatcacatcctattttaaactccactatgcaaacaatgttatgtatagtgcaaaacaatgttttgcttggtcatatacacgatccgttagacacaaccttacgaagatgtgtatattgcgttgtatttatagccatacaagggattaaatatagaatgatgatatatgtgataggctacaattgaataaaagtttgtctaacaattttgagatggtttggacatgtttaacatagacctccaaagacgctaatacttagtgggattctaaggcgtggtagtattgaaaagagaggaagatagaagttgacataataaaagatagtaaaaggagatttaaaaggatgaaatatacttacaaatttagccttgaataaaagtgcatagaaaatagctaattctgtgtttgaaccatgacttgtgggttctattaggttttaattttagcctatcccaaacttgtttagaataaaaggctttgcagacgggcgctgtgtccgcctatgtaaactttgattttcgcagatgggcgctgtgtccgcgattggaggtggacatgctgctctcgcctgcgaaacgaattttggccttgacgcctaaaatttccacccaattcccttttatgttattgtccccttttatgttattcgttgaatcacatccttactaattggtaatctttgctgaatttcttgccgcgtatgggtttcagcttgttcgattaaaacaccactgccagtttacagtttctctcgcgaatggtctcacaatattcgctggtttccacaaaataagattgtcaatagctactacgtacttatgctattctgcatgtgatgtacgagtgtgcatcttcaagaatctttaagttgaatggtcccataataatattgataacaatgtaaattgtatgtcctgtacgtactttggtatcgcgacatctcagtgtgcatcttcaaggatcataagttgaatgttatcattaaggtcagtttggttcagataaatttaattgttagttatagctaaacattgccttggtgtcgcaacaactgagttgaatattgtgactgttcgaataaatggtgggggatattgatgatttttttttctaaataggattacatcagagcttttttttaatcttggtgatggataatgttatcgttttgataagttctaaatactcctaggataatatttgagcaatctaaagaagtcagtccggtgtatgctggatagcaatttcttgggacttctattggctagcacaccgcaccagtgcgtggatagcaatttcttgggacttctattggctagcacaccgcaccagtccggtgtatgctggactgcacaccggaccaattgcgtagagatgttggttttcagtccttaggcagcgtggcacaccgcaccggttcagtaagcatcagacctgttagagtttaatggttagctttcggttctaatggctaggtggtgtggcggcacacatggtagagtctggtgtcacgggaacaacattcgatagaggtcctggtactgttcaaggtcttgtgcatgcagaaattacagaatttgttatccaagtctaacgactatttgggtggttgggagctacaaatactcccctaaccagctcattcaatacataagagctgagcattcaagtctatacactagagcaacactctcgatcaattaaagcctcccaattgccatagagagtcatgtgcgttgatgtgtgatagtgccttgtgagagtggctaagagaagaatgtgtgctattgtgcttggagctttaactcccatttattataaaggttagcaagaggctctgagcttgtggagtacctcgtggagactccggtctctcaatcgagaataagaggatttaagcttaatctttggaatctacgatttgtttttcattctccctctataaaatttttcttgctttgatcttcactctaatcacttgtgttgctcacaagcttattctgcattcattagagcaacaagtggcaagagaacccatccttctactctgattatatttcctcttgttctaacatgtatgttatgtgggggccaagtgtataagcgtcgaccacaacaagaagtaagagatgagaaagacaagctggaattgagttagttgagagagtttagggataagagatagattgagttagttgagaaaagttagggataagaaggagtagccgcacgtccccttgggactacataatgtaatcgaatgtgaaggaaaaggcaaggaagaagtttaatctaatcaa

SEQ ID NO: 6171 - DNA, 947 bp, Zea mays
aatcctttgcttaccaagtcctcgcctcttggtcgcgggctcccccctgtgtgagggattctatccgattctagcggcctagattcggttgcctcggaccgggatgaatcctggcgtttcaacagagtatatatcagggtctctctcggccgcgcccggccggaaactggtaccatccgccgccgcagccatccgcttgttctcttcggttcagttctcgagtttccaggatgaaggtaatagctgcctatctgcttgctgttctgggtggaaacacttccccgactgctgatgatgttaagagcattctggaatcagttggtgctgaagctgatgaagaaaaactagagttcctgctcacagaactcaaagacaaggacataacagaagtgattgcagctggaagggaaaggttatcctctgtgccttcaggtggtggtgcaattgacatgggagctccagcagctgtagctggcggtggcgcagcacctgctgaagaggcaaagaaggaagaaaaggttgaagagaaggaagagtctgatgaagatatgggtttcagcttgttcgattaaaacagcactaccagtttacagtttcttcgcgaatggtctcataatattggccggtttccacaaaataagattgtcaatagctactacgtacttatgctattctgcatgtgatgtacgagtgtgcatcttcaagaatctttaagttgaatggtcggtggtcccataataatattggtaacaatgtaaattgtatgtcctgtacgtactttggtatcgcgacatctcagtgtgcatcttcaaggatcataagttgaatgttatcattaaggtcagtttggttcagataaatataattgctagttatagctaaaaaaaaaaaaaaaaaaggggcccctgagttgaatattgtgactgttcgaataaatggtgggggat

SEQ ID NO: 6172 - DNA, 4304 bp, Zea mays
  misc_feature (3211)..(3211): n is a, c, g, or t
gggtccctcgggccggccggggatgcagataggggtctttcggtaatttttcgaggagttggggagggagggattcgaccggcggcgatcgggataggcggaggccggcgagagcgatggaggaggaggtgacggggagcggcgggggaattgggcggaagatggcagcgggggaggtggatcttaaggagaaatcggggacggcgtggagccactcgtacctcaaccagaagccgtggcacccgctctcgtacccgaaccagcgccgcaagtggatcgccgagcaggtccacgccaatcacgcgcgccgccaggaggaggtgcagcgggagttcgcacaggaacaggagttcttccggcagaccgcactcttctctaagaaggacaaggagaagatggaggtaatgaaagctgtgagttttatgtacgtgcgcccaccgggatacaatgcagagagtgcaaaagctgctgaaattgaagatgagaagaagaggtcggatccaggtgacatgggtactgcatctgcaagtacctcttcaatacctgacaagggacctgaaaaggctaaatcaggcgcagataagaaaaataggccaaaagatgtttttggtcggccattggcaacagaacaagaatttgaagttctcaagaatgctccaaggttagacacaggtgctcctgcaagggtcaaaccatttggagttgaagttcgtaatgttagatgtttaaggtgtggaaactatggtcaccaaagtggtgaccgggaatgtcccttgaaggatgcaatcatgcctaacgaggagagtcggttgaaaagagacgatccacttacaactataatggcgcagacggattcaagtgagcctctgaagtgggaacttaagcagaaaccaggcatgagccctcctcgtggtggatttgacccagatgatcctaatcagcagattgtggcagaagacatctttgatgaatatggaggtatactagtagtaagaaacatgatccgtgtctatttataacttctgcaatttaatatttttgttgcccatcccggcttcttgtctttcaggttttctgggcaactgtgatatcccagctctcatttccaatttttctgctaccaaatccaagaaacgttccaagaagaaaagcaagcacaagcaggctaagtctgctattcatgaggactctggtagacatgaaagcagttaccatctatcatcggactttgacaatgagaagagaaacataacatcaagaagcaagagaaagaaagcaaactgttctgattcatcatattctgattccgagatagatgctagaaaaggcaagagcaagtcaaagcataagcatacgaagaaataccagttagagtcttctgattcagaatttgatgtccgtgaagatacaaggcggcgtctgaagagagaccacatgaaggagaaaagagatgagtcaccattgccgttctctaaggatcaaggagacacagaaggcaagaggcattcaaggtgttcaagggagaagcacaactacagttattcatcgagttcttctgagagaggcaggcggcgttcgagggagaaacgtcactacagttattcaccaagttcttctgagagaggcaggcattctctacggcacaaggagaaacaatattacagtgactcaagttctgatcggagccatcgacactcgagaagatcgagggagaagagacatgatagagactcaagttctcctgatgccatcaggcgctcaagtagatcgacggagaaacagcgccgtcctgatacaagcccacgtcatgccaacgggcattcaaagaaatcaagtggcaagcaagactatactgagcgtagccgttacgaaaccagtagacattcaaggagatctcaggagaaacggcactaccctgattctagcgtctctgattactcggactctgatcagcacaaaaaacatcgccaccatcataggagaaaatgaactggcagtgtataaggtaaaatgccctatctgaagtagtgatatttatatatctggggaccgctctggatgtgacgcattaagggtaccttgtccctttcttgagatcaccagaatccgcctggagtcttgtgctcggtggctgatctcagggctttgtgatgttattacagtaatgtacacggtgtaacagagtttcttcatactgggagaatggttgtttgggtcttcaaacggttgtgttgttgtagaacgtggtggggggcgtaacgtcacgggctgtttagttctgtgcctgagctagccttctgatctactgtggactcactaataagcttcatgtgaaatgtgtagcacttgtacgcaagagtgcttcccaaatgccaggacttcattgtttatggctccaacattgaacgttttatcttttcttagctgttttagaagttgtaacgtccttactaaggctgtatgcatggaagtgcaaaagactggaacttgtttccattatagaaaaaaaatgacaggacttcagaaacacttttgagaacctggaatggtttacctactcccggtggcaatacctaccaaacactttggcctctaaatgctaggtaaaaccacttttttcttcctcttgtgatgtgctgagcatgcatctagttatgggagtgaggcaagtatagcatgggtacagcaattagcacgttttggtaacgtcttcgtcaaaataagcacgtttggtaacgtggatactggaaaatgtgtagctttgagagttaaactgatgggcaacccattggggtagacatgaatgcgagctttctatccattataggactatcaaacattcattgtgatgggtccatctccacttggttgatttacctcctacaacaactacaataatggttagaaaaatgatggtattgaaatacacctactaaatattgagtaaggtcattgtaggacacccctcaatgtgtcaggtataccagatgggctatgggctattgtcgtgtcaggtataccaaatggcctatggctattgtcaagtatgtctgatgggctatgtgggctggaggagagatataagtaaatgttgaatactctatacgagcgacaacttccgttcggtctttcttcttccccacgttgtagttcttctaccctttcttcattctctctgttgagtccattcgttcctcccgtcaagcatttnttacgtcggagccacggagaggggtgctaacacaatgttaatatcaatatacaccattcaacggtatctttgctgtcagtatcctaaatatggagtacccactcctgctgggtctaggcggggccatggatgacgagcagtctactccaacctagagttggactcggcagggccactggcctctgggtcaccggcgtcatcacataccccgatagtgagattactcaacatctacagtctagggtcggaccccagtaggacggtcccggacccctgcgtgtgccatccggacctccaactaggggaggttcggtgctgccaagtgtccaggccatcgcggatgggacacgaacctccataagtgccttccagaccccggccaggggcgcggcgcttccgcatggcccaagacatatcgcggaagccaccatgcttcgtttgacgtaagcctctgacaccaggaccgcctgcattaaatatgggcaggatttgcacctgtccacatcaggggcaggtagcatgtacctcgtattaaatgcatgcaacgtgtgcagtccataaggcttggggcgcgctaataactcgcatgttaccgagacgaagaccattgacccactgcgctgtgcgtgggtaactcccatcatgacttccacaattcccgttgtcgagccatgcatgagacaggcggaggagacaggacaacaccatccacctactcccctacgcaagacgacgaggcaaccgacaccgcttgaaagtcacctagaggggagtgaataggcgaaacctgaaaaattataaactttaaagacaaaattcacccgagtttagcatttagaactagtaataatgaaatcagagtgcggaagatagttcttcttgccacgagttgctcaatcaatgcggataaccttgggagctaacttaaaacgatctcatgcaagagaacttagagagatgggagaggaagaatcaaatcgcaaagcaagattaacacatagacaagagtgatttgtttccgggggttcggttccgaagaatctactccctattgaggaggccacgtagaccaggtctttcaaccctttccctc

SEQ ID NO: 6173 - DNA, 896 bp, Zea mays
agcgatcacctctcctcgctgccgcggcatcttcttctgggtcctggcccgtcctcgtcgcaccattccatggccgattcagccgcgctctccacctccctcccccgctctctggcgtccaggaggcccctctcgtcgcctctccacgccagagcccgggcccgctcccagcgccgctgccggctcggatcgcgctcgctccaccggttgcgtgctcgggcgggaaaggacgacccggaggacctctacgggccctacccctgggaccagcccttggatctcaccgctgggtccgacattcaatgggtgcctgaagacagagtcacgctattcacttctgatgggctgatccagattgggggttccttggttcctcgtcgagtttctgcttctgagaagaggcaacggaaactgaagagtggacaaaagttgcgccggtttcaggagagctcttacatggatccaaatcaaagtctttgccttggagcactatttaacatagcagcaacaaatgtaaattatttgttacttcttaactactttcttaccatatctagactttattttcgtaacaccatttgatatctcagggcctagacatgggcagaagattatgcatctttggcttttgccgttctattgaaatgttaagcgatgtagtggaagatacggtattggagcatggcggtgaggtatgtttccctatttggtgaactatacatgcgcaagaatcttcagtttgaggaactaaatggtgggccttgatcttcccttaatgttttgaagagagaaaaaaaataagagtgcggtacatggtcaatgattactgaaagcatattactttgctagtgaaaagacagtacttgagtaatgaggcataccacaccaagtatggt

SEQ ID NO: 6174 - DNA, 1053 bp, Zea mays
ggccggaaaaaaaaaaaaaaaaaaaaaaaaaaaaaaaaaaaagaaaaaggagacgaccgcgccggcgccgcccattaatttctccccttctatccgcgatcacctctcctcgctgccgcggcatcttcttctgggtcctggcccgtcctcgtcgcaccattccatggccgattcagccgcgctctccacctccctcccccgctctctggcgtccaggaggcccctctcgtcgcctctccacgccagagcccgggcccgctcccagcgccgctgccggctcggatcgcgctcgctccaccggttgcgtgctcgggcgggaaaggacgacccggaggacctctacgggccctacccctgggaccagcccttggatctcaccgctgggtccgacattcaatgggtgccagaagacagagtcacgctattcacttctgatgggctgatccagattgggggttccttggttcctcgtcgagtttctgcttctgagaagaggcaacggaaactgaagagtggacaaaagttgcgccggtttcaggagagctcttacatggatccaaatcaaagtctttgccttggagcactatttaacatagcagcaacaaatggcctagacatgggcagaagattatgcatctttggcttttgccgttctattgaaatgttaagcgatgtagtggaagatacggtattggagcatggcggtgaggttgtcactgcagagaaggcaagcagtaacggcctccaggagaagctaaccatgtctgtcgcagtaccattgctgtggggcgttcctccagcatcagagaccctccatgtcgcggtgcggagcggtggaggtattgtcgataagatctattggcagtgggacttattctagatgtccagcgttaacaaaattggttccaagatgtatatgtctctctaattttctgcacgcgttgtgcagcaactgtaaacttagtctctacctgtacagacccggtcacccttgtgcatatatataaaagaactttgggatcacaacttaaaaaaaaaaaaaaaaaagcggcc

SEQ ID NO: 6175 - DNA, 2366 bp, Zea mays
aattcggcacgagaccgaatccccagaccaaatcgccgtcgccgtcgccgtcgcatcgcagcagcgggagtcccagggtcccggaccgaatccatttccagacacccaaggccaagatccatcgctcgttccaaccagccttcttcttcttctgcttggtcgtctgatctcgttttccattcgtgtccaatccgatccagccaaccgctgtgaatgatggcgctcaacctgtcccaccagaccggcgcggccgtggcggcggcaccggcggcgccacgcgcggccgtcgtcgcggcggcggccacggcgccacgctcggccgtcgtcgccgcggcggccaccgtggcgccgccgcccgcgtcggcgcccgcccccgctccggcgctccagctgcagacgatgacggtggacccggcccccgcgcaggcgcccgacgcggtgaagccggacctcgccatggcgtgccaggcgctggtggaggccgcgcccgaggcggagcacgccgacgtggccgccgagctccggagcagggccggggtgcccgtcttcgtcatgatgccgctcgacaccgtgcgcaaggacggcaactcgctcaaccggcgcaaggccgtggaggccagcctggcggcgctcaagagcgccggggtggagggcatcatggtggacgtctggtggggcatcgccgaggccgacgggcccgggcagtacaacttcaacgggtacatggagctcatggagatggccaggaagaccgggctcaaggtccaggccgtcatgtccttccaccagtgcggcggcaacgtcggcgattcagtcaccataccacttccgggatgggtcttggaggagatggacaaggaccaggacctggcctacaccgaccggagtggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacaggttcatgctgagtagcttgaaggcggctgctgaggccgtgggcaagccggagtggggcaacgcgggtccgggcgactccggcagctacaaggactggccggaggacacgggcttcttccggcgcgagggcgggtggagcacggagtacggggagttcttcatgagctggtactcgcagatgctcctggagcacggcgagcgcatcctgtcggcggcgacgggcgtgttcacgggttcccccggcgtgaagatctcggtgaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccacggccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgatgactacctgtatggcgagtccctatacttactcatacataagctgcgccgccgtgtcgtcggtgcgtgcaccgcgcagtagtgtgcgtacagcggaagctgcgactgcgagcgaggtagggtgtggggtgggtgactggggtacggtacgtaggtgccacgttggaggctttggcgtttgctcagagcctggcaggagatgggtttgatgttctgctgctgtgttactgtatcctacacctacagaatgtgctatgatttgtactgctataatttttaacgaagatacaaacttctacaaaaaaaaaaaaaaaaagcgcccgggggggggcccaccccaattccccctataggagcgataaataaaaa

SEQ ID NO: 6176 - DNA, 2228 bp, Zea mays
  misc_feature (2074)..(2074): n is a, c, g, or t
cactcctatagggcgattgggttcctcggagacccggccgggatcgacctcgatccattgaataattttactaatcaaattcttgttgggatatattcctccaattcccctcctcctcccaacaaggcaacaacaatctgttccggccgccaaacaaaacccaaaaaaaaaaacacactgaacccaataatccgatcccacagaaacttttctctcggtccgttcgatcgatcgctgccgtgtcgtttgccagacaccatcagcacccaaaaccatggcctgcaacctggctcagtgcgccaccgccgccgcggcgaccgtcgcgccccgcacccctcgccctgctgcgtccgcgtccgtctccttctccgcgaggaagccggcgggcggcagcctgcggctgcagcggcaggcgtgctgcgagccgtcggtggcgccgtcgcgggcggtgttcgcctgccgggccgcggcgtcggggagcgcggccgacctggcctccgggggcaggaggtcgtccggcgtgccggtgttcgtcatgatgccgctggacaccgtcaaggagtgcggcaccgcgctgcaccgccgcaaggcggtgcaggccagcctctccgcgctcaagagcgcgggcgtcgagggcgtcatggtggacgtgtggtggggcatcgccgagcgcgacggcccgggccggtacaacttcgcgggctacgcggagctcatggagatggcgcgcaaggccgggctcaaggtccaggccgtcatgtccttccaccagtgcggcggcaacgtcggcgactccgtcagcatcccgctgccgcggtgggccgcggaggagatggagagggaccaggacctctgctacaccgaccagtggggccgccgcaactacgagtacgtctcgctcggctgcgacgccatgcccgtcctcaagggacgcacgcccgtcgagtgctacaccgacttcatgcgcgcgttccgcgaccacttcgccgactacctcggcaacaccatcgtggaaatccaagtcggcatgggccccgccggcgagctgcgctacccgtcctacccggagagcaacggcacctggaagttcccaggcatcggcgccttccagtgcaacgacaggtacatgcgtagccgcctgaaggcggcagcggaggcggccggcaagcctgagtggggccacggtgggccgaccgacgctggcggctacaacaactggccggaggacaccgtcttcttccgcggcgacaacggtgggtggagcaccgagtacggcgacttcttcctgtcgtggtactcgcagatgctgctggagcacggcgacctcatcctgtcgggcgccacgtccgtgttcggcgccgcgcccgtggaggtctccgtgaaggtggccggcatccactggcactacggcagccggtcccacgccccggagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgaggaccggatggtggccttcacgtacctgcgcatgggccccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccggccgggacgggacgggacggaacggaagcctacgatcgactgtacatacaggggttgggacttgggagggagctcgggttcttgttgggttttcctttgggtggagagcgagggagcgcagtcgagagccagcgagcagtctctcgtgcagtgcagcgcagngcagtgcagctccggcgtagatgggcgtggatgagattgtattgtgaccaagccgggagggaaagcagggaggggaggacaaagaagttttgtcacgtttcaggctccggccatcgccggagtttgtccggggaatatatcgatttcctattag

SEQ ID NO: 6177 - DNA, 1275 bp, Zea mays
acggcacctggaagttcccaggcatcggcgccttccagtgcaacgacaggtacatgcgtagccgcctgaaggcggcagcggaggcggccggcaagcctgagtggggccacggtgggccgaccgacgctggcggctacaacaactggccggaggacaccgtcttcttccgcggcgacaacggtgggtggagcaccgagtacggcgacttcttcctgtcgtggtactcgcagatgctgctggagcacggcgaccgcatcctgtcgggcgccacgtccgtgttcggcgcggcgcccgtggaggtctccgtgaaggtggccggcatccactggcactacggcagccggtcccacgcccccgagctcaccgcgggctactacaacacgcggcgccacgacgggtacctcaccatcgcgcgcctcctggcgcgccacggcgccgtgctcaacttcacctgcgtggagatgcgggaccacgagcagccgcaggaggcgcggtgcatgccggaggcgctggtccggcaggtgggcgccgcggcgcgcgccgccggggtgggcctcgcgggcgagaacgcgctgccgcggtacgacggcacggcgcacgaccaggtggtcaccacggccgccgagcgcgccgccgaggaccggatggtggccttcacgtacctgcgcatgggccccgacctcttccacccggacaactggcggcgcttcgccgccttcgtgcgccgcatgaacggcgccgggtcgtgccgggaggccgcggagcgggaggcgcacggcgtcgcgcaggccaccgggtcgctggtgcacgaggccgccgtcgcgctgcggagctgaccggccgggacgggacgggacggaacggaagcctacgatcgactgtacatacaggggttgggacttgggagggagctcgggttcttgttgggttttcctttgggtggagagcgagggagcgcagtcgagagccagcgagcagtctctcgtgcagtgcagtgcagtgcagtgcagtgcagctccggcgtagatgagattgtattgtgaccaagccgggagggaaagcagggaggggaggacaaagatgttttgtcacgtttcaggctccggccatcgccggagtttgtccggggaatatatcgatttcctattagaaatccgcagaaaaaaaacacgagactagttctcacgtccgaatatcaactatgtggtatttgctaccttaactcgtatggctatgttttcaagtcaggtgttaactgtatatatcacctcgtgc

SEQ ID NO: 6178 - DNA, 2563 bp, Zea mays
  misc_feature (9)..(9): n is a, c, g, or t
ctccctccntattatcattgggttcctccacgcccccccacacacaaccctcctccccaaccccatctctctctctctgcctgcgttctcctggtgctgctctcgctctcctcccctgctttgacctccccgcctttccccgccgtttcttggatttctaggatccagacaaccgcccttgtgagcctgccttcctgcctactacctgcgtacgtacaggagggtccttgcttgggtgatccgggtgcctggtttctcggttccgcggcttccgctgctgttggattcgccgagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccttgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgctgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgagcacttccctagggaatgtcggggggatgaacaacggcaacctgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaagtgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacaacaacgaactcatggggacaggtaggctgcaaaggggacttagtggtggtctggatgacattgtcgtggacatgtttaggccggaccgcgcagacgatggcgtctccttcattgatggggactgggaactggtctagcaagtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagccaaggaatgatgtcctgtttcctcttggaaaaaaaaaaaaaaaaaaaaaaaaaaaaaaaaaaaaaaaaaaaaaaaaaaaagg

SEQ ID NO: 6179 - DNA, 3133 bp, Zea mays
  misc_feature (27)..(27): n is a, c, g, or t
aaattcggcacgaggccgaatccccanaccaaatcgccgtcgccgtcgcatcgcagcagcgggagtcccagggtcccggaccgaatccatttccagacacccaaggccaagatccatcgctcgctccaacctgcctcctccttcttctgcttggtcgtctgatctcgttttccattcgtgtccaatccgatccagccaaccgctgtgaatgatggcgctcaacctgtcccaccagaccggcgcggccgtggcggcggcaccggcggcgccacgcgcggccgtcgtcgcggcggcggccacggcgccacgctcggccgtcgtcgccgcggcggccaccgtggcgccgccgcccgcgtcggcgcccgcccccgctccggcgctccagctgcagacgatgacggtggacccggcccccgcgcaggcgcccgacgcggtgaagccggacctcgccatggcgtgccaggcgctggtggaggccgcgcccgaggcggagcacgccgacgtcgccgccgagctccggagcagggccggggtgcccgtcttcgtcatgatgccgctcgacaccgtgcgcaaggacggcaactcgctcaaccggcgcaaggccgtggaggccagcctggcggcgctcaagagcgccggggtggagggcatcatggtggacgtctggtggggcatcgccgaggccgacgggcccgggcagtacaacttcaacgggtacatggagctcatggagatggccaagaagaccgggctcaaggtccaggccgtcatgtccttccaccagtgcggcggcaacgtcggtgattcagtcacgtacgtgtcttcgtcgtctctttctctagcactttctggcttcaccatcaccagtgcattctttcgattaaacgtaaattacctgacgttagtttttagagtacttgtttaaccgtatgtggattacacgaaacgaaatgcacatagaagatcagtactacaatcagaagccgcatgttggtatctgattctgagctggagctgatctgatcttcagaaaagttctgacgccttcacggttttttagctgaactgaataaaacgcttccactagacacagtagttgatgtggactcgaacgcaaggtccccgtgacttgagccacggagaagcacaagttcaccatccgccaccctgcatatatagcgtactgaagaagaaaaaagtcgatcctttttctccttacagacagtggcgcttccctcttcctgccgactcggcatgtgatctgctcacgagatccgtgagcagaaagtttaggctccagcagaacccataatcctgaattcctgacgaagatatgttatcctttttggtttcctgccacgtgatcctgcatgctttggttgtttgcagcataccacttccgggatgggtcttggaggagatggacaaggaccaggacctggcctacacggaccggagcggccgccggaactacgagtacgtctccctgggctgcgacgcgatgcccgtgctcaagggccgcacccccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtcgttccctggcatcggcgagttccagtgctacgacagggtaatgcatgccttgcctgcgtgctcgttcatcttttctctccgatccccttgtactatgatctcaagagctttctggatccatgtttgcgcgtgttgcagttcatgctgagtagcttgaaggcggctgctgaggccgtgggcaagccggagtggggcaacgcgggtccgggcgactccggcagctacaaggactggccggaggacacgggcttcttccggcgcgagggcgggtggagcacggagtacggggagttcttcatgagctggtactcgcagatgctcctggagcacggcgagcgcatcctgtcggcggcgacgggcgtgttcacgggttcccccggcgtgaagatctcggtgaaggtggccgggatccactggcactacggcacccggtcccacgcggcggagctgacggcggggtactacaacacccggtcgcacgacgggtacgcgcccatcgcgcgcatgctggcgcgccacggcgccgtgctcaacttcacgtgcgtggagatgcgcgaccacgagcagccgcaggacgcgcagtgccgccccgaggcgctggtgcagcaggtggccgccgcggcgcgggaggccggcgtgggcctggccggcgagaacgcgctgccgcgctacgacgacacggcgcacgaccaggtggtggccactgccgccgacagggccgccgaggaccgcatggtggccttcacgtacctgcgcatggggcccgacctgttccagcccgacaactggcgccgcttcgccgcgttcgtcaagcgcatgacggagccgggcgcgcgggaggcgtgccgggagcaggtggagcgggaggccgagggcgtcgcgcacgccacccagcccctcgtgcacgaggccgccgtcgcgctcaccaactgaccggaccggccggcgttccccgtcgactgtgttcgatcgctagacggggtggcacgctgcgacgactacctgtatggcgagtccctatacttactcatacataagctgcgccgccgtgtcgtcggtgcgtgcaccgcgcagtagtgtgcgtacagcggaagctgcgactgcgagcgaggtagggtgtggggtgggtgactgggtaccaggagtggggtacggtacgtaggtgccacgttggaggctttggcgtttgctcagagcctggcaggagatgggtttgatgttctgctgctgtgttactgtatcctacacctacagaatgtgctatgatttgtactgctataatttttaacgaagatacaaacttctacaaaacgtgcaacatcgtgcagtatggccattgtcgttcgtgcttcagcggtcagaaggtgtctgaggttctcgattttctttctgaaagtcctccgggccttggttattacagtatgtaaaaagtttattatataaaaaaaaaaaaaatttt

SEQ ID NO: 6180 - DNA, 3215 bp, Zea mays
gtgcagcgtgaattaagaaaaatacaaatgaacctgtcattttttttcttttttctgtagtaaacataaaaagcaggtatttttggcgaaataccgacgattttgagcggtttaccagtgcggttccatcggtaaaccgacatgggaaaattttaatttgatttaggcaaactggtcggttttaccggtaaaccgccgatttaccattaccgtcgggggacggttttcgctaggaaaatggctcgttgaacccttagggcttatttgggagcaagtgaaatgaaggggattgaggggactataatccctcactatttaaaattgaatagtagaggattctaactcctccaatcccctccattacccttacttccaaacaagcccttaatgacacctgctgtagggacttagggtatgggtgtaagctaatgataacgtgaaaggcgcttggcggctgggcagcagtcgttcccgctcgggctcgggctcgctctggtagtcatatattcattaggcaactgatatcgataccgtatatccatacccgcgaaatatatacacgtgcatacaaaaatctaccatatatatacccaattaataattacttgcgtatctatacacgttgccatcctaggtgcggattagaataagataccgcttgattggatggatgtgcgcagtgcaggtatctgttcatataggtagtgtttggttggatgcgtgctaacagccatgcacggcgtgtgcgttgactttaagtaagcacatgtttggatggctgcatacgagcgagcaggcctgtatatgctggtgcaacatagaccaatttgtgtctctcagcctgcacgcgcagaaacatgggaagattgtctcccgtgagccaagctcggacaagcctgcatgtgcgtatgcagacaagcaatcatgaggatagttacgtctctcgcatgcaaacattcaaacaagagcttaaacaatacaagatgaaagcaaccgattatcaatgtcgacgccagagaggtgcgccgtggataatttagctcagccctcgctggccggcagtgaggtgcgcctggagaaggtggcccccgtagagcctggttacttcggcccggcccattatgtcatcaaacagatccgagccgtccgattcaggttattcctcgcgacacatccatttataccccggcccccgccgccccccggccccgctttctcttagactatctgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtccggatctcctcgacttcctatcattttctcttctgtttccttttcacttttgttggttcctttgatatcttggtttgagtatgttttttatgtgctagattggtttgtttttcaggtggcaagctcgtgtaccagtacaccaagaagagagccagcgggcccaagtgtcccgtgaccgggaagaagatccagggcgtgagtgaccactttctcatcataacataccttatacttgtggcacgtagctcacgattgttcggttagtcttgcggccttggtagggcgatttgttttgggaaattgggagtaggtacggtggtgggaaatggcggtattgaagttggtggtaatctttccgtaaaatgtagtgaagttagttgtccatatcgatatttatgtcactttataatgattagaattcttcttagtgtggaaacgggtgaaattcgggctgcaacatgcaatccttttttgcacaggcataaaattcatgggatggaatttgattcccgagctgtgcattttgttgtgtaatggaggctagggagcctttcagtcggaaatggattggtggctcactataaccggtcgaaatttacggaaaggctaggggggtgttcatggcagctaaagcagtgtctgcaaagtgggacactagcagtagcagattgctgctacagccaaacaagccctaattctgttattgtcagatgtccaacaacaatttcgcactgctttgataatattatttattttctcattatgacaatacattcatactagtttgtttgtacagtgctgattcttatacagcaagccttctaggtaaggatttcatatgcacacttcgtagtttgtacagtggtaatttgatgttggtttctttatttatcttattggctgtcatgtgagatcatacagctgaaacgtttgaggatgcaatcttggtagtgtttcttgacttcagttaatcaagttatgcacttccggtgatggtggcattcccattctagttccaaaatgttcaccacagcagaaaacagtcaacattgacattgttgcattagcatgaatttcttcttgggaaaatggtggctgattcatattttgttggaattctatattgtgaatcccttgatgtgtttctttgtagcatgctttgatgctattgcttgatttgattctggaggatgcatgttcatgttctacaatttgccttattattacttgtctgtgttggcagttcatcttggttgctcacaccgagatggttttcattttgatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacatttttgtcgacagttattatcaatggcttagtctcttctagctgttctattgttcttgtatcttgagcggacaactggtttctagggcaccttgaaatctgtctacgagatctctaagattatgagatgacatatgaccccctattgcttttgttcactttgctaaaactgaaagtccgagttcacatgagttgggcatcagttggtgtttatttcctgcttgttgggtcttgcgtctgaattgggaatcagtttgtgtttatttcctacttgttgcatttagttcttaaaaaaaaaaaaaaaaaaaa

SEQ ID NO: 6181 - DNA, 893 bp, Zea mays
gtaccgccccccccgccaggggggggctccgcgcggccggcccggctctttctcttagactatctgccgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacatttttgtcgacagttattatcaatggcttagtctcttctagctgttctattgttcttgtatcttgagcggacaactggtttctagggcaccttgaaatctgtctacgagatctctaagattatgagatgacatatgaccccctattgcttttgttcactttgctaaaactgaaagtccgagttcacatgagttgggcatcagttggtgtttatttcctgcttgttgggtcttgcgtctgaattgggaatcagtttgtgtttatttcctacttgttgcatttagttcttattccaattactctggctgtgagtttaaggcccgatatgtttcatcgtgactagaggtcagtgggattctctccag

SEQ ID NO: 6182 - DNA, 2033 bp, Zea mays
  misc_feature (2006)..(2006): n is a, c, g, or t
aacggcacacctccgtgccgctggtggtgccgcgggtgttggcctttctgaagtcgcttctgccgtgatgggggttgctttgatgagtactgctggctttatgcgttacgactggtccagttcgaagcgcccacacacgcctgatcattgtcagcactatatagcacttgtccagggcaggacagggaataagactgttaacaatgtcccacatgagatggaagctcattctgcagtgcgtcaaatagaaacagaaatggcaacaaagtggaaccatcaattcatgaaagcttccctgagtgcagattatgattacattgaacgcaaacagagggatgctggtagagaaatctattcactgagggaggagcttgtggtggcccaggaccggattcatgagcttgaagcagagtgtcgatctacaaagaagcagcttgatcacctggcaaagaatattgcagaggaaaaggcttctttgaagagcaaggaacatgataagtttcaccacatcttagatgcaattaaggaagaactgaatcgggagagaaaacagcgacagcgagcagaaatgatgaactccaaactgctcaatgatctatctgagatgaagtttgctgcaaagcgttatttgcaagattatgagaaggagaggaaggcacgggtgctcatggaagaggtttgtgatgaattagcgaaggagatcacagaagacaaagctgaggtggaggctatgagaagtgaatcgatgaagatcagagatgaattggaggaagagaagaagatgctccagatggctgaggtttggcgtgaagagagggtacaaatgaagcttgttgacgcaaaactggcacttgagaataagtattctcagctgagcaagcttcagaatgaactcgaggatttccttcaattccaatcaggctgtaatatggaaaaaggaacggtaagggaagcagagaggctcaaagaagcaatctgctcttctaggataaatggtatcaaggagttttcgtacaaggctcctccttcttcagaagacatttttgctgtatttgaagaactcaagcaacgagaagatactgctgagaaggtgattatgcaatgtaacggaaatagacccaagggtcgcggctcaagagcccacacagccagtcctgaaacggacacgttcttggagaatcaaccaaacagatattgcaatgaacctcgcacccgaaatgaggcagcagaagatgatagtggctgggaaactgtaagccaagttgaggagaatgggtcttgtaattcaccgggcggaagtgaaccgtctgtaaatggcttctgtggagaaaacgatgcttccgtgagtggaaccgactgggatgaaaactgtgacaatgatcaggcacacagtgagatcagtgaagtttgttcaacagcagcaggcaggtctcggaacaaaagatcattcgccggactatggagatcatcaaacaccgtggaccaaaagaagatgggatccaatacactcaacggtaggtcatcaaatgccaggatgtcaaatgccaccgaatctgctgacctgaagaatagcgaagtgtgtgacagtccgcacatcacagggcagtggaggccggacctgctaaacccggacatcgttcgagctataaaaggatgcatcgactggccccgaggagtgcagaagcagagcttgaggtccaaggttctggaggcaaggattgacggcagtaaggtccagctgcgtcaagcactgaagcagaagatatagcgtggtcagccggtcacattcttgctggtgggggcttccttcagctggaggcctggagcaggcagcgacccgcgagatgaatttctgcagcagtgggtatctcagttgatgcctgacggcccactgacctgctttgcttccgtaatgaaattgttcgctcagtgccccgttgtaatcacgcctgtcctgtgtagaaatactttaatcaataagcaatgaaatcattcgaccttttttntggataaaaataaaaaaaaaaaaaaaa

SEQ ID NO: 6183 - DNA, 1894 bp, Zea mays
  misc_feature (1840)..(1841): n is a, c, g, or t
atgggactaaaatcccgtgccatctctgtacactatattagcttcctgattccaacatccactccctgacctgtgcggcgttcccgtgcccggccggagtattgatcgcatggcctgcgccggcgccgcacggaaggtctcagcggtgctctaccactacccgtgcccggacggcgcgttcgcagcgctcgccgctcacctctatttttccggcgccgcccatccggtccgattcttccccaataccgtctacgaccccatcaggagtgattcacttccactggaagaaataaaagatgtttaccttcttgactttgtgggacctcctggttttgttgaaaatatagcccctaaagtcgaaagaataacaatcctggaccatcataagaccgcttttgaaagtttgtgtgtgaatgccacacttgggcaaaatgtgaccaaggtgatagacatgcagcgtagtggtgcgacaattgcatttgacttctttagaaacaagctcttaacagaagttagcaccttacggggtaatgaaagtggtaaagatgtagccgacgtcaaatatgtacctgacaacaaggctgaaacagtacacaagctttttaagtttattgaagacggggacttatggagatggaaaattccaaatagcaaggccttcagcagtggacttaaagatttggacattgaattcaatgtcaatgcaaataataaattgtttgatcagttgttggagttggatcctgagcatgtcatttcccatggacaagcgacattattagagaagcaaagattaatagatgattgtttggagaaatcctatgaaatttccctgggatgtggccagtttgggagttgtctggctgttgatgctgatgctatttcaaatttgagaagcgaacttggaaatcaactagctagcaagagccgtgattttaatctaaggggtattggggctgttgtatacaaagttcctgagttgaataatgaccagatactgaaagtaagtctaagaagtttagaacaagaagacacaacctgtatctctcaggaatatggtggtgggggacatcggaatgcaagctcgtttattttgagtgtgactgagtttgacaggtggaaagtcggatcttctcgaccaaaagttttgaagacatgaactgtcgtgtggatgaggtttcacgtgcttggccaacgtcagtaacaaaacggcagcaggtgggcatctttgaagcaagtattggttgatgagctatgaattctcagggaagacggcccgaatgaacttcaagaaacgctccgagtagaactgggggtccacaacagagatcgagtccgagtcatattgcatggaattcacgatcgattttctttgtcatattgtactattgcaaatatgtcaatgatgcccaggtagagaacatcgtacacctcacgaaatgtctcgacagttgacagataaggaaaaggccaatgcagctgatgaggagttgaaaaccttgatttgctagttgaacatgtagatgattttgtgatgcttctccaaccagtgagatagtagctgatgatatgctagttgaacagctttaacttgtgatgcacaattttactttatgcggagggaagggtgacacggaacgacatgctttatatagtagagatggagtgttcttatcacttggagccttggggtgagacaaaaaaagaacaatggaacgctcgtgtcctggggcttgttgtggagcacaaaatattttattcttggtcttttttcaaacttaaatagatgcaaatgtgtagatgagggccttccctctgataaaaaaaaaaaaaaaaaaannaagggcggccgccgactagtgagctcgtcgacccgggaattaattccggaccg

SEQ ID NO: 6184 - DNA, 766 bp, Zea mays
tgttggagttggatcctgaccgtgtcatttcccggggacgagcaacattattagataagcaaacattaatacatgattgtttggagaaatcctatgaaatttccctgcgatgtggccagtttgggagttgtctggctgttgatgctgatgctatttcaaatttgagaagcgaacttggaaatcaactagctagcaagagccgtgattttaatctaacgggtattggggctgttgtatacaaagttcctgagttgaataatgaccagatactgaaagtaagtctaagaagtttagaacaagaagacacaacctgtatctctcaggaatacggtggtgggggacatcggaatgcaagctcgtttattttgagtgtgactgagtttgacaggtggaaagtcggatcttctcgaccaaaaggtgcataaccatctggctttcttcattgctctacaagattaatgaagaaacacatgcagagggaacaaaaccccaaacttgggggtgtgggacatgagaaacatcatagctgcatatcagacaattctcgacacttacgcagcattctgctatcatgccatatcttaccctatggcacttattcataggctgctgtgtgggcacttagttttacaaaatctgctgaaatctaattggagaactctacatgtctcacgtactagcttagacactgaatatattagtccttaaatgcgtctttttacattttatttatgcaagtgctactttgattaatgtgtagttctgt

SEQ ID NO: 6185 - DNA, 1146 bp, Zea mays
agcctgtaaactgaaaatgtaacatgccatataaccacttctttcccttctgggttgctgtttgtgtgacaaagttgtacatcttgctgttatgctactgaaacctggaaaaactgaagttttcctgaacttacagaagaaaaaggtaaactagatctttcttttttttctttgccccccccccccccctcgtatcattgcattaagaagttctgctttgacaaagttgttgatcaaaactggaatctctgtatcatttgtaactgagatcttcgtattgatctcttgcacaaggtgcaggtacagcctcaggtctaattgcttgaatcctttgtgtacatctcgggcttcagaactccgacataaggcaggttacggtagagctccgcgtaatctaaaccatagccaacaacaaagtagtctgggcactcaaatccacggtaaaattttccatcccccactagatgaacattgactttccttcttgctggtttgtcaagaaaagtgcaaaccgatatggatgatgcacctttcttctccaaatgagcaatgagataggacagagtattccctgtgtcaacaatatcttcaaccacgaccacatgcttcccggccacgtcgactttgaggtcggccgtgatacgtggcttgccgctggactctgtgcccgccccataggactcgacgcgcacgaggtcgaccacgagccgcacgtcgacgcgccggacgaggtcagcgaggaagaggaacgcgcccgtggcgacgccgacgatgacggcgggctccggcaacgcgcgcaggtcggccgcgagctcggcggcgacctcgcccacgcgggtggacacctcgtcctccgtccacagcacgtaatcgatgccgacctcggcgctcaccatggcagtagaggcgaccgtggcagcggcggcggagcaggggaggaaggttagggttgcgagccggcgggcgcggagcgcaggggatttattagggcggcgttggcgcgtgggctgcgtggtggcgcggtcgcgccacgggtggaatgccgcgggcttgatgaggaaccgtgccaggattccggaatcccgcgtcgtcaccacagaccatggccggcccccctcgtggtgcccctccggttgtagttccggc

SEQ ID NO: 6186 - DNA, 2611 bp, Zea mays
  misc_feature (2512)..(2512): n is a, c, g, or t
agctcgaattccgttgctgtcggcggccattggaggcttaaaatcttctgttgatatgctggtgacctacatgaaggagtacccaatgtgtcctcagattcttctgatctcagctcggttagacagaaagcatggtacatgtccaggtctgaaaagctttgatgagttgatcttgaattggcctaaagaggcacaaggaattcaatatatgtggaatcaatatgttgaacatgctctggccactgatgccgagttagctgagaaggtactgacttgctggtttgaagaacatggaaaggactgtgatatccaaagcaatgctgctatttgtatagaactgagcagtgaagaacctggaacatcatcacttgtttcacctcaggcagttggttctggtccatctatatcagaagatctcgtctttcggttactaaacctctcactgtataagatactggagaacaacctacaggaagcacaaatggctgcgagtaaagcattgaaattggctcatggggagtggtacgagcactgtataagagaacatgctgcaattcatgcactggagctggagaaatcatcatcttcgacagatgctcaaactcgggctacattcagtttaatcattggctaccttgctgatcattgcaacttgcccacgagggagctgctgtcacgaaggttttgccagaatattaagaagcataggcttaggcagcttatagatgatactattggttctgttcctgcagattcttctctgataaactctgtccttgaagtgtgctttggcccatccctccttccaaaaagcattagcgatgtgaagtacctggttgattttgttgaaacagtcatggaggctcttcctgcaaactatcgcctgggcttggctgttggtggattcgtagctaagcacttcacaggttatggcgcagcctccactgggaccaggttctgggcaagctctgttctgatcaatgccatctttcgagctgtacctgtcgcaccggaatcagtatggctagaaggtgcaggcctcctggagaaactgcatgccacagagattttgaagaggttctatcagcaggcggcatcggtctatcccttctccttcaagctgtggcacgcccatctgaattactgcaaagccagtgggagcaacactgagagcatcctggagagtgcgaggcagcgtggcatcgagctgaatctgacaccaacatagtgtgtcccttggatccaagctgcatgatgttttgccagtcggagatgttggtagtgttgtgttaactggagatggcgtgtagatatatcggtgatcatggtggtgtgagatcatttttgttctttaggtgcaggtttagtgggacatagtcgtcggtatcttacagcatgtgtttctgatggagtgatatggttagtaagcagtggtgaaggatacaggcatacgggcactggggcatataccatacttttggactagacgggctagagactgattttggagtccgttatgtttccattttccgttctcttggttttctctgtcgtcaatgtattataatcatgatgatgaatggatggagaaatgagatgagatttttttgagttcactcttgcagtttcggttattatatttttgtgctgtcttcgaatctgatttggtcgacggcatgtttggaagtaaagtattttaaaatcaggttttggaatacaaaaaaaaaaaaaaaacatgatataatctttgtattttttacattgctcttagcaacatatgtttggagataaagtatctcaaactataatatttagtatacgtgtacaagactagttatagacaaactttgggttggagtggagttttaaatactctaaaaatattatggtatctacaaaaccatggtacataagggcacaaggcagagttttagttttttttacaacgtagccaaacatttcttaataaaaatcactatggtattctctagtaccatggtttaccttgaaactctaaaaatacttagttttcaaatacccctaaatatatatagtactccaaaagcctagatataatcctagctaaatttaaagttacatgaggacaaaaataaacaacttcataaacagggtaaaccaataaactaactctgtaaatcttttctatttatatttaaatcaactcaactgtgtaaatcttttctatttgtatttaaatcaactcacaaccagccgccgcgagccactgccgaacaatttggctttgtagatgttggccagaaaacaacggcttcacctaaatgttgaaacgcacggccaatacagtgtgtccagcctgttctccctctccgagacaaacaacaggctggttgacgtggcccttctccagttctccgtatcctcgttggcgccgtgaactgaggactatccgccgccgtcgccgcgacctgaaactggaggccgccaccgccgcgacatggcgcactgaacgctgctgccgtgtgacgcccangcagagaacgacatggtagggagcgacacaggctcaaaacgggcacaggcacgcgggcgggggaagagaaatagacgtgagaagtggagcacatgtacg

SEQ ID NO: 6187 - DNA, 2413 bp, Zea mays
attagagttgtagtccgaggtgtgctgtgcatcctctccgtatgcagctaatcgcccgcccaagaaggtttctgagcggaaaggaataggaaagtcccgacgagaagtgcactctatctttttatatagggactagggagagaggtttgctcggtagctcagagacatcctccagctgattttctcgccgcgcgccgtgttcaatacggctacgaaaatagtagggctggcaaaccggtggccggccggcagcgcggcggccgaggagatggggagcctcgacggcggccactcgctgcagcagggccgccaccacggctacgcccactcccagtcccacgtcggcgcgggtcccgacagcagcaacaacaacaacgacgaggacgacgcgtcgcccccgccgcctgccggggcgggaggaggtcctcgccggccgcgcgggaggcccccggggtccaagaacaagccgaagccgcccgtggtggtgacgcgggagagccccaacgcgatgcgctcccacgtgctggagatcgccagcggcgccgacatcgtcgacgccatcgcgggcttctcccgccgccgccagcgcggagtctccgtcctcagcggcacgggcgcggtcaccaacgtcacgctgcgggagcccgcgggggccggcggggcagcggccgtcgcgctgcgcggccggttcgagatactgtccatgtccggggctttcctcccggcgccggcgccgccgggggccacggggctcaccgtgtacctggcgggggggcaggggcaggtggtgggcgggagcgtcatgggggagctcatcgcgtcgggccccgtcatggtgatcgccgccacgttcggcaacgccacctacgagaggctgccgctggaccaggcagacgccgaggagggcgccgtgctgtccggctcgtccgagggcgccaccgcgcagcagctggagcagcagcagagcagcgggggtcccgtcgtgccgccgtccatgtacgccgtcccgcagacgccgccgcacccgcacgacatgttcgggcagtgggggcacgcggctgtgacgcgcccaccgccgacgtcgttctagctagcgctagatgcaccagctgcgacctgcaccggccgcccgcccgccgtataccctctccacctttctagttagatttccacttcttcactagctactactagctactactctagtttgttacgtagctctaccatggcatgcatgtgtgatcgttttcccatttcttctagctctcttccatctggagcgtgtggatcaatgtacaattcctatttgcgaataccggaatccatcaatgtttactttaaaaaacccaaaaagcgcggccgctcgcgatctagatccagttagcattgcattaacgaggtaagcgaatcagtttcacaagttaaatcttcaaacttttcatcaaaagaaaggctttgttcttgtgttccgctaagcttgaatttgctaaaataagttgctaaccgccactagaaaaagatattggtgatccaaatagtccagttagcttatagccaaccttaaatatcaatatataaagttcagctgatccagacggatccatgtatatatcctacaagaaattaagtgccacatattgtcttcaactgatggacctgccattacacgttttttttgttggtttcttatatttctttgtccttatgtatgaatgattatgaatttatgataatttcaatgaagaattcatggatttcaactttattgtgtcgatagctgctcacgcactcgacaaaccttgaaaaatacttgacaaactatttgccgagtgtgaccctaggtaaactctttgtcgagcactcacacgcttctttcccggtttggtcctaaaatagaccgtaacttatgctaaataacatgaatatcattttttgcattcattgtttcccatttttctagtgacctgcaccgaagaaattaaattaaacaaactaaatctaataggtatatcaaatactttgataattgtgctaaaattgaacatatagatatatatactattgaaagaaattagaaaaagtttttggaggggggcaggggaaagaaaaaattcctgggacactcagcaaagatgttattttgccgagtgtctcccgggaacactcgacaaagttaattaccgtcagttaccattggcagctaacagcgctttatcgagagcccttatttgccgagtactgggctctcgggaaaaaaagtctttgccgagagcctttttatgctaagagtttggctctcggcagatgctctctttaccgagtgtcgttttatgccgagagcaacactcggcaaactaagttttgtcgagtgccagataaatagctttcggctaagagctaggcattggcaacg

SEQ ID NO: 6188 - DNA, 738 bp, Zea mays
cactcctaagggcgattgggttcctcgaggccggccggggccctttcgttcctgctatgctacagcaacatataacccatagagataattcagtagatctagtagtttaactccataattgttggatttcaatacattcaggttcttgctaatttgatcggttttaaatgtttgatggaatcggttggactgtggaccgaggccggcgaatcaatcaagaacgccatctcctaggttagggtgtgttggacctgccatgggggacaggccggcgccgatcgagaaggtcgcggtgccggagaagatggccttgttcctccacgccgccgtcacgtcaccgggacaccagcagcagcacggcgcctcgtcgcacgaggcgcccgccgcgaacatcacgccgcggacaacagccaggaataagcagcagcacctgccggtgagccccggggcgtgcctctgctcgccgaccgttcacgagggctcgttccggtgcaggctccaccgcggcagcggcagcggctccggcctccacgagatgaagatgagcaagaaggccggcgtatgacgacgcgacgcagcgggcggcgacaagcgttcgtactacgccttaccgcaaatgcacaggtgcctttgcctgcatttcggcctctgtttttcccccctcatttgttttcgctgcatacagtaatacagaaggggaagagtaccttttttttgttccttgtgcggccctttccc

SEQ ID NO: 6189 - DNA, 1575 bp, Zea mays
ggcatcgccaagcagagctaccagctgcgcatctggctcagcgccgtgatcgcgaacatggagacgtgcgtcgacgggttccccgatgacgagttcaaggccaaggtgaaggagtcgttcaacgatgggaaggagctcaccagcaacgccctggcgctcatcgagaaggggtcatcgctcctctccgtgctaaagggcggctcgaaacgacggttgctcgaggaggagggagaaccggcgcaagccgggcctgcactcgacaaggacggcatcccggagtgggtgcccgacagtgagcggagggtgctcaagggcggcggcttcaagagcacactcacgccaaatgtggtggtggcgaaggacggcagcggcaagttcaagaccatcaacgaggcgctcgccgccatgccaaagacctacgacggaagatacgtgatccaagtgaaggagggagtgtacgaggagtacgtgaccatcaccaagactatgaagaacgtgaccttcttaggtgacggctccaagaagtccatcgtcaccggcaagaagagcttcgccgacgggatcacgactttcaagactgcaaccttcactgcgcaaggcgacggattcatggcgatcgggatggggttccaaaacacggccggcgcggagaagcaccaggcggttgcgctgctggtgcagtcggacaagtccatcttcctcaactgcaagatggacgggttccaggacacgctgtacgcgcactccaaggcgcagttctaccgcaactgcatcatctccggcacggtggacttcatcttcggcgacgcggcggcggtgttccagaactgcatcctggtgctgcggcggcccatggacaaccagcagaacatcgcgaccgcgcagggccgcgcggacgcgcgcgaggccacggggttcgtgctccagaagtgcgagttccaggccgaggccgcgctccgggactccgggcgcccgcccatccgcaactacctgggccggccgtggcgcgagtgctcgcgcaccatcgtcatggagtcggagctcccggacttcatcgacaaggcggggtacttgccctggaacggcgactttgggctcaagacgttgtggtacgccgagttcggcaacacagggcccggcgccaacacggcggggcgcgtcagctggccggggttcaagaaggtgatcagcaaggcggacgccaccaagttcacggtcgagaacttcctgcacgcccagccatggatcgatcccacaggcacgccggtgaagtacgacctgttcacatgaggacacagctggaccggggatcggatcggagggttcggttcacggtggccggtgggggatcggaggccagcgcggcagcatgcatgcccttggttcgttgaatcgttcggtgtcggtccccccggggtcggccgaaaccgatcactgcgtacacgagtggaaaatgctactgctgttcagtttaagttcgcgttgtatgtatagtggctgctacttatgtgagttttgtacctgtacatgaagtctcttttcttttatatacatggctaatggggtgttgactaa

SEQ ID NO: 6190 - DNA, 3427 bp, Zea mays
  misc_feature (440)..(440): n is a, c, g, or t
tccttgggctctttcgcgcgtgccttacgtgtgcggtggctacgacataattgcatctcctcatgtacatcctagggcaattgggagttaccttgcaccaagactgataaacttatgtttgcggcatcaacagatattgtgattggtgatggctctaaaatatcattataggatagtgcctgggttggtgggatgagggccaaagatctggcgcctcgcctatttaccatatcaagaaataagaataaatctttggtaggtgcggtaagaagcaatgcctagatcactgatcttgacttgctcgatagaataattaattctcaccgtattcacgagttctacactctcttgtcccatgtccaaaagatccaactccgactagggtatgaagatgtcattaattggaaattcacttcagaccatcgctacacagtaaatcngcatatcaggctcaattctttggatcgacttgcacaaagtttgacctgttcatatggaaggtttgggtgcccccctaagtgcaagttttttagttaggtagctattcaaaattgaatctagacggccgatcatttagcagccataaattggccacatgcatcatatatgcatggggccctggagtctaggatacatcttatcgttgaatgtgagttctctaaacggatttgtgaggacattgttgtttagatgactattgaggaccttaagccgttccacgctcattgttgtcctggtgggagagatcggccatgttggcgggatgcaaaaggaaagtcctgagatcgttgtggacttgtggcgtggcaaaatgaatccaagaaataacgaactcccaaacatagcctccacaaacgtctccccacccttctttccccggaacaatccacagtccccaaataaacctgtctcgccattgcctcccgcccttgctccatcccccccgcccggggcgatggaaggcagagggtgacggccaggaggaagcggtcaataagagacaggggaaaatttgcccaaaaaaggactagaataacagctccgatccgaccatgtcgtcgtcggcgttcggcgacttcggtccgctcaccgagcgccgccgcgccgaaaaggcgcggcagcagcgcaggcgcatcatgatcgccgccgggactatctccatcatcatcatactcatcgccatgggcagcgccgcggtcatgtacagcgggaagaagtcgtccagcgacggtggccacaagtctgcttccaaaggcaagtcgagcggcgggtcagactcggactcgggagcggaagcggaagcggaatcggaagcggaatcggaatcggggtcggaatcgaagacgaatctgaaggccgtgtccaagagcatcaaggcgatgtgctcgcagacggactacacggacgcgtgcgagaagagccttggcaaggccgcgaacgccagctcgtcgtcgcccaaggacatcatccgcagcgccgtggaggtgatcggcgacgcgatcggccaggcgttcgaccgcgccgatctgatcctgagcaacgacccactcgtgaagggcgccgtcgccgactgcaaggaggtgttcgcggacgccaaggacgacctcaacagcacgctcaggggcgtcgacgacaaggacggcatcgccaagcagagctaccagctgcgcatctggctcagcgccgtgatcgcgaacatggagacgtgcgtcgacgggttccccgatgacgagttcaaggccaaggtgaaggagtcgttcaacgatgggaaggagctcactagcaacgccctggcgctcatcgagaaggggtcatcgctcctctctgtgctaaagggcggctcgaaacgacggttgctcgaggaggagggagaaccggcgcaagccgggcctgcactcgacaaggacggcatcccggagtgggtgcccgacggtgagcggagggtgctcaaaggcggcggcttcaagagcacactcacgccaaatgtggtggtggcgaaggacggcagcggcaagttcaagaccatcaacgaggcgctcgccgccatgccaaagacctacgacggaaggtagacaaggtggttggtagtgcacagtgtttataacgtgttggtgaatcgtcgttctcctatagatacgtgatccaagtgaaggagggagtgtacgaggagtacgtgaccatcaccaagactatgaagaacgtgaccttcttaggtgacggctccaagaagtccatcgtcaccggcaagaagagcttcgccgacgggatcacgactttcaagactgcaaccttcagtaaggacgacgatgggcctcctcaacctcctcaaatgcaacaactgacgccccccatgatgtgttgttgtttggttcgtagctgcgcaaggcgaccgcgtccgggcgatcgggatggggttccaaaacacggccggcgcggaaaagcaccaggcggtggcgctgctggtgcagtcggacaagtccatcttcctcaactgcaagatggacgggttccaggacacgctgtacgcgcactccaaggcgcagttctaccgcaactgcatcatctcaggcactgtggacttcatcttcggcgacgcggcggcggtgttccagaactgcatcctggtgctgcgccgcccgatggacaaccagcagaacatcgcgaccgcgcagggccgcgcggacgcgcgcgaggccacggggttcgtgctccagaagtgcgagttccaggccgaggccgcgctccgggactccgggcgcccgcccatccgcaactacctgggccggccgtggcgcgagtgctcgcgcaccatcgtcatggagtcggagctcccggacttcatcgacaaggcggggtacttgccctggaacggcgactttgggctcaagacgctgtggtacgccgagttcggcaacacagggcccggcgccaacacggcggggcgcgtcagctggccggggttcaagaaggtgatcagcaaggcggacgccaccaagttcacggtcgagaacttcctgcacgcccagccatggatcgatcccacaggcacgccggtgaagtacgacctgttcacatgaggacacagctggaccggggatcggatcggagggaagttcacggtgggggatcggagaccagcgcggcagaatgcatgcacttggttcgttgaatcgttgggtgtcggaggcaagggggaggaccgatcactgcatacacgagtggaaaatgctactgctgttcagtttaagttcgcgttgtacttgtatgtatagtggctgctacttatgtgagttttgtacctgtactgtacatgaagtctcttttcttttatataccatggctaagggggtgttgactaaaaaaaaaaaaagtggtgtttcaacgttaactatgaatattcaatatagtttaaatataaactaataat

SEQ ID NO: 6191 - DNA, 487 bp, Zea mays
aaagcttcagagtatggatgcaccgcgcgtggaggtcgagctgcttcggcgacagagagccgcttcggagcaagcagcaatggacgctaagcagaggcaaagttcgggtggcatgtggggttggctcgctggaagcccgacaccagcagtttagttccgtgattcatatattttacttgtaacattatatatcatttgactgacaccctctacaatttttttatttggttacttacggcattcgtgttcattttggaccacacaaagaataaggtgttctagcgatcgttatactcacaattactcaaaatgtattctttaggtttagcaagggggtgttcatgttagtcgatgtgctggttatccttttgacgctgtgctggtttggctgtccatagattgttcgcttcacaaggggatgttcatgttagtcgatgacttttttgtgaaactgcagtttgatatatgaagtgcaagtatcgtgaac

SEQ ID NO: 6192 - DNA, 1342 bp, Zea mays
  misc_feature (1074)..(1074): n is a, c, g, or t
gccggccgggcttcccgggccccgccgcccacgcgtccggtactgcctccactgcagtcccagctcagagctctcagcggtggcggccggcgaccggcgacatcctccggtatcgactcccgtggagtggagcgttgaaccacgctgcggacctgcattcaccagtccgccgtttccttcgccttcgccttctccgcgtgatccggttgctctggccactgatggccggtgacattacatgcggatccttgctgcaaaaattgcagttgatatgggatgaagttggcgagagtgatgaggatcgtgacaaggtcctttatcagctggatcaggaatgccttgatgtttacaagaggaaagttgaccaagcaactaactctagggatctcctgatccaggctctggatgactcaaagatagaacttgctaggcttctttctggtcttggagaaaaagctattgcaagaacccctgagaagacaacaggaacaatcaagcagcagctagctgctatagcgccaacacttgagcagttgactaaacagaaaaatgaaagaagaacagagtttgttaatgtacaatcacaaattgatcaaatatgtggtgaaatcgctggcaccatagaagtgggtgagcaggtgacaacaccccaagtcaatgaggatgatttgacacttgagaggcttgaagattttcggtctcaactccaggagcttgagaaagagaagagtaataggctggagaaggttcttgagtatgtaattatggtacatgatctttgtactgtcttggggatggattttctcagcacagtgactggagttcaccccactttagatgactctgttggcgacaactgtaagagcattagcgatgatacattgtcaaaacttgacaagacggtagctacacttaatgaagataagaagctgcgtctaagcaagcttcaagaactcgctggtcagctctatgatctttgggatctcatggatgcccccaaggaagaaaggcgcatgtgttgatcatgtgacctgcgacagatcagcatcgtgtggatgaagtcacagcacctgngatctcttgctctagatttaattgaacaagctgaggttgaggttcaaaggttagaccagctgaagtacagcaagatgaaagaaatagctttcaagaagcaaaatgagctggaagatatctacgctggtgctcatattgtaatagacacagctgctgctcatgagaaaatattggcactgattgaggcaggtaacatagaaccatcagaactaattgcagatatggatgcccagatagcaaaagcaaaggaagaagcattgagtagaaa

SEQ ID NO: 6193 - DNA, 901 bp, Zea mays
  misc_feature (15)..(15): n is a, c, g, or t
  misc_feature (31)..(31): n is a, c, g, or t
  misc_feature (46)..(46): n is a, c, g, or t
cccagcgtccgcaanaatccagcacttgttngaaaccctggtgtcngaaaaccaccccgccggtcggggaccgtggtctgtcctttatgtatgatggtgtacctcttctagctatgttggatgagtatgttatgctcagacaagaaagggaagaagaaaagaaaagaatgcgggaacaaaagcgctacattgagcagcaactgaacaccgatcatgaagggccatttggatcgcgggtgagtccaaaccggcctgccagttcgaagaaggctgttggcgtaaaggtgaacggcagcgtctcaaacggcactcctccaaacagaaggctttcaatcagtggccaacagaacggtggtggccatggcgtcaggtctggagggaaggatagcaagaaagacacggctaagacagcatctccaggtaacaatgcagttgcagctgctcctgtgggtgcggcagcaacagccaaagaagacgcggtctcccaaatttctgtcaccgatccggttccgagcacaccatgatctttaacctagcatcgtatattagatataagcgactctttttctgatgttctgttgttttgtggtaatatcttataatgccttcgtagagtaattatgatgcctgcccatccttcagctgctttggcttcatggtgtaattcttgttttagttccgctcggccgtgctgtttcgacctgtcagacggtgtagtgtagtcttactgagatgtattgcattaatcagtgtgctggacatatagctgttgaaacgttttttgtgtgcacccctgtgagacagtgagagtagcgtacttttaatattatctggaaactggactccgcatttcattccgtaggtgcgcgggagggggggcggccgcgggcggggatgtttg

SEQ ID NO: 6194 - DNA, 2322 bp, Zea mays
actccggcccccgccgccgcccccgagaacaggagtgcagcactgctactgcctccactccagtcccaggctcccatctcagagctctcagcggtggcggccggcgaccggcgagctcctccggcatcggatcccctggagtggagcgttgaaccacgctgcgggcctgcattcaccacctccgtgctttccttcgtcttctccgcctcatctggttgctctggtcagtgatggccggtgacattacatgcggatccttgctgcaaaaattgcagtttatatgggatgaagttggagagagtgaggaggaccgtgacaaggtcctttatcagctggatcaggaatgccttgatgtctacaagaggaaagttgaccaagcaactaactctagggatctcctgatccaggcgctggatgactcaaagatagaacttgctaggcttctttctgctctcggagaaaaagctattgcaagaactcctgagaagacaacagggacaatcaagcagcagctagctgctatagcgccaacacttgagcagttgactaaacagaaaaatgaaagaaaaagagagtttgttaatgtacaatcacaaattgatcaaatatgtggtgaaatcgctggcaccatagaggtgggtgagcaaatgacaacaccccaagtcaatgaggatgacttaacacttgagaggcttgaagattttcggtctcagctcaaggatcttgaaaaagagaagagtaataggttggagaaggttcttgattatgtaggcatagtacatgatctttgtaccgtcttggggatggattttctcagcacagtgattgaagttcatcccagtttagatgactccatcggtgacaactgtaagagcattagtaatgatacattgtcaaaacttgacaatacggtagctacacttaatgaagataagaagttgcggctaagcaagcttcaagaactcgctggtcagctctatgatctttgggatctcatggatgcccccaaggaagaaaggcgcatgtttgatcatgtcacctgcaacagatcagcatctgtggatgaagtcacagcacctggatctcttgctctagatttgattgaacaagctgaggttgaggttcaaaggttagaccagctgaaatacagcaagatgaaagaaattgctttcaagaagcaaaccgagctggaagatatctacgctggtgctcatatagtaatagacacagctgctgctcatgagaaaatattggcgctgattgaggcaggtaacattgaaccgtcagaactaattgcggatatggatacccagatagcaaaagcaaaggaagaagcattgagtagaaaagacatccttgataaagtagaaagatggatgtctgcgtgtgaagaagagagctggcttgaagattataaccgggatgacaacaggtataactctagccgaggtgcccacctgaatctgaagcgtgcagaaaaagctcgtattcttgttaacaagattccagcacttgttgaaaccctggtgtcgaagaccacagcatgggaggagaaccgtggtctgtcctttatgtatgatggtgtacctcttctagctatgttggatgagtatgctatgctcagacaagaaagggaagaagaaaagaaaagaatgcgggaacaaaagcgctacattgagcagcaactgaacaccgatcatgaagggccatttggatcgcgggtgagtccaaaccggcctgccagttcgaagaaggctgttggcgtaaaggtgaacggcagcgtctcaaacggcactcctccaaacagaaggctctcaatcagtggccaacagaacggtggtggccatggcgtcaggtctggagggaaggatagcaagaaagacacggcgaagacagcatctccagggaacaatgcagttgcagctgctcctgtggacgcggtctcccaaatttctgtcaccgatccggttccgagcacaccatgatctttaacctagcatcgtatattagatataagcgactctttttctgatgttctgttgttttgtggtaatatcttataatgccttcgtagagtaattatgatgcctgcccatccttcagctgctttggcttcatggtgtaattcttgttttagttccgctcggccgtgctgtttcgacctgtcagacggtgtagtgtagtcttactgagatgtattgcattaatcagtgtgctggacatatagctgttgaaacgttttttgtgtgcacccgtgtgagagtagcgtacttttaacattatctcaaaaaaaaaaaaaaaatatcattctgtaggtacgct

SEQ ID NO: 6195 - DNA, 1587 bp, Zea mays
ccacgcgtccggttcttgattatgtatgcgtggtcgcgaccgaggtactgtcttggggatggattttctcagcacagtgactggagttcaccccactttagatgactctgttggcgacaactgtaagagcattagcgatgatacattgtcaaaacttgacaagacggtagctacacttaatgaagataagaagctgcgtctaagcaagcttcaagaactcgctggtcagctctatgatctttgggatctcatggatgcccccaaggaagaaaggcgtatgtttgatcatgtgacctgcaacagatcagcatctgtggatgaagtcacagcacctggatctcttgctctagatttaattgaacaagctgaggttgaggttcaaaggttagaccagctgaagtacagcaagatgaaagaaatagctttcaagaagcaaaatgagctggaagatatctacgctggtgctcatattgtaatagacacagctgctgctcatgagaaaatattggcactgattgaggcaggtaacatagaaccatcagaactaattgcagatatggatgcccagatagcaaaagcaaaggaagaagcattgagtagaaaagatatccttgataaagtagaaagatggatgtctgcgtgtgaagaagagagctggcttgaagattataaccgggatgacaacaggtataactctagccgaggtgcccacctgaatctgaagcgtgcagaaaaagctcgtatccttgttaacaagattccagcacttgttgaaactctagtggcaaagaccagggcatgggaggagaaccgtggtctgtcttttatgtatgatggtgtacctcttctagctatgttggatgagtatgttatgctcaggcaggaaagggaagaagagaagaaaagaacgcgggaacaaaagcgctacgttgagcagcaattgaacactgatcatgaagggccattcggatcgcgagtgagtccaaaccggcctgccagttcgaagaaggccattggcccaaagttgaatggcagcgtctcaaacggcactcctccaaacagaaggctctcaatcagtggccaacagaacggtggtggccatggcgtcaggtctggagggaaggatagcaagaaagacacggcgaagacagcatctcctgggaacagtgcagctgcaactgcacctgtgggtttgacagcaacagccaaagaagacgccgcctcccaaatttctgtcaccgatctggttccgagcacaccatgatctttaacctagcatcatatattagatataagtggacctttttctgttgttctattgttttctggtaatatattgtaatggcttcgtagagtaattatgatccccttcagctgctttggcacatcctggtgtaattcttgtttagttcccctaggcggtgctgtttcgacttgtcagacggtgtagtatagtcttactgagatgtattgtcattaatcagtgtgctggacgtataagctgttaaaaccttttctgttcccgtccttgagttttgcatctatgtgagcgtagcgtacttccaataaaaaaaaaaaaaaaactac

SEQ ID NO: 6196 - DNA, 1175 bp, Zea mays
aaggaacctatgtatgcttgctttgcagtatcgcattactattttccctttagtttttcggaaatcttaaatgaacttaatcctcggttgactagattcacatctgtatcctataattatgacctgattgctctatttctaaatattttcatgcgagttctttttttcatagttaaaaggaactaggtagcatttcattagaaataggcacccaaattcgcctggatggtctgggtatacatccacacccttgaccaactgagctagctcagcttcctttttttcgtagttaaattctgtaagattccaaagttatcttagggaaagccgtaaaagaacagaagttcaccatcttatgagtcagacctttgatgcagggtgttacacttggaggtacaggcaaggaacatggagataggcaccccaagattggtcagggagctctaattggagccagtgctactatcctcggcaatattaatgtaggcgaaggtgccatgattgctgctggctcccttgttttaaaggacgtacctccccacagtatggctgtaggtaatcctgcaaaggtagttggttatacagagaaagaagatccttctttaactatgaaacatgatgcaaggagagattattttgagcatgctgccatcagattgagatgattgatacacctaatgacgagtcttctttctattcgtctgtggaatactgtggagtaaaaaaagttccaaatcgccttattggcaagaagttttgtggagttaaaaaaaggtttcgtcgtcttactcgcaggaaaccttgtgaagttaaaaaaaaaatgtttgacgaaacgcatacggatgccattccggacatttcgtcacaggcacaaggctggatagtcgatgagctctgtgtttccctttctgcccagacaaccaaatgaagatggaaaagggtcacccagggctccaaaatctagagtgtagacaagcatgtccttaatgcgccttaaattggtctggatggcacttttttgtgataaactatctatctaaaccattgactaatgtctactctactctcaacaagatcaattaattgtatatttgatattaaagttggaatgtttagtatgacaaatttaatattttaaaatagatatgcatgaaatttgatcttgatctttttct

SEQ ID NO: 6197 - DNA, 1162 bp, Zea mays
  misc_feature (37)..(37): n is a, c, g, or t
ggtaccctttggtccggccgggctttccgcacttcanattcgctgccgattatgtgcgctacagaaagacacttccaacatgaatgaacgctttccagatgctacatcagaagagctcgatgtgagtgatgctacatgtattatttgccgtgaggagatgactacagcaaagaaactgctctgtgggcatctgttccatgtgcattgtctaaggtcgtggctagaacgccaacacacttgccccacgtgcagagctccaatcattcccgcagataatggacatgctgtatcagcacgacaacatggagcccaggctggggttcagcctgctgcaggtactgccactccatcctcagaaggagcaccaggtgagaacatgagcaggcaccaagcaaaacttgaagctgctgcagcggcagcttctttatatggaaggtcttttgtttatcctccagcaaacaccctaaaaaggtctgttcctcctcagcctgcatcaagtacaccacaatctgaagcaagtagctccaatcatcagtcacaaaaagaccaagaaatgcagtcccgaaacagcagcgatggtttagtgcctctgcctcttaatgcagatggtgctgttggttcaggaacaagcacaagggaccttgaaaattcacttcagaaggcacaagaaaactttattaagagccagattgagatgttacagatccaactgcaaatggtgcagcgtggcgctgctgggccgcccagtaacgagaatactgagcacacagaagaatgactgaatctgtgaacaggcacttctgcatcgtggtgtaataataaggagaatactgatgagcacacagctgaatctgtaaataggcggcgatgaggatgggacaaaagaaagccaaggattgacgatacctggggctgggggaaactgttacatgatgtcttgcctggatttttggcaggcctgttaatttatgcttcactattagtgccttgttgccagcaccagatgtttctctctctctgtgtgtgtgtggtggtttctgtacatgaaagccttttgacgggagaaccaaccatggctagtttaattatgaagttcacttgttgtacccgagggaaaatagaaatgactcttgtttttgcctatctaaaacccacgcgtccg

SEQ ID NO: 6198 - DNA, 1083 bp, Zea mays
  misc_feature (441)..(441): n is a, c, g, or t
accgattccgtgtgctgttcgctgtcgcctattgcgcttgcgctacttggtaactacagcgtcggccgccatcccccgcagcagccgttttctagctgcttcccgctggttcgcggccgccgtcctgggcgtctgagcgaggggtaaccctgcccttttgttcctgggctattcctcagctcgcgccgctgtcgcctcaccccccaatccaatcctccgcgatcgatcggcgggcgcggatggaggcgctgaagaagcaggccagcaagctccgcgagcacgtcgccaagcagcagcaggcggtcctcaagcagttcagtacgcggtatagtcaagatccttctcttgttgatgaagcggagcttgagtgccaccagaatctccaaaggctttacagtactacaagagcagctaagcatttccagcggaatattgtacganggggtggaaggtttcattgcagttagcaccaaacagatggagattgtgaaaaaactagccggggattggttgtaaatatggagacgacaatcagcattttggttttgctcttgcaagggcgtctgaggagttcggtaaatctcataaacaaatagagaaagagcgggaggatcttcttaaaattcttggagagcagatttttgagcctcccccgcgtccgataatgagtgctcctcttgaagatgctcgattgctaacttaccgttatcaacggatcagacaggacatggagtctcagatagctgatgtgatgagaaagcaacttaaatccaaggaaagtagtggtaacacagataactctgtgaaactgcaacatgcagaatcgaaattatcagatcttcgaactacactggcagcgttaggaagagaagcaactgcagctatggaggctgtagaggctcagcaacagcaagttacgtatgaacgtctccttgcaatggttgatgctgagaggacatatcatcaaaatgctgctgatattctgaataaactccatgatgagatgctctatgcaaagcatcataatgagtcagcaaaccactacgatgaacagtcttcagagcctgaatcagatgcatgccc

SEQ ID NO: 6199 - DNA, 2021 bp, Zea mays
gttttaagttctaaccgtcgcaaattgaccactgaccagtcaaaccccgggggcacccgcgaacccgcccttccgtccttaacgggtcaggtctttcaaacggcctcctcctaaccccacccagtgacccgacccgcagagaaaatccacggtcagcgaagggttcttctgaccgggcgaggctctcatggcggcggctgaccccgagacggcggcggcgctgcggggggaggtcgccgcgctgcggatgcgcgtacaggagctggaggcagagaatcagaggctggcaaggattgcttcgacctgtacctgcggattcaaggagggcagtgttggatccattactgcacatcataatgtgaaatttcatcaaaatagcactatggagaaagatttgagctctccatttgatcacacagtaatatccaatgcaaatgaaatgcagtgcaacagaaatgcagatgacaatggtttacctgaggattcaagcaagcatactaaaagaacaggtcgcaaggtgggcattttaagtcactgcccaaagcgactagttgctctcaaagtcatgtatttcggccagagattctatggtttttcttctgaaggtaacattgaaccaacagttgagtctgagatatttaaagcactggaaagagcaaaactgatggttgccaataggaaagaatcatgctactcgaggtgtggaagaactgacaaaggagtttctgctactggacaggtgatttctttatatctgcgatcgaacataaaggatgttgggggggacatgttagatgaaagatccgaaattgattatgtgaaggtattgaatagaattcttccaagagatatacgtgtactgggttggtgtcctgttccagcagattttcatgcaagattcacctgtttgagccgggaatataaatacttattttggaaaggggacctggatatattggaaatgcagaaagctgcatccaaattcattggagaacacgactttaggaatttttgtaagatggatgcagcaaatgtgagtaactacaggcggcacattacagaatttactatttctgcatgtgacagaaggtccaacaatgatgagctgtgttccatgacgatcaagggtagcgcttttctgtggcaccaagttcgctgcatggtagctgtgttatttctaataggtcaaggccttgagtcaccatccgtagttgattcactattggatattatgaaaacatctaggaaacctcaatataaaatggcgccagagcttccattgattttgcaatcttgtctatttgataaagccaactttatgtgttcagcagatgccagccggtctctgactgagcacttaaatgatgaatatcgtcaccatatgctccaagctgaaatatttcacatagcgtcatcctgtttaccttttccagaaccaaattcatcagaaacgcctcagaagaagaggaaccatattcctctcctgtcacgagagacagagccttcttacgaggagcgcatatcgaaagtcaaagcgaagctggctgataatctcaagtagagccaccgttttcaattgttacaccaatacttggaagagaacttatggaactgtagaaggtttcttccaaaagcctacatgaggcaatccctctttatgccggtcttcgccttcttaagcttggcaggtttatgatgtggtctttttttatggcaaaattggatctgttaacatgtggagatggaaataaccaggaaacatgagctgagcgtggattttaccattttgaggtgttagaaaagcgtgctgcctattttagctgttctagactagacattcagactaaaacatatggagccccacgtttcgggtattgtcatgttgtgcgtttccctttcaaaatagtgtaagagccttgtgttttttttttctttctgaatttgttgtaaaatagtctaggagctatgtaatgttgttgtcgcatgatggtgtaccaaaagtgtagtaaagcatcccttgc

SEQ ID NO: 6200 - DNA, 773 bp, Zea mays
ctccccattccagaggcactctctcggcctcgcctgctagttgcgcatgaaacagggtcgtgagcaaagctccatacagccccgctaagtcgtccgatggcatggagtcaccgaggattgaggtgacagcggagggcaaggcccagtaacttgaaaggtccccgcgaagtcccatcggtgaaggctgacgttgtgggaaggggcagggacatgctgttgttgcctttatgttatgtggcggcggcagcgtggaaccgcactaataatgtggaccggaacctctgttactgtggtttgtgctgtcgcgtgctaggtttatgctgaagtggattccttcactccacacaccgaactgtctgttgtacatcacgccggtggtctcgtctgtctgacttcgttacatggatcgtctagtagtaacggaatgcagtcccacgtgtggacatgtgtttattgtgaaaaatgatgggctttgcttgcttgtttcctctaccatttcccattttggcacttaacgtttgttcttctcttcgctaccttgttctcagctcaaatggtcccacgcagatgcatgtgtagggaggttgaaaatgatagaaatacgctcagatcaccttcgttcctgcttctcttgccgtttctgttggacccaaaaaaaaaaaatcgatgtcgtcccacgcagatgcatgcggaacccctggactgttggcggcgcccacgagtcggtgtcgtcggtaacccctaaattgcccagctcgccattattcaggcac

SEQ ID NO: 6201 - DNA, 1529 bp, Zea mays
tcagctacgtaggcccccccccccggtactacacagtttcatcacatagttgctggcggctggccggcctctttctctttctcgtttctgccccctctgcttgcccccctttcatctcaggcgtcgaagagagagagagagagagagaggagttgcaagttggtgagatggatctgttggagcggaatattaagacggagacggaggagacgcgcaaggaacaggagcgtaaggaggaggaggcggaggcggaggcggaggcgggggagaggaagacccaggagccgccgcagcaaggccagggcctcagcctctcactcgccaacggcagtggcaggtctggaatgttgccgatgtcgaacgtgtccgctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggcaacctcaggttgttgctgaacctagctcgatatgcaaacttcaggctgatctccccattgccaggaggcactctcttcagcgtttccttgagaaacgccgtgacagggtcgtgagcaaagctccatacagcaccgccaagtcgtccgatggcatggagtcaccgaggattgaggtgacagcggagggcaaggcccagtaacttgaaaggtccccgcggagtcccatcggtgaaggctgacgttgtgggaaggggcagggacgcgctgttgttgccttatgttatgtggcggcggcagcgtggaaccgcactaataatgtggaccggaacctctgttaccgtcgtttgtgctgtcgcgtgctaggtttatgctgaagtggattcctttactccgcacaccgaactgtgtctgttgtacatcacgccgtgacgccggtggtctcgtctgtctgacttcgttacatggatcgtctagtagtaacggaatgcagtaccacgtgtggacatgtgtttagtgtgaaagatgatggggctttgcttgcttgtttccaaaaaaaaaaaaaaaaaacgccccgaacgtttgttcttctcttcgctaccttgttctcagctcaaatggtcccacgcagatgcatgtgtagggaggttgaaaatgatagaaatacgctcagatcaccttcgttccttgcttctcttgccgtttctgttggaccaaaaataaaataaaatttcgatgtcgtcccacgcagatgcatgcggaacccctggactgttggcggcgcccacgagtcggtgtcgtcggtaaccactgaattgtccagctcgccattatatccagataagtctgtttggctgtccgcacaagccatattcaggcactcgtagtgcaattcacacttgttgctgctgcag

SEQ ID NO: 6202 - DNA, 918 bp, Zea mays
  misc_feature (862)..(862): n is a, c, g, or t
  misc_feature (864)..(864): n is a, c, g, or t
  misc_feature (899)..(900): n is a, c, g, or t
cattgggtccctcgaggccggccgggcagacagataccgaaccgagaccgagagtgcaagcccgggcccctccttccccttccaattccagtagtcccacgcacaaactttccccagctgcctgcgcccgcccaactaccccgcgcgcggcagccggcagcaggtcgtgccatggacgacgacgccacggtcggatcgcggcagcgccagcagcagccggcctcgccagcggcggctgattccagggccatgatggcggagctggacgcgccgctgcacgccctcgggttcgagatggaggagctctccccgtcgcggctcaccggccgcctccccatcactcccatctgctgccagccgttcaaggtgctgcacggcggcgtgtcggcgctggtggcggaggcgctggcgagcatgggcgcgcacatggcgtcggggtaccgccgcgtcgccggcgtgcagctcagcatcaaccacttccgcagcgccgccctcggcgacaccgtcctcgcgcaggccgtccccgtccacgtcggacgctccacacaggtttgggaggtgaagctctggaagatggatccgtccacgggagcgaagggacctcagatcgccgaatccagagtcacgctgctgtctaacctgccgttgccggaggagcacaagagggcaggagacgctctgaagaaatattcatcaaaactgtagagaagaaacttcatgctcatgaaagcccttgcatcttgcaggtttcacggatctgatggatgttgtaattaaaaagcattgcctataataaatatttcttatttaccaccaaaaaaaaataaaaaccagcgccatgtgtcccgttgagccttcatcncnctaaacaaacaaagaaacagaagacctttcctgtnntgaaatacgtcaggagca

SEQ ID NO: 6203 - DNA, 889 bp, Zea mays
cattgggacctcgagccggcgcattggccaccccgaggccggcggctgatcggccagatagataccgaaccgagaccgagagtgcaaaccttccttccaccttccaattccagtagtcccacgcacaaactttccccagctgcctgcgcccgcccaactaccccgcgcgcggcagccggcagcaggtcgtgccatggacgacgacgccacggtcggatcgcggcagcgccagcagcagccggcctcgccagcggcggctgattccagggccatgatggcggagctggacgcgccgctgcacgccctcgggttcgagatggaggagctctccccgtcgcggctcaccggccgcctccccatcactcccatctgctgccagccgttcaaggtgctgcacggcggcgtgtcggcgctggtggcggaggcgctggcgagcatgggcgcgcacatggcgtcggggtaccgccgcgtcgccggcgtgcagctcagcatcaaccacttccgcagcgccgccctcggcgacaccgtcctcgcgcaggccgtccccgtccacgtcggacgctccacacaggtttgggaggtgaagctctggaagatggatccgtccacgggagcgaagggacctcagatcgccgaatccagagtcacgctgctgtctaacctgccgttgccggaggagcacaagagggcaggagacgctctgaagaaatattcatcaaaactgtagagaagaaacttcatgctcatgaaagcccttgcatcttgcaggtttcacggatctgatggatgttgtaattaaaaagcattgcctataataaatatttcttattttaccaccagtttcttctgtacgcctgtaccatgtgtcccgttgagccttcatcacact

SEQ ID NO: 6204 - DNA, 625 bp, Zea mays
gtacccccgattcttgccgggagggtccccacccgtccggttcaccacagcaacatgaagaaaaggagccagatcagagaagaagtggtggcgatgccgccgagggcagtgccgtcgtcgtctcccttgcctcttgcactcgccgccgtcgccatagtcgtcgtagcacttgccgtttcctcctgttccgcgaccaccgatgctccaggcctgggagtgggagcgagagagatggtggcacgggacgaccccaagtgcgaggagatggtgccctgcaccttcaggcgctgcatccagtactgcgtcagcatcgggctgcagcccaaggggttctgcaactccaagcccaacatgcaggtctactgctgctgcgtcatcccctagcatcatagctcctcgtcaacacacctaaatctgcagccctgctagagaagatacgatctctatgcagattagctgcagcgatatatatagatggatgaatcgtgcaagcggttgaactatggtgctggaatctgtaatatatataagcggatcatccaaagtgcaaaacatatagtttttgcattgccaaaaaaaaaaaattaaaaaaaaaaaatattaaataataaaaataaaataaaaa

SEQ ID NO: 6205 - DNA, 3875 bp, Zea mays
tgacattagcgtgccgacaagtagctagaagaaagacatgctccgataatggatatatgattttctttgtatatatactctttctaacaagctttgataataaaaatctattgagatttttatcaatcatgattgccttttgaacaagttctacttcagctattcaatctcactaaacaaatactttgttgagacatttttgtgtaaacacatgggccacacatccgtccccaagcctcggcggcgcgttcgaaatatttttgctcgtcaggacgggagtcggttgcgtacacgcacgtttcctcagtttttttggccggccgtgcatgatccgaaatgaggggccgggaagtgaccaccgtggcgcccgcgccgtcgcacatgggacaaggcaccggaagcagatcagcgcgaggacgtggcgcgcgacccccttgccaggccccagcgctgcgcccgtggcccgccaccccgtttcgctccaccatcacccaaaatctaggagacccacgctaggccctaccgggccggtctgtgtctgtccgtcccagtacggtccagcaacccgaagcgtttcgttggtccaccttggttcattactaatcgcactacgccactaccgatggccgaccaggatttagatatttgagcgacgactggtccgctgacacgtagccaaaagcgaagcgtttaacggaggcgagctagatattttcgccccgtctgtcagccagcacctgcttcgctgggccccgacccgctcagctgttgcttgtcagttgcccgtgacaggtactagccagcgggcggccgagatcgcgcgggcggctggcccgagcgcgcccaaccgtccctttggctctgtctcctccggccccaccctcttctcttctgtccgctccgccgagcgtgccggcatgcccccaaccccacccactgagcaaagcggaaaaaagcgaggaaaaatatcctgctcggctgctccaacgaagcaccggaggccgcaacagagaagagcggacgccaccgccgccaatcaatagattaggcgcggataatggtgctggccggaccgcgacgggcggaggagggcgccgcggcccccgcgcgccgccgctgacagagtatacctgcttaaccagccgtctgcaggcacggcgcacgcgcggtggtacctcgcgaggggctcgggttgactgggcgctactcgcggccgcggggatggaggaggaggcgcctgcagatccaccgaccgcttcgtccttcgcctgcgtctctggttccgggcgctgctgaatccgacgcttcggttcgcgtccccagtccccttggcggaggcgtggatcgtgtgtttggggggtctgggtatggtgggcggaggcgagggggatcgcgtgggcggcggcgtaggggttgggggaggccagcagttcgtggaccggagcaaggtgaggattcttctctgcgacggcgacgccagcagctcccgggaggtgctgcggctcctctgcaactgctcgtaccatggttagtattagtcaacctttgtaccccggtacttgctttctctaatcgttgggatttaccggattaggactgcgtttacttctcgctgtgggcttaatcattagaagtactaccaatccgttcgcttctaatgataggaatctgttgggcgtcatgtgtgcttaatgtttctttttctctcgaaagatatttgtacttactgttgtgctgttgtgacggtgaactttttttttcagtaacttgcgccaagtctccgcggcaggtgatcaatattctcaactacgagggcggcgagatcgacatcatcctggctgaggttgatctgccggtctccaagtgcttcaagatgctcaagtacattgccaggaacaaggacctgcgccacatccccatcatcagtaggcagccttcctattctgcgccttgtgcggttgtgcctattactgtgatgtgctttctgtgacccgtcctccctatcttatggaactgtgcagtgatgtccaacagagacgaggtgtctgttgttgtcaagtgcttgaggcttggtgcggccgagtacctggtgaagccgctgcgcacgaatgagctgctgaacctttggacccatgtgtggcggcggagacggatggtaaagggcactatgctgattcacctcaacctctgcgttagagaagcatgctcagctgagatgcttgtaggagttgctgtacctgcatgaattattctttaaatcgagtgctggtgttggcagcttggtttgcccgagaaaaacttcttcaatgacaacttcgagttggtgctctcagaacctagtgatgcaaataccaatagcgccaccctcctctcagatgagacagacgacaggcctaaagaaaacacaaatcaagaaacgggcacctcaaatcagcttgaatacgaggtaatgaacccaagactcatttagaagtttgttgcagcacttttttgttgttgctgttttagtatattttcatttctgttctttgatgttgccacacagatctgcccttttgtctctatgttgtatgttgatgacatgctaacaatatacttgtttaaacgcccttccatttcttggcgtatttcagtctaatccttccgttgctgagcgcgaccagagagacaagatcggtgctccaggctctgccctaaatgccagtcaatcacggtcgatcttgcagcctgtttcagcctgtaataactggtcttcctttttgttgttaaccacttcttgagttctatatctccatctgttttctgataattattttaattgccagcgactccgggaagaatgttttcacgtcctataaaaactaacctgaaggttgctgagtcgtctgcatttctagcatatgttaagtcaagcaccccagccaccagctcatttgatagcggactacaaagaggtgacagccggttagattctttggataaccatggtaattgctctagtgcaacagatagaagtgacaccggtgctgatgtaaatattcggaataaagaagcttttgagatgcctgtgcagtatcctatggtatgcttttcttcctctagcatgcatatggagcgaagcaatgaaggccataatgacacttcaggaactccacctgcataccatttcccattttattatccagggatggtagaacacaacatggcactttcatcagtgcaaaattttcaagcaaacataaacagtgctcaagcacatacaccaccagcgatgcttcatcagtacaatgttttctcccaatgccatagtttacccatgatatcaccatttcagtttaatacttctggcatgagtatgcactcaagtcatttaccgacgcaaaatgtgtggtcatcggcatcgagcacaccaacgcctgacgaaacatgcaatcgctccgagagaagggctgcagcacttgctaaattcaggcagaaaaggaaagagcgctgttttgacaagaaggtgaggtatgtgaacaggaagaaacttgctgagacgaggctaagggtgcgaggtcaatttgttaggcatgcaagcaatatggatatcataagcactggagatgatatatctgaagacgaagatgacgatccaacctccagggaggtagatatgatttcttctccagagtagtggagaggtcctcttgtgtgaaaaattagagtgcagatggttactgctcactttgttacaactcagtaggactagacaatacattcttctactggcaacaaggcaatacaccctttttgctcacacacagtataaacttttgtccccaaatatctggctgttactccggttgctttaatcgagaaatcatctttttgat

SEQ ID NO: 6206 - DNA, 2244 bp, Zea mays
gcacgagaccattacctagaacatcctaatctcaacgcaaacccaactgtcttggttgcgcaagcaccaagcaggtggaagatgatggaggtggcgggggctcaggcccgcgcggttcccctcctgctccgcaacaccgcctccctgcggacctccgtctccgtctcctgcacgggctcccgccggagctgggtggcggcggccacggcggagggggacgagacccgcggcttcgacaaggtgcccatggacacccccggcgcgtaccgcctggtagaccgggacaccggccgcagcgtcatcgtgtggggcggcaccgacgacagcgacgaggcctccatgccgtccccggcggtgctctcccggaccaccgaccgccgccacagccaaggtgttgggggaggtacaggtatcgggaatttcggcaggttcaaggcacagaaaataaaatccttggtcacgaggtcagctcaccgcaagagggagagttctaatcgctcaagcactgcctggtctgatgaatcttctttcaatggctctgatgatgaagaggaaagctattttgagagaagaaagcatgtctcagactctgaacgccacccgaagatgagcagtggctccagagatggaagaactcgaagtgcacattctctgagttctgttttgagccaatacagaggcgatgatgatacagacttccctggttcagaggctacttctggttccaaacgatggggtaatgttgccgatgttacttatggacggcagaatcagaagcaaagggagcctctgaatttccctcaaagaaaagggcctctggacggcggatttttcagtcgcagatctttcaaggagattggctgcagcgatgaaatgctaggtgcgttgagaaattttgatttccctcgtccgtctcatatccaggctatggcatatgggcctatcttagaggggaggagttgtgttgttgctgatcaaagtgggtctggcaagacactggcatatctttgccctataatacaaaacttaaggaacgaagaagttcaagggctccataaatcatcccctaggaaccccagggtgatagtattgacccctactgctgaacttgcttctcaggtccttaacaactgccggttgatatcaaaatctggggttccatttaggtctatggttgcaaccggaggatttcgacaaaagactcagttagagagccttgaccaagagctcgatgtaattatagcaacacctggccgtttcttgtatctgcttcaagaaggctttgtgcaactagctaacctcagatgtgttgtgttggatgaagtggacattttatttggtgaagaaggtttcgagcaagtgcttcatcagttgatcaccgtggcaccagtgacaacgcagtatcttttcgtgactgccactcttcctcttgacatctataacaaggtcgttgaaacctttcctgactgtgaggtgatcatgggacccggtgtccaccgaacaagctctcgccttgaagagatccttgtggactgcagcggagatgacaacgaagaaaagaatccagaaaccgccttttcgaacaagaaaacagcgcttttgaagattatcgaggagtctcctgtccgcaaaacaattgttttctgcaacaagattgagacatgtagaaaagttgagaatgcgctgaggcgggtggacaggaaggcctcgcagatcaaagttctccccttccatgctgcgctggatcaggcccagcgcatcgcaaacatcaaggagttcctgaacaagcaaacggctgactccatgttccttgtgtgcacagatagggcgtcgcggggcatcgactttgcgaacgtgaaccacgtggtgctcttcgactacccccgcgacccgagcgagtacgtgcggcgcgtcgggcggactgcccgcggcgcgtccggcaacggcaaggcgttcgtgttcgcggtgggcaagcaggtgtccctggccaggagggtgatggagaggaacatgaaggggcacccgctgcacgacgtgccgtgcgtctagagaccctggagggggaggtgtctgatgcgtgcaattgctgcctaaactctaagcatgttttttgtttcggaacgttgtgggtcatctatcctatccctcgcttgactcttctcggaaaaggttctcgttcccatgaatcttgatctgcctcctggtattgatagcgattgatcgaaaaaaaaaaaaaaaatgaga

SEQ ID NO: 6207 - DNA, 1632 bp, Zea mays
cattgggtacctcgaggccggccgggtcgggtgctggtggttgggcagtaggcaaaggcaaggccgtacgcggaagaccccccggcagcctgcccagcgcaagaaaaaggcagaacccagccgcggcgccctcttcgcagtcccaactcccaaccgagaggtgaaagcatccgtcccgtcccagtttcgccgccgaccctgcaaagcagaaggctctttgcgcgtcctcccctctttcctcccggactcgccggcgttcctgtctgttgctgccggtgggcggtggtggttggagatgacacatgtgtttccaagggaaggtgcctcatctagctcaacctcaatgagcagccagaggagtgaaactgatgatgataggatgattgcaatggttctctctgaagaatatgccaagttagatggtgctatggccaagcgtcttactaatttaacatcaattccccttgttccccggattaatacatacttcccgacatatagtgatgctactatggaccattatcgcctccttgacaggttaaatgcatacggcttgtttgaggtgagagtgtctggtgatggaaattgtcagtttcgtgcactctcagaccaactatatagatcacccgattatcacaagaatgttcgaaaggagattgtaaaacagctcaaggaatgtaactccttatatgaaggttacgttccaatgaaatataaacattattgcaagaaaatgaagaagtatggtgaatggggtgaccatgtcacgctacaagcagctgctgacaagtttgctgcaaagatatgtcttctaacatcattcagagatacctgttttgttgaaattgttccacaatatcaagctccacagagagagatttggctgagtttctggtccgaagttcactataactcactgtacgatgctcgagatctccctagcaaatacaagcctagaaagaagcattggttgttgttttgatatccacgcgggggtttgcttcttaatggtggaatcatattgcttgaccgcttcgaccaccggccgctggtggcagcctggtcatagctcattgtggctctatccactatatagctatgcatcaatgatccattgtattgctcggtacaactccatcacgatccaggcatacaacactagatacagttacaatgccgaacctgagccttgtgaatagatactcctttactgacatacaggttgattgtataccatgtcctatttgttcattgttatattctttatttatacagttacatattattaatcttcatcagttcattattcagttcatatttggaagaattcatcatcgcgttcttggcccaaatgttcattgccttttgctgacacgtgaatctgtttatcgtatttcatgcctggattggatgtacagcagttgtggtacagcctgccaagtggtggaagccctgagtgactgattctaatgctttagagcatctccaagagactttttattttttactctctatttgactatttatttgtctctccataaatattaaactctatatataacatcttattccaacagactctccaaaatgcaatttagcttggctaacgagagttgctagccaaatttggcc

SEQ ID NO: 6208 - DNA, 1242 bp, Zea mays
ggcggcagcctgcccagcgcaagaaaatagccgcaacccaaccgatcgtgcggaagcaatcaaagctagccgcggcgcgtgaaagcgtcccgtccccgtttcgctggccatccccgcaaagcagaaggtgttgctttgcgcgtcctcccaatccgtggctagcggtcccctgtttcctgccgagctcgccggcgttccccttcctccgctgctgccagtggtggttggagatgacacatatgtttccaagggaaggtgcctcatctagctcaacctcaatgagcagccagaggagtgaaactcatgatgataggatgattgcaatggttctctccgaagaatatgccaagttagatggtgctatggccaagcgtcttactaatttaacatcaattcctcatgttccccgtattaacacatactttccaacatatagtgatgccactatggaccattatcgcctccttgataggctaaatgcatacggcttgtttgaggtgagagtatctggtgatggaaattgtcagtttcgtgcactctcagaccaactatatagatcacctgattatcacaagcatgttcgaaaggagattgtaaagcagctcaagaaatgtaacaccttatatgaaggttatgttccaatgaaatataaaaaatattgcaagaaaatgaagaagtctggtgaatggggtgaccatgtcacgctacaagcagctgctgacaagtttgctgcaaagatatgtctcctaacatcattcagagatacatgttttgttgaaattgttccgcaatatcaagctccacagagagagatttggctgagtttctggtccgaagttcactataactcactgtacgatgctcgagatctcccaagcaaatacaagcctaggaagaagcactggttgttgttttaatatccatgcggggagtttgcttcatactggtggattcatattgtttgaccctttctaccaccgtccgccaaatgatgcaccgtacagctacagcatgatccaggcatacagcagtaggtgtagagttacaatgctgaacctgagcaatgtgaatagatattcttaatacaggttgactgtaatgccctgtcttatttgttcactgtgtatattctttatttatactgctacatgttagctctattcatcagttcattgttcccttcgtttttggaagaatccaaaaaaaaaaaaaaaaaccaaatgtccattgccttttgctgac

SEQ ID NO: 6209 - DNA, 1231 bp, Zea mays
caggggccacctcgagggactatctcgtgttcttaccttctctcctctcttctcaccagcggagagaaagcaaaccctagtccccgtcgtcgccgccggcaacccttcggatctgcggcgagcgccacagcggttagatcgaatccacccagggggagattgaagcccctttgtctgggaatttcgcggggaagcaagcggttggtgatttggtggtgaaggaggctatggggtcgtcgtcgaaggtggtgcggccggaggaggtgctggagtcgctgaagaacgacggcagcatcgacgcgctccgcatgaagatcatcgcccagctcaaggccaacgaagatatgaagaaaaacactatgatgatggtggagcaaagcaaggtactgaatactcctggagctgagaaaaagacaaagagggagttgtttgatgcacttcgacaggaactggagaccccagtccttgaaaaagcctccaaggcagtttgggagctgattctagacaatggtgggttagggaaagagataactgaaacggttgagaaagtcttctgccggctcagtggaatcgacatgatgccacctctgccttcgggcgctggtgctcatcaagagaaagatgacatggccttcgatgaaaaagttgtgaagagcaagggggtggatgcctttgaaccatcctcatcaaggaagagacccttcagcgacgtcaaccgaaaaggtgcaggtgctttacctaatggcagtgctacagaccagcatgatgagtccgaggatagtgaccagaagatgtgatgctctgctctctgctctaatttttagctcaggctgaagtagctttgctgcttgaatgataacaagtcaattgtgatccctgcatattctatggttgtatggtatattggcaagttagactttttctgtttatacaagttctgtgaccaactgctataggatatttgagttttcaaatctgctgctgtgagtttcttcttaatataggataaatttgttgactattactcttgacagttttgtggtatgtttaacttgtaatcattcaagagtgttgtaatcatcaagagttataagttagatgcttcttaatcttccagtattctattctttttctcgagggagttcattagcaattttctaatggttgcttggtcagtgggggttggtaatcacttatttgtcttgtttagtttttgttccaaaaaaaaggt

SEQ ID NO: 6210 - DNA, 1930 bp, Zea mays
  misc_feature (27)..(27): n is a, c, g, or t
cgtctggccttagtgtttagacagctnggcccacgctgcaggttgaggttcccttcactgccttggttgccaaggaaagatgaccgggccggttccctccgcttctgtctctcgtctctccctcggcctcatgcgaattaccactagatatacgccggtcgcccaatccaaccgcctttaactcccctcatctctatctataaaacacccccgccccgccccgcccgcccgccacccctcctgtatcctcccaattcacgacaacccaaacaaacaacccccctacacacacacacggaggcccggtccgggtggccgtttcgattcgatgcttgtggccgcccatcagcgaacgagtcgcagccggatcccgactcacccgagggcgctcggccgcctctgaagccggaaggagcgcgcgcgtcggacatgggggagctcgcggcggcttcctcgcccccgccgcccgccgtgctgcaggtggtcttcgtcgacggcgagcagagcgtggacctgggcacggtcgccgtgcagccgtcgctgagcggtgtgaagcggctgcaggccgtggtggcggaccgcgtgggcgtcgcgccgtaccagatctcggcgtccctggcgcggccccgccgcgcgcgccgcgtgcccctcgacgacgccaccgacctcgccgccgccgtcgcgcgggagggcagcgagtgctacgtcgtcgctgggctccgccgctcccgccgcgagcgacggggcggccggtcccgtcgcgacaggaagggagccaaggacgcgggcgcgccagcggagaagaccatcctgaagcgcctcccgccaacggatctggcgtccctggtcggcactccccctccgccgcttcccttcccccacgccgttgccgcggccccgccgctcgcgctcgacgggtggggctacgacgactacgaggcccggctgcgggagctgcagcttcagcgcgattggtacatgttgagcaccgcgggagtgggagcgggtccggacccagcctacctccatctggcggctggcgggcacccggagcacgaggatccggcggcgccgtggtccccggggcggcgcccgtctccgtgcccagagtgcgaggcggcggcggcggccatgcgccagccggcgttccactggtgcgtgcacgacgcggtggtctccgctgtgttccgctcccacgtgggtcccatcgagcgccctccgaagaagaccccctctccgcctccgcttctgcctctgccgccgagccctggtcgcctcctcggcatgcccgtctacgagttcatcgaccagcacctgctcttccgtcgtcgtcgcctgccccactctagcagcaactgtacgtagacaaaaacaagcgggactgctggagtggatgggattggggatgaattgtggatggacggaggttgcgtgtgggagttggtttgcgcagcgcgaggaggtagaggattttcgtttcgatagtagctagtcaccgcagcagtcgtttctcctccttggtgtgcaaggaagccatgacgtggtacctggacggacacgcttgctcgctcttgtctcggtccggcacgcggcagggcttcttcgcctggttcaccgtggcactgtagcagtagaaaaccaaatttccccccttcctttttttcctttttctttcctgtggcctgtgggttgtggtgcactggtgcgtgcctgaacaatgtggcatgggcgagtccatggcttgattcgtttcggccatatttgtggactcctcttttgtttttccttttttctgagagagaagagagagagatttgtttctgttatatcgaagtggtatatgcagaaggcttctattgtagccttgtgagtgtaactgttcgtctcgtgtcatccatcctgtgcttttccttaaaaaaaacacacacac

SEQ ID NO: 6211 - DNA, 1190 bp, Zea mays
tggaagttttcatggattttgacccagtattggtttcaaagttaagtgagaagaagatcattgcgcctggatgtcctagctgctccttgctatccgaactgaaactgcgcggcgtcattgtaaaacgcccgccaaatactcatgatcatagaggaatttggatcgtttgacaaatactgttggagcttcgtgaatcacaaacctatattgagccggttcaggtactcccgtcaagtgcctgtcaaaacatcgaaagcagacgccataagcaaagacctggtccgaaggggtttccgcagcgtcggcccaacggtcgtttataccttcatgcaagtctctggcatgactaacgaccaccttatctcctgctaccgttttgctgaatgcgtggcctcctctgctggtgccgctaaacttaccgatggaagcctagcagatgcaagtgatagcaaccatgccacggcggagcagaaggtgaacgggacgaatgacattgaactgtccagggctatagacgagctcagcatttcatagcggttaggagggggtgctgaagcgagacggtgttagcttgtgtattttgtgtgctgtagtggagggtgtgatttggtgtcttttttctatagtttttaccactcgtcgatgtagggtagaacaatctttagtctttggcttgccaggaccattgagcgacagcagtgtaatgatgtatattctttgtgatgcgagtgcacctgttttcctgcattgcagttaagctggcttttcgccagtgtcgtcaaaaaaaaccctcttttccgcatctgagaagtgtcgttgcgtatgttaaacttgtattgcaggaacatgaagttccgtatgcttttgttccctattccctcatgtgcttaatatctgcactcgtgcgagtacaaacctgtcgttccttaaaaaaaccagtcgtgagcaggaaaaaggtttcggaatcaaatggtatggttgaaacaacaactaacaggaatagttcgaacagcaagttcagaattcagagatgctgtgacccaaaaggggtagttattatcgtcgtgaaggcatgtgaggggatgtggtggtggttcagatagggtaacgtatccaaatgaatagctggaatagcaaagtcagggtatatctggaaagctgagtgccgcggcattttggttgtaaagcca

SEQ ID NO: 6212 - DNA, 2078 bp, Zea mays
ctctctacttctctaccttgcctagcaaaaatctactgccgaccaccaccgcggcaggcacacggagcaccctccactccaccgaccaataccagcggcagtaaattccgaggccgagcagccgctgccgagcctcgaggctcccttctcgcttccctcacccgcctactcctcctagggtttcctcccgcctcgctggcgtgccgcctcccctcgccattgccgcggggcgttccgccgctcgtgggacccgcatcgagactcgagagctgttcgtgctgattcccgcggagccttgtggctgcgactctgcggcgtcgggtggggtggggaggttttgacgcccgtggggtttggatcgagggcccggagctgtgtctccgcaatgccgggctggtctggcggcgattgctagggttttctggtcggatttcggtggaagagctgaggttttgcttcgagtgcgggagctgcctgcaacccccccgcttgccttggcccgagctcggtgtttccgcagcaatgcctagccgattttagctcgctctggggttccgaagggcgaaggggctgtcgggcggttcgagattgcaaggagtcggtggctcggcccaatgtccggggcaagcgcgagggggcggctgtcgccagcgtccggcggcgccggggactccgaacctcggtccgcggggggcaggacgcgctcggtgtccgctacccgcggccggaagccctcgccgaggcccgggagggatgccgcggcggcggcaggggcgacagaggagaagaaacccgccgccgtgcccacattgctgccctcgcttagcgcgcccgcggggatgcgtcggcaggagctgctgctgcgctcgggtctgtcgccccgcccgtcctgctcctcggacgcgtccacggactcgttctgcagccgagcatccacaggccggattgggaggccggcgtttggggctaggaagaagaagaccctctctcagactgattacaagcctgtttccatgctggaaagggagggcggattggcttatcagaccgatgctgctggtgtcaagaggaggtgcgcatgggtgacagcaaatactgatccttgttattctgcatttcacgatgaagagtggggagttcctgttcacgatgacaggaagttatttgagctgctagtactgtcaggggcattagctgaactgacatggccagcaattctgaataagagagacatattcagggaagttttcatggattttgacccagtatcggtctcaaaattaagtgagaagaagattatcgcacctggaagccctagcagttccttgttatccgaacagaaactgcgcggtgttattgaaaacgcacgccaaatactcaagatcatagaggaatttggatcgtttgataaatactgttggagcttcgtgaatcacaaacctatattgagccggttcaggtactcccgtcaagtgcctgtcaaaacatcgaaagcagatgccataagcaaagacttggttcgaaggggtttccgcagtgtcggcccaacagtcgtatataccttcatgcaagtctctggcatgactaacgaccaccttatctcctgctaccgttttgctgaatgcgcggcctcctctgctggcgctgctaaactttctgatggaagcctagcaaattcaagtgatagcagccatggcacggcagagcagaagatgaacgggacgaatgggctggattcaggtcttgaactctccaggactatcgatgagctcagcatttcatagcggggtaggagcggtgctgaagcgatatggtgttagtttgtgtattttatgtgctgtagtataggtgtgattcggcgacctttttctgtagtttttccactcgtcaatgtaggctagaaaaatttttagtcttcggtgtgtcaggacccttgaacgacagcagggtaccgatgtactaccttcgtccggagataattgtctatctcgtattttgaggtgcttccttcgtcccgagataattgtttatctcgtattctgagaagttaaatattttaaatttcgactattttattt

SEQ ID NO: 6213 - DNA, 834 bp, Zea mays
  misc_feature (7)..(7): n is a, c, g, or t
ccctcgnggttcggcccattgggtacctcgaggccggccggcagcttcagagttcctgactcctcgttcgttctgcgtttcgcgactgagatagccaaccctgcgactgcgtgcgtgcgggcgagcgagcaggcagaatggagcgccacgcccagaagcaggcgccgctagtcctcgcgctgtcctgcctcctcctcctcgcccccgccctcgtctccgccgtccccactccaagaagcctgcgcctggggggccagcagcagcacccgccggctctgaagctcacttcttctcagcaggaggcggcgatcgcggcggcgatgaacatgggcaggccgacggcgagggtggccgtggaggtgaacgactaccaaccgtccggccccaacaaccgccacgacccacccaagggcccctgaagagcttgttgaacggcgctcggctggacgtggacgacccaataatgcttctccttcgttgttgtcatctttaccagcagtatatatagagtgctttgctagtgctcttgtattctaccccaccagtagagattaaggatttaaggtagacacaaagttacctagttatatttgtacactggccgataggaacttggaagcacatcggtagtttgtgttgttcttaggttgccgttcgtcagaactgcatgcagatcgatttcatctcctgctgcagctgcaggtgtcgatacagcacctgcagcagatcgagattgttcagcttaattattctgttcctccaaaaaaaaaaaaaaaaaaacctccagttccagacctgaagaaactccgaccggccggtgggcggtggcggcag

SEQ ID NO: 6214 - DNA, 791 bp, Zea mays
gccggccgggtcgggagcttcagagttcctgactcctcgttcgttctgcgtttcgccactgagatagccaaccctgcgactgcgtgcgtgcgggcgagcgagcgagcgagcaggcagaatggagcgccacgcccagaaccagaagcaggcgccgctagtcctcgcgctgtcctgcctcctcctcctcgcccccctcgtctccgccgtccccactccaagaagcctgcgcctggggggccagcagcagcacccgccggctctgaagctcacttcttctcaggaggcggcgatcgcggcggcgatgaacatgggcaggccgacggcgagggtggccgtggaggtgaacgactaccaaccgtccggccccaacaaccgccacgacccacccaagggcccctgaagagcttgttgaacggcgctcggctggacgtggacgacccaataatgcttctccttcgttgttgtcatctttaccagcagtatatatagagtgctttgctagtgctcttgtattctaccccaccagtagagattaaggatttaaggtagacacaaagttacctagttatatttgtacactggccgataggaacttggaagcacatcggtagtttgtgttgttcttaggttgccgttcgtcagaactgcatgcagatcgatttcatctcctgctgcagctgcaggtgtcgatacagcacctgcagcagatcgagattgttcagcttaattattctgttcctccgatcttgtcactgatgacacataaaaaaaaaaaaaaaaaaaaaaaaaaa

SEQ ID NO: 6215 - DNA, 916 bp, Zea mays
  misc_feature (8)..(8): n is a, c, g, or t
gaacaacnactggctaccacctccatgggcacttgctgcaatggctatccttggattcaacgagttcatgacattactgaggaacccactttacctgtttgccatatttgtgatgtttctcattggaaaagccatttgggtgcaatcagaattcggcagggaattccaacacggatttcttcctgccatcctttcactgtcgacgaagtttgtgcccactgtaatgaacatcctgaagagattagccgacgagggccaagcacctgcagccgccccagagaggcagagagagatggagctccaaccaaaacccaccaggaacggttcttcatacaccaatgcgacgtcggcggggtcatccagcgtaaccacttcggagatcggacctgagtattcgagcccggtggcgcaatgatttagctgatctttagcctttggctggaagcccactctagcgcagttgagggaaacagggtgcctctcgagaacataggaagattttaaggacagtcaggtgccttgcagtttttctaagcctgcccttcccccaaactgatgcaaggtggtgatggggtggcactgcccatcactattatttaaggatttttgggggctggggggttgtttgtaagagcattgtagaatgatttcgtttaatttttttggtttctgtaacatgaatacatgatatgtgatggttgtatagaagatctggggggcgtagtagtgcccattctacacagcttatactgggcagggggttgcgtagttgccagaagcttgtacatgtctttaaaccgccatcggattgcgatggagtagtattactggtgttctgcaaacacacccctcccctcccccaatctcggactcgcacggggcgtctccaactaacgccactaatcaaaaacatgcg

SEQ ID NO: 6216 - DNA, 2900 bp, Zea mays
ccaaaaccccctgcccataaagaaactccacttagcgaatttttcgatgtacaagttgtggcactgtccagttatgaagaaaaagaagagttgttcaaacagcaggtttctgatttaagagataggtttcagtattctatcgctcctggtggacttgctggggatcgtcgtggtgtcgtcccagcttcaggattctcgtttagttcccagcaattttggaaagtcattaaggagaacaaagaccttgatctgcctgctcataaagttatggtggctactgtacgttgtgaggaaattggtaatgagaaagtcggcagttttacatctgatgaggaatggcaacaattagaggaggctgttcaacatgactttgttcctggatttgggaagaagatcagcagccttcttgatagatgtttatcagagtatgacatggaggctatttattttgatgaaggtgtcagaagctctaaacggcaacagcttgagtctaaactcctacagcttgtcaatcctgcctatcaatctcttctaggtcacttgcgtactagaactttagaagcatttaatgagtcctttgacaaggctctagaaaaggagggatttgctgcagccgctcgcaattgtactcaaactttcttggagaagtttgataaaggatctgaagatgctgctattcaacaagtgaattgggacacctcaaaagtgaaggataagcttagacgtgacattgaggctcatgtagcttcagttcgagctgctaaattatctgaactttgtgccaaatatgaggcacaacttaccaaagctctggcggaaccagttgaatctcttctagattcagccagtgaagatacgtggccagctattagaaagcttcttcaacgcgagacaaaaactgccgtttcaggtcttcaatctgctgtgtcagcttttgaacttgatgaagcaactgagaaagaactgcttgtgaagctggagaagcatggaaggagtgttgttgagtcaaaggcaaaagaagaagctggaagggttttgattcgcatgaaggacaggttttcaatgctgttcagccgagatgctgactctatgcccagggtgtggacaggaaaggaggacataaaagctataactaaaaccgctcgctcagcttccatgaagttgctttctacaatggctgcaattcggttggaggaggatggtgataacattgagaacactctttccgttgctcttgttgacacctcaaaacctgggactactgataggagtatccaattgaccgatccacttgcctccagttcatgggaaagggttgccgaggagaagactttaattacccctgtgcagtgcaaaaatttgtggaggcaattcaaggctgaaactgaatatacagtgactcaagccttagctgctcaggaagcaaataagaggaacaacaactggctaccacctccatgggcacttgctgcaatggctatccttggattcaacgagttcatgacattactgaggaacccgctttacctgtttgccatatttgtgatgtatctcgttggaaaagccatttgggtgcaatcagaaatcggcagggaattccaacacggatttcttcctgccatcctttcactgtcgacgaagtttgtgcccactgtaatgaacatcctgaagagattagccgacgagggtcaagcacctgcagccgccccagagaggcagagagagatggagctccaaccaaaacccaccaggaacggttcttcatacaccaacgcgacgtcggcggggtcatccagcgtaaccacttcggagatcggacctgagtattcgagcccggtggcgcaatgatttagctgacctttagcctttggctggaagcccactctagcgcagttgagggaaacagggtgcctctcgagaacataggaacttaggaagattttaaggacagtcaggtgccttgcagttttttctaagcctgcccttcccccaaactgatgcaaggtggtgatggggtggcactgcccatcactattatttaaggatttttgggggctgggggggttgtttgtaagagcattgtagaatgatttcgtttaatttttttggtttctgtaacatgaatacatgatatgtgatggttgtatagaagatctggggggcgtagtagtgcccattctacacagcttatactgggcagggggttgcatagttgccagaagcttgtacatgtctttaaaccgccatcggattgcgatggagtagtattactggtgttctggaataacacggaggaacgtgttgtgactaaaaaaaaaaaaggtaactggctgttctcattcggtagttttgacgcgtgcctcgaaccgattcatatttgagccccatctggcgcagattggcagcgtttttaagaggcagacatgacaggttgttgctgtaaccttgtagttttgtaattttctaaaagcgccaaaggggccgtgttgcaagcttcaaccttttttacgcgatacggtgtaaacgtctgccaacgctgctagaagacgtacgtgtccgtttttgggttccagaaatgttccgtctggacccagtcgctgctgaaaatgaatttggtttccgaccctttttgtggtgccaaacactgtccttagtaccgtacactgcgggcaaacggcgcccgatcaaacagtacgattgcatgttcagcgatggatcttgaagtacttgcctcgtcttcttcctagaaagagtacaaattttgatcaaacctagaattgcattcttgtccgatagcggactcaccgtactacagcgattgagacgtcaggtacgttacagtacagagcacagtatacatccctgctggcacctcggcgtccatgagctcgcccctgcag

SEQ ID NO: 6217 - DNA, 1736 bp, Zea mays
tcgggggggagggcggggatttaagagataggtttcagcattcaattgcccctggtggacttgctggggatcgtcgtggtgttgtcccagcttcaggtttctcatttagttcccagcttttttttgttttgtctcaaggagaacaaagatcttgatggggctgctcataaagttatggtggctactgtacgttcggcgcgagctcgagacgaatcggttccaaggctttatagctgatgaggaatggcaacaatttgaggaggctgtccaacatgactttgttactgggtttgggaagaagctcagcagccttctggatagatgtttatcagagtatgacatggaggctatttattttgatgaaggtgtcagaagctcgaaaagacaacaacttgagtctaaactgttacagcttgtcaatcctgcctatcaatctcttctaggtcacttacacactagaactttagaagcatttaaggagtactttggcaaggccctagaaaaggagggatttgctgttgcagcttgcaattgtactgaaactttcttggagaagtttgatagaggatctgaagatgctgctattcaacaagtgaattgggacacctcaaaagtgagggataagcttagacgtgacattgaggctcatgtagcttcagttcgggctgctaaattgtctgaactttgtgcgaaatatgaggcacaacttaccaaagctctggtggaaccagttgaatctcttctagattcagccagtgaagacacgtggccagctattagaaagcttcttcaacgcgagacaaaaactgctgttttaggtcttgaatctgctgtgtcagcttttgaactcgatgaagcaactgagaaagaactgcttgcgaagctggagaagcatggaaggagtgttgttgagtcaaaggcaaaagaagaagctggaagggttttgattcgcatgaaggacaggttctcaacattgttcagccgagatgctgactctatgcccagggtgtggacaggaaaggaggacataaaagctataactaaaaccgctcgctcagcttctgtgaagttgctttctacaatggctgcaattcggttggaggaggatggtgataacattgagaacactctttcccttgctcttgttgacacttcaagacatgggactacagataggagtatccaattgtccgatccactagcctccagctcatgggaaagggttgctgaggagaagactttaattacccctgtgcagtgcaaaaatttgtggaggcaattcaaagctgaaactgaatatacagtcactcaagccatagctgctcaggaagcaaataagaggaacaacaactggctcccacctccatgggcacttgctgcaatggctatccttggattcaacgagtttatgacattactgaggaatccgctttacctgtttgccatatttgtgatttatcttgttggaaaagccctttgggtgcaatcagaaattggcagggaattccaacatggatttcttcctgccatcctttcactgtcgacgaaatttgttcccactgtaatgaacatcctgaagagattagctgacgcgggtcaagaacctgcagcagcccccgagaggcaaagagagatggagctccaaccaaaatccaccaggaacggttccttatacagcaatgtgacatcggcagggtcatctagcgtaaccacttcggagattggcgacagcaacg

SEQ ID NO: 6218 - DNA, 1680 bp, Zea mays
accgaggaaggtactgggcacttgggcaggctgctccgactggaccactgctatcctcagtgctctctctctcctactcctgtgattctcctcttcagctcttctcgcccattccagctccgactgcgccggtgggggaccgcgcaccccagcggcgccaggcgtccacgggatggtggttcttgtggctactgccgctcggtggcccgggggaagcacggctgcccgggcgcgcccgccggctgcgaggggcagggcccccctccgcgtcgccgccgagcccgagcacaaggcggccacggtcaggtttgaaaaatatagattgttatcatggatgaaaccaataaggcatgacgtcagggcccaaatgtccaatgtaaatgttggtgccggaagttatggaggagatgaagcaaatggccatggagaacatttggatacctctgctaccggagaccccaacaaattagcaaaacaactttcaggatctcgttacctgcaacccgttggtgtcatgctatttctgtgtgccctggcaactagttttttcgttttctttaaaggacaatcatctgcagttgtagctatgctggctaaatcaggtttcacggcggcatttacactgatttttgtatctgagattggagataagacgtttttcattgctgcactactcgcgatgcagtatcaaagagcactggttttacttgggtcaatggctgctctctccctgatgactattgtgagtgttataattggacggattttccagtctgtgccagcacagttccaaacaacgctacccataggagagtattctgcagttgctctgctggcattctttggtttcaagtcaataaaagatgcattagcacttcctgataatgccaacgggaaccttcaagggaattcagaaagtggagaactggctgaggccgaggagcttgtcaaggaaaaggtctctaaaaatctcaccagtcctcttgaagtcctttggaagtccttcagtcttgttttctttgctgagtggggagatcgctctatgcttgctacaattgctttgggtgctgctcagtctcctttgggcgttgctagtggagccattgctggacacttgattgcaacagcctttgctattcttgggggagcattcctggccaactacttgtccgagaagctggttggcttgttaggaggagtattatttttgctctttgctgctgcaacgctttttggtgtattctaatctatctgaagaatttgctgttaggtgaaagacttcgcagttccagtttggtctttagattttgaagatgaggggcaaacctaagtaggcttggcacatgctgtatgtagatagacgttatccttatcagagatgatttcgatgtgcccaaaattctaccagacagactggaaactgcatcacatggacagcttacagaagttaccattcaaataatttgattagatttgtttaataagaaggtactgttttgtgctaaggatctagtgttgacttttgtcaatcatgtgcttgtttttcattcatgggagacaatgacagaaggaatccccaggatgaattgttctgaaaaacaactctccgttacccaaaaaaggaggaaattacacaattatatataaattttttttgcaagcgcaaaaaaaaaaaaaaaa

SEQ ID NO: 6219 - DNA, 1556 bp, Zea mays
ccggccggtaaagcggcgcatcgtcactggagctctctggccgggactgcactctactgctcaggtcggaaagtttctgtgccccgagcgagaacgagaagacaagaggaagccaaaaggagaaccgagttcgggagggagcggatggcaatggctctgcttccgctattgctctcggtcctcatcgtctcctgcgtcgcgcagtcgccggcctcgtcgccgtccgcgtcgaatgctcctccggtcagcgcctcggctccgcggggctctgtcgcgccaccgacaacggcggtctcggcgccgcagggctctgtcgcggcaccgacgacagctgcggcctcggcgccgcaggcttctgtagcgccaccgatgacaacggcggcctcggcgccgaaggcctctgtcgcggcaccgacaacggcaacctcggcgccgctggcctctgcagcgccaccgacgacaacggcggcctcggcgccaacggtctctgtcgctgcaccgcaggcctctgcacagccgccagcaccagttttcgcgtcggcgccccaggcgtcggccgcggcaccaacgaaagcagccgccgcccctcaggtctcagccgcggcgccggcaacagcagccttgccgccaactacatcagcctccgcgccccaggcctcggccgcggcaccaacaaaagcagccttgccgccacaggcctttgctgcggcgccaactacatcagccgcggcgccacaggcctctgccgccgcacctcctaccggcgccgccgcgccaccgaccgcagctgcttctccgcagctggctgccacgttgcctccggtttcctccccgccactggccgctacgccacctgtctctgctacccctccagccacgctacctcccgcaacgcaacctcccgtcgccgtcgccgcgccagccccggcgactccggctccagtcgcctccccgcccgtagcaatgccaccggcggcgcttgccccggccacgctccctccagcgatggctccgacaccacttctcgctgcccccgtcatgcctcccatcgcgccacctgtcacggctcccgcaccggctcccgtttctccggctccaagtccaagcgtcgccccgaccccgtctccgacagaagctcccaccccgtcgcccacagaggccccgaccccgtctcccacgcaggcgcctacactcgcgccgttgagctcggtgtcggtgagcccgtcgctggcgccggggcccgcgctcgctcaggaggacgagtcggcggcgccgagctcgcgcactggcgtcgtcgcggccctggtggccgccgggctcgtcgtcggcttgttttaagaagtagagctgcggcgtttattaccgctatacgtccgtaccgttcctcgcacgggtctcttgttctcctgttggtgttctcatggattgatgcacgcacgaaccattcttgctgtacaacacattgataatttattttccatttattatgtaaaaaaaaaagaaaaaaaagcggccctcgcgctccttcgattatccctttaggagggtaattcgcg

SEQ ID NO: 6220 - DNA, 3379 bp, Zea mays
gcacgagaccattacctagaacatcctaatcgaaaaatggcaatggctctgcttccgctattgctctcggtcctcatcgtctcctgcgtcgcgcagtcgccggcctcgtcgccgtccgcgtcgaatgctcctccggtcagcgcctcggctccgcggggctctgtcgcgccaccgacaacggcggtctcggcgccgcagggctctgtcgcagcaccgacgacagctgcggcctcggcgccgaaggcctctgtcgcggcaccgacaacggcagcctcggcgccgcaggcctctgcagcgccaccgacgacaacggcggcctcggcgccaacggtctctgtcgctgcgccgcaggcctctgcacagccgccagcaccagttttcgcgtcggcgccccaggcgtcggccgcggcaccaacgaaagcagccgccgcccctcaggtctcagccgcggcgccggcaacagcagccttgccgccaactacatcagcctccgcgccccaggcctcggccgcggcaccaacaaaagcagccttgccgccacaggcctttgctgcggcgccaactacatcagccgcggcgccgcaggcctctgccaccgcacctcctaccggcgccgccgcgccaccgaccgcagctgcttctccgcagctggctgccacgttgcctccggtttcctccccgccactggccgctacgccacctgtctctgctacccctccagccacgctacctcccgtcgcatcgcctaccgtcgccgtcgctgcgccagccccggcgactccggctccagtcgcctccccgcccgtagcaatgccaccggcggcgcttgccccggccacgctccctccagtgatggctccgacaccacttctcgctgcccccgtcatgcctcccatcgcgccacctgtcacggctcccgcaccggctcccgtttctccggctccaagtccaagcgtcgccccgaccccgtctccgacagaagctcccaccccgtcgcccacagaggccccgaccccgtctcccacgcaggcgcctacactcgcgccgttgagctcggtgtcggtgagcccgtcgctggcgccggggcccgcgctcgctcaggaggacgagtcggcggcgccgagctcgcgcactggcgtcgtcgcggccctggtggccgccgggctcgtcgtcggcttgttttaagaagtagagctgcggcgtttattaccgctatacgtccgtaccgttcctcgcacgggtctcttgttctcctgttggtgttctcatggattgatgcacgcacgaaccattcttgctgtacaacacattgataatttattttccatttattatgtatggatgacggactgcctgctgctttcttttgattaaaaaaaaaaaaaaaaggtgcatggaagatgtatcgcggccctccgagccgcgtgtcgctagtaaaacgcgtgtcatgctgcgttttttgtacgcttgttgtcacgtaaatggacgtggagatggcaactaggttctagtagatgcacgcaggcgaagacgaaagaagaaggcctgccttggaggaacgtgaccagccgtaacagtatgtcgccgacgatggtagatccggtgctcttgccgacattttctgcgaaggggaggacaggaactcgtagcaccaccgacagaaacgacatgaaacgcgacgcacgtacgatgcccatcgcagggacgagatccgtagggtcaaccgggtgggtggcctggggccagggcgggccggccggccggccggccgcgcgttccgtgctcccaaaaggccaatgatacaccaccctcaaatcatttcggccacccaccgtcgttcgcgtttgacatttgtgtgattcgtgaatctgactgacacaccgtacagcacatgccgggtactccagtactagtctccactctccactacgccatcgccaccgagaaaatacgcttcgccgtgggaagaagcgtcactgcgtcagcatcggcagaggcatgcgtgtcggttgacgaactccgggagtcgggagggaaagaggagccgacgagggggagtggggaacagagcaatacaatgaggtagtagatcctgccagtgcgccatcgagctcgcactgtgaatcccagggtctgtcgcaaaaaacgccgcccggcacaacacccgtgagagcgcgtacgtgggggcgccgcgaaacatgcgccggtcggtcgtcggttggcgctggcgctggcgctggcctggttcggagagtgagacggcatcgtcgtgtatgaaccatgagcagctaccagctaggactggggagcgacggatccacgtacattatgtcagtatgtactgcacctgtgatcgtcgggagctggtcctggtcctggccctcgagccacctgccgccgatgatgaggcgtactacggagtactagcctcctgtctcttctgccatgctcgccgtgcccggtttggcgtttttcttacacggctggttgcctatgcggccaccaccggccagcaaccgctgattgaactccaaggtagggaacaataatggccgatagcagttactgaatgaaaggaggtgaacgttggaagcgatgcgccagctgctgtccgtgtccgtgcttcacaaatgatgccagcctaccgagcagtgcgcgccggacgttttccctgtgagcgcaacgacagccagccagcgaggtacggcgaacgggcccgaacgattcggcagaaaaaaaaaatggcgcacttatcgtgtccatacatgtcaagaattcattctcgtaaacctaacggtgctagtaacaaggtgagatggtaaatgtttgttgtcaacaaactgatgattgaagagtaacccttttagcctcgactctttttttaatctaatatttgttgaatttttttaccttccacttttggtctaattaatttgatctacttatgctataataatgtctcaatataaaactataaacataaaaaggtactctcgtagacttttaatatagtttagaatgattgttcgtgtaatttcctaattggcatgtggtttgtttagagagcaacttttttcaagatcgtcctagttaattcttttccgcaataatttatatggtgggtgcttcaagcataaacttgtttaatattttagtttatgttatttagcaacagatgcggttaactcatattgaaattaaagggcccctttatgtgatctttataatggcaggggtggatatattagagcaaaattttatgggttactttaaatcagtggtggatccagaaataaatgaaaaggggtgctaaattatgtattggagatactaaacatgtccctacaatggaattaacggaaccactgtggagaggatg

SEQ ID NO: 6221 - DNA, 878 bp, Zea mays
ttgggtacctcgaggccggccgcattgggtacctcgaggccggccgggactgcactctactgctcaggtcggaaagtttctgtgccgagcgagaacgagaagacaagaggaagccaaaaggagaaccgagtttgggagggagcggatggcaatggctctgcttccgctattgctctcggtcctcatcgtctcctgcgtcgcgcagtcgccggcctcgtcgccgtccgcgtcgaatgctcctccggtcagcgcctcggctccgcggggctctgtcgcgccaccgacaacggcggtctcggcgccgcagggctctgtcgcagcaccgacgacagctgcggcctcggcgccgaaggcctctgtcgcggcaccgacaacggcagcctcggcgccgcaggcctctgcagcgccaccgacgacaacggcggcctcggcgccaacggtctctgtcgctgcgccgcaggcctctgcacagccgccagcaccagttttcgcgtcggcgccccaggcgtcggccgcggcaccaacgaaagcagccgccgcccctcaggtctcagccgcggcgccggcaacagcagccttgccgccaactacatcagcctccgcgccccaggcctcggccgcggcaccaacaaaagcagccttgccgccacaggcctttgctgcggcgccaactacatcagccgcggcgccgcaggcctctgccaccgcacctcctaccggcgccgccgcgccaccgaccgcagctgcttctccgcagctggctgccacgttgccctccggtttccctcccgccactggccgctacgccacctgtctctgctacccctccagccacgctacctcccgtcgcatcgcctaccgtcgccgtcgctgcgcca

SEQ ID NO: 6222 - DNA, 3245 bp, Zea mays
ctagtttctccgcgaagctagttcggacacgtacccggatcttagcttccgccgctgcgtgggcgtacgagttgcacgcgatcaaaattgaaacaggtcggataaaacttgcgttgtcagagccatttcgtcgtgatggaagtacggaattcatctttcctctcctcttaaatacatactttgtcttcttgatgtgtttatatattaaatgctaataaatataactatgtaaaagctttcaagagccgtttagatctattcattttagagaaattaaaattacttaataaaatattatttagtttagaatttgatattccacaactctgtaaaccttaagtataaggttatcatgaaaaatgattatatgtattaataaaatatatttctacactgtaacttataaaataatatttgattcactcttctatattaaaaatatagcacataaatatttttcttatatattgctaataataatatacaaatttatttcacataactatattaacttaattaattttttcctaaattactgctattataaattattattattagaatgaaactccattctaagaatccaaatgagaagtgataatttgaaattaggtgagagttaaagctaagagtgcatttatattattatttatagactgatgtctctatatctatactaagaatctaatatagacacctactgctaccaatttttttgcccctatcacgttcctctgctctagaaatttagggctaatcaacagaccacacgtaccttagtgtttagaaataaacaaaaattatatttatagcctacgcactgctctatatgctccctagcatcgtggcacgcacgagaatatatctagtattgatatataaaagaagggtgaagaccaaattatattatgtaaaaaatcagagatctcttcaaagttcaaacacaactgcaggcttatttggacaagagatgctgacctaattaacggaataatgtaatccagcgtcccggccggccgccgcgcagccaaaaagccgcagtgccatctcatcctcgactcctgttttcttttacactcttggctctacagaagcatccaggcgtgagcgacgtgtcctcgccggccatacgtgccccggcgcatgcgccgacacgtccgccgcctgcccacggccccagagcccgaggaagccaaacaccatctcggcttcttctatggcagcgagtagataatcacacacactcagcagcagctgctccccgaccttcaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggcggtggcgccaaggtccgacccggaccacgggtcggagcggcagccgacggcgatgctgggcggcgtgatgggctcgctccgcgtcatcgagctgcagctggtggccttcatcatggtgttctcggcgtcgggcctcgtcccgctcatcgacctcgtgttccccgtcgccaccaccgtctacctcctcgccatctcccgcctcgccttcccgccgctgcacgccaccaagtcgtccaagcctgatgacgccgccggctcgcccgccgcctcctcccagtcgtccccggagatcttccgcggcagcaagtaatcaacaatccattcaccacttgctttccttcgttcattccttccgctagctagcttaaaacttggagtctggctgccgcaggctgttccaggtgtacgtggtggtgggcacgacggggggcctgttcctgccgctggcgcacgtgctgggcgggttcgcgcggggcgacgacgcggcggtgcggtcggcgacgccgcacctgttcctgctgtcgtgccagatcctgacggagaacgtggtggggtcgctgggcgccttctcgccgcccgtcagggcgctggtgccgctgctctacaccgtgcgccgcgtcttcgtcatcctcgactgggcctacgacgcgtgggcctccaccgcgcaggacgccgcctgggtgtggttcggcaggtgtctcgccgccgccaacctgctctacttctccgccaacctcttcgtcttcctcatcccgaggttcctgccccgcgccttcgaaaagtacttccgcatgcgcggcgagctgtgcgccaagacggccgaggacaagcgcgcgcgcgagggtgtcgtcggtgcggccaagtcggaggtgtcgtccaagaaggcggactgagagctatcggctctcgcagtcgcagcacggggtgtaaattcggtagcctgtggtgggcctgctgtaatttctcctgcgttatgtttaattgtcatcggtttgaccaatagtcgttagtcggcaggaccgcaggagacctaatcgacatcagttttcgggtctcgcagtggctccgcaattaacaaaatgatcatacaatgcataataataaaagccaataataataataaggcagcatcataattcgtatagaatataaatccttatagaatataaatcccacatgtagagtaataacaagactacctaataatttaagtgtatgtaagatggattgtaaagtcacattgatgagaatagaaccatgaatattattaggccaaagaatgtgatcaagcacataatttatcttttacttgtaaatccaagtgctcatatgtttccttaaaattgggcttaggtttctgctaagctatcttcgttcgtaacaaaatataggcaaataataaataaaaatagcgtaacaaaacatacacataggcaaataataaataaaaatagcattacacttaacatggaaacaattacacttaacatggaaacaaacacttaacatggaaacaaattaagtaagaacattctatgcggcgtcggaacattgttaaactaaattcagaataaattcgagaaccattaaatttgaaagttaaactaaattcagaatttaaagcgtcgggacaaatttgtaagttcgagaaaaaagttaaactaaattcagaatttaaacgaatacaatacaaattttctaagtttctagaatacactaaaaatcattttatatatttatttaattaatttctcgcagcttgatggattggggcactattctacaagagtttaggacctcaggtgtaaataaaaggacctatatgttacagt

SEQ ID NO: 6223 - DNA, 1127 bp, Zea mays
gctcactcagcagcagctgctccccgaccttcaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggcggtggcgccaaggtccgacccggaccacgggtcggagcggcagccgacggcgatgctgggcggcgtgatgggctcgctccgcgtcatcgagctgcagctggtggccttcatcatggtgttctcggcgtcgggcctcgtcccgctcatcgacctcgtgttccccgtcgccaccaccgtctacctcctcgccatctcccgcctcgccttcccgccgctgcacgccaccaagtcgtccaagcctgatgacgccgccggctcgcccgccgcctcctcccagtcgtccccagagatcttccgcggcagcaagctgttccaggcgtacgtggtggtgggcacgacggtgggcctgttcctgccgctggcgcacgtgctgggcgggttcgcgcggggcgacgacgcggcggtgcggtcggcgacgccgcacctgttcctgctgtcgtgccagatcctgacggagaacgtggtggggtcactgggcgccttctcgcctcccgtcagggcgctggtgccgctgctctacaccgtgcgccgcgtcttcgtcatcctcgactgggcctacgacgcgtgggcctccaccgcgcaggacgccgcctgggtgtggttcggcaggtgcctcgccgccgccaacctgctctacttctccgccaacctcttcgtcttcctcatcccgaggttcctgccccgcgccttcgagaagtacttccgcatgcgcgacgagctgtgcgccaagacggccgaggacaagcacgcgcgcgagggtgtcgtcggtgcggccaagttggaggtgtcgtccaagaaggcggactgagagctctcggctctcgcagtcgcagactcgcagtcgcagggcggggtgtaatttaaattcggtagcctgtggtgggcctgctgtaatttctccctgcgttatgtttaattgtcatcggtttgacctaaaaaaaaaaaaaaatat

SEQ ID NO: 6224 - DNA, 1901 bp, Zea mays
cctcgaccccgcgtccggggacagaaaaaaaagaaagggaaaaaagggggtctgctgtggactgtgtggtcccgcagggcgcaccattcacccgtcttccgccgagacaccctgcacggctcgccgagacttcagtttactggagcacgcaccgcagcgtctcccccttctgctcatcctccgtccctccgtcggaagggctggcgctaagggacgatccctccgtccgcccgtccgttcgacgggacctcggttggtttcgtcggtcgctgggaggacaggtgacggaacggtgatatgaggcggtggttatgttgtaactgccactatgacgtcgaggaagatgaccacgccaaggaacaggccaaagctcagagcaataagaccgactccaagcagaagtcttcaaagcctcctggtagtcaacctgagccagagttctcccctcctacaattgatgtccctgaattgtctttggatgatttgaaactaaagactgatgattttggatcaagtgctctgattggtgaaggttcttatggacgagtatatcatgccactttggacgatgggagacaagcagcagttaaaaaacttgatgcatctgaaaatgagcctaatgatgagtttctcaaacaggtctcactggcatcaaagctaaaacatgaaaatcttgttgagatgttgggttactgtgtcgatgggaattaccgtatactcgcatatgaatttgcaaccatgggttcgcttcatgatgttttacatggaagaaaaggcgttcaaggtgcgcagcctggacctgtacttgactggatgcagagggtcaaaattgctattgaggctgcaaaaggtatagaatatctgcatgaaaaggttcagccttcaatcatccatcgggacatcagatcaagcaatgtactgctgtttgaggatttcaaggcaaaaattgcagactttaatcttttgaaccaagcaccagatatggcagctcgtctccattcaactcgtgtattggggacttttggatatcatgctcctgagtatgctatgactggccagctgacacaaaaaagtgatgtctacagctttggtgtggttcttttggaacttttgactggaaggaaaccagtagatcacacaatgcctcgaggtcaacaaagtttagtcacatgggctactccaaggttaagtgaagacaaggtgaagcaatgtgtagatcccaggttgaagggagaatatcctccaaagggagtcgctaagcttgctgcagtggcagctctatgtgcacagtacgaagcagagttcaggcccaacatgagcatcgttgttaaggcgctttcgcctctccttcaacaaagacctgcaccaaccaccgaagagccagctccacaacctgggagctgaaaccagtcacatgtgatgggacccctaggcataagccatctccgcaaccattcaatcagcacattctataaatcattgagagtattttgggtatttgttctgtagcgttctcagttgggtatagcatacatgaacttgcccctgctgtttgtggccacctagttcgtggcttgatgttggcgccgcacaatggtatatgcagttggttcgaagtttttttttaccttctctataccaataccaagtgaccaactgtttgtaggttttcataattcgcggcttgaagaatagatgcaggatggtctggatttttttttgtccgtggcgtggtgttgctgcctgacctacgtgatgtacttcctctcttccaaatcccaattcaccttttcttgttctaataaaaaaaaaaaaaaaattgacttgtttatataaatatatttatggacggccgtctacaacagtataaaaagcgcccaaaaaaaaaaaaaaaagcggcc

SEQ ID NO: 6225 - DNA, 1836 bp, Zea mays
gtatagaaaacggggctgccacgcgcgccggccgggacatccattttcatccctagctgtggtcccacaggtcgcaccattctcccctcttcttccgccgatacacacgccctgcacgggggctcgccgaggcttcagtttactactgaagcacgcaccgcagcgtctccaccttctgctcaacctccgcttccgtaggtgccggcgctaagcgaggatccctccgttcatcggtcccgacggcacctcgactcgtttcgtcggtcgctgtggcgacgggtgattgactgcgatatgaggcaatggttatgttgtaactgccactttgatgacgaggaagatggccatgacaaggaacaggccaaagctcagagcaataagatagaccccaagcagaagtcttcaaaacctcctgttagtcaacctgagccagagttctcccctccaacaattgatgttcctgaattgtcattggatgatttgaaacaaaagactgatgattttggatcaagtgctctgattggtgaaggttcttatggacgagtatatcatgccgctttagatgatgggaggcaagccgcagttaaaaaacttgatgcatctgaaaatgagcctaatgatgagttcctcaaacaggtctcactggcatcaaagctaaaacatgaaaatcttgttgagatgttgggttattgtgtggatgggaattatcgtatacttgcttatgaatttgcaaccatgggttcgcttcatgatgttttacatggaagaaaaggcgttcaaggcgcgcagcctggccctgtgcttgactggatgcagagggtcaaaattgttattgaggctgcaaaaggtatagaatatctgcatgaaaaggttcagccttcaatcatccatcgggacatcagatcaagcaatgtactgctgtttgaggatttcaaggcaaaaattgcagacttcaatcttttgaaccaagcaccagatatggcagctcgtctccattcaactcgtgtattgggaacttttggatatcatgcacctgagtatgctatgactggccagctgacacaaaaaagcgatgtctacagctttggcgtggtccttttggaacttttgactggaaggaaaccagtagatcacacaatgcctcgaggacaacaaagtttagtcacatgggctactccaaggttgagtgaagacaaggtgaagcaatgtgtagatcccaggttgaagggagaatatcctccaaagggagtcgctaagcttgctgcagtggcagcactgtgtgtgcaatacgaagcagagttcaggcccaacatgagcattgttgtgaaggcgctttcgcctctccttcaacaaagacctgcaccaggcaccgcagagccagccccgcaacctgtgagctgaatccagtcacgtgtgatgggacctcgcagcatcaggcatctccgcgatcattcaatcagcaagtcattgagagtattttgaatatttgttctgtagcattctgttcctggcttgatgttggcgctgcacaatgacaatggtatatgcagtaggtttgatttttctttttcttttaccttctctataccagtaccaagttaccaactgttcgtagattttcagaattcgctgcttgaagaatagatgcaggatgatctggattttttttttggtctggcgtggcgttgctgccttctcttccatggttaccaaataccatgattgaaatcaagtcacttctactttgtttgaagtcaaaattcttatactttgaaaaagttcgtagaaaaaaccccaaaaaaaaaaaaagaagggcggccgccaacaagtgagctc

SEQ ID NO: 6226 - DNA, 2140 bp, Zea mays
ggatccaacgcagctgggctcctctcgggccggccgggctcgcgaccgcgggtccgcccccccccgtaatccccatcaaaccccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgagctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaacgagttcttcaaggagcaaaaatacccagaagcaataaaacactacacggaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgttaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgtttgttcacgtgcaccctggtcatacatatgttttaacaagcagcagcggcataagaatgaacctgttcgggggctaatcttatcccatttggattgtaagtgcattgacattggataattcatgtttgtggcactgagtttcgagtaaaaaaaaaaaaaaaaaaaaaaagatgtgcgcccgcgttgtcccaccccttaaggg

SEQ ID NO: 6227 - DNA, 2669 bp, Zea mays
ataaaataactagccaatcccggcatactcgtgatgagtggttgtcatcccaacctcctgggtcataccgtaatcagtggcttaccttctataattagatgctcaggactttattcaaacaggtgtggccggggcgggctggattatttaggctgcagcccaactttgttggcccatcaacttggcagagcttgcaaaatttagcatatggctagattagaggcccaaatgtttgtaagaggctggaaaaggcccatttatatatgcgacagtaggcgtaataaaatagaaatacacacagtggcaggccgtaatccatatggttgtccggtgtccggtgtcccttccgttgccttccgtaattcctgatcggctattccgtggaagaaccttcgagaactgggatgcaactatgccagcacgcagctgggctcctctcggttttataaaaacctgggagctcgccgccccagcccccatcaaccaacccccggacatttctggtcgcaccctcctccggccctcccagccgccaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcggcgcacctcggcctcggcgacgccgccagcgccgtcgccgcatacgagaagggccttgcgctcgaccccagcaacgaaggtctcaaggcggggctcgaggacgccaagaaggccgccgccgccccgccgcgtcgcgggccgtccggccccgacgccatcggccagatgttccagggccccgagctgtggagcaagatcgcgtccgaccccaccacacgcgcctaccttaacgagcccgactttatgcagatgctgcgcgaagtgcagaggaaccccagcagcatcagcatgtacctctccgatccccgcatgatgcaggtgctcagcctcatgcttaatgtcaagatccagagacccgaggcctccgagccatcgcagtctaccccaccgccgccgccgcagcagcagcagcagacatctcctcttcagacgaaagccagagaggtggagccggagcccgagccagagccgatggatttcactgatgaggaaaaggagcgcaaggagaggaaagctgctgctcagaaggagaaggagttaggtaacacagcttacaagaagaaggacttcgaggcggcgatccagcattacaccaaagccttggaacatgacgacgaggatatttcttatttgactaaccgggcagcagtttatattgaaatgggaaagtacgatgaatgcatcaaggactgtgataaggctgtggagaggggaagagaacttcgtgctgatttcaagatgatctcaagggcactgacaagaaaaggaacagctctagtcaagcttgctaagacctctaaggattttgatattgccatcgagacctaccagaaggctctaactgagcatcggaacccagacactcttaaaaagttgaatgaggctgagagagcgaaaaaagagttggagcaacaagagtactatgatccaaaattagcagatgaggagagagagaaaggcaacgagttcttcaaggagcaaaaatacccagaagcaataaaacactacacggaggctctcaagagaaacccaaaggatcctagggtttacagcaatagggctgcctgctacaccaagttaggagccatgcctgaaggtcttaaagatgcagagaagtgtcttgaactagaccccaccttcactaaagggtacacaaggaaaggtgcaattcaattcttcatgaaagaatatgacaaggccatggaaacctatcaggctggcctgaagcatgacccgaaaaaccaggaactgcttgatggtgttaggaggtgcattgaacaaattaacaaggctaacagaggtgaaataagtcaggatgaattgcaagaaagacagaacaaagctatgcaagacccagagatccagaacattcttaccgaccctatcatgagacaggtgctaaatgatttccaggagaacccaagggcggcccaggagcacctgaagaaccctggagttatgcaaaagattcagaagcttgtaagtgctgggatagtccaaatgagatgatcaggcacacgatgcgattgtacctgcttgttcgtcccttgtgcttggctttgttagttaacgtgccctttaacaagcagcgacggcaaaagaatgaggggctaatcttttttcccaattggattgtaagtgcagttaacattggattattcatgtttgtggcagagtctgagtataggcgccgtcttgctttattgatgctggactttgcgtgcttgtgggtgggggttggttccctagctaaagtttagttcatgtcccattaaatatttgaatataatatatatttaattaggtttcaaaaaaaaaaaaaaaaaaaaaggggcgccccccgactattgaccc

SEQ ID NO: 6228 - DNA, 867 bp, Zea mays
cattgggtacctcgaggccggccgggccgggatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtactcgcttcgttttctctgcatgcgtgtataattgtgttcaataataagtgagagcggtgtgatgtgtggctcccctttgacaaaaaaaaaaaacccggccgccgccccagcggcgt

SEQ ID NO: 6229 - DNA, 1232 bp, Zea mays
  misc_feature (1228)..(1228): n is a, c, g, or t
cccccccccaagctatagctagccagccatcctactgtcacacacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggccgagggcgagtacgagaggtacaagaaggaggagaaggagcacaagcacaagcagcacctcggcgaggccggcgccatcgccgccggcgccttcgcactcgtacgttcacaatgcatcacatccacaacggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctccccttgtcaggcctcatgtttatccgtattgaatcctggcaccatgcatgactgaggatctggatgtctatgaagcaccgtgtatctatcatcacttttgcaaaaaaaaatattcttatatttcttgaaaaaaaaaaaaaaaaaaaaaaaagccagttctccgcgttctttccactgcttactaagatattgtttggttcatatatttgtaacacgattgataactaataatattaaactatgtttgtttaaattcaactgtaatcatatancgcg

SEQ ID NO: 6230 - DNA, 919 bp, Zea mays
tggtacctcgagccggccgggccgcgggatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggctagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtactcgcttcgttttctctgcatgcgtgtataattgtgttcaataataagtgagagcggtgtgatgtgtggctccccttgtcaggctcatgtgtatccgtattgaatcctggcacatgcatgactgaggatctggatgtctatgaagcaccgtgtatctatcatcacttttat

SEQ ID NO: 6231 - DNA, 496 bp, Zea mays
agcccgaggcgaaaaaggaccccgagcacgcgcacaggcacaagatcccggaggaggttgtttccccggcggccgttggcgccggcggttacgtattccccgagccccccgagaaaaaaaaggcccccaaggaccccgaggaggccaccggcgaaaaaaagccccccccccttttcggctgaccgtagtaccggccggggcgcgaccgagctagctagttccggggcacacaaccacacacctgtttaattttgtactgcatgcgtgtgtaatttgatggttcccaataatgagtccctctccggcccttggtagctgcttgcttttggtgagtgaaagtgtgagactgagggaaaaaaggtggtgggcgtggggctacgtcaaaaaaggcgtgttcctgtaatcctgtactcgcttcgttttctctgcatgggtctataattgtgttcaataataagtgagaccggttttatgtgtggctccccttgtcaggctc

SEQ ID NO: 6232 - DNA, 916 bp, Zea mays
  misc_feature (17)..(17): n is a, c, g, or t
  misc_feature (857)..(857): n is a, c, g, or t
  misc_feature (859)..(860): n is a, c, g, or t
  misc_feature (878)..(878): n is a, c, g, or t
  misc_feature (887)..(887): n is a, c, g, or t
  misc_feature (889)..(889): n is a, c, g, or t
  misc_feature (891)..(891): n is a, c, g, or t
  misc_feature (904)..(905): n is a, c, g, or t
  misc_feature (911)..(911): n is a, c, g, or t
  misc_feature (913)..(913): n is a, c, g, or t
gccggccgggaagctanatcccagaacaggggtcctactgtcacacacttacacacacacagacaagtggtttccaaagccaagtgtgtgtactagcaaccagctagctcgggcggcagcaggcagccatcatgtcggaggagaagccccaccacttctttcaccccccccaagaaggacgaggaccagcccgccggcgagtacgggtactccgaggaccgagggtggtcaccgcccccggcgagggcgagtacgagaggtccaagaaggaggagaaggagcacaagcccaagcagcacctcggcgaggccggcgccatcgccgccggcgccttcgcactttacgagaagcacgaggcgaagaaggaccccgagcacgcgcacaggcacaagatcacggaggaggtcgctgccgcggcggccgtcggcgccggcggctacgtattccacgagcaccccgagaagaagaaggaccacaaggacgccgaggaggccagcggcgagaagaagcacccccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgaaagtgtgagactaagggaaaaaaggtggtgggcgtggggctacgtcgaaaaaggcgtgttcctgtaatcctgtactcgcttcgttttctctgcatgcgtctataattgtgttcaataataagtgagacggtgtaatgtgtggctccccttgtcagggacaaggtttatccggnanngagtgaaggaaaaaaaanaagggggcncncnagggtccaacttnngtaggncngcg

SEQ ID NO: 6233 - DNA, 881 bp, Zea mays
attgggacctcgagccggcagacctatcctactgtccacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggaaaaaaggtggtgtgggcgtggggctacgtcgaagagaggcgtgttcctgtactcgcttcgttttctctgcatgcgtgtataattgtgttcaataataagtgagagcggtgtgatgtgtggctccccctgtcaggctcatgtgtatccgtattgaatccctggcacatgcatgactggaagatc

SEQ ID NO: 6234 - DNA, 779 bp, Zea mays
gccggccgggctgcgatcctactgtcacacacacacagagagagacaagtggtttccaaagccaagtgtgtactagcagtctagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtccgagaggtacaagaaggagggggggcgccgccggcccgccctccgccccggcggctacgtattccacgagcaccacgagaagaagaaggaccacaaggacgccgaggaggctagcggcgagaagaaacaccaccccctcttcggctgaccgtagtaccggccggcgcgcgaccgagctagctagctccggcgcacacaaccacacacctgtttaattctgtactgcatgcgtgtgtaatttgatggttcccaataatgagtccctctccggaccttggtagctgcttgcttgtggtgagtgagagtgtgagactgagggagaagaggtggtgggcgtggggctacgtcgagagaggcgtgttcctgtactcgcttcgttttctctgcatgcgtgtataattgtgttcaataataagtgagagcggtgtgatgtgtggctcccctttgtcaggctcatgtgtatccgtattgaatcctggccccatgcatgactgaggatctggatgtctatgaacccccgtgtatctatcatcacttttgc

SEQ ID NO: 6235 - DNA, 1016 bp, Zea mays
  misc_feature (995)..(995): n is a, c, g, or t
cattgggtacctcgaggccggccgggccgggaagctatagctagccagccatcctactgtcacacacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgagaggtacaagaaggaggagaaggagcacaagcacaagcagcacctcggcgaggccggcgccatcgccgccggcgccttcgcactctacgagaagcacgaggcgaagaaggaccccgagcacgcgcacaggcacaagatcacggaggaggtcgctgccgcggcggccgtcggcgccggcggctacgtattccacgagcaccacgagaagaagaaggaccacaaggacgccgaggaggccagcggcgagaagaagcaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgttcctgtaatcctgtactcgcttcgttttctctgcatgcgtctataattgtgttcaataataagtgagagcggtgtgatgtgtggctcccctttgtcaggcctcatgtttatccgtattgaatcctggcaccatgcatgactgaggatctggatgtctatgaagcaccgtgtatctatcatcacttttgcaaaaaaaaatattcttattttcttaagtagcatgtcatgattcatanaaaaaaaaaaaaaaaaaaaaa

SEQ ID NO: 6236 - DNA, 2402 bp, Zea mays
gataaaacagtagaaaaggtaaaggccaccccattttggtattttcttctcccctattccctcttcttgttcttggagttgttggtgtccccggagctacaaaggccccgccttttggctcattctcagactttagtactttaccatctgctccaagaaagcgtcttggagatggcgcgcaccgagaagctcaccagcgatggctgctccggcggcgaagtccaagtggaggtggagctcggcatgggggtggacgggaaggggatcatagagtgccggatatgccaggaggagggggaggaggccgctatggactcaccttgcgcttgcgctggcacactcaagtttgcccacaggaaatgcatacagagatggtgcaacaagaagggaaatattacatgcgaaatctgcaaccaggtttactccccgaattatgtcatccctccaccgaaatgttgttcagatgaaatggacatgaatcttaggcaaaactgggtcggacgaatcgatccccatgattcccatttcctagccatcgccatcgcagagcagcagctgctgcaagctgaatttgatgactgtgtatctgcaaactctagcggtgccacatgctgccgatccattgctttaattgtgatgttccttttgctcgtacgccatgtaattgtcattgtgagggatgttagcatgctacaagatgcaacggtgctgttcagcgcaactcttcagtttgcgggattctttcttccttgttatgtaatagctcgttcttgctacgctttgcagcatcggagacggagacaggtgtagggaggctcacctgaaccttaagggcttgtttgggagcaagtgaaatgaaggggattgagggtgctagaatccctcactatttaaaattgaatagtggggtattctagccccttcaatcctctccattactcttcctcccaaacaagccctaaagaacacaaagacgcaccaattgaagcgccgtctcggcggtaccaccgaagataggaggactacatggaagcttgcgaagtgagcctccccgttgttgcttggattcaccgcaaagcatttggtttctgtcctgaagacgtcggcggtttaattaggttgattgagtagcgagagcaggcgctgtgaagctcaagtgtacatacgttgagggggacaaggccttttttttttacagctgagaggaagcaaaatgtagcctcacacatttctgctgcaaataaaagaacaatcgcccgtcagcgcctctgaagtttatgcttggtttgggattgctggcttgcacctcgcagttgaagagtaggtagtagtagtacagggcggctgctacctgctgctgctggacaagtgcgtacagagggtggtttctgaatgggacagacgtggagtcacgggctcagtgccgctctaatgctccgttaagtgccggattgtctcttcgtcagtaattatgacattgcaatcgcctgtaattttcagtacacccatcatgaggaacacggtggcaaccctcgtcacttcgtcacgaaaaaaaaaaaaaaaacctcgatcggtcgcttcgttcgtgtcagtcggtgtcccctgttcattgctggctccgaatgcgctctctcagtctcactcacgccccacacgtccatcttcctcacgctggcgcctttctcgttcgcatattttccttttgttctcagttcgggtgcgcgtttataattataacccttcctatttttctagatgtagagatgtatcagttgtagaagtcggatattagtaacctcatagatcagatgtccagcacaacagagaaatttttcagatatgttaataaacaaagtctcgctgaatctgcaaattgacctctgaaaacgacatgtttgtcatttatacaataatggttataagttcctcacactctacaacgtcaactaacaatctgcatcactaatgtgttagaagcaaaccacgaagttcgcaactatgggtgaaatgcccgagattcaattcgtatccgagcccgggttctcagtatccgatccgtatctgatttttatccgtattcgtatttttaaagttggatatttaagatatcgatatacattcatatcgtatacaacacaacttaataatatgtgtattccatctgagtccagagagaaaatatgaaaaaggtaatattcgtccatgtacgattcgattgtaccctagtcgcaaccaacccccaatgcaactgggagttaggtagaagagatatacttctatgtaatatttgttaattaaatttaaaaagaaagcaagacaggtgtatctatcgcaggcggccgcgacggattccggcagcaaggttgccgtcggcaccgccaagcaggttgctggggtcgggg

SEQ ID NO: 6237 - DNA, 1059 bp, Zea mays
tataattgcgtgtgtctttgattacgatgttttgctcacaaagttgctactgctttccaataattcttgacagcgtcaacgagtttgtcagtgcaaagaccgacccaatgataccagtgtatgaattcttaacttgattctctcatgccaggccagcagaaccatggcccatggttccccttatcagtgtctctctctctctctctatttttttttggctgactttgctgcttgcagaagcaaaaggagacatggatcttgcagcttctcgcggtggatcagatcaaaattgcgcacatgcttttcatgcctgtgctgctggtgccactgcttgccgaagcccaatgcgccaagctgcttcagctgttcttgttgcacctgccgcgacacgcagtgctgtactccgatctgccgctgttcaaagaccccttcgtgcagccccggctgctgcacctgcagccttcccagctgcagctgcaagacgccaccaggctgcggccattgccgaccccagtgcagcagctgctgctctagtggttgcagctgcgcggactgcccgtgctcctgctcctgccccccgtgctgcagctgccccggctgcttctcctgtgaggggtgctcggctggctgcctcggcgctctcaaccggtgtctcggcggcctgtcgtcgtgctgcagtgggatgcgaccttcctgctgcaagtgccagtcgtcgtgctgcgaggggggttcgtcctgccgcggcaccggcacgggagcgtgctgccgcggttcgtgcctcggtgccccggcgtcgtcgtgcccggagtgctcctgcggctgcgtgtgctcctgctccaggtgcaaaggaggatgccgctgcccgtcctgtggtagtaatccctgctgtcccggtggatgcttgtgctagatcagagtattatattactactagctagtgtgtctgttgctcttcttttcctgttgtggatgatttggcgtttgatttggatggaacctcgctagtgcataatattcactgtcatgaattaactttgacgcccgtcgccactgcgccag

SEQ ID NO: 6238 - DNA, 3724 bp, Zea mays
gttggtacaggtaaaatacagttttaaatatcatggtttatctaaaaaccatgatatttttagagttttggaaactccactcaggatctcagttttctatactttggttttttaatacaaccaaacatatcttggctttaagtaatatcgtagttttattgtggtaaaacaatacaataatatctgtgccatgtacggttataaactagggtattttaaaactatactccttggaaagaagtatttgaagtgtgttgcgtaacacatctcctggaaagtaggcccttgagaaacgtacaaagaaagtggaaactgtgggccggaaaaacgaaaaaaccgaacccagcccaataggcgactaggcttccatcgctcaagatgatatagtccagcctggttacacaaagagggccagccgatggcgagaaacccaccagccgcgcgtgcggacccacgtgtcgttgccctcccgtccagactcccgagcatctagaactggagccgaaccaaacaaaaccccacctgcaagtctcgctcccccacacgcactgacccacaccccccgcaccgctctctccccacccaggcacccagcctccacgccacagatctctctccctttcccccctctctctctctccgaactctaccccgcagtctcggccgcggccatggcggaggacgcccccaacgccgtcgccgagggcagccagcccgcggcctccgagggatccgccgacgccgccctgccggctgccgcgggcgccaaggccgcggaggcgctgctcccgtcgctcagtatctggccgccgtcgcagcgcacgcgcgacgccgtggtgcgccgcctcgtgcagacgctcgcggcgcccagcgtcctctcccagcgctacggtgccgtcccggagcccgaggccgagcgcgccgccgtggccgtcgaggccgaggccttcgccgccgcctccaagtccgccgccgccgccgccgagtgcccggcctccgtcgaggaggggatagaggtgctccaggcctactccaaggaggtcagccgccgcctcctcgagctcgccaagacccggtccgccgctgctgcggcggcgcccgcgcccgccgaggggagcgcgcaggcgcaggagtccgcggaggcctcgtcggcgactgctccacccaccgaggaggctgccgtaaacgaggagtaaggcgtcggaccgcgctttgatccaccgacaattgctgttattttggcatttcgtcggaatgttatttatcgttccccctgcctatgttttaagtacatctattatctatctattagagatgagatgcttgtgacaagagggactgatgtttgtttcatggatatgatattctcgaatatttatcgctagtttatttttaactaaaccgagacaaataaaaaaaggagggagtaatattgaattattatatatcaaccgtgcatcctttcgacgagctaattgttcttgttttcttatggttgcaaggtggttaacactaggattattgaactgtgttacttgggcttgtgagaggattgttttcgtgatcactgaataaccacccatgtatgctgaactctctctatctatacaatctaacgtggacccatcgtgctactacggctttagccttctcaattcccatgcccaagtgtccgcaaaaatagtgcaaaacgagcacttaaacccacgcccctctcctctagaaatttggggctaactatatttatagtctaggtgctgctttccacgctcttccgccttgtgtcaacgcacagacacatacctagtactatttatgcattaatcatgcaacagtgcagttctagagaaatttcgaaatatgttaaatcatctctagtaaattagacatgcttgctgatggtgttagaaccgtattgtttgatctaggacaacagacagcagctggcatttttcaatgaagaataccaaactgcaaggacaatggttgatagtctaagcaaaggataccacattcaaatctctttgcaacaccaaccacatctcttcaattatacaggtgtgacagccacctttaattatatgcagaccttaacttcgattctccataattctgattttagagtgcatacatatatccgggtaaattgaagctaaaaggcaaacttggttggtcacacctaactagatgaaaactgcaggttgtcgattttccacagttgagatttcggattgcatatttgcatatgtataattgaagtttgaacttaaaaggcagccctggttggtcacgcgtcactgtgaaaactacaggctgtccataccacctttttattttattttgtgaacatcatttggtgccatctgtagaaaaacctcatactcatcctgaattatcaatttggaccagcaaaatctatgcctacctgttttttttttggcaactagtacatgttagtccttataaaaaataaccaatgatatagacattatgtttttgaaaaatatttccaagcagctgtgcagttatcgtgaaaaaaattgggtatcaactgtatagacatgattgttatgtagcaaattctcactcgcatgtattagatatttgaatcaacataagttggagttataataaatatttgtttaggcttattcgttttccagtttcctgacattttgatttggtagccaataaaggcgttgttacttatgaagaaatgcgtattgtcatttgcctataacatgcgatttccagcttgctatcgccatatggcacatgaatatcgatgtccagcaacgagtgtccttccttctgttgcctcctacatacctgtcgttttatatatttccctgtcgttttatatatttcatgtgcttgaattttaaaaccacctatatattttaggtgcttgaattttaaaagatgatttcataaaatagttattaacattaatttaagatggggtttcagatagcatgattttagataacattcttgtacaaccaattaagatttcagataacactcttgtacaactaattaggacaagtaacgagtaaattactatcgaaaagaacaaaatgttttagaggcaaggtgaattgaatcagtataaaattctcgtggagttaaaacctaacgcatagtccattagagcaactccaagagtttcctaaaaaatattcctcaaaacattatattaaaggctgctgaaaaaagaaattcccctaaaaaaactaaactccctgcgcctcccggtcgtctactcactaaaattaaactcaagcaattcacaagtgtgaaagcgtgggcctgcagagcatgtcgcagagcgtgcaattgctgggagccaacagatttgagggaaaggatggattggggaaaggtgtttgctcgcccatatttgagagagtagagctcaaacgagggatcccggttcttttggcaagaaagagggagatgttggacagagaatttttttgcatcaagtattagttcttttctccttatacatctcaacaaaatggtgtagtggagagtaagaatagaactctattggacatgataaaaaccatgcttgatgagtacaagactacggatcgattttgggcagaagcgattaacaccgtttgctactccatcaaccgactctacctaccgaattctaaagaaaacatcatatgaactcctcaccggtaaaaagctcaatgtttcttatttagag

SEQ ID NO: 6239 - DNA, 4200 bp, Zea mays
ctctactttataaataatataatatacaatgtaaaacagtattttacacagccgtttacaataaacagcctgctaaagatgaccttatacaatccaaaaggcccatcgccgccgccaaatgaaaccgtccgaataaacagaggagcccatccccagcccgggaagtagtcttctagagccttccctccgcagcggtggcagtataaaagacacacgcacacggcacacccgtcgccttaaaccatcgttagagtttccttggtagtttttttccctcttgtcacagcaccccccacccacacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgatggcggtgatgcggagccaagtgctgcgagtaacaaggcctcagcggacgatctcaagtcctttgatgctgagttcgtcgatgttgacctggtcaccctcttggagctcattaaggctgcagactacctggagatcaatgggctgctagacctgacctgccaggccgtcgcggacatgatcaaggggaagactgcttgtgcgaactgttataagttattgactgattgattaagattagaactatcttgttcggagattggccattgcctggaaatattgggatattctgtgtttgtgttgctgctgtttaatttagttgctgggcgtaaactacttccgtttcgtgtaattgaatttgcttcatgtagaaactggataccgtgctgctgttttattagcttacgaatctgggataggtatcgagtccatcgcatgatatatatttgaaattgtccgttgatgtttaagatggcttatctatcctatgtttaatggggatgcagtacttgtttcacaatacagtagcaggcattgataattcatttgttgtaggactggcataaacagtgattagttgcttaggatatttatctgcttgatgaaaccattgccttctcatggttcatccatgttgtgaatggtttgcatatatagatagttttgccctgtcatatatcttatggttacctgcaacaactagaagttaccatgcatgttcttgattatcatacattagatcaggagctgggtttatttattcttacacttcagttgtttgtgatttagacagagatcatcttagatacggtctgattttatcctatgtgtgaaacctctattgtgcacccattgttgtgtggatctctatgtatttgaaattgttcacttggtaattagagttgtttgcccattagatagatgatgagctaggtttattctttacaatttaatttttttttatatagactggtcttcttggatcatgaattcatgatgcattagatagatgataagttgggtttattctttactatttgattgtttcttgatttttatgtagactgtgatctccttttgttgattgagggtccctagtatttggaattgtccacttggtaattagtagtagtacacacccatctagtcatgatcattgttgtactttggtccatagatatttgaaattgttccgaaatgtttgtatgatgctttaggatgagctggagtagttgtatatatatatggttctgccatgcttggtgcacatgtacagttagttgaaggcagaattggtgtttgtattggccattatattttgagtgtcaagaaataaatatattgtaggattatattgtgactgtccatgctactgcattcacaggctgcagactacctggagatcaatgggctgctggacctgacctgccaggccgtcgcggacatgatcaaggggaagactccagaggagatacgcgagacattcgacatcgagaatgacttcacacctgaggaagaggctaaagtgaggagggagaatcagtgggcctttgaatgaagaagctgcaggctagctctaacaaaacaatagcaatatcatataaccaggccagagatgaagtgcttgttcaggatgttatgagtcgaaggtttggttggtcgtgagcagactatattgctgttccagtattttggctggtttggttcccaaacattgctggttcttctgcctacccaattttgttttactggttgctttgctttgcttcgcttcgctgatgtgctattgcttatggttttatttgtttgttccgtctccgtcgatgtgtgatatggtatcgcctgatgtatttatgttggaattacgggcctacttggttagttggctttgaactaagaggccgcaagatgctgactgctgtgtcatgtgacaggaaaaagttgtgctaaacagcatagaacaacggtaaagataaaatttgtctgttataaaaaaagataaattttctataagtttaaattagaaaatcggctaaaaacaatcaacagacttcctagtagcaccagacacatgcttgtatattgtaataagaagataaggcactatacgagacaacgtctagattttctaaggtgcctttatagatgagtcattatatatggaatattcaatcattcctctgatggactgactctgaagctgatagacgggtggaataggtgattctacaaaacttactttaaacaatataaagttggtctataaaaggtgttagtgtaaattaaaaccaagttcgaatgagaaaaagagagaaaaatactcttcacttgattgctctcttgagatatgtattaaactacgagcaatatataagtaaagtataatcactaaggaagacgaaaatcacagtaaagtaaagtggacaagggacacggcgaattttcacgtggttcggccaaagcctactccatgttgtggtgacctctttcggttaaggattgcactcaacccctctcaagtgatctaaagatcaaacttgagtgtcacgttattctcccttatatttcaacctgcttataaggaatctccaaaagctggagtgacttacgccttacacaagatgatcacaatccaaaatcagagtaagaacacaaacacaaatacacaatacagcaacaacaacacacaaaagttaagacaagagcgtagcaataaaatctcttataagtcactgaacagcgtggtcgttgggtacctggagaggaaacctaggcactccttttatagctccaagaggcctaggacccgttgccttctccacaaggaagctaaaaaaattccctgtctgcaagcttatcggacagtctggtgcgctactagatatccggccagcaacagtcgctcggcgatctgattggtcagtttccttttccagtgtggcacccgacagtccgatgcgccactcggtagcagccacgtcagctagccattggcggctggcgcccgcccgtagagagagagccgttggagttgatgtctggtgcaccggacagtgcactattcactgtccagtgaattttataattaaaattcctaagagctgcatcttcgaccgtatgcttcaccagacaatccggtgcacacctaaccgttaggtgggtccgaaacttacccaagttggactcttttgagccaaatttttctaagctcttcttgagaggttctctagcacttagacaaacatagttagcaactaaaataatttactaagagttgggatcatacctctttcattccttttctccaggatttacagtgtgtccacaaataagtccaaatgacaattttcttgcacaaaagagttagccgccaagcaacagtgcaagaaacatagtattatgtatgtacaacttttcatgtatgtgcaagaaacatagtatcattccttttcatgtttttgtagctttacctaaagttgcacttttggccttctaattctactcatttagacttcttgtcttcaatatgctttctctacttctgtgctcatgctcatataaagagagttagttcacagtagtgtattggtcatttaatcactaaaacaactagaaatggcctaagggca

SEQ ID NO: 6240 - DNA, 925 bp, Zea mays
ccggccggcaaccatcgttagagtttccttggtagtttttttccctcttgtcacagcaccccccacccacacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgatggcggtgatgcggagccaagtgctgcgagtaacaaggcctcagcggacgatctcaagtcctttgatgctgagttcgtcgatgttgacctggtcaccctcttggagctcattaaggctgcagactacctggagatcaatgggctgctagacctgacctgccaggccgtcgcggacatgatcaaggggaagactccagaggagatacgcgagacattcgacatcgagaatgacttcacacctgaggaagaggctaaagtgaggagggagaatcagtgggcctttgaatgaacaagctgcaggctagctctaacaaaacaatagcaatatcatataaccaggccagagatgaagtgcttgttcaggatgttatgagtcgaaggtttggttggtcgtgagcagactatattgctgttccagtattttggctggtttggttctcaaacattgctggttcttctgcctacccaattttgttttactggttgctttgctttgcttcgcttcgctgatgtgctattgcttatggttttatttgtttgttccgtctcaaaaacaaaaaaaaagggggcgctcgcgatcta

SEQ ID NO: 6241 - DNA, 997 bp, Zea mays
aggctgtccactcccccgtgatgtgagcgcgtttctctcccgtcctctcctctcctcccccgcaacaaacacctgcaagctgctctcgatctccctctccgtcgcccgctctctcgcgcgcgcattacttgcacgtacgagctcagaaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctacgacctcgacttcaccaccatcgagaactgccagaagagcaagatcttcttcttctcctggtcccctgacactgcacgcaccaggagcaagatgctgtacgccagctccaaggacaggttcaggagggagctggacggcatccagtgcgagatccaggccaccgaccccagcgagatgagcctcgacatcgtcaggagccggaccaactgaccgtcatcgtccatcaacgaccaagcaacaacacatccacactatatactcaattcacattgcatgcatcgttattattacatcatttatttcagaccccccgcccactgctaaccgtagtccataagagattcatcatccgtggactatgctcgatctcttccgtacgatacaattctcaaatatttctatttatttcctaagtgaattattatatatgtactatttcattccaggttcattttacttgtgaccattcttcagttcttttttctgtaaggatcggtatatcggagcatatgtgcatggctatgccagttgttgggcgtaagaatgtatttttttctgtaatatagaaaaaaactattttaagcaacaggttattgtcaaaaaaaaaaaaaaaaaa

SEQ ID NO: 6242 - DNA, 928 bp, Zea mays
actcctaagggcgattgggatcctcccggccggccggggccatctctctctatcgcattgcttgcgcgagcgcagaaggcacacacgtacagccatggcgaactcgtcgtccggcctggcggtgagcgacgagtgcaaggtgaagttccgggatctgaaggcgcggcggagcttccggttcatcgtgttcaggatcgacgacaaggacatggagatcaaggtggaccgcctcggcgagccgaaccagggctacggcgacttcaccgacagcctccccgccgacgagtgccgctacgccatctacgacctcgacttcaccaccgtcgagaactgccagaagagcaagatcttcttcttctcctggtcccctgatactgcacgcacccggagcaagatgctgtacgccagctccaaggacaggttcaggagggagctggacggcatccagtgcgagatccaggccaccgaccccagcgagatgagcctcgacatcgtcaagagccggaccaactgatcgtcatcgtcctactatcaagcaacacgatcgaccaccacctcgattatatatgcatcattatagtatcgtttattaatttcagacccacccactgctaaccacatcgtccacgagagattatattcatccgtggactacgctctcgatcttacaatttgaaacctttctattttcctaattactatgtattccaggttcattttgattgtgaccattcttcagttctttctgtaaggatcggagcatattatatactctatgtggctatgccaattatattgttgggtataagaatgcattttgtttctgtaatacggaaaaatatattttctttaagcaacaacaaggtaaaaacttgcctcggtgcattttttatttcccaaaagaaaacaaaaaaaacaaaaaagaaaa

SEQ ID NO: 6243 - DNA, 919 bp, Zea mays
  misc_feature (542)..(542): n is a, c, g, or t
  misc_feature (761)..(761): n is a, c, g, or t
gatttggactatgcagctgccctcccacaccggcgcagaattccgtagaagaatatgcatgatatttttttactattattatgggtttcgtctgtctgatttgttgtttcccctttgctgtggacgcagagctgaagccttggaggagtaaaggtgtggtcttgccatggagcagccgcagcagcacaagggaggagcggttccggcgcctgcagcggcggccgcgaacggggccggggccggggccgcggagctgatcgggtacgtcgacgtgcacgtgcgtagcgcgcgggacatccagaacatctgcatctaccacaagcaggacgtgtacgcgcggctctcgctgccgggagacggcgcgccggcggcgtccacgcaggtggtcaacggcgggggccgcaacccggtgttcgaccagtcgctgcgcctcggcgtgcgcgcgggggacgtcgacgccgcgctccgctgcgaggtgtggatgctcagccgggtcaagaactacctgcaggaccagctgctgggcttcgcgctcgtgccgnctccccggaggtcgtcgccgccgacggcggcacgctcgcccgcgacttcccgctcaccaccagcgacctcttccagaccccctcgggcttcctgcagctcgagctctcctacatcggggtcgtcccggaggtcgagcccaatctcgccgacccccaaacccgggcttggccaccccgaagaagaaggaggagccggggaacaacgccgccgacggcgtngggaacgggaaggagtacgagaagatcgagttcccggacctgaatctcgtggaggagaaccagatcatggtctccgagtacaccatgctgccgtgcgcggccgtggaaacgcacagctgcgacagccttctgacctcggagcacgatgacggcgccac

SEQ ID NO: 6244 - DNA, 1809 bp, Zea mays
actactagtactgccgccctaatccttttccttttggagtccgtgttatatctcgagcccccaccctgccggctgccgctccctctgttccgcttgattccagtggccctgcttccctcgtcgccactctctctcgagagcagcaccggcacttcggacaggagttgaaaagcaaaggtgtgttcttgtcatggagcagccgcagcagcagaagggagtagcggtctctgcgcaggcggcggccgcgaacgggaccaagggcgcggagctgatcgggtacgtcgacgtgctcgtgcggagcgcgcgggacatccagaacatctgcatctaccacaagcaggacgtgtacgcgcggctctcgctgcccggggacggcgcgccggcggcgtccacgcaggtggtcaacggcgggggccgcaacccggtgttcgaccagtcgctgcgcctcggcgtgcgcgcgggggacgtcgacgccgcgatccggtgcgaggtctggatgctcagccgcgtcaagaactacctgcaggaccagctgctggggttcgcgctcgtgccgctcccggaggtcgtcgccgccgacggcggcacgctcgcccgcgactttccgctcaccaccagcgacctcttccagaccccctcggggttcctgcagctcgagctctcctacatcggggtcgtgccggaggtcgtgcccatctcgccgacgcccaagccggcgctggccgacccggaggagccggagaacaacgccgccgggaacgggaaggagtacgagaagatcgagttccctgacctcaatctcgtggaggagaaccagatcatggtctccgagtacaccaggctgccgtgcgcggccgtggaaacgcagagctccgacagcctcctcacctcgtagcacggggacggcgccacgaccctgggccacgacgccggcgtgcgcctcgtggagagcttctcgacggacaacagcaccgccgactcggtgagcaccttccggagcgacacgccggtcagcagcgtgtccaccacggagtcccccgctgccgcggcgttcccggccacccctcagtccaacttcagctcggagccgtctgggaacgcccactcgtcggctgaccgcaaggagaagccggcgttggagaccaccgacgcggaggtcgcctcgtcccgcaccgtccaggaggtcccggcggcgaactcacccggcgccgcgtcggaggccgccgtggacaagccggtgatcagcgtcaacatcgagcaggaggtgaaggtggacgggaaccagatcatggacatgtacatgaagagcatgcagcaattcacggattccctggctaaaatgaagctccctgccttggacttggacatagacaatggtagcagcgggaggagtagtcctgcagcagccacaaccgacgcagaatccactggtgccgactcgatcgcggtgaagaagccagccgccgccgggaagcaggataagccatctcccaaggtgttctatggcagccgggcgttcttctgatctcctgtccgcttgagcactggaagcacagcgctccagccgccgagtaacgaagcaaagagacggcatttgcagtcgcctcagctgaatcttactagcgcagaggaataacaccttctcatgctcttgctctagatttgccagatagggaattaattgctcgtttcaatgtattagttgctcgtttcaatgtatcggtcagtacttatgaaaaatcgtctggtttccctcttttagggctagtttatggactctacttttccaagaaattttctgtttttcca

SEQ ID NO: 6245 - DNA, 1757 bp, Zea mays
  misc_feature (2)..(3): n is a, c, g, or t
tnngctcgctcgctcgctctcctccgctcgattccagtggccctgctcccctcgtcgtccctctcccgagcgagagcagcaccggcagttcggacaggagctgaagccttggaggagtaaaggtgtggtcttgccatggagcagccgcagcagcacaagggaggagcggttccggcgcctgcagcggcggccgcgaacggggccggggccggggccgcggagctgatcgggtacgtcgacgtgcacgtgcgtagcgcgcgggacatccagaacatctgcatctaccacaagcaggacgtgtacgcgcggctctcgctgccgggagacggcgcgccggcggcgtccacgcaggtggtcaacggcgggggccgcaacccggtgttcgaccagtcgctgcgcctcggcgtgcgcgcgggggacgtcgacgccgcgctccgctgcgaggtgtggatgctcagccgggtcaagaactacctgcaggaccagctgctgggcttcgcgctcgtgccgctcccggaggtcgtcgccgccgacggcggcacgctcgcccgcgacttcccgctcaccaccagcgacctcttccagaccccctcgggcttcctgcagctcgagctctcctacatcggggtcgtgccggaggtcgtgcccatctcgccgacgcccaagccggcgctggccgacccggaggaggaggaggagccggggaacaacgccgccgacggcgtcgggaacgggaaggagtacgagaagatcgagttcccggacctgaatctcgtggaggagaaccagatcatggtctccgagtacaccaggctgccgtgcgcggccgtggaaacgcagagctgcgacagcctcctgacctcggagcacgatgacggcgccacggccctgagccgggacgccgccgtgcgcctcgtagatagcttctcgacggacaacagcaccgccgactcggtgggcgccttccagagcgacacgccggtcagcagcgtgtctaccacggagttcccggccacccctcagtctaactccagctcggagccgtccgggaacgcccactcgtcggctgaccacaaggcgaaggcggcgtcggagaccgccgacgcggaggtcgactcgtcccgcaccgtccaggaggtcgcggcggcgaactcgccctgcgccgcgtcggaggctgccgtgcacaagccggtgatcagcgtcaacatcgagcaggaggtgaaggtggacgggaaccaaatcatggacatgtacatgaagagtatgcagcaattcacggattccctggccaaaatgaagcttccagccttggacatagacaacggtagcagcgggaagagcagtcccgcagcagccacacccagcgcagactccactggtgccgactcgaccgcggtgaagaagccgaccgccgccgggcagcaggagaagccctctcccaaggtgttctacggcagccgggcgttcttctgatctccggttcgctgatcagcggtagcacaccgctccagccgccgagtaacgaagcaaagagacggcatttgcagtcgtctcagctgaatcttactagcgcagaggaataacaccttctcaggctcttgttctaggtttgtcagatcggggatgagttactgtctttaatgtatccgtcagtacttatgaaaaatggtttggtttctctgttttagtaatgatatttagatccttttttctgttaaaaaaaaaaaaaaaatccatgtcctcaaaattcgtcggtg

SEQ ID NO: 6246 - DNA, 1209 bp, Zea mays
tgccctgtgaagtctgtgaccctcccccggcggctgtgctcccgggcgcgcggactttctgcgacccctctcgcgaccttgtctcgtttacgtgcgtttttaacaggaggctgattgctacgtacgcggtcaggaatggtgtgttttcttaacgcctttcaatactgcacgactctgctaccaacggcaacgcctttgaatactggactggaccgctagctagtcgctaacgcgcggcgaggccagccaaacaaggcaataaataaatgcacgcttagttaggtaaaagggcagagaaaggcaaaaccagatagaaaattaaaaagaactcttactactattactactaccctaacccccctttggagttggtgttatatatatgtctcgagcccccatcctgccgctcgctcgctcgctctcctccgctcgattccagtggccctgctgccctcgtcgtccctctcccgagcgagagcagcaccggcagttcggacaggttgagaatctgcttctcaattgcctcttctgctctgagatctcgccttttcttccggggatttgagcccttttgattttatcgggatggaaacctacgcatcgtgaactcctttcttgtggaggtgcagtgaagtgggttctcgaggtacttcagcagctgcgtggttgcgttgaatcgagtatgagtaggaggaatccccctcatcacgagtctgttcaataagcttgtggaggtggtgcgcacctccctccggttagtctgtctcggcgcggcgcactgtactgtagtagtagctagtaaggatctgccgacagtttcgcttcacctacttctcggatttggactatgcagctgcccctcccaccccggcgcagaattccgtagaagaagatgcatgatatttttttactattattatgggtttcgtctgtctgatttgttgcttccccctttgctgtggacgcagagctgaagccttggaggagtaaaggtgtggtcttgccatggagcagccgcagcagcacaagggaggagcggttccggcgcctgcagccgcgcccgcggagctgatcgggtacgtcgacgtgcacgtgcgtagcgcgcgggacatccagaacatctgcatctaccacaagcaggacgtgtacgcgcggctctcgctgccgggggacggcgcgccggcggcgtccacgcaggtggtcaacggc

SEQ ID NO: 6247 - DNA, 1459 bp, Zea mays
agagccgattcgtcagcacgaggttcatcagcggaaaaataatcatcatctccgcaattctgcttaaagtcgactgactgaagattgcagaggatgcgagtagagtagtgcaccatttttattttgtcatcttcagacttcagtaacataacagaagcgtcagaggactgaggtctgagcctctgaggagggggagggagagggacagagctacagaggatgctacgcctgcggttccggccagctcccctgtcactgaagctggccttcaccgtctccctcgccgtctccttctccgtctcctgctgcgcctcctcctcatactcgtcccgcacatcatccagatcgccgcaggccgtagccgcggacctcctctccgtgctcgccggccctcgcgccgcggcgcgggtaccggcggcggaggcctcgcggctccgcgcctgcctccggttcctcgccccggccaaccccacggcccaaaaggtctcgtcttggagccgcggaggcccccggaagttcctcctcgatggttgcgatgcgggggcggctgaggcggacgagatggtgatgtggccgccggccccggtcttggacctggcgcggctggccgttgactccggaggcgatcccggtgccatccaccgcgcgctcgacccaacaatgctgccggtgccagatgttgagggttcccagaagaataaatgccatctcacaagaacaccgtatgggaggcgctttgccaatgaggagatcaattcatattttgcattcttgttcgaattgattgtggcacgggcaccttcggttggattaaatgtatcactgaatcgctatgatttgttccatgggcatcttttccttgcatcggagacaggacggcttggaattctgttccatgctaaagaatacccagcatttaacaaggaattgtttccttataatttgggatattgccaggcaggatctaatgtaccatatgatgattcgatgaatttgcgcaatgtactttggttagcacctttgccatcaaaggagacaaaagcttggttagcaccaggagtactagttgtcttggacgcacatcctgatggaattatctatcaagagatgatacgtgactatgttcagattgttagaacagtatacgaagatgatcttggggagaacacagttgatgtcaattatctgaatgtggcaaatgcagctcccgtagatagaatttacatttgttgaagtcatatgtaccgctatttgttttcccatggtgtgatttgatttgatttctgagaaccggacgtcaatgcatcatcctcatgtccaccaaagcaattgttcccgttcccatgaccgctgctgtgtatttcacatgtttatttgtttaattaaaaatgctcaacgaagcaacgatttgttgttaaaaaaaaaaaaaaaataaaaaaacattcacaggtacactttt

SEQ ID NO: 6248 - DNA, 1650 bp, Zea mays
  misc_feature (1600)..(1600): n is a, c, g, or t
ttttggctccccgtcgagcctcatcggtaaggagtcgaggcgagtcgacccgaacaggaacctccgaaaccctgaccaaatcgcgaggcaaagccgcgtcggcggcggatggcgccgtccttggtcgtctcggcgaggcatgggcatgcccacgctgtgccccaccggagaggtcgcaggcagcgtgtggtcgtcgccagttccggtggcgccggtccgccgccgaagctggtgaccttcctcgggaagggcggctccggcaagactaccgcggccaccatcgccgctcagtattatgcaagtgaaggcttcaagacatgcctggttgttcagtcccaagatcctactgcggagcacttgatgggcagtaaaattgggaattctctgaccgagtgtgtggccaatctctcggccataaagctggagactggtaagttgctgcttgaacccctagaccgactgaagaaggtagacgcccaggtcaattttactcaaggaatccttgaagggattgtaggagaggagcttggagttttacctggaatggattcgatctgtttagtcttagctcttcagaagctccttaatttcttttcatctggaaggagtaattcacaatcagaatttgatgtgatcgtgtatgattgcaacaatacagaggaaattctacggctgataggtgctgctgaccgggcaagatcttacttgaggtatgtgagggaccttgctgagaagactgacatcggaagacttgcttctccttcattactgaaactaatatatgattctgcaaggccaaatggcaaaattagtggaggggagacttagtacagagatatgggatgaaattgtgccactacttgagaaaatctcagtatggtttgccgatccttcaaaacttgcatgcttccttatcatggatcctaggacatcaatctctgtatcctctgcattgcggtattggggttgtaccactcaagctggcggtcaaatatgtggggcatttggatacactgaagacccttctgaaatgcaccgagaagttgctcaaaatttcgtgccgttgtctttgtcttttctgccatttctcccgaatgattcttccgtggattggagcagagcactaagctcattgagccaaaatacaaaggaacagctgaggaatgcgtccacctgggtgtacccttcagtcagttttgattctgttcagaaatctgtaaccctcttcatgccaggctttgataagtctgaaatcaagctatatcaatatagaggtggatcagaactgttgatcgaagctggagatcagaggcgcgtcataaaattgccacttacgatgcagggaaaggtccaaggtgccaaattcgttgacaggaacctcgttgttagcatccggtagcagaatcgctggcgccggctgccggctgggattggagcaccccacttcagattggcagtttactgccgactaatgagcaggatcatcgggattgcatgtctgtttctgttcgtagcctgaattttgtggtgctgtttgtttcaactttcagccagagtgaagctgcatagtcctattattttttgaagaggttcgcgatanctcgagtaaatagtaaactggcagttttttgccctgcttttgtgatcagg

SEQ ID NO: 6249 - DNA, 770 bp, Zea mays
cactcctatgggcgattgggatcctcgaggccggccggggctcaattctcaatcaccactcgcccatcgtgggcgccgcccttctccccaatcctcatcctcgtactaccgccgccaagaacgctaccgccgccaagagcagcacaagcacccgtcgcatcaccgtcttcaatgaattcctctgtctactcgcctaccccgacttcacttgatagcccgccagacgcatctcgatgcttctgctccctggttcttagggcctgtggatgagaccgtgtccctgccgtccaaaaatcagcaggccctcatgctcatagcgttcatggatccaggaaaaggagacgccggtgatacttcaaccaccagagagcgtcggatggggaccaccatcgtacgggtccgctgggaccgctgctagcctactagggcagcaacgaattgacaggaatcataaaagcatatggaggaactatgtataggctacaaagaagcataagaagcatttttatagcagaagccaagtgttctgatgattttgttttttcaattgtgttttctgttattggttcagcatgcacatatattgacatgatttatggcatggcatctgccatctttgttatatttatgacatcgttcttgattgatgtgtgcgacatgaatgatggatctttttaacatcctgaccatcattgtgtcgctcattatcgtattttgtatatcatttatgggttcacggatatgaaatgacaggtttctttatttttggt

SEQ ID NO: 6250 - DNA, 802 bp, Zea mays
  misc_feature (762)..(762): n is a, c, g, or t
gccggccgggccgggaatctccgacgatgatcccctcgattcgcggcgccctcgcctccaccactccccaaccacccgacgccgacccccctcaattcacgcccccacctgctgcatcggctccctctggcgccccgcctcctggcccagatccgtgcaccccttgccctctccggactcgatgattcacagatccgcccagctgcccaggcactgactaccggcatccggatctcctgctccactgctcgccgcctcggggctctccggcgttggctcagcgcgacgggccccccaatagcctagttccggatcccccaaccgcccacgccccacaggtcaagcaccggccaccgatgtctgacgaacgagcgaactccccgcggatgcaggaggaggaggtgcaggagcgaccgccgaccgtccgcgtttcaccatccccttctccgatctcaaggaatcataaaagcatatggaggaactatgtataggctacaaagaagcataagaagcatttttatagcagaagccaagtgttctgatgattttgttttttcaattgtgttttctgttattagttcagcatgcacatatattgacatgatttatggcatggcatctgccatctttgttatatttatgacatcgttcttgattgatgtgtgcgacatgaatgatggtttttttaacatcctgaccatcattgtgtcgctcattatcgtattttgtatatcgtttatgggttcacggatatgaaatgancaagtttcctattttggaaaaaaaaaaaaaaaaagcggcc

SEQ ID NO: 6251 - DNA, 700 bp, Zea mays
attcaacgcatcacctccttcctcgctcctgtggtacccggaggcggaggcgccttgtgccgtcttgtcccggccgagaacgtgggacggttccgcgcgggctcgcgcggctctctggccaccagaccatagaggatctctccaaggtcacttcctcgctcatgtcacctaagggcgaccaagtctaggcggaggaggcagcgggtcgagggtcaccgaagaggtgatgaatggtgtgcgcccccgtctggaacaacttcgtgctccgtacacagaggacaatgtgctgtgggtggtgttgtcggccatgtacaacatgaggtgtgtgggcatagggttgtccgagaacgacctcattgtgggagtcgactgcgtggtgtatgaggcagtggtcctaggagacttcccaagaattcgccacccaccttcacacaagatattccagcttttcacatttgatacaagaccgcaagagacacgcaacccccgaatcctctgcatccagcacctcatcaaccatcccggaatcataaaagcatatggaggaactatgtataggctacaaagaagcataagaagcatttttatagcagaagccaagtgttctgatgattttgttttttcaattgtgttttctgttattggttcagcatgcacatatattgacatgatttatggcatggcatctgccatctttgtt

SEQ ID NO: 6252 - DNA, 1676 bp, Zea mays
gattgattcacaagacgtcgatcccaaaccctaaccctttcaacggttccactccaccaccaacctcatgtgtcggcgcccgccgccgcacccaacccctccctcctccgtctgctcccggtcctcgcgtagccgcaacctccctcgttgccccacactacccacgtccctagcgtcatgcagatcaaaaccaaggggcaggcggcgacagtggttcagagtccgccgctgacggccctgcgaggaacgggtagattcgcttggtgtccgggcggctccgcgtcgccgaatccgatagcattgtggatctggaggtaggaaaagggcttggtggtagacgtggaggacgatggcgttcatggtcctagaagtaagcgcgatggtctcctcaggcatcggcttcgtggacggctggttcttcccatcatagatcagaagaagactcgagtcataaaaaagttcatcattgttgcttgaatcccacgaaatggccgctggttcttctcatttcgttgtagcatgcctagatctgtgaaatggtttgtttccttcgcttcgcttgaatcccacgagtaagctgctggtatctagtttcaattacatacaaaagcttttttgtggtgatgataatgttggaatcgctggtgtaggatttgttatgtgaatgtgacaaatggtattcttgtttatgcacttttggatggccttcaaacatgtttttaataggaatttgtatgacatatttgtcactgaactgaaatatttgttatgattgtaggtcactttacaggtagcatacacttttagatcattattcttataattatgatattatgttcaattcctatttacatgatttgttgcatctttttgtcaatcttaatcttattttctttgatttattgcatcatccatttgaatatagacataaaaaccaagagctaaaatgaatattattttcagttctaggcggcatagtaaattctattttttcttataatgatgttaatcttgatggtttcacactatggttttaggacaattattatggtttcacttgggtaccgtttggttcagatatttgtaacgtaatgggtaagtgataacgttaaatcatgtttgttttagtctccccgtaatcagatcccatactaaaaattaatacgcgtactattcaaacttgttaccgatagtaatcgaatgtaaaccattacattaccctttgcgttacatttcttgaaccaaacagcaccttggtgtgcactgtgcaggcaagcggaggtttctaatcccttctgaggtaaggctacaccaatgagacattggagcccatgtcagaagaggtcacaattggtccaaccgtccaagcaatgtccgatgtgagagctggaattccatggaccaaagcaaatgagcaaggtcagtgtcaccgtggactattcccaaatttagtgttactgctaattctggttgcatgatttcataggtcaatagtggtcatcatatgaacggataggtaatataattattctaaataaatgtataatgaatgcttgtggtactagaattatgtcgtaaaattttgtatggctgtattctggtactagaaatgtataataattgttctaaagaaatgttagaggataaagaagtaagttacaaaaaaaaaaaaaaaa

SEQ ID NO: 6253 - DNA, 5140 bp, Zea mays
  misc_feature (3747)..(3747): n is a, c, g, or t
caaaacatacatcattgaactttaaaagcatataaccttcaatactaaataaaaagattagtattgtttaaatattagatactactgataaaaaagataaacaccattagctatattaccaccctctccaactgttttctgaactaattgtaaatgggcccatagtgtagtcgtcaagcatggaggcccgctcgaccgacctcctcgatcgctcaaatttggaaacagcggttgctactgaccggggtgagtgctgcgttgttggcgactgccctgttttttaatggattcagtgagagctaaaaagtgcgagactgcgagagaaatccagcaggtgtacgtacgtaaagcgagagtcgacgcgtgggcgcggcagacgcgagcctcccgccacgttggcctcgttcccgcgccacgcggccacgcctgcctgcctcctcaccttgggtatacgcctccgcgccccccgggcctccatgcgcgcgctactgcatctgcggctcatcaatccgtgcagtcccagagcaccccgtcttcccgctactcccgcaagggcgctcgtcgcttccttctccggggcgtggcaggcaccttctggtagagcgagagcgagagcagcgccgccggcagttcgcgctatggcgtcccagcaggtgttccgggctcagcagcagcagcagcagcagttcccggctcagcagcaggagtcccagccggggaaggagcacgcgatggacccccggcccgaggccatcgtccaggactacaaggccgccaacaagctcaaggacaaggtggcgctcgtgaccggcggcgactccggcatcgggcgcgccgtgtgcctgtgcttcgcgaaggagggcgcgacggtggccttcaccttcgtgagggggcaggaggagaaggacgcggaggagacgctgcgtgcgctgcgcgacatcgggtccgagacgggcgcgcgcgagccgatggccctgcccgccgacctcgggtacgaggccaactgccgggaggtggtggagcgggtggcgtcggcgtacggcgggcgcatcgacgtggtggtgaacaacgcggcggagcagtacgagcgggagagcatcggggacgtgacggaggcggacctggagcgcgtgttccgcaccaacatcttctcctacttcctggtgtccaagcacgcggtgccgcgcatggagcccggcgcctgcatcatcaacacctcctccgtcaacgcgtacaagggcaacaagacgctgctggactacacggccaccaagggcgccatcgtggccttcacgcgcgcgctctcgctgcagctggccgacaggggcatccgcgtcaacggcgtcgcgccgggccccgtctggacgccgctcatcccggcgtccttcggcaaggagaaggtggagcagttcgggtcccaggtgcccatgaagcgcgccgcgcagccggccgagatcgcgcccagcttcgtcttcctcgccagcaaccaggattcgtcctacatgtccggccagatcctccacgtcaacggtgcgtagtgcggcacttactagttactacgtacctgatgagtgatgactgatactatgcctgaactgttttttttttttaatctgcaggaggcgtcatcgtcaatagctagatacggaagctgttttgctgtcgtgtccaagtctaagggaacaaagcgagtgtccgtgtgtaccaggtagcagtgtcagtacgtgcacgcaggaaggcaaggcagggttcagttgtagcggtgtgtaatgctgtcagcacagcacttgtaaagaaggaacgtgtctgaataaatatgcgtccaagcatgaagacttcctccgtacgtggtttgcacaaaataatcgtacgtcccggtgcagtggtacttgctagtgcaccattctccccctcttttggacgagctttatcccggccgggacacgttcagtagaacactaaattcgaaaccaaggttcaaagttggtttagcaacacattaaattcgcatatgcatttgagccagatgaatcacgtcgatcatggttacaaccggacgtatagcagtgtgcaacttcaacattcaccacgctaatgagtcagcctttacctttatatattctaaaagcaaaatcacatgtcaacgcttatagcgctgatgttctctcgacactgtttagaaaacaaaaacaaaatatgcaaacaaaaaagacgaagctatcatcttcagccacggcgaagccatctgcttgcttgcgagtcaaaactggagacatcatcttaaagctccctcaaccttggttcttgctagcatcccgtatatggaacataagctgcaataatttgacaagatgtcggcaaaaggggtacacattgttgaacggaattgattagcgaggaatcaccttaacgcccacgtagaacgtagtaaatatgaaggcaagggaaggcagggctgcaagataggaaacgtgtatttaaccatgaaggctgttcagttgggccatgtacatctgactaaatggaatccatcacaagtggatggatgtgaaactgtaactcaccatccttcccagccattcttgatatcagaactttaatcccggatggccccacgacgtaaccaacaagatttgccacctgtgtgttaaacatctcagaaatagcacacatgtaactatgcacgaatggctgatgccatgtatagctgaaattttcctatttgattgcaatttagcaaatgatcatggcacacgagatcattggaacttcccattaaatataatagctaaacaaatggtttcatgtagtctcttgagcagttttcttggatgcctattgtttaatatttatatgcttttactggtaagagaccaagaacaattgtgttcttttggttgtgcattcagaaaaaaaaacatctagaacgtaccataagacagctgattgtcactgcaccagcaattgctttaaattcacggtgaacaagcatcccaagggaactagttgcctgcaaaaacatattttaaatatatgagatgctagccttcttaaatttccatgaagcatcttgaattcacgcaatgggcatggagttatttggatccattggaacttcccattaaatatattagatatctaagcaccctagcaacttcattccagcagatatcttgaatttttatatcgtatgggcatggagttatttggatcctcaattaatatgtcttccttaaaacttacaaattgaattaatttttcaaacaaagacggcaacttgacatgttttatctaaatttagcatcttgtagtagctgctctacatttctttcacactagaaattagtattctaataataaaaacaaggtgcttcagacaatctaatcattttttttttgtgaagcatttcttcctgaacgattttttttttgactggaggtagtaaactagtagctttaaagaaaagcagatgagctgcaaccatggcaagccgactgaatccttggaaaaaaaagtttacctgaaatttgctggacagagatttaaccaatatctctggaatgaaaaataagcaagtcaaccatgcccatgagataagtttccattctagatcatgccacactgctacaaacgtgaatatcacccagatactcagtagttttctttgagaaccaccaagaggaatgtataagtacctaaccaaccatttattaaaagaagcatgccagcttttccagaaactctcncagatcatggcaattatttatacaccttggcatgttttcaggagtctcgactcctccaaccagtgaccaaaaccggaagtagcgccaaataagaaagaatttcaaccacataaagtttaacaccccataactgatgatgaaaacctcaaaaggggataactgctgccatagccggcttactacaaaggcattgtagtggaaaaagtgtgtcatgccttccataagaaggaaactcaaaatccaccttagaccataccaagatatttgtgcaaatgaataatttttctgaggtacctctaactgagcagcaaatgcattgtatccaacaataggtccagcaatatacactggagcatatgtcaagtagcataaatacataagaaatgtatatctgtcaacactgagccctctttcctgcaaagcaaagtagcatgtctttccagaataacaaacctgagatctttgcatatgtttcttgaagtcaaaatgagaagaatgaattgtccagcagtaatcacatccaaagctaatcatccgtaatacaacaaaattgaagcatatgtgccacctgaatgtaccccgatagttgtctagaaaagccatattttgaccgaacaatgagaatgaatatccttcataaactcggttaagaataagaacggacaagttgaagctccaaatgaggcttgtgcaatacttataatgagcaaatagcttcactattgagtaattaatcagtgcaattaaaagaacaaaaacaacacaagcaccgtgaagataacataaatagctcaaggacagtatgagccacaacaaagcagtacctcgacctttcaggccatagcaatatctcaacgtattgaccagaatcagaaatgctcccattacaacagtcagaattggcaagttcccgcggaagtttctccattgcgcatccgacaggtcattcagatgacccgcaagtgatcccacgcgtagtccgtagagcctcccggaatattcgtgcgagaggcgaagcgacctccagatcacgacgaggtagaagcccagcgcgtagagtacgagcaccgcaagttccacccggttccagggcacgccgcccatctccgccagacctcaacccccgacctcgctaggcgtgcgtgggaaattggggagagtgagcagcgtgggagcagggcccctgctcggcgagccggtggggaatgcgcggctgtgtccgggcgcagaggcagcaaggcgactgagatccgaggcggaatggcagctggcagtggcggacgatccaggcggaggcgacaccggcgactgcggtgagaatggaagcctagaaggccccgggccggagctgctggccgttggatgtggtatttttcgccggtttcccggccgg

SEQ ID NO: 6254 - DNA, 2128 bp, Zea mays
ttttttttttttttttggcaacacattaaattcgcatatgcatttgagccaaatgaatcgcgtcgatcatggttacaacaggacgtatagcagtgtgcaacttcaacgttcaccacgctaatgagtcagcctttacctttatatattctaagagcaaaatcacacacatgtcaacgcttatagcagctgatgttctctcgacactgtttagaaaacaaaaacaaaatatgcaaacaaaaaagacgaagctatcatcttcagccacggcgaagccatctgcttgcttgcgagtcaaaactggagatatcatcttaagctccctcaaccttggttcttgctagcatcccgtatatggaacataagcttaacgcccacgtagaacgtagtaaatatgaaggcgagggaaggcagggcatccttcccagccattcttgatatcagaactttaatcccggatggccccacgacgtaaccaacaagatttgccaccataagacagctgattgtcactgcaccagcaattgctttaaattcacggtgaacaagcatcccaagggaactagttgcctgaaatttgctggacagagatttaaccaatatctctggaatgaaaaataagcaagtcaaccatgcccatgagataagtttccattctagatcatgccacactgctacaaacgtgaatatcacccagatactcagtagttttctttgagaaccaccaagaggaatgtataagtacctaaccaaccatttattaaaagaagcatgccagcttttccagaaactctccagatcatggcaattatttatacaccttggcatgttttcaggagtctcgactcctccaaccagtgaccaaaaccggaagtagcgccaaataagaaagaatttcaaccacataaagtttaacaccccataactgatgatgaaaacctcaaaaggggataactgctgccatagccggcttactacaaaggcattgtagtggaaaaagtgtgtcatgccttccataagaaggaaactcaaaatccaccttagaccataccaagatatttgtgcaaatgaataatttttctgaggtacctctaactgagcagcaaatgcattgtatccaacaataggtccagcaatatacactggagcatatgtcaagtagcataaatacataagaaatgtatatctgtcaacactgagccctctttcctgcaaagcaaagtagcatgtctttccagaataacaaacctgagatctttgcatatgtttcttgaagtcaaaatgagaagaatgaattgtccagcagtaatcacatccaaagctaatcatccgtaatacaacaaaattgaagcatatgtgccacctgaatgtaccccgatagttgtctagaaaagccatattttgaccgaacaatgagaatgaatatccttcataaactcggttaagaataagaacggacaagttgaagctccaaatgaggcttgtgcaatacttataatgagcaaatagcttcactattgagtaattaatcagtgcaattaaaagaacaaaaacaacacaagcaccgtgaagataacataaatagctcaaggacagtatgagccacaacaaagcagtacctcgacctttcaggccatagcaatatctcaacgtattgaccagaatcagaaatgctcccattacaacagtcagaattggcaagttcccgcggaagtttctccattgcgcatccgacaggtcattcagatgacccgcaagtgatcccacgcgtagtccgtagagcctcccggaatattcgtgcgagaggcgaagcgacctgcagatcacgacgaggtagaagcccagcgcgtagagtacgagcaccgcaagttccacccggttccagggcacgccgcccatctccgccagacctcaacccccgacctcgctaggcgtgcgtgggaaattggggagagtgagcagcgtgggagcagggcccctgctcggcgagccggtggggaatgcgcggctgtgtccgggcgcagaggcagcaaggcgactgagatccgaggcggaatggcagctggcagtggcggacgatccaggcggaggcgacaccggcgactgcggtgagaatggaagcctagaaggc

SEQ ID NO: 6255 - DNA, 1617 bp, Zea mays
  misc_feature (594)..(594): n is a, c, g, or t
tttggacgtgaaatgagttccttccctacattgtcatttgcttcccctgaaatttcactgtgcagttagattgatcaattagttcagtggtactctttaaacgggaagtcaagagaattccattctcaaaatttctcctttaataccttgttaggatactctagtattcacctaaatccacgtgtattgagttaggtttaaattaaactctaatttaaactccaatctaatttaatacacacagatctagatgaatattagagtatccaaacaaagtcaaaggctagtttggaaacttaaaaactctcgagaaaaatgaactaatttttcttctcaatcctctccaataataaaggggatttgagtttccaaactagttctaagtaacaaacgacagttccttctgaggttgtgtttctttcctatcaaacttttctggattgttaaacagtgacctcccatgaagatgtgcatccacatacagcttagccgatcttatatgaaacacatcattatcgcagcagatacgcatgattcttcagtaaaaaaagaacaattttgaaaaggatcagcaacggattcgtaataattttncacgacgtaaagaacaataaggaatacatacagcccatccatacacagttacaagtagaccctccgatactttatcaggctcctcctttttctctgaaccatcgaccatgtcaaaagaccaagcagaaggaccaaaagtgttatttgaatgggattttttttcttgcttggtgggtgcccgaccgacaaaatgacctttcccacttgaaaagttcagtgccctcatcatccatcaaccaatgatcagaaaagagatcatgcgaggaaggaattccttcacagtgaaaaccaaaaaaaaaaacagagcagaaaaaggaaccatactagtccgtaacacaaaaaaaggagtacaaagttccaagaacctcatatactcctacgtgagaacaaaaaccgaccgcacgttgaggatcttgatcgggctcgggcgaaacttggacgaaggctgaacatgtatgtgaaaatcgcatttacacggcaaaagattcacagattaaacgctgtttacattgggaagtagtacataggtacaggcggcgtacagcatgcaatgcaacatacaacgctgcatgcatgtgtgcacgtgtagttgattgagctcagcgccgcttgacgggatcgaagttagagacagcgacgacggcgccgacgatggcgacgagcacgacgcctccggagacgatgctgaggaggaagttcttgagcgacggcgagatcccgggcgcggcctccgcgacctccggcagcaccagcgccgccgccacggccgccgcggccgcccactccttggccgggtgctgcttctgatgcgcggacgacgcccggacgacggccatccgggtcgccgaacgacggggcgcgagcgcgacggcccggcgcgacgtcgcgttcctgccggcgcagagaggcttcccgagaccctgcgccacggacagagacgccgcgacggcggtgacggccatgggtcctgggctccgctcaggcgctgctctcgggacgtgtgatggcactggcaggagcggc

SEQ ID NO: 6256 - DNA, 2123 bp, Zea mays
attttgattatttgagaaacgatatgtatatttattttagcatggagtgaatattccactcccactgagcaactcaaaaaggccaaaacccttccccaggggccgtctcgctagtcgctactcactgtaccgcaccgccgccgccgtctcgcacacggggcacaggacgcgcgcgatcccctcgagtccggattgccatggccaccacggcgttcgccgccgccaggttcttccccgcccacctcgactcctccccacgcatcgcgccccaccgcgtcgggcccaccgcgaatctctccttctcaccgctttccgccaactcctcgtccctgctccgcctccattccccctgcccatccggccccgggggtaggctgcccccgccgccgcgatcgtacggcggcgccggcggatctggcgacgccgcgaactccggtggcggcgaaggccgccgcggaggcatcctcgggctcctcctcgccgggtgggccgcccgcgtcgctgcggacccgcagttccctttcaaggtgctcatggaggagctcgtcggcgtcaccgcttgcgtgcttggcgacatggcctcccgccctaacttcggcctcaacgagttggacttcgtcttctccacgctcgtcgtcggatccatcctcaacttcgtcctcatgtacctcctcgcccccaccgccggcgtcgccgccgccgcgtcgtccgccgcgtccgcgctccccagccacatgttcgagcccggcgcgtactccctcggctcccgcgtcgccacgatcatgtccaagggcgccaccttcgcggtggtcgggttcgcggccgggctcaccggaaccgcgatctccaacgggctgatcgcgatgcggaagcgcatggacccggcgttcgagacgcccaacaagccgccgcccacgctgctcaacgcggccacctgggcgctccacatgggtgtcagcagcaacctgcggtaccagacgctgaatgggatcgagtacctgctcggcaaggtcgcaccggcgccggtgttcaaggtgtccgttgttgctctccgctgcatgaacaacgtgctgggtgggatgtccttcgtgctgcttgccaggctgaccggggcgcagaaatcagacaagccagcgacggtcgcggaagagaaggagaggttgatagctgtgggcaatgccgcagcagatgccatcaacgaggcgaggcatggagagggtaagtaggtggtagaggagagagacgagtaagttgatggtgcatcatctcagactcgtttgctggttcttggacatagaccaagaaactcacctagtcacctgtagagttggttggaataaggagtggagtgaggttcagaacttcttttttaaaaaactctgtttgtggtttatcggtgttgatgatgacatgcttagtgatggtagaataaagtttttttttcctctcatgctcatttgatcgttgactcgatgggtagcctgtttgttaaataccttcagtttttgcatgcagtatatatgattctgaatggtactatgatgtccagatgagaggactcagtgacccaaaggggatttgttgatgatctagttaatcttgcactcgattataacaagtttgtacaggacaatatcaatttctattgtagtatctcattacggtcggacttaaccaaacatagtataatgttattggttaccattcacattataaacatgtgaaccaaatagtactctagtgttttcttaagtgcgtgaatggcttgtgcttacctaataatcaagattccagtattgaatgtcttactgatgcaaataaggccacagggccatgctagaacaatgcatgggtctaagatgtctgttggaagttggaactacatttaggtcttactgctacatttcattgttactgtcatgcttaagatcaagttgggaaaaaatatttaagggcttgttcggttcgctctcgatccatatggattgagtgggagtgggagtgagagtgggattggataagtttaaaccccaagcaagtcaaacttctttttaatttttttcaattacatccaatccatgtgtaatagaaataaccgaacaaaccttaaatcaagttgtacc

SEQ ID NO: 6257 - DNA, 1350 bp, Zea mays
  misc_feature (16)..(16): n is a, c, g, or t
  misc_feature (1350)..(1350): n is a, c, g, or t
gcacgagaccattacntagaacatcctaatcaaaaaccgccccaaaccaaaaaccgccgccaagtacttccccgcgcacctcgactcctccccgcgcatcgcgccccgccgcgccgcgcccaccgcgagcctctccttctccccgctctccgccagcccgtcgtccctgctccgcctccggtccccctgcccgtccggcccggggggcaggctgcccccgcccccgccgccagcgcgcccgtctcgcacgcgcagcacaggacgcgcgcgatcccctcgcgtccggatcgccatggccgccgcggcgggggcatcctcgggctcttcctcgccgggtgggccgcccgggtcgccgcggacccgcagttccctttcaaggtgctcatggaggagctcgtgggcgtcaccgcgtgcgtgctgggcgacatggcctcccgccccaacttcggcctcaacgagctcgacttcgtcttctccaccctcgtcgtcggctccatcctcaacttcgtcctcatgtacctcctcgcccccaccgccgccgcgtcgtccgccgcctccgcgctccccagccacatgttcgagcccggcgccttctcgctcggctcccgcgtcgccacgctcgtgtccaagggcgccaccttcgcggtggtcggcttcgcggccgggctcgcgggaaccgcgctctccaacggccttatggcgatgcggaagcgcatggacccggcgttcgagacgcccaacaagccgccgcccacgctgctcaacgcggccacctgggcgctccacatggccggcagcagcaacctgcggtaccagacgctgaatggggtcgagtacatgctcggcaaggtcgcaccggcgccggtgttcaaggcgtccgtcgttgttctccgatgcttgaacaacgtgcttggtggggtgtccttcgtgctgcttgctaggttgaccggggcgcaaaaatcagataagccggcgacggtcgcggaagagaaggagaggttgatagctgtgggcaatgctgcagcagatgccatcggtgaggcaagagatggagaggagggtaagtaagtggtagaggagaggaacagtaagatgatggtgcatcgtcccacgctcttttgcaagaaacctgtagagttggttggaatggaataaggagtgaggctcaacttcttttcttaaagtcggtttgtggtttgtcgctgttgatgattacttcctccgtttcgttttagttgtcgctggatagtataaaattaaactattcagcgataactagaaagaaacaaagaaacggagggagtatatgcttagaatgaagtttttctctcatccttaaaaaaaaaaaan

SEQ ID NO: 6258 - DNA, 1315 bp, Zea mays
ggcagccagagagacggagccaccagccacggagtgacggaggcactactagtgtcgtaacgacgccacgacggtgtgtctgactctgatctcgcatcgcgccgaggccctccggaatcccaatcctctcctctcccgcaagcaccccgggtctgctgcagcgcctcgtctccgtggtctggcatcagagtccccgggagaatggttgctctgtcggcaggagcgctggctccgctcgcaggtctgtctccgctgccgtcgtgcagcgcggctccgttgtactgccgcaggagtccgccacttctcaatgtcgccatcgccaagacgcggccagctgttcaccaatctgctcctgcaagcttccgaaaatgtgcagctatgtcagaacatggacgtcaggaactccggaccaatgagtaccagctggatgatgatgatgagccgttttggctggcagtggtcagagaccttgctgtgggtttcaagggattggtagctttcttagctgagcagccgaggcaactgaagcacctggagtggccgggctttctacacacgctgaagacggccacacttactcttgtattggtagctatgtttattgttgcattatcaactattgatgctgccctctgctacatgctggcctggctacttcgaaaatctgcctagaataatgctggaatatccatgtattgcttgaatatgatttagccagacaggatagtagcaggcactgcagctggaactcaagctcttgttgtcgtcgaggtcagcaatgttaatcagactggaggtagcaggaaggtggatcttgcacggtgtgccattttatttttgggaggattgagaaaatcaaaacagctgccctacaaatagtgctgatgtcatgtgatgcagatgctcatagtggcatttcaaagggttaattagatctgtgccattataactttgctgttttggaggcacaccgttacatgttgaggtccaatttaacagagaaagagcacatcatggataggatccgagaactgtgtgtagtgatttgtaacttctcttttatgttaagcagacttgcttgtaacttgttggtccgtcagctaggatatggagtatttttaagacatccggtctactttgtaggcttaacaagtcttccactctgatttctcattagtattggattggtgagttcttatctagattgtctgctgttgagctacaaaatgcaacttacatgcttttgtaattatgggaggctgcaaaattggattttatacatcagaagaaggatgcaaattttgcaaacatggtt

SEQ ID NO: 6259 - DNA, 1201 bp, Zea mays
gccggccgggtcgggcctggcgccgcccgcggcccgcccgggccggacagaacgccgccggccgcccgccggacccaaccctgtgcgtctcgctccgttggttatctgagagacggagccaccagccacggaggcactactagtgtcgtaacgacgccacgacggtgtgtctgatctcgcatcgcgccgaggccctccggaatcccaatcctctcctctcccgcaagcaccccgggtctgctgcagcgcctcgtctctgtggtctggcatcagagtccccgggagaatggttgctctgtcggcaggagcgctggctccgctcgcaggtctgtctccgctgccgtcgtgcagcgcggctccgttgtactgccgcaggagtccgccacttctcaaggtcgccatcgccaagacgcggccaactgttcaccaatctgctcctgcaagcttccgaaaatgtgcagctatgtcagaacatggacgtcaggaactccggaccaatgagtaccagctggatgatgatgatgagccgttttggctggcagtggtcagagaccttgctgtgggtttcaagggattggtagctttcttagctgagcagccgaggcaactgaagcacctggagtggccgggctttctacacacgctgaagacggccacacttactcttgtattggtagctatgtttattgttgcattatcaactattgatgctgccctctgctacatgctggcctggctacttcgaaaatctgcctagaatcatgctggaatatccatgtattgcttgaatgtgatttagccggacaggatagtagcaggcactgcagctggaactcaagctcttgttatcgtcgaggtcagcatcagactggaggtggcaggaaggtggatcttgcacggtttgccattttatttttgggaggattgagaaaatcaaaacagctgccctacaaatagtgctgatgtcatgtgatgcagatgctcatagtggcatttcaaagggttaattagatctgtgccattataactttgctattttggaggcacaccgttacatgttgaggtccaatttaacagagaaagagcacatcatggataggatccgataactgtgtgtagtgatttgtaacttctcttttatgttaagcagacttgcttgtaacttgttggtccgtcagctaggatatggagtatttttaag

SEQ ID NO: 6260 - DNA, 2015 bp, Zea mays
cccggttgtgtcccgcctctcgcggtcccgccccgttttctccaaggcagccgctagaaataccaccacgcggacgcgttcgcacgagccgcatcgcatccatactccactgcatctgccatcttggggaactctttggcctctggaaccggcctgcccagccgctcgatcgacgttcggcgaggaggctgatccggtctgttggatcggaggcgcggcgatgggggcgctgtcgcggccggaggaggtgctggcgctggtaaagctgcgggtggcggcggggcagatcaagcgccagatcccgcccgaggagcactgggccttcgcctactccatgctccagaaggtgtcccgtagcttcgctctcgtcatccagcagctcggacccgaactccgcaatgccgtgtgcatcttctacctcgtgctccgtgccctcgacaccgttgaggacgacactagcatcccgaccgaggtgaaggtgcccatcctccaggaattctaccggcacatctacaaccgcgactggcattattcgtgtggaacaaatcactacaaaatgctaatggataagtttcgccacgtatccactgccttcctggagcttggtgaaggttaccaaaaggcaatagaagaagtcactaggcgaatgggtgcaggaatggcaaaatttatatgcaaagaggttgaaactgttgatgactatgacgagtattgtcactatgtagctgggctagttggttatggactttccaggctcttctatgctgctgggacggaagatctggctctagattcactgtcaaattcaatgggcctatttttacagaaaactaacataattagggactatttggaggacataaatgagataccaaagtcccgcatgttctggcctcgagagatatggagtaaatatgcagataaacttgaggacttcaaatatgaggagaactccaaaaaagcagtacaatgcttgaacaatatggtgactgatgcactgattcatgctgaagagtgccttcagtacatgtcagccttgaaggatcctgccattttccgtttttgtgcaataccccagataatggcaattggaacatgtgctctttgctacaataacgtgcatgtctttagaggagttgtgaagatgagacgtggtctcacggcacgaataattgacgagacaaactcaatgacagatgtctatactgctttctatgagttttcttcattgatagagtcaaagattgatgacagtgatccaaatgctgctctaacacagagacgtgtggattcaataaagcaaacttgcaagtcatctggtttggtaaagcaaagggggtaccatttggagaagtcaccttacaggcctatgctgatcatgattgtcctcctgctggtagctattcttttcggggtaatgttctagctggccctttcttttccgcgatggagacttgagagaaactatgccaatcagatcctttttgtactgtgtattctccaaaggctgcagcaaattcggaagtactgactgtagatcgatacggctgcatgctactgtttccatgactccgttgatgctctcaattcgtttgttcattttattttctcgcgctttgtattgtttgaagctgttttaaggcagaaaatactatcgtgacatgtatgatgtatcctacgaacatgtgtctcagtttagttagcaatggctgcacctctgttcttaaggcgtcgcctaggcgtccgggcgatgggcgatggtctaacgcctaagcgctttgcccgcctacctcacctaggcgttcagaaggtgctccaacgtcttggaccgccttaccgctttaaaaactatgggctgcactgtagttattctatgtgttgtcttgttttcatatctgatatgtttgtgtttatcataactgtgtactctcccatggcgctaattatattcaatattatatgtatgtttagctaaattttaaaacatctaatgataatagttatgtactaaaaaa

SEQ ID NO: 6261 - DNA, 1838 bp, Zea mays
cacggggaccctcgtcgccggccgctggtgcagggacgccccgcgcccgttagaaatactcccacgcggccgcgctcgcagagtcgcaagagccgcatcgcgtccattaggtccatagcatctggaggggacccgtctggcgtctggcgtctggcgtctggcgtctgtctgggaccgggctgcccagccgctcgatcgacgttcggcgaggacgctgctccggtactccggttggttggaccggagggcggaggcgcggcgatgggggcgctgtcgcggccggaggaggtgctggcgctggtgaaattgcgggtggcagcggggcagatcaagcgtcagatcccgcccgaggaacactgggccttcgcctactccatgctccagaaggtctcccgcagcttcgccctcgtcatccagcagctcgggcccgaactccgcaatgccgtgtgcatcttctacctcgtgctccgtgccctcgacaccgttgaggatgacactagcatcccgaccgaggtgaaggtgcccatcctccaggaattttatcggcacgtctacaaccgcgactggcattattcatgtggaacaaatcactacaaagtgctgatggataagtttcacctcgtatccactgccttcctggagcttggtcaaggctatcaaaaggcaatcgaagaaatcactaggcgaatgggagcaggaatggcaaaatttatatgcaaggaggttgaaactgttgatgactatgacgagtattgtcactatgtagccgggctagttggttatggactttccaggctcttttatgctgctgggacagaagatctggctccagattcactatcaaattcaatgggtctctttttacagaaaactaatataattagggattatttggaggacataaatgagataccaaagtcccgcatgttctggcctcgagagatatggagtaaatatgcagataaactcgaggatttcaaatatgaggaaaataccgaaaaggcagtacaatgcttgaacgatatagtgacgaatgcactgattcatgccgaagagtgccttcagtacatgtcagccttgaagaaccatgccatcttccggtttttgcgcaattccccagataatggcaattggaacatcggctctttgctacaataacgtgcatgtctttagaggagttgtaaagatgagacgtggtctcacggcacgaataattgacgagacaaattcaatgtcagacgtctataccgctttctatgagttttcttcattgatagagtcaaagattgatgacaatgatccaaatgctgctctaacacggagacacgtgaattcaataaagcaaacttgcaagtcatctggtttggtaaagaggagggggtaccatttggacacatcaccttacaggcctatgctgatcatgattgtcctcctgctggtggctatccttttcggggcactgtataccaagtgatgcacttgtagctggcctttttcccctatggagacgagacaaactctgccaatctgatccttttcgtactctgtagtccccaatggctgcaggaagttcgaaattactggctgtagaagtgtagatcatacggcagcatgctactgcttccatgactccgttactgctctcgattcgtttcttcattatgttttctcgcgcgttgtatcgtttgaagctgttttaagcaacggaaaaaaataccatgtgacacgtgtatcctacgaacatgggtttctgtttagttagcagtgggcgcactgtattatgttgtcttgttgacatgtcatgttttcaaagctgatgtgtttgcgttcaaaaaaaa

SEQ ID NO: 6262 - DNA, 1665 bp, Zea mays
ggagtgcttcttgagcatgtttcggagccacaattcggcaggagataaggaacgattgtcctgcgccacctctaattgatgtaggagctccctagccatttcaagctgcagcttaatcttcccaacttttttgtcattccagctctgcagactcctagccgttgtctttaatttcttggccaaagtgataagtgggcaaggccctgctggaacaaacacccaagattgagctaccacatcatgaaatccctccatcctaggccaaaatgctagccatatataggtgtgataacctggaaagacacaaaactacctgcctaacaagtagaaccatgattttataaatatcccacattgaacagattgaagatggtagctaaaaaggtcatgttggcagtgcataccgtaaagatgtggctgaaaatttagccacgtatcaactataaagaagtagcaacagtagcaatcacatagtcacatggtggtgagacaaaccttttgataagaaaaaattcaaatggttagctgctgtagcatattaggtgtgatacaaagtgctacgtttagtgggaataaggatcgtgaaaactaagggcttgttcagttaatccatcccaatcctctccaatccccatgggtaagggattaccctaacaaggcctaggtaaatgcaagatatgcactatctatggaacgcaaaaaggataaaacagataaaaattagatgatagatacaacatttttttataggaaacaaaactttaatttcattaaataaggtatcgctgagggcctcaaatattctgccctgtaatacattacagcctttgaggaaattttttggttaaaaaagggaacactctggcttttaagaaatacatatatttacactgctattgatagcaaaaggatcaccatcagttccatacttctagataagatgcttgtgctgtaaactcaaattttaccttgagctctctgcactatctggtataaaatggagtgtacagtttaatatctatggaccaaagaatattaaccaaatatgtcattgttctgaaatagatttctcaatggctttcacataaacagcctttggcagtgtcccggtaatactatgtattttctctccatccttaaagagtaaaacagttggaatcctctcgatgctgtaagctgtagcaacctgtgggtaatcatcagtgtcaagcttgtagcattttattctcccagaatattcttgtgctatctcatcgacaatccgtgtgaccattctgcaaggtccacaccaggaggcccaaaactcaataagcacaggtacatcactgcagatcacatattcattccaagagcatgcagtgattgtttcagcgcggggagagtaggcgcagttcaccctcaccaccgccgtgcggcgcggcgttgcccgcctgatccgcgtcgtcgcagcgtccggccggtgggcccagcggcggcactgccaccgacgggcgtaggaggagccgtagcctacccttccgcgactggatgtggcggcggagggagcaggcagcgtcttggcgcagcggagcccacgcggaggcgcggggcaggaaagagcggcgacggcggccatgtctgtttcgtgtgtgttcgagctcgagtcgtcacggagaaatgcagttg

SEQ ID NO: 6263 - DNA, 1379 bp, Zea mays
aagaagtgattttatatcctgcattgagtgtaaagcatctaggaaaaaatttgttctttcagcaagcattatttttgcagtccttcattcatgggaaaccaaggagaaaaatctatgtgctggttacagcaaacagtttattgtgtgtgtgtgggggtggggggggggtcagtatttctctgactgttgtgaaatgtcgttttttatttaggttgaaactgttgatgactatgacgagtattgtcactatgtagccgggctagttggttatggactttccaggctcttttatgctgctgggacagaagatctggctccagattcactatcaaattcaatgggtctctttttacagaaaactaatataattagggattatttggaggacataaatgagataccaaagtcccgcatgttctggcctcgagagatatggagtaaatatgcagataaactcgaggatttcaaatatgaggaaaataccgaaaaggcagtacaatgcttgaacgatatagtgacgaatgcactgattcatgccgaagagtgccttcagtacatgtcagccttgaagaaccatgccatcttccgtttttgcgcaattccccagataatggcaattggaacatgtgctctttgctacaataacgtgcatgtctttagaggagttgtaaagatgagacgtggtctcacggcacgaataattgacgagacaaattcaatgtcagacgtctataccgctttctatgagttttcttcattgatagagtcaaagattgatgacaatgatccaaatgctgctctaacacggagacacgtgaattcaataaagcaaacttgcaagtcatctggtttggtaaagaggagggggtaccatttggacacatcaccttacaggcctatgctgatcatgattgtcctcctgctggtggctatccttttcggggcactgtataccaagtgatgcacttgtagctggcctttttcccctatggagacgagacaaactctgccaatctgatccttttcgtactctgtagtccccaatggctgcaggaagttcgaaattactggctgtagaagtgtagatcatacggcagcatgctactgcttccatgactccgttactgctctcgattcgtttcttcattatgttttctcgcgcgttgtatcgtttgaagctgttttaagcaacggaaaaaaataccatgtgacacgtgtatcctacgaacatgggtttctgtttagttagcagtgggcgcactgtattatgttgtcttgttgacatgtcatgttttcaaagctgacgtgtttgtgtttaccagaattgtgtagtggagaacaacatttgccgcgttgaaaaaaaaaaaaaaaaagcggcc

SEQ ID NO: 6264 - DNA, 3459 bp, Zea mays
gcggtgataggcagcatcggtcgccggcggcttcttcacgggcgtgccgccggcgtgcgcgcgcgtcgtgccgcgggacagcgaccgcagcaactgcctgcccaaccgccccgcccagcggacgccgcagcagtgcgccgcgttctacgcccgtccacctgtcaactgcgccgcgttccactgcaagccgttcgtcccgcccatgccgccgccgcgactcccatcaccgcccccgccgatgctcccatcaccgcccccgccgcggctcccatcaccgcccccgccgatgcttccatcaccgccgccgccttcgccacctccaccatcaccaccgccgccgtctccacctcccccacttatgtctcctccgccgccatcaccgccaccgccgtcaccaccgccacctccactgctgccgccaccaccacaaccacattccccacctccaccgttgtcgtcaccaccgccaccaccaccactgccacaaccacattccccgcctccaccgttgtcgtcaccaccgccaccaccaccactgccacaaccacattccccgcctccaccgttgtcgtcaccaccgccaccaccaccactgccgcattccccacctccaccatccccagcccccgcgccagtctaccacccgccaccacccaccaccgtgcccaccatgccccgtcctgccgccaccgctaccctgcacaccaacgcatccatggccacctccgccaccatattaccccggcccattcccacccacagaccctgtccgatacgcatcacctcctcccccacagcagcaccatccatggccatcagtatacccagttcaatatggatcgccgccgccccctccgctgcattgatagaaagaatctcagacgcacggaacggaaggatagttggttctgctcttgcccctccggccatggctaccacttgccagattcaccagtgtacgtggtcattgtcatgcttagcaaatactgttggttgatggctgcatgcctcgagagcgcgtggtaatctccacagaattttgtgaaatcatggtctgtcggtgtcggtcgttggtgctgaaagggattgaattgaatgtgacggggtggtctgctgggtctcttcggagcgttttaggcttgggattggtggttaaaattggctgtgaataaagaagagtttgagagggacagcagaggaggggattgtattgtaggtgcagggatatatcatatatctgggtgtatagagaagtttcagctcagttgagttcagtcagacatcaaagtttagaccaataaatttccagtgcccgtttgttccttttgtaccacagttatcatcggttattcatccttgtattgtattgttcagcccccttttttcagcgttaacatttttatttatcctttcctggattctgcttattatctgccacttgctagtcttgttattgtttttaaatgatctttgtttttcccccctttccttttctgtgttctgttctcttctagctattcattgaatatgcagtttactaaattgcagcagaaacatgttctggatagcagcactcctcatttcgcacctgttcctggtttgcacattagaccgacctgtaatatttaggggatggactggtttgtgtctgcctctatggttggaatggcgctgagaacattagcgttagttgatctgattgcgacggggactgttaagagtttgggttatgttaatctgcacttagcttggcatgttgttttttatgttttacattgttcgcttggctttaatctatatcggcttctacaatgtttttgtctatatgaattgtagctgcacagtctaaatccatagcaaacagctccgacggcggtgcaactttcttgaggatttggtgtcctttgtctcgttattaaggtatggccgaggtgctgtgatatcccgtctttcctgccatgtgcttgcttctgaagtatcttggtcaggaggactcaggaatactcttttttcccttcacttcaccctaagaacatcgcttatgatttgtcaacagcgataattgttgtccgagaagcattttttttttgccaggtcttgcctgctactgccatgatgttcttcatactgcagctgagcagggctgcactatgtatgaatcttctttgagcagtacccccccccccccccccccccttttctgcagtttcttaatcgctcgctaatcctggacccggacctgaccggttggttgctggttggaatatctgccggccttgagagctgccaagttgcgcgcggccgttgtttaagcgtgctccccatttgtccagaaagcttgcgactgtgatgtttgtttttaacccttttgcttttagcggactgagagtgctgtcggtacttttggtcaattagataaactaatgcaggtggtgaaactaccgcaggtggcggcagcccttgtcgctgccagtgtgatccctcatgccactgtcatcgactcatcgtacgccaatttgaagtgggggcaaccaggttcgtgcgcctaattgtatacgcttcacccgcaaaacttgccttcgccacggcccgtggacatcaccatcctgcaacagtagacaaagcagctattcgtgagtcgtgtgactcggcgtctcttgagcacgcacggggcagggaactctactgctagtgcatgctagagacaacgcttggatgctagacgaagacgccagcgcgctaggtctaggtggcgaatgagtgtgggtgatgcggtgctctggtagcccgtgaaagcagaaattgtttcacgcaatgattttattatatatcgacggaaagaggtacagtcgagacagagatttaaccacatcttcctaaaatatactcctccacatacatgtagggatgataataaatcacaaactaaatatttcttcgcagtagtaatagaggataatcctaatcagatttaatccttaaattgtatagtgtaaaatatagacttcattaccaccctacatacaggatgtctcaaaccattacaccaatacactataacacaattatttaacattttctcaacactgtcttaaagtttaaaaaatcatagactatttctactaccacaatacatattattattaagttatgttgtttaaaaatagtaatattgtaaagaaataaagtaattaaaaatgaggggggttagacctccccatgcatggccacatgggggaggtgcatgggagagattagacctcccccatatataggggcgttaagagcaaatccaatagttatgtaaattttagctctctaaagcaaagatttaagaagttgctaaataactttggaagtaaaaaatgtgagttctcccaatagttctctaaatataggttgtaattttgttttgtatctatccacataaaaaaataaagtcacaaatgtcatcaatta

SEQ ID NO: 6265 - DNA, 889 bp, Zea mays
ccggccgcgttccactgcaagccgttcgtcccgcccatgccgccgccgcgactcccatcaccgcccccgccgatgctcccatcaccgcccccgccgatgctcccatcaccgcccacgccgatgctcccgtcaccgcccccgccgcggctcccatcaccgccgccgccttcgccacctccaccatcaccaccgccgccgtctccacctcccccacttacgtctcctccgccgccatcaccgccaccgccgtcaccaccgccacctccactgctgccgtcaccgccaccaccacaaccacattccccgcctccaccgttgtcgtcaccaccgccaccaccaccactgccgcattccccacctccaccatccccagcccccgcgccagtctaccatccgccaccaccaccacagtgcccaccatgccccgtcctgccgccaccgctaccctgcacaccaacgcatccatggccaccgccgccaccatattaccccggcccattcccacccacagaccctgtccgatacgcatcacctcctcccccacagcagcaccatccatggccatcagtatacccagttcaatatggatcgccgccgccccctccgctgcattgatagaaagaatctcagaagcacggaacggaaggatagttggttctgctctcgcccctccggccatggctaccacttgccagattcaccagtgtacgtggtcattgtcatgcttagcaaatactgttggttgatggctgcatgcctcaagagcacggaacggaaggatagttggttctgcatgtctccacagaattttgtgaaatcatggtctgtcggtgtcggtcgttggtgctgaaagggattggattgaaggtgacgggtggtctgctgggtc

SEQ ID NO: 6266 - DNA, 2805 bp, Zea mays
  misc_feature (2661)..(2661): n is a, c, g, or t
tgggtacctcaaggcggccgggatccgttttctttgcgcgtctcccttcccgagtcgcaggttcgcacccctggcgctgtcgccgtctgccgagcccgcagcccggaaaaggggaaggcggctacgcaaacgcaaggcaccccaccccgttcaccgcagccgaatcaattaaaaagccggcggcgagaaggtgggttggggaatctgaagcgatcagagaaggcaagcttgcttgcttgcttctccaccgaatcccccatctcgcgccctccgtctctcgccgcggagactcgcccccccgctgatggaccagctcgtcaatttcatcatccgcccgcccagagctgactacagtccaaatgatgatctattagagcaggagtttatgctgaagggaagatggttcctgaggaaggatttggaggacaaacagacggggcacgcgactcttcgctgcaatagtggtggcgacctctacacctacccctccaccacagctccctcctgcagtctcgccaccacgtcgtctctgtggcatcatcgcctcggccaccccggtccttccagcctcgccaaacttcgaagcatgtaaaaaatggtcagggcaagaagttacaatgtagtcactacatgcctgttgtgattcctgaaggaaaagctcttccttgtgtcatatattgtcatggaaacagtgggtgcagggctgatgctagtgcagccgctaccattcttctgccgtcaaacattacagtctttacactggacttttcagggtctggactctctgaaggagagcatgtcactttaggctggaatgaaagagaagatctcaaagctgtggttaactatttgcgaacagatgggaatgtatcttgcattggtttgtggggtcgctcaatgggtgcagtcacaagtctaatgtatggagcggaggatccatcgattgcgggaatggttcttgatagcccattctccaacttggttgacttaatgatggagctagtggacacatacaaatatccactgccaaaattcactgtcaaacttgcaatacagcatatgcgaaaaattgtcaagaggaaagctagtttcgacatcatggatcttgataccattcaggtagcaaaacaatgttttgttcctgctttgtttggacatgcaactgaggatgattttatacttccccatcattcagacaagatatatgaatcatatattggcgacaaaaacattataaaatttgatggggatcacaattcaccacgtcctcaattctactttgactcaatcactatatttttccataatgtgctaaaccctcctgaagtggcagaggatcattatttcatgacaccacatggtagccttggtcagggtcattgggatacagaacaagacatagagtatcggttctctcaatcacctacagggacagccaatgctactacaacagaagatgccattgcacagttgcgctctagaaggctcatgagtagaatggaggtcccatctggtgccaccaccgaagacaggactgatcgaactgagggtttcgatagtgatcttggtccctcttcatctagtgtatcaacagcaactcctcccaatggtcgcaacggaaggctgctgactccaacctctgatgatggcgagtatgtggagtactcatttgatagcttgtcagatatgcctcacaccgtggaagatgaagatagaatgctaatgcaagcaattcttgaatcactgaaagactatgaacagtcgaatacaaaaaatgtgcaatccactgcatctgatcctgcatctgatcctgcatctaaagccaatggtactgtaaaagactgcaatggtgttgctgcagcagcattggagcaagatgcatcctcatttgatgctcctgacaagcatacgaatgtccccaacagtggagaaaaagtcagcgaagggcaaagtacagattgcaacgccggaaagagcagtgcttcggtctctgcttctggttcctcagagcccctggcaccaacacagatggtgaatggacaacctgcttcggtagactcccagaaagtgacccagaatgccaatggagaggatggcacaagagcaactttggtagttcagaagagccggacaggcggcctgatagaaaaatggggttccttcttcaagaacaacgactaaggcgaggaaagatagacgatgacacctttgacaatacgtgttccgttgtgttcatagtcatagaatcgccgttggctgatgtccagcttgattggttttacgtgtaaaatggaaaggaaacaggtgatttcaggacgttcgtgtgtatatagaaggaattgtagcgcccccattgatttataccatctctcaacttccactactttcggttgcggtgaattggcaagacctttgttcttactaatgtgctgtagacttgtagcataatttgaaagctgattattttgtagttttttaaatagtaaagggtaatgtgcctcttaacgtaaaaaaaaaaaaaaaaaaattatccccccggacacccctcgatccatctttgtgtacttccgaggtctgttctatgacaccggcaatgaccccgagggcggatactacgcaagaggtgctcgcgcatcggtctgggagaacttcaagaacaancccgctgtttgacatctcgaccgatcacccaccaacatactacgaagacatgcagcgctcggtgttctgcctctgccccgttggctgggcaccgtggagtcccaggctagtcgaagccgtggtctttggctggctcccgggatc

SEQ ID NO: 6267 - DNA, 2227 bp, Zea mays
cctgccggatccgttttctttgcgcgtctcccttcccgagtcgcaggctcgcagccctgcgctgtcgccgtctgccgagcccgagcccggaaaaggggaaggcggctacgcaaacgcaaggcaccccaccccgttcaccgcagccgaatcaattaaaaagccggcggcgagaaggtgggttggggaatctgaagcgatcagagaaggcaagcttgcttgcttgcttctccaccgaatcccccatctcgcgccctccgtctctcgccgcggagactcgcccccccgctgatggaccagctcgtcaatttcatcatccgcccgcccagagctgactacagtccaaatgatgatctattagagcaggagtttatgctgaagggaagatggttcctgaggaaggatttggaggtaaaaaatggtcagggcaagaagttacaatgtagtcactacatgcctgttgtgattcctgaaggaaaagctcttccttgtgtcatatattgtcatggaaacagtgggtgcagggctgatgctagtgaagccgctattattcttctaccgtcaaacattacagtctttacactggacttttcagggtctggactctctgaaggagagcatgtcactttaggctggaatgaaagagaagatctcaaagctgtggttaactatttgcgaacagatgggaatgtatcttgcattggtttgtggggtcgctcaatgggtgcagtcacaagtctaatgtatggagcggaggatccatcgattgcgggaatggttcttgatagcccattctccaacttggttgacttaatgatggagctagtggacacatacaaatatccactgccaaaattcactgtcaaacttgcaatacagcatatgcgaaaaattgtcaagaggaaagctagtttcgacatcatggatcttgataccattcaggtagcaaaacaatgttttgttcctgctttgtttggacatgcaactgaggatgattttatacttccccatcattcagacaagatatatgaatcatatattggcgacaaaagcattataaaatttgatggggatcacaattcaccacgtcctcaattctactttgactcaatcactatatttttccataatgtgctaaaccctcctgaagtggcagaggatcattatttcatgacaccacatggtagccttggtcagggtcattgggatacagaacaagacatagagtatcggttctctcaatcacctacagggacagccaatgctactacaacagaagatgccattgcacagttgcgctctagaaggctcatgagtagaatggaggtcccatctggtgccaccaccgaagacaggactgatcgaactgagggtttcgatagtgatcttggtccctcttcatctagtgtatcaacagcaactcctcccaatggtcgcaacggaaggctgctgactccaacctctgatgatggcgagtatgtggagtactcatttgatagcttgtcagatatgcctcacaccgtggaagatgaagatagaatgctaatgcaagcaattcttgaatcactgaaagactatgaacagtcgaatacaaaaaatgtgcaatccactgcatctgatcctgcatctaaagccaatggtactgtaaaagactgcaatggtgttgctgcagcagcattggagcaagatgcatcctcatttgatgctcctgacaagcatacgaatgtccccaacagtggagaaaaagtcagcgaagggcaaagtacagattgcaacgccggaaagagcagtgcttcggtctctgcttctggttcctcagagcccctggcaccaacacagatggtgaatggacaacctgcttcggtagactcccagaaagtgacccagaatgccaatggagaggatggcacaagagcaactttggtagttcagaagagccggacaggcggcctgatagaaaaatggggttccttcttcaagaacaacgactaaggcgaggaaagatagacgatgacacctttgacaatacgtgttccgttgtgttcatagtcatagaatcgccgttggctgatgtccagcttgattggttttacgtgtaaaatggaaaggaaacaggtgatttcaggacgttcgtgtgtatatagaaggaattgtagcgcccccattgatttataccatctctcaacttccactactttcggttgcggtgaattggcaagacctttgttct

SEQ ID NO: 6268 - DNA, 868 bp, Zea mays
cccaagatggtccagggcgtggacgacatgctggcctacgacatcccggacctcctgaagaagttcaggaacccctacgactgaagccggaaacccactctcttgcctcctcctcctccttagggaggggtggcagagcttcagcgacggacgaggaggacgtgccggtgcagcagcggttcatctggtcagggaagagaaagatgcggcgcctttttcacgactccatcatctctcttctggattactctcagtgctgcagcgtaaactcgcgcgcagttccctgtaaaagctggagcttttctgagcgtgtaggtgcgttggtggaacttgggcccccagtcccccacccaagatctcacctatctgcactgggctggccggctgggcccgccgccaaccaccgtgcttccgccattgcgtcgccgcataaccttggctaagcgtgaactttgtcacaacaaccacgtttggcgtttccatgcttgtcctgggttcctggcaatccctgtattaatccgtctgccattgcattatcttgcactgactgatcttttccaaccgaaggatgtggtggtcggtagagctaaaagttaagttggaccctgtcgagccgaggcactccgggccctcgggttcatcgtgtttcaggtaattttttttcggggccaacacgatatggaataatttcgggctaagtcgccatgcccagaagctaagactagtccagtccaaacacggaacggcatgaaaaaaaaacctgtatatatctagaaaaatacatcatcacattattcataactttgttatagattaaaaaaaaaatcaaatgagaaaagagacatcaatgtttaaccattttgttatc

SEQ ID NO: 6269 - DNA, 1155 bp, Zea mays
ctgaattcctgggtcgacccacgcgtccgctcgagaagttgcagctccccacaatggaaggtctggctaaaaaactaaactctgggagcaagatcgagtctgctattgttgcatgtcatccatcagaagcacctactatgactgccagctggtttaactccaagtcaggaaagaagattcctttgaaatcagtcacttcaatcgtcgatgggctaaagaaatcgtacattgagaagttgaggcccttggaaaaaacctatcagttccatgacttcgtgtctcccttgctgactagcagcgatttcgatgcgaagccaatggtcatgctgttgggtcaatactccacggggaaaacaacatttataaagcatttactaaaaacaagttatccaggcgctcatattgggccagagcctacaacggacaggtttgttgtcatcacttctggaccagacgaaagatgcattcctggaaacaccatcgccgtccaagctgacatgccatacagtggcctgtcatcgttcggaacagcatttttgtccaagttcgaatgttctcagatgccacatccactgttagagcacgtgaccttcgtggacactccaggagttttatcaggggagaagcagcggacgcagcgcagctacgatttcaccggagtcacgtcgtggtttgcggccaagtgcgacctcatccttctcctgtttgatccgcataagcttgacatcagcgatgagttcaagcgtgtgatcgggtctctccgcgggcatgatgacaagatacgcatagttctcaacaaggccgaccaagttgatgcacagcagctgatgagagtgtacggagcactgctgtggtcgctcgggaaagtcctgaacacaccagaagtcatgcgtgtctacataggttcattcaacgacaagccgatcagggagacagcggctgggccgctgggcatggagctgttccagaaggaacaagatgacttgctctcggacctgaacgacatccccaagaaggcctgcgaccgtcggatcaacgagttcgtgaagcgggcgagggcggccaaggtccacgcgcacataatcagccatctgaagaaagagatgcctgcactgatgggcaaggcaaggctcaacagaagctgctcgacgggct

SEQ ID NO: 6270 - DNA, 2649 bp, Zea mays
cgccggccccggagctgccgctggtagacgagatgttcgaggccgtccgatcccgtggcgctggcgtccatgtggtccctacctttgctggatggttttcgtggaaagaaatccacccagttgagaagcagaccttgccttctttttttaatggaaaatctgagaagcggacacctgaggtatatttggcggttagaaattcgatcatgatgaaatttcatgccaatcctcaattgcatctggagtccaaagacctggctgagttgtcaatcggggagaccgatgctcggcaggaaatcttggaattcttggatcactggggcttgataaatttccaccctttcccaccagatggacatgaggagagtaagccagaggagacccaagacaattctaatgacgagaaagcttctttgatcgagcagcggagagctcactagtccccccccccccccatgacgcctttaccaatgaaagaagatgtgagagctccgcctcctctgcctagcttgattcctgaatctgtactcattcaagatgtggttgcagcagctgagccttctgttgagtaccactgcaattcctgttcagttgattgctcacggaagcgctatcattgtcggacccaggcagattttgacctctgttgtgattgctataatgaagggaaatttgatccaggcatggccaaaaccgatttcatcctcatggattctgcaggagtttcaggtgctagtggtactagttggacagatgaggaaacattacttctattagaaggtttggaaatttttggtggaaaatgggctgagattgctgaacatgttgctactaagacaaaagcacaatgcatgttgcactttcttcaaatgcaaattgaagaccgcttccatgatggcaaagatattaatcaaaacatcccagtaagtacagagcaagccacaactgagaaagccattgctgaaacatctgagaaaatggaagttgaagataaagtggaaggaagaggtactgtggatgaaaaggcctcagagaaaacagagggaaactgtgaagaaacaaaaactgaaaatgccagtgttgttgtaaataaagatactcagaattcagatggcagagattcaggtgcatctccaagcactgaagagccaaagcaatcttctgatgagcaacctgtagtaaaggaaaattctgcagatgtagatacttctggtgaaaaactatcaaatgttgctattgatatcctaaaatctgcatttgaggctactggtcacagcccagaatatgaaggttcatttgcggatgcaggaaatccagttatggcactagcagcgtatttagctggtcttgtggaagatgataacaccaccacttcattccgtagttcactaaaatctgtatctgatgtgtctcctgcactccaattatcaagtaggcactgttttattcttgaggatccgccagatgaactcaaagacatttgtgctagtgtaagtaagaaaaatagagatggtgataaaaaacaagatgaggatatgattcaaaattcaattgatactgagaaaaaagagatcaatgagaaagaaggtaagtctttatctgtggaaaagaaaaacaattcatccatgtcacaacatgaccaccaagaatcaggcattaagagcgtctcaagtgatgattgctccttagtggagccaaaaaccaataatgctaaggagtcaggtgattcaactgctattggggacaagagtgcaaccgaaactacaaaaggtaatactgaacaagtgaatgacttgccaagtgttgaggtggaggctcctgatgattcatcttcaaaaggtaaggatgagctcaataagactaaagatgcagtggggacaccagctaccgtacaggaacagaaacacagccaaacattgggaaatggggatagggaagaacctaacaacattgaaagtgtagttgtcgatgaagagaagggctctgtagtgactgccaaccgacctgattccatagctaggctcaaaagagcagcagctactgctgtttcagcagctgctgtgaaagctaggtttctcggtgatcaggaggaatatcaaattcgaaggctgacagcacttgtaatcgaaaagctgttccaaaaaatagaagtgaagatgtcgttgttttcagagattgagcaggtggtctttcgaacgagagagtacaccgagaagaccagaaagaagctcctgaaggaacgaaatgcgattattgcagctcggatgggcgcattgccgtctaggccaaaccagccaggtgtagccggaaacaggttaccacctgggtatggcaaccctcctgtaaggcctccaaacgcaatgcctcggcccaccagctgaggaaattccggattccggacacccagtgatctataccccattcttttagaagcataccccaaagactcaaacctgccagcttgttgtagcattttttagaaagtacattgtacaattgtctgtataactgcttctatgaaaattcaccaaacctccacaactgttttaaacattccatcagataggaaaattacatttctctacaaaaaaaaaaaaaaaaaaaaaaaaaaaaaaaaaaaaactcgaggagggggcccggtaccaaaaa

SEQ ID NO: 6271 - DNA, 943 bp, Zea mays
  misc_feature (9)..(9): n is a, c, g, or t
cggccgggngtgggctccttcctaaatcagcaaatcctatcttgtccgctgcccccgccgccccgcggttgggtcgtgtcgtgtccccacctcgtcttcgttctgctcctaccaattccagtcccagccatccgcccgcccaactatggcggcaacggctctgctactccccagcctcgcggcgctcacggacacgccgcgccgcgcccacaggttgctgcagccgcagctccagctccagcgcggctcccttgtctctcggtccctccggcctccgcggcgtcggcggctcgcggtctcggccgtgcaagagacgaaggagggggaggccaagacggccgacgagataaccgagaagtacgggctcgagttcggcctctggaaggtgttcagctccaaggaggaagagggaggcgaggggaagaagtcgcggacggaccaggccaaggaactcctggccaagtacggcggcgcgtacctggccacctccatctcgctctccatcgtctccttcactctatgctacctcctcgtcagcgccggcgtcgacgtgcaggacctgctcgcgaaggtcgggatcgtgacaggggaaaccggagggaaggtcgggaccttcgcgttggcctacgccgcgcacaaggccgcgtcgccgatcaggttcccgccgacggtggcgctgacgccggtggtggccagctggattggcaagatcaggaagggcggcgactgatgcgccgccactcaagtacacctctcactgaatcatgtagtctatgcaaatagccatacataagcttatataggtgttctactagccggtgccagcgaatctatctggtgctgcttttgtaaaagctgttcaatgacgattttgaacaaccagttatgaatggcgagtggagagagtttttgaactaaaaaaaaaaaaaaaaaaaggccccta

SEQ ID NO: 6272 - DNA, 2509 bp, Zea mays
gcacgagaccattacctagaacatcctaatcgaaaagccttcccctctcggtcgaaaccacaacggcctcttccggcataacaatatgcaccgaatattcagctcatccgctctcctataaaaacgaagcgcaaatccaaaaaaaaaaacccgcccgcacgacgcattgtccgttccgtttggacccatgatatatctcgctgggatcttgaccgtgcgcgagacgaatctcctcgtgcggtaaccgataccccccaagtcaaaaatcagcccataaaatttttatgggcggaggatcacccgtcgccgcagttcaggacgcgagcgacgacggcgccagggtcgtggtgctagtcgcgggttctcccgtcgattccgcctccgattccctccctcctcccgttgcggcgactcctgctcctgcggcggaggccaagcaggagtcggtgtcggagacggaggaaactaagcaggcggcggcggcggcagcagcagcaacagcggcaggaggtgtgcaggccatggcggtcaccgtagtgcgggacgtcgagacgggcctggacgcgagcaccagcgaccgggacggtgacaagccttcctggttcacacctaagagattacttgtcatgttctgcattatcaacatgctgaactatattgatcgaggagtaatagcaagtaatggggtcaatggtacccgcaaaagttgttctggtggcacatgcacctcgggctcaggaattcaaggagacttcaatcttaataatcttgaagatggtacactgtcctcagcatttatggttgggttgttggtgtcttcgttgatatttgcaagccttgtaaaaagatataatcctttcaggcttattggtgttggcttgttagtgtggactatcgcaacagctggttgtggagtatcatttgatttctggtcaattactatatgccgcatgtttgttggcgttggcgaagcttcatttataagtctcgcagctccattcattgatgacaatgcaccggtagctcagaaaacagcatggcttggtatgttctacatgtgtataccaactgggatagcattaggctatgtttatggcggactggttggaaaatatctgaactggcgtgctgctttctggggagagtcaatattgatggttccttttgttattcttggttttgtaataaagccactaaacctcaaaggatttgctcacaacacaacaaaagaatatggccagatgcttaatcctgaggttcaagatcagataaataataatgcgacaaagcatgttttgcctggtggaattgaggatctttcagggaaggttccacaaaagttctccttgtccagtttttgccacggtatcatgactgaaattggtcgcttcagcaaagatatgaaagaactactacaagagaaggtttttgtcatcgttgttttaggttatatatcctacaatttcgtcattggtgcttattcctactggggcccaaaggcaggtcaagagatctacaatatggggagtgcagatcttatgtttggtggaattactatagtgtgtggaattattggatcactagcaggaggtttcatccttgacaagatagggtctactattcctaatgccttcaagcttctttcgggtgcgacatttgtaggggcaatattctgctttggtgctttttgtttcaagagcctttatgggttcataccctcctttgcagttggggagctttcagtgttcgcaactcaggcacctgtaaattttgtatgccttcacgccgtgaagccacatttgcggccattggcaatggccgtatccactgtttcaatccatatatttggcgatgtgccttcttcacctcttgttgggcttcttcaggacaaaatcaataattggagggccacagctcttattttgacatccatccttttcgctgctgttgtgttctggttcattggcatatttatccccagcgtcgatcgtttcaatgaagagagcgagcatggccttactgtcgccgagagatcaaatctcaggccgctccttgatgaaaaggacgagccacggacatctgactaaaacctacgcaagtcataaccttttatttcttggcttagtccgtagtttttcccttatgccatcaacatgtgaaatgtaaatttgcatgcccattggctgtacctgtacatatacgaggtttgttcgttttgcgttattcttttacttttttttgtacaggctacagaaacaagcaaaagagtgctagaattcctttttttacgaattaaaacattttagaatttctttttacgaaaaaaaaaaaaaaaaggattgtgacatggcataactttctggttatgcggttatgctctgctcacgggaggctaggtgatgtcactgtatgcctagatggatctgcaactactctttcgtggctactttgagcacctcgaatccccttggggattggagtggattaagagcttgttcgattagttctt

SEQ ID NO: 6273 - DNA, 4637 bp, Zea mays
tgtattattatttacttaaaaactgtccagtacaagaattggtgagagagtgcaggacgaaaatttagagattttttatttaatattatataagtgtatagttatatttgtagatatataattgattaaatgtggacatagatatagatataagtatagatataaatactagagttttatattttaggtgcctgatgttttatatgataaatttagacaaacaactagtataattaaaaatataatttacaagagaacttttattttttttctatatatacttcaacaattgacaacattacatattgactgaataataatgaaaaattaaacaccataaatgttacagtcaaacgacgatgacagcattgctttttgattgaataataataaaaaaatcaggcaccataaatatcctatagtcaaacaatgacaacatctcatgttgactagacaatagtacaaaaatgagagcccctgtacaaaggacccagatataaaatgtcgtctagcatttctaacctgtcccgtctcatgtgccgctcgtcgtcgtcttgtgtcactcatggactctcctctaatggagcccctactagtgcccaacaaccacagtcccggtccggttgtcgccgccacgccgggagaacacggcggtgctgcggtcgacgagagcagcaccctcgtggatgctgccagtggcacggatgagagccacagggcactcgccgacgccgacgtgaagatgaacgacgatggcgacgtacaaggggacgagctgtccgcgtccgtgcagcgccggctggacgagagcagcgccgtggagggggaggatgaagaggaggagattggtgacgacgcggaggccgacgacatggcggcgcgcatgggacggcgcctggcggcgctgcccgggaatgcgcatgagagcgagccgttcaccatcttccgcgtggcggggcccatgcgcgaccgcaaccggcacctctacgagccgcagatgatctccatcgggcccttccaccgtggcgccggccggcacctcgccgccatggaggagcacaagtggcggtacctccgcgacattctggcccgccccggcggcgcgacgctggcctcgtacgcccgcgccgcgcgctcgatggaggcctccgcgcgccgccggtacgcggagcccgtgctgctgcccgcggccgagttcgccgagatgctcctcctggacggctgcttcctggtggagttcttcctcaaggggcaggagagcgcggaggacgcgctcatcgacgcctcgtgggcgatgcagaacgtgtacaacgacatgctgctgctcgagaaccagctccccttcttcgtgctcgagcgcttctacgacctggccacgggcgggctcggccgggactacttcgtcaccaacgtcctcgtcaactacctcaccgtggacatgtgcgtcggcccgcgggaccccgagagcacgcggccccccgacggtgagatccaccacctgctgcacctctactactactggttcctgccaccggaggaccgggacgggagcggcacgggcagcaaggacaaggaagacggcgaggcgctcgaggaactgatgtccacgtctgcggatgagcgcatgccgtggcagctgccgccggcgtcggagctgaaggactccggggtgacgttccgcgccaagaagtcgccgcggagcatggtggacgtgaccttcgaccgccgcagcggcgcgctgtagatcccggccgtggagagctacacgaaccacgccatcttcgcgaacctgctggcgtacgagcagagccggggccggtgggagctgcagcgcctggtgagctacgtgctgctgatggcgtccgtggtggacgcgcggcgcgacgtggaggtcctgcagcgggccggcgtgttcgtgcgcggggacgaggagacggcggcgttctacgcgcacctgggcgagctgtgcccgccgcccgagttcgtcaacaactgctacgccgacctgttccgcgacgtcctggagtactgtgggcgcagctggaacaggcaccgcgccgtgctggtgcacgactacttcagcaacccgtggaccagcatgtccgccgccgccgccgtcttcctgcttgtcctcaccgtcgtgcagacggtctacaccgtgctgccatactacagccagaattaaccgggcaaaaaacaaaaaaggcgttttgccgccgtcacacagaccgggtgtcgccctctgttttttctttttttttgcctgcaactacaagaaaccctatgatttttccttggctcctcctcctatacaatccatatgaatgatggcgtctggagcgtgatcgtttgcttgtccatcgaatccgtgcgcgtccacgatcgcatgaatccgtccaagattaagtaatggaacaacataaaaagacaatattagtaggatgttgaatcattttagaatgaaaacaagcatcatccctggttttccatattgcccaaagaacaacaccaaatcctaaaataaccagatttatggaatctttatcaaagctatgtaaccaatctccaaacaacaaatctacatcatttggaattgagtttaaagcaatttgcatcactctctaaatatatttagccaacgggcactcaaaaaaatgagatgagcagttgattccaaaagaccacaaaagcagcagctaacagaccctgacattgctttttcttaagattttctttagtgaggattttgtttttcagaattagccataagaacactattattttttttgtggaatcttaattttctacataagtttgtatggcactttaaccgaattacttcttaactgtgaaaacacggacttgactgtgaaacccttttcacccagaagccagatagttctttcatccttttcagagagcccctaagaactgcagccgtgcctgatagtgtcgaacaaagtaacatctcttaacctccttctgaagtacaaattatcacagttaccataagagctctattcacagaaatcttcttgtccatggagagatcgaataaccttttgagtttaccagcaaaaggaacatcaccacgccatctatcaagccaaaaactactatccttgccattaccgacaaacttttttcttaaaatttagataaatctcctttgacccccagatcccactccaaaaataggaaccgacttgtcgttttttaaccaagctaagtgaaagtcacatagagggatgaataaacgaaacctgaaaattacaaactttgaacacaaatttcacctagggttatcatgaccatcctctcccctcaaatcgttcgagcgcaataaaccttccccgtgcatgttggcgccaatctcgcttcggcgttgacctcagcccctactctcgcctggggagtacaaaatcctagcttccgtgccccggtgaccatcacgcgcgttcgtcaccctccgggaatcacgctgtgggcgctgccgtgggagcttgagggaaaccgccgcgagtgatcactgctagcatcctcgctcgcgggtgagcgcgcggtcgtggggtttcgccttagcaaccagatcacgtcggggacggcaaaagggaagaaaggcggtctcggtggccgcaattcctcgctgtcgccacgactttgccgtgcatcgtgggcacccccaacttcgactctgccggcggtttgtgcctacccaacttgttcgaattgtcctccacatcgtgtatcgggtctcggatcgaggattgacgttcccaggcatcatttggtgtgactccggcgatggacaaccgcaacacccgggcggcgccgccgtcgagtgaaggggatggggaggaatcgttcgagccgttgatctgaagatgagtgactaagatcagatcatgtcataccaattcgagtggatggatccgggccgttgcgatccaatcgggtggatctagaaggctccgggagaattaaaatctgcgccgtagatttcaaatcgtgtggtcggctgcgtatcacttcactctggggggtgcataatctaatcctagccgtcaggattagatcgggcagtccaggatcgaccataccccttcagccgtggattcttacaaatgaacccctgtgttttatcggaataaacccgccatccatactagtgtaaggaatactgcagatcagtcctaatattttcacaaagcccctgatctttgggatattagtgcacgcagtacaacaatagagggaattaagaaaatcaatatatgtactacatattaagagagcaatagtagtctgcctccctcgttctgtcgttctgccgtccatggatctggaccgtccatatcacatcgtgtgtctacgtctcccacactccatccttctccaccgcacgaccacccaatccctaacctcccccgcacgttcctctctctgtcgcgttgcccgcccctgccgcgatagatgcctcgcggcctccaccgccgacgcgacctctctccgcctcccctcctccctttgcctccaccgcccctcccccaacgtcatcgccacagccatgccactcgctcccgcgggatctagatcctgcgggagcgagtggcgcggtagtgatgacgacgtcgggg

SEQ ID NO: 6274 - DNA, 1346 bp, Zea mays
cattgggtacctcgaggccggccgggtgtgtataccaactgggattgcattaggctatgtttatggcggactggttggaaaatacctgaactggcgtgttgctttctggggagagtcaatattgatggttccttttgttattcttggttttgttataaagccactagacctcaaaggatttgctcacaacacaggaaaagaatatggccagatgcttaatcctgaggttcaagatcagataaataataatgggacaaaaaatgttttgcctagtcgaatcgaggatctttcaggaaaggttcggcaaaacttctccttgtccagtttttgccatgttctcatgactgaaattggtcgcttcagcaaagatatgaaacaactattacaagagaaggtttttgtcattgttgtcttaggttatatttcctacaacttcgtcattggtgcttattcctactggggcccaaaggcaggtcaagagatctacaatatggcgagtgcggatattatgtttggtggaattactatagtgtgtggaattgttggaacactagcaggaggtttcatccttgacaagatagggtctactattcctaatgctttcaagcttctttctggtgcgacatttgtaggggcaatattctgctttggtgctttttgtttcaagagcctttatgggttcataccctcctttgcagttggggagctttcagttttcgcaactcaggcacctgtaaattttgtatgccttcacgccgtgaagccacatttgcggccattggcaatggccgtatccactgtttcgatccatatatttggtgatgtcccttcttcacctcttgttgggctgcttcaggacaaaatcaataactggagggagacagctcttatattgacatccatccttttcgctgcagttgtgttctggttcattggcatatttgtccccagcgtcgaccgtttcaacgaagagagcgagtatggccttactgccgccgagagatcaagtctcaggccactgcttggtgaaaacgagccacggacatcggactaaaatctgcgcaatccataaccatttattacttggaagggcaatcttagggtatgtttgttttcctccctaggattatatgagctggattataatgaaaataagctaaaataagctcgcattggcgaacttatttcagttgcatgccagttgcaatcttagggtacgagggtacaatattactttggaaggctaaaataagttatcataattcaacttatataatctagaagaaacaaacaggccgtagtccgtagtattatcctgtctgtgccaagcacatgtgaaatgtaaa

SEQ ID NO: 6275 - DNA, 2562 bp, Zea mays
tgcagctatcagacctgtcttcaatcctggctgaaacgaacaagcttcggtgaaccaccaggtttcatttcagagatggatttattactgaccaggatttagtgaaccaccaggattcactctatttgggccaggaacaaaaacgtgtcagttttcaaacgagccctaaggctttgttcgtttacatcggattggtgggtcggaataattccgagccagattgcttctctaatttatataaactttaattaaccggaacgattccgggtgcaatccgatgtaaacgaacaaggcctaagatgaattgaagcgtaaattatattacaccctaatccggctcgatataacagtcccccgcccttaagtacgagcccaacgacctccaaagcgccgtctccgcctagtcgctcgccatactacctcctcagacaccggcggcggccatgccgcctccgcgtccgacgcaccccccacttccctctcctctgccgcccgggccgcctcccctaagcgcccgtcgtctccctctcccgcccaaccgcccggcccccacgtctctcctcctcgcgccgccctcctccccagcccgtgccctcgcgcttctcttccccgactcctccgcccatctcttcccgtccctaccctccgtctcccccttcgccacctcttatcccgctcacacccccgtcccatcaccactcgccgccgccgcctccttcgcgctcctcctgccgtcgtcacacccccgcggcctatccgcgcatccgtccccttccaactcctctgtccacctccgcgcctattccctcgctcccgcgcccgctttcccgcgctttgcgcccgcctcgctctccttcaagcgccatgcctcagctgcaggcctgccgctccaggacctacccttcggcattggcgtccgcctggccggcggggtcaacgccgtctcgctgctctcactgtccaccggccagatctgggtgctctctccgaagctggccgcggacggccggacagtggagctgcacaagtgcgcggtcgtcgagctcgagccggcgcggcccgtgtacgcaatggaagtcgcaatgggaaggctgctgctcggggaggttggcggtttgcgcgtcttcccgctacggggtttgatgaagggtggaaaggagagggatgtgaagaaggaagttgctgtggttgtaggaaggtagggctgccacaagaagaatgggatgctgaatggcttagttgtgccagttaatcgtgttagctatgggggcaatggtgaaggtgattttgtttcgacttgtaagctcacaactctgagggtaaaacagagttcaggaagctattgttctttttcgttggcatttcaaaatgatgatcaaaagtcagaaggcagcatggaattgctgaattcagtgaaagctatttcgatccatcctctttccaataacaagtttttggtactggattcatctggagtgttgcatgtcttcattttttcaacaacacaaatggtctcaagaggtgccatcaagcaatattctgaaaatatccatacatatcgcttgcattatcccatgaaagtgcaattatctgctgtcttttcagttacctctataaagacacaatttttttgggtttcagatggtggacatactgtacatgttatgtccgcagttgagactgaatcccctaacggtgataatggagacgttactggagaaagagagttagcgcctatcaagctttcagctattgaagcaatctttacaagcgaaagagttgaggacattgtatctatctccaaggattcagttcttatccttggtcaaggcaacatgtttctgtatggaacttcttgaatttggttctttatcatgcatgggcatggttcaagactttgcagctttggatggtcttttggctaaagacaggatgagttttggtgattttgaagatgaacttatccaccagtccttgaagtcgtgagctttactatttattaatcacagtaagcagatgaaaaaagctcatgttttttcagaggacagcaagaatctgaaggtgacgccagattatggacggaccacgccgtaatgaccctattgctctgcatgcgtactttacatgcaaagactggcacaattcttgttgatatgacttggaaagagcaatgctgccaaatctattcccagtctcagttgtcgtggaaagtggatcaccatgaggccattcagctatggaataatacagctggtgctagactgctagtgtaattcagggactggacttgcggtgtagtggagtcgaggtttgggcatgttacttactgcatactacctctgttcttaaatatttgtcacccgctagtcatttttgaattaaacggtgacaaattaaaaagaacggagggagtatatcaaaaaaggaataatgtagtactcttgtaagagttaagatggaatgttgaaaggcgcgactttgagccattcttatcattggttttttattgctgtatttttttttgtgacattccactattccggtatacccggatcaggaaaa

SEQ ID NO: 6276 - DNA, 1249 bp, Zea mays
cgcgcgatcgcccgccgcagcagcaatgcctccacctccgccgccggccgcccgcatcagggggcggtgcagcgcgctcagcttcgcggcggcgcgggaccgctgcttcagccaccgcttccgcagggcggggctgcgcccgctcgccgtgccgctccctggcccgggcccaggccccgacgccgacccggccaccaccgtccacatgtgggtgcccgcgggcccgccgccgcggaacccgctgctcctcctgcacggcttcggcgcctccgccacgtggcagtgggcgccctacctccgcccgctgatcgccgccggcttcgaccccatcgtgcccgacctcctcttcttcggcgcctcctgcacgcgcctccccgatcgctccgacgccttccaggcctccgccatcaaggccgccatggacgccatcgggctccccaggttcggcctcgtcggcgtcagctacggcggcttcgtcgcctaccggatggccgccatgttcccggaggcggtccaccgggtcgccctggtctgcgctggggtctgcctcgaggagagagacctggcggagggcctcttccccgtggccgggatcggggaggccgccgcgctgctcgtgccgcaccgcccggaggaggtgcgccgcctagtccgcctcaccttcgcgcgcccgcccctcatcatgccctcctgcttcctatgggactacatcaaggtgatgggctctgatcatatccaggagaaagctgagctgctatacgctttgattaacgggaggcaactctgtactcttccaaaattgacccagccgacgcttataatctggggagagcaagatcgggtgttcccaatggagctggctcacagattgaatcggcatctagaggggaattctcgattagttgtcataaaaaatgctgggcacgcggtcaatatcgagaagcccagggaagtgtgccggagcatcattgagttcttcaaggagccggtcgctggagctgcaaatgcggacgacaaggtgtagtagcttccaccaatggcggacgtggacaggtcttcgctgggcatcggcagacggcgcacccgcttgtggcacgcaaacacaaggcagatacgtggcattgtacatctacatccctctgccattgttctgatgtacttaaagggtgtatgtagagtcattgcagtagcgattcataaagcatgtaacggggaacagagggggacccttggggcccaaatccgagtg

SEQ ID NO: 6277 - DNA, 833 bp, Zea mays
agcacgtatacagggacagggaagaaggacgtgcatgtttcgcggtttctgagactcaaagcgcgagcacaacgaacgtgcacacgcgccagacgtgtcactgacagttgcggcccacaccatgactttcacctggacgcctagtcagccaagacctgccccatcctggccatccaaccaatccggtcaacgggagaacatgtacgaggcgatgtcgccgcgccgggcgctcctcgccatcctcctcgccgtcgccctcgcctccgcttcctcggcaccccagcccccgccgtgcagccgctcgtgcgcggccctcaactgcgactccgtcgggatccgctacggcaagtactgcggcgtgggctggagcggctgcgacggcgaggagccctgcgacgacctcgacgcctgctgccgcgaccacgaccgctgcgtcgagaggaaaggtatgatgagcgtgaaatgccatgagaaattcaaaaactgcatgaggaaagtgaaaaaggcaggcaaggttggcttctccaagaaatgcccgtacgagatggctatggctacaatgactcaggggatggatatggccatcatccttagccagttgggcacccagaaggtggaactctagcgttagctagctccgcctcagctgcatgttgatttattctcacggaaatatttatatactccactgaagaatagaatttgcttccatatgattactgttgtttcatcgaagtcagagggatgcatggcttatctttcttctgccaaattgaaaaagaaaggaaaagacttcagtaaaaaaaaaaaaaaaaaaaaggccccctagggcc

SEQ ID NO: 6278 - DNA, 1196 bp, Zea mays
  misc_feature (1180)..(1180): n is a, c, g, or t
gcacgagaccattacctagaacatcctaatcgaaaacatcctggccatccaaccaatccggtcaacgggagaacatgtacgaggcgatgtcgccgcgccgggcgctcctcgccatcctcctcgccgtcgccctcgcctccgcttcctcggcaccccagcccccgccgtgcagccgctcgtgcgcggccctcaactgcgactccgtcgggatccgctacggcaagtactgcggcgtgggctggagcggctgcgacggcgaggagccctgcgacgacctcgacgcctgctgccgcgaccacgaccgctgcgtcgagaggaaaggttacgtttccttcatccccggcctgcgtttgttgtgctcgttaattagggtctgagtgagatgggtggatggatcatgatcaagttcctagcttgcaactcatcggtagcaaaggaatttttcattggatttgatttcgcgttgcaatctgatcactacacttgctcactccgttttttttatttgtcgcgttttagttaaaaaaataaactagccgataacaaatattgaagaatagagtcagttttctttatttattttctgcttgtggtgtggttggaatgcagtgccttcaagcaccattaccacaaaattttgcatttaccatccacgaaaaggatgaccacagttattctcccaacctgaacattacatgtaatcagtcagtcactcagcctcagcctgatgggaatagaaatgaaaatagtgatcaacagcggattagcatgaggatatggtatccccacaccaactcaaaatagtttttgacttttattcacctgcagttcctgagctgatgtaacttttctcttgttttgatttatcattctctgctaggtatgatgagcgtgaaatgccatgagaaattcaaaaactgcatgaggaaagtgaaaaaggcaggcaaggttggcttctccaagaaatgcccgtacgagatggctatggctacaatgactcaggggatggatatggccatcatccttagccagttgggcacccagaaggtggaactctagcgttagctagctccgcctcagctgcatgttgatttattctcacggaaatatttatatactccactgaagaatagaatttgcttccatatgattactgttgtttcatcgaagtcagagggangcatggcttatctttc

SEQ ID NO: 6279 - DNA, 853 bp, Zea mays
  misc_feature (784)..(784): n is a, c, g, or t
cattgggtacctcgaggccggccggatcgttgtcgtgattcgtgaacggcggcgacaagaagccgggagagatgccgctggccacaactgctccgccgccctgtcctccgccgagtccagcagcggcaccagtccggacgcagctcctctcctccgtcgcgaagctcgcgctcacggccgcgctcgtctgcggctctggcggtcccgctgccgtcgtcgtcgtcgttccggccgccgctcaggccgtcccgttcgtccgtcctcctcctcctcccctgcaaggaaggcccttagcgtcctccactccttacgcgcagtcccagaagctgcagcttggcctcgacaagctcggaaagatcaggccatgcccgtccaccaacccggggtgcgtgtccagcaacccgctgggatcctccggctccttcgcctcgccactgctcatcccggaatcatccccaggggagaaggccgtcgcctcgctgcggcaagccatcgagaagacgcagcgtaatgtggagttcaaggtcgacgaagacactccatatggacactacatcgaggcggagatggacggcggagtcggccgggacgtgatggagttcctggtgaagaaagaagccggcgtggtggcgtaccggtgcatggccaccaaggtcaccttcgtctaccccttcaccaccgctgtcggcgactccaaggggcagaagcagagggtcgcgggcatctcgagggagctcggatggtacgccccggacatccagtcctccatggacttccgtcgacnacgtcaattacgtttccgtgagaattagaccgtattatgaatcgtcacttcatcgatacgatcgggaca

SEQ ID NO: 6280 - DNA, 1546 bp, Zea mays
gtactttctatacagacgccacgccacctccttccccttcgagatatttttttggttggatctagcgtgacggcaaagacggtgtatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcggcttgattcaagtggatcaatcgacagtagccatcaaggaaacttttgggaagtttgacgaggtcctagagcctggatgccacttcttgccatggtgcatagggaagcaaattgctgggtatctgtcactgcgtgtgcagcagcttgatgtccgctgcgaaacaaagacaaaggataatgtcttcgtcaatgttgtggcatctgtgcaatatcgtgcccttgccgataaggcatctgatgcattttacaggcttagtaacaccagggagcaaatccagtcatatgtttttgatgtcatcagggcaagtgttccgaagatgaacttggatgatgcctttgagcagaagaatgaaatcgccaaagctgtagaaaatgaacttgaaaaggcaatgtctatgtatggatacgagattgtgcagactctgattgttgatattgagcctgatgagcatgtgaagagagctatgaatgagatcaatgcagctgctaggctgaggttggctgccagcgagaaagctgaggcagagaagatactgcagatcaagagagccgaaggtgatgcagaatccaagtacttggcgggtctgggtatcgcaagacagcgccaggctatagtggatgggctcagagacagtgttcttgctttctctgagaatgtgcctgggacctctgcaaaggatgtcatggacatggttctggttacccagtacttcgacaccatgaaggagattggggcctcgtccaagtcctcgtcggttttcatccctcatggaccaggtgctgtcagagacatcgcagcgcagataagggatggtcagctccaggccagtctgctgtgagcacgttggaaaaggcatgcttttgacattcccatcagtaaagaagtacatatacatcatgaggagtaaaaaaaaacttactagcgataatgtgagtacagcttgttcgttctatctatatggtgcatgtgattattattatggagattaatgttaaataggttcgcatgtattgtgccagaacaaggctaaggaccagtttgcgtaaaaaaatgtatgtttggaacttatctaagttttggagcctgaggaaacccctccatcctgtgcaaactattttgtggtaaactgctaaaaaaaaatcgtgaaaaaactcgggggggctcatgttcattttctgtgcc

SEQ ID NO: 6281 - DNA, 1422 bp, Zea mays
ttattaaccccccacgttctcttgcgtctccacttgtctgtacaaatcgactatatgtactgcgcctctactcccggcccgccgagaaaaacctgaacctggtacaccttgcctctccccactaagcttgtttaccacgcttgtagataagacatgggtcaagcactcggcttgattcaagtggatcaatcgacagtagccatcaaggaaacttttgggaagtttgacgaggtcctagagcctggatgccacttcttgccatggtgcatagggaagcaaattgctgggtatctgtcactgcgtgtgcagcagcttgatgtccgctgcgaaacaaagacaaaggataatgtcttcgtcaatgttgtggcatctgtgcaatatcgtgcccttgccgataaggcatctgatgcattttacaggcttagtaacaccagggagcaaatccagtcatatgtttttgatgtcatcagggcaagtgttccgaagatgaacttggatgatgcctttgagcagaagaatgaaatcgccaaagctgtagaaaatgaacttgaaaaggcaatgtctatgtatggatacgagattgtgcagactctgattgttgatattgagcctgatgagcatgtgaagagagctatgaatgagatcaatgcagctgctaggctgaggttggctgccagcgagaaagctgaggcagagaagatactgcagatcaagagagccgaaggtgatgcagaatccaagtacttggcgggtctgggtatcgcaagacagcgccaggctatagtggatgggctcagagacagtgttcttgctttctctgagaatgtgcctgggacctctgcaaaggatgtcatggacatggttctggttacccagtacttcgacaccatgaaggagattggggcctcgtccaagtcctcgtcggttttcatccctcatggaccaggtgctgtcagagacatcgcagcgcagataagggatggtcagctccaggccagtctgctgtgagcacgttggaaaaggcatgcttttgacattcccatcagtaaagaagtacatatacatcatgaggagtaaaaaaaaacttactagcgataatgtgagtacagcttgttcgttctatctatatggtgcatgtgattattattatggagattaatgttaaataggttcgcatgtattgtgccagaacaaggctaaggaccagtttgcgtaaaaaaatgtatgtttggaacttatctaagttttggagcctgaggaaacccctccatcctgtgcaaactattttgtggtaccctgcttctctgttatcgtgattcatgaatgagaatctcatgttcattttctgtgcccaaaaaaatatgtaaaaaaaaaaaaaagggcgccccccgactagaaaagcgcgtcgacccggatattaat

SEQ ID NO: 6282 - DNA, 4306 bp, Zea mays
atattttgcattcctttattactttcaccacatacaaatggaccaaattacccctattcatttcacaaccatattttttacctcttctgttcataagaaaaacataaatagataaaatatatgagctccatttttatagtgttaaacatacaaataggcacatatttttttacgaaggaagaagcttagatttaaccgttgaacttcaaacacaggtatcttcagcatcaaactattaaaagtaaacatacttggttcacagcaaggtcttcgactgtactccctccattctttttttatttgacgtgtttttttttcaaaaacatcaatcatttgtatcattcaaaaaatttatatgttctataaaaattactccctctatcccaaaatatagttttaaaattcaacggttaaagctagacgttgtcctttatagaatatctatgtttaatttatttgtatgtttaacaccatgcttaataatatagaaatagagctcatatatttgtatacatttatgtcgttcttatggataaaatagaaaaaaaacaagggtggaaaataggggcaatttggtccatttgctagtgaggtgaaaataaaagaatgaataatatagatggagtgtagttttctaaatttatttaatgaaactggtactattttttgaattgctggaaaacgagcgatattttctaaatactgtctcaaactagtgttgttttgtggattcttcccacttttgttggctagcgagaattcacacgctgatctcctcgtaacaaaatttgacccacttgtcagccgatcccgtcaacggtttgtttgaactaatagctgttggaacgaagcggctggaagaaaatgttcctcgcaaagtttggctgacggcacccaccgcccacagaagcgcacctctgttctttggtgtgtggccgtgtggattcaaaaccgctgaccggccgcttatttaagcccttgccccgccggttttctcttctcccgtcggcgctggtccacgcggctccaacacctgcctgcctgcctgattcttacaccaaccaaccacgcgcgccaagccgaattcgtcttccaccgatccgccccgcccgtttcccattgcttagcttgctatggcgcagcagcagccggtgcggcggattctgaaggtggcaccgccggggaagggggacggggaatccttccccacggtgcaggcggcggtcgacgcggtgccgctgggcaaccgggcgcgcgtcgtcatccgcctcgcgccgggggtctacagggagcctgtctacgtcgccaagaccaagaacttcatcaccgtcgcgggggcctcgcccgaggccaccgtcgtgtcatgggacaacaccgccacgcgcatcaggcactcgcaggtacgccgcggcgtctgctcccttctccgcctgcctgcgtccagctcgacgaaatgcccgacaggcttgtgtgcatgtgctacggtcgctatgattagtaggtcccaaggatcggattttagctgagctgattaacgtaaacctttcttagcttccgccacatagtttgatcaaagtcatgcagatgtttggagttttatcataagatgcatgtgtcttcacattaaaagcagacacaatactgctggtgcatatgcatatatatagagacaaccaagaaactgttcctgcatggtttcaccaatttcattcctcgaaatgtgcttaatattttgactaattcttatttacatatctcataacgatgaactgctgctgttttctttttctctcataaagtcatccagggttataggaactggaacattcggctgtggtacgttcatcattgagggggaagatttcattgcagagaatatcacgtttgagaactcagctccccaggtactggttctacgcttcttgttctcctggcacaaacagaaacagatgatcatgggatcggaagttgatgtgtgcttgctaactagtcatgatcacagggctctgggcaggccgttgcagtccgggtaaccgcagataggtgtgctttctacaactgccggttcctcggttggcaagtacgtacgtctgtctccttagctcctgactcaacaacaaccacagatataatttttagtaacatttggaaactctaattctaatcaaaatttaacaggacacattatacttacactacgggaaacagtacttaagagactgttatattgaaggccattgtgacttcatctttggtaactctgtcgcccttatggagcattgccatatccattgcaaagcagcgggatacatcactgctcatagccggaagtccacatcagaatctactggctatgtgttcttgaggtgagtctggtggtgtatgtagttaagtagtttgtttaataagacactcaaatatttctttttttttaaaaaaaaagtttatttgctcgatttgttttatccaagcatctaaaaatgtcacttttggcattattaatgtgacttttttttgctcatttattatttgttttgacacttcaggtgtactattactggacatggagaagctggatacatgttcctaggtcggccatgggggccctttggaagggttgtctttgcgtacactttcatggatcgatgcatcaagccttctgggtggcacaactgggacaaatccgagaacgagcgaactgcttgcttttatgagtacaggtaaccggacaattccatgtaactatcagctagtgacatcatcctgaaattgtggaaatcgaagactgctttgtagatggatgatgtagagatagcacagactgctaacactagtatacttcttttttttctgcaggtgctcagggccaggcgccctcccatcgaaccgggtcacatggtgtagacagttgctggatgttgaagcagagcagttccttgcgcacacttttatcgacccagacgtcgataggccatggctcctccagatgatggcgataagaataccagcctcagcatagtttgatcccggcagccgcaggtcctgcatggttcatgcctcctttctagcctatttaaataaactaagttggaggatgcattatatttgcataagtttgtaacgtttggtgaattagtatccactttcatctcactgtgggcggtggggatagggaatgagagagcttctcttgtaacgaaccccagcactaggctgaaatatatgcagattttattttgcatgaactttttttgtttcattcagaactcgagcactttctctttcttttttttgcgtgttataagcgtatatggtaccacagattatactactggcgccaattgttttgcgtgttacaaagaccgaaattcccatgttcatacccgccaacaacattatactactcgcgccaatttcgtacccgccatcagcaaaatactggcgccaccatattttccagtacaaataattattgagtacacgttacgtattcgaaatagcacggcaccagtccacaaaatttattacacaaagtattgtaacacagatgtatttcaaatattcgaaataccacagcaacagaaatgtgtttcaaacattaaaacggtccacagctgtacacaaatttattacacaaaaggcattttacattctactaaacaaaccatcagctatccattctcggaattgattcatactgcggtcctcttcaccttcaactggaccggcggcaatttcttgactaaatacaccgacaacagatgtctcaccaacttcaggaacataattctcatcatggtcacacaattcaaagtccttgtctaccagacaactctctctaataatttttttctcgaacgcgcagttaagctgagcatcattatattaaaaagaaaaagaatggtccaacatggacccggatacaagagcttcccttagggaggcccagagcaaagaaataagaaaaataaccagaacaaaaacacaaacaccactacatcaagtagctaagagacaaaggatggcgactgcatgaaagaggagaggcccacaactccaggcttttcccacaactgttgcttctcccagccctgacagatagttaaggccataaacttctaagggctctggcccctgccaatccccacagtattgcatcttcttggatgtgttggaggatggtgttagtgcttggggatgctccatcaaagacgggcgtttctatgtttccagagcccccaagccacaagaatcaccattgaattaaaacctttcctctggacttttggcacctgatgctcagggg

SEQ ID NO: 6283 - DNA, 1504 bp, Zea mays
agaaaatgttcctcgcaaagtttggctgacggcacccaccgcccacagaagcgcacctctgttctttggtgtgtggccgtgtggattcaaaaccgctgaccggccgcttatttaagcccttgccccgccggttttctcttctcccgtcggcgctggtccacgcggctccaacacctgcctgcctgcctgattcttacaccaaccaaccacgcgcgccaagccgaattcgtcttccaccgatccgccccgcccgtttcccattgcttagcttgctatggcgcagcagcagccggtgcggcggattctgaaggtggcaccgccggggaagggggacggggaatccttccccacggtgcaggcggcggtcgacgcggtgccgctgggcaaccgggcgcgcgtcgtcatccgcctcgcgccgggggtctacagggagcctgtctacgtcgccaagaccaagaacttcatcaccgtcgcgggggcctcgcccgaggccaccgtcgtgtcatgggacaacaccgccacgcgcatcaggcactcgcagtcatccagggttataggaactggaacattcggctgtggtacgttcatcattgagggggaagatttcattgcagagaatatcacgtttgagaactcagctccccagggctctgggcaggccgttgcagtccgggtaaccgcagataggtgtgctttctacaactgccggttcctcggttggcaagacacattatacttacactacgggaaacagtacttaagagactgttatattgaaggccattgtgacttcatctttggtaactctgtcgcccttatggagcattgccatatccattgcaaagcagcgggatacatcactgctcatagccggaagtccacatcagaatctactggctatgtgttcttgaggtgtactattactggacatggagaagctggatacatgttcctaggtcggccatgggggccctttggaagggttgtctttgcgtacactttcatggatcgatgcatcaagccttctgggtggcacaactgggacaaatccgagaacgagcgaactgcttgcttttatgagtacaggtgctcagggccaggcgccctcccatcgaaccgggtcacatggtgtagacagttgctggatgttgaagcagagcagttccttgcgcacacttttatcgacccagacgtcgataggccatggctcctccagatgatggcgataagaataccagcctcagcatagtttgatcccggcagccgcaggtcctgcatggttcatgcctcctttctagcctatttaaataaactaagttggaggatgcattatatttgcataagtttgtaacgtttggtgaattagtatccactttcatctcactgtgggcggtggggatagggaatgagagagcttctcttgtaacgaaccccagcactaggctgaaatatatgcagattttattttgcatgaattttttgtttcattcaaaaaaaaaaaaaa

SEQ ID NO: 6284 - DNA, 557 bp, Zea mays
cccgacctctcgtatctctcgctcgcctccctcgtccgcggtccgccgccgctccagatccagccgtgggagcggggacggggcagggcttgagcacgctctctgcagcttcaggctctgctcgtcggggtggaaggagaactcgagtgctcccaggctttcaacctccacgctctgaaccgctggtacccgagatgacatgtccttgggcttgggcttgagctgggcgcagaacgagcccgtcgtcggaagggacgatgtggacaacctcgtccctggctccatgttgaggccatagagcttgaaccccgaggcggagcccttctgcctgagcgcggccccgcggttgaactgctcgacgaatgcgccgaattgctccctcccggaattggagcggacgacggagtgagagaacttcttgttcctgttgtatggtttatgatgtgcgtgagtgataaaatttatgtatttgattcttctgagtgtctctgtgttaataacaagttgtcttgttctgttgtttaaaaaaaaaaaaaaaaaaaaaccggccagtacct

SEQ ID NO: 6285 - DNA, 3739 bp, Zea mays
ttaaggagttgaatagagagacgaatgaagacagtttaggctggagtcatgcaaaatcaaggcttctctagtgagctttgtggagcgtgacgtgcgtggctgtaggtgcggcacgttgtggggagcacacagctcggcggggcgggcagcgagcgggcgcgcgagctcggcgtcgtggcggagcaaaacttccggggcggggggaggagagagaaactttgaaaggacccagttttgcggggggggcgcgggtctctggatggggacaacacgtgcggcattgccgagaggggttgcgagagcgacgcttttggaggacgaagacgacgacgagggggcgcgccgcgacggtgagggtggaggacgccggcgatgggagggggctgccgccgccgtcgccggcgacggggccctacgccggcggtaggtcgcgcgggccgcggcggcagggcgagaccatagccaagggccacaagaactacgtcctcttgctcgacctgcagctcggcatcaggtaggtacccaccttaataaccggccgtatctcgtttcttcatttcagacatttttccggtaattgatggccacggttgatgcaatgtgtgctaaaattattgggcatttcatctcatgtaatgccgttgacataaatcttattgatttatagtatttggttggggattcgttgttatcatcattggagattagatctatcctatattgtataaaagctgcaagtttttccttttaaatgagaacctatatgttatgtgattgctgaacacagcaggagctgttcttgaacaatgctaagcgatgattgatgaatggtttgttttctcccctccagtcgtcactatgagatttcaagacgtatcgcccccgccgtatctaatgacatgttttgcaatgtttttgtaacgaacatgcatgtttctgctaagattgagctcgataatgatggtggctaattaatttcctggaaatgatgacatccctactattgcatcaaaagggcatgggtggtatatatattatgcgaacatgtatttcaacgcttagcacatgatctttggtggcacgcccaagcttggcaagtcacttctatctacaatgcgaagcaccccacacttatctatcatataaagttgaaagcatagcagtcgaacagattgcacacgcacagggtaatgcccacagataaggagacataagagccttgcgactgtatggagaggacagagacctgggacataagagcttagcagattgtatgggaacctatagagttcaacagatctatacagaaccagcttctctgcgttctagttttcagcagcattagtttcgctggatactagtcagcatttcaaactcttctggcatggagtgcagtagcatgataagaagtatgtatcttatttactatgtacagatgtaatcatacttgtgatgttaagaacgccatgagccttttaatacatgaacatgcaaatggattatataagtatgtttatgccccactcatctttgtctgcatgataggcacgcagtaggaaagcaaggtccaattacacttgatctcaagtcatcagcttttgaccccaaggagaaagtatggacaaggttccctccggaaggctcaaaatacacccctccacacagctcatgtgatttcaaatggaaggattactgcccgcaagtattccggttggtcgtcgtcgtcactcccatccataatgcacacgttacactttgactatggtgtcactcatgcacgcatgctcattggctgtgttacatgattggttccgaactgaaccgcaggacattgcgcaagttgttcaaggtcgatgccgcagactacatgctatctctttgtggagaccaggctctccgggagctgtcgtctcctggtaagagtggaagcttcttttacctcaccagcaatgaccagtacatgataaagacgatgaagaaatctgaagtgaaggtttgtgtgctgtctttctactccaagcacttccttgactccataggccatcagcggctttgctgttaatcaactgaacgtttgttatcatgatatcatacagatatttctgaagatgcttcgagcttattataatcatgtcagatcattcgagagcactctagtcacaaagttttttggtcttcactgtgtcaaattagccggagctaaccagaagaaggtcagaaatgagaacatatttatttttatatcatggtatagatagataactagttagctgtgatgattatttaggtactcctttgtagtttacataccatggccgaatgccaaatcctgatcatctctttttctgtctgtactatatcaaccaggtccgttttgtcataatggggaacctgttctgctccgactactctatccataggcgattcgacctgaaaggttcatcccttggacgcacgactgataagccgcagacagagatcgatgagtacactactctcaaggacctcgatctcaacttcatatttcggctgcagaagcattggtaccaagagttccaaaggtgagtgagtgatgctaaagccgatgagaaaccgttaaacatcttgtacgtattaacgtgaaggtcgttggattggttggagcagacaggtcgacagggactgtgagttcctggagcaggaaaacatcatggactatagtcttctggttggtgtacattttagggacactagggataggctattgaccggaggttggttgagatgaaaactacttcaatattttttttctttgcatggttatcatgtatgtaccttacgaagtgcgttaccggtattacttgaaggttcgttcgatagcgattgcagcagaggatcatcgcctcaattgtcaagaggagacacggatccaaacaggtaaaccgagactctggctgcaaattttggctgcattaatgctttctaatgccaaccaattgtcaagaggagacacggatccaaacaggttagccaagataaagcttgggtcgaacatgccgacgagagctgaacggacgataaggaagggcgactgcgaggtgcagatcatgggggagcctacgggggagttctacgacgtcatactgtattttgggatcatcgacatactccaggactacgacatcagcaagaagctggagcacgcgtacaagtcctttcagtacgacccgacgtccatctcggcggtcgatccgaagcagtactcgagacgcttcagggatttcgtgttcagagcgttccaggaagacaagttcgatttgtgactgaagaaggcacaaggaagccagcctaccgggtgccggccgctgacatgtacggataaccagtgttgaaatgcagagtcagacatgcatggcactgctggcatcgcattgcagcagagcttttggtgaccctacctgcttgctacttccacaccagactgcagcgcacggcagaagcttcagggcaggccgtcaggctgatgaagccctgagggggattcagctggcactcatgtagaagcgagggaggctccaattcgagatgtcggtgcatttcaatgtttttcatataaaaagctatgcctaagaaaaaagcatacatgcatatagaaaccaactgatattagcgtagacgctgacaacctacggagaaatttgtaatggcagttcagggatgtaaatcttttcttacgaggcaacaggtcacagttcttatt

SEQ ID NO: 6286 - DNA, 2468 bp, Zea mays
tgcagcagaggatcgtcgcctcacttgtctcgaggagatacggatccaaacaggtaaaaaaaaaatgggactcatgccttaacctatttcatccattaatgcttttgtatcgcggatcatgcacagtaacagagtgtctttttttttcgaacaggttagccaagataaaacttgggtcgaacatgccgacgagagccgaacggacgatacgaaagggtgactgtgaggtgcagatcatgggagagcctacgggggagttgtacgatgtcatactgtacttcgggatcatagacatcctccaggactacgacatcagcaagaagctcgagcacgcgtacaagtccttccagtacgacccgacgtccatttcggcggtggatccgaagcagtactcgaggcgcttcagggatttcgtgttcaaagcgttccaggaagacaggttcgacttgtgaagggacgcgtgggaagctcgatcgggaggctaccgttgccgctgacacgggttaaccagtgttgagatccgcactgcagcagagcttttggtgaccctacttgctacttccacttgcactcgccggattgatgaagctcctgcatgcattgcatgcggagtcttcaaggggatttcagctggcactcatgcattcaagtaaaggctccaattcgagataccggtgcgtttcaataagcaggttcaacagtatctttcgttaaaaaaaacagctctgcttttcgggcggctgctatgtcgcactgcacagtgtggcgtagcgcagcgatggcaagctaatgcctaagaaaaaaacatacgtgcatatagaaaccactgatattagtgtagacgctgacaacctacggagaaatttgtaatggcagttcagggatgtaaatctttttacgaggcaacaggtcacagttcttattgtctggtagtgatagcagtgtgcgcatttcaatatattctctgatggaattgtcttgggtttggatcataagttgtttcggctactttctcagatcacttcgattgtaagtacatccagattagtctcacgttctctattttcaactaccggctcactccaggcagccgtccgcggtggattgcgctggcggagagggacagggtggagattggaacggacatttccttgttctaagatttctattaataactgaacattcagcgggcacctcgcgagcatccataccttctcctattcataagaatgtatgaactacatagaatttgcctggaagccactagcagacaaacaacacggagcggaatcaagccactggcgatgggaactaattgcaaggataaaataaaacacagcctcaagcctacccccgaattatttataaactcgtgctgggttctcatttgatcccagttttcctcatcctgtcctttgccctaggcatgaatcaaacggccatacaagcagtcaacctattcaatttcttcgccaagtcgcacaaaatacatatacaccgccacaacactggaaaaacttgtctaaaaggcatctctccatgacaacgtgttatacagaaaagactatatcacacatcccacttaaggagctatcctcgcacaacacgaaagctaaaaccatatcgaagagcaaaatacatttacactcgtatatgcagttttctgcaatcgccaggcggggagaaaagaaccactactgaagaatttacaatcatgaaatcaaacggtcatcctcctacctcgggtggttccaaggagagggtggcttgaatggaaagccctgcggagcagatccacgtcccaaatcaaggctatgaagttgttccatcagttgcgaccttcgctccttgaagaaatctagtctagttgttagctctaccaaagtggaggatgtgaccattggttgcctcccaaattcaatgccctaacatacgaaaatataaatcatcttagaagctacagaagcgcatacttaacaacaaagcacactgtgagtctcgcttacctctgccagctttgggacgttgatggacacagaggtgttctctgttgacatacttgttgagggttctgtgccccttgattcacttgaggaggcatcaaatgaaagctttcgtgtgagtggcctcgaagaaccataaggtagcacatgctgcttgatgtttctccattgtgatgactccaccgaactctcctgcagacatgattcaatgtaagtattgcttgatgaagtatcatcccccagttttgcatcagatttaaataggggtgacacacagaaccagtcattttagcatataaaatttccaatgtagttgataatggatgtacatgtagactagcgtgttatgagcaccaagacaaagctcccaaaaaaatctccattttttactaggacaaactcaactttaccagctgcaatttttacagtaaatattagacctccaagactaaaggtcagtccatt

SEQ ID NO: 6287 - DNA, 2320 bp, Zea mays
  misc_feature (1832)..(1832): n is a, c, g, or t
gggtttaaatcactgttccaatcaaaatatttctcaattttttataatcccctccaatccctgtaggtacgaccgccgtcgtcaaatcctctgatgatggcaactcttcacgagggcttggaggtaccaggacctgagctgattgcgcggccatggggtgagataccatgaatgatccatgagacatagtagctaggagacgcccaagcatctagctcgatgtctccgcacatgcatgcatgcatggcagggcacccgtgcgtagcggcaggagcaggacgggacttacaagacaggaaaccgccgacgaccttatcggcagcagtagcacggacaggaagcagctcaggtgagtaggcgccgccgtgtctcggttgccttggccgtcgctaaagcaagcctaccaccagcaaacgcacatgcttctctgttgttggttgtcgtagacggttatcttttttggactgcacacgacctgccgctttcaaaacatgcatgcatgaagctggattttgcttggacctttaggtgttgtatcgagatcaccgtagtgtggatgcctcgtcaccatgtactacgtgagggcgtgctagtgggtccgagtgccggcgcccatcgatctttgcatatcggaatgatactcccaccggccaccatatcccacaggccacagcttataaaagctgcggcatccgcggggccggccggcccggcatctttagacgaagccacagcgctctgcagcacacagataatatactcctccatccagctcggagcaaagagagcagctatagtcttcgtgacaataaccaaccgactgagcgatcatggcgtctctgctcggtctgtacaccagcggcagcgcccggggcaggagggtccacgccgccaggagcagtggccgccgccagtcggctgcgccgttgaagcagctgctgtcgaggttgaggtgctcctggaggagacgcgcggcgcggccgaggcgcggcgcggtcaggttcgggtatgacctgcatagctactcgcagaacttcgacgatggcgatgcctagtcagcccggcggccaggactagcttcttcagtacgtgtagctagctagctaggagtctaggacctgcaggatcctccttcatcagtacgtgtaactagctatggccaggatattagtgtggctttaattagtgctttgtcctgatcactgagatttcagtccagtgttaatttccggtgatcgattatctgctctctagctggttcatccagttattgtataaagaaattacttcatcttataattaagtttgcacaggcaagcaattctatgcttgccatatatagatcaacgatttggtcagctgttggaatggatggcttcgttgattttccagctgctcgatcgatctgcgtgttgacagatttatagatcgaggagctagctaggccggcacacactggcctgctgtatgtgtatgtttgattgcaaacaggtatagtgtgtgcgtcctgcccacatgctgtattttgtaacgataaaaatacgctaaatatatacatgtactaaccgtgattgtgtatgttgtacttacataagacagagtaaatagattggttttagagaattctaaacggattgtatagagcagagaatctgtgatgacagcgtcaattagaataagtgcacacattgtgatatatatgaagttgtatgtatgtatgtaccccaaacgtactgagggaaggaggaaaagtctaaataaaagttttagaatagaaaaaaatgcagtgaagtgtgcaacattgtataccgaattgtgtatgaaacaatggntcatgttttcatggtttaccttacctgtagcagaaaaaaactggatctcacctagaaacgagttcctcggatttctcgattttcggttttctcaaaaaaaatcggacataatttagaatgaacaactctgtttaatcagaaaaaacatatagatcatttctaaaccacctaatgtcactgtgtacatgtaaccattctataaatggcaaaatgaatcacaaattgactatgaatatatatccatagagaacatagaataatgagacagtccaaataaaccaaatattacataaataaagttctttggtagcattcatgcaccatcgaatataacactagtgttgagtcacaaatatttgatagtccatagttcaaattatgcacagaaatcaatcacagttctaaatattagtaggccacataaatcagatatagtagcaatattgtgctgaaactgaaactgagcacacagttgatacaatagagcc

SEQ ID NO: 6288 - DNA, 713 bp, Zea mays
aggatcagctcatccggaccttattccgggtggaaccaatggacctggtttggaatttggtacaacccattgaaagtgttcgtttcggcccgaactggaatcgaaactggcccggattaaaattttccttcacgccacggctggaaccaacccttgtgtcgtaccctccggatcgaatcctagacgacgcgaccggcacggcggcggcgcacagccccgacgacgaccctccccgctgccttctccccgatctctacgacaccaattatagatggggaaggtgaacctcctccctcttgggatccggcaccaactccaaaagttctacactcagatgagacaggcgaggttaaggttcgacgactcctcgagggacatgccaagaactatcaagttacattgttgtttattttccctgtcttattgggaagcaaagtattggaaaaaaactgcatttagttgatgatccactagaagtttaggctatgtcccactcgagtctttatactgtggtgttgtctcttgttatgcaatgttccctgcatgatttttgtttttggcatgtctacaactggttcagctgttcggctgctcattatggttgcagtcaaccataagattgttgtcttagcacctttgatatgtcgtagcaaaaactgctagttcactctttgatatgtctagattgaaccagtccacgccctaaaaaaaaa

SEQ ID NO: 6289 - DNA, 1924 bp, Zea mays
  misc_feature (983)..(983): n is a, c, g, or t
ggtccgaattgaaatcgtaaccggccccgcgggctcgcccgcctcaccccccggcccggcaccaacccttctgtcgtaccctctggatcgaagcctggacgacgcgaccgtgcggcggcgactcgacgcaaccagcacggcggcggcgcacagccccgacgacgactctccccactgccttctctccggtgaggatctgctctcttccttccctctcctatcctctgctctcgctgcccccaaactctcgccctcaatctcgctcctctacgctctcgcaccgcggcgctttgttcaaggtgtggccgccgccagtcgcctgcgtcgttgaagcagttgctgttgaggttgaggtcctcctgggggagacgcgcgacgcagccgaggcgcagcgcggtcaggttcgggtatggcctgcatagctactcccagaacttcgacgatggcgttgcctagtcagcccggcggccacggctagcttcttcagtacgtgtagctagctaggagtctaggatattcgtgtaactagctatggccaggatattagtgtggctttaattagtgctttttgtcctgatcactgagatttcagtccagtgtaaacttccgatgattatctgtgctctctagctggttcatccagttatattgtataaagaaattacttcatcttaaaaaaaaaaaaaaaaaggcgcccaattattctatgcttgccatagatcaacgataagcagactgtgatttggtacgtcagctgttggaatggatggcttcgttgattttccagctgctcgatcgatctgcgtgttgacagatctgttgttgcaaaatgttgctttgttggaacagcagcctttcaacctatacatagtttgctttagtccgtagtaatttgctttagtccttattacttgtacttttcaatctatacatggtttgctttaattctgtttttatattcagcttatatctgacaacaagtntatattatttagttccacaatgagtatctcattgcgggatcgtattagaaagaggagggaagaagaagaagaagatgacatgatgatatttattgggaagcaaagtattggaaaaaactgcatttagttgatgatccactagaagtttaagctatgtcccactcgagtctttatacagtggtgatgtctcttgttatgctatgttcactgcatgatttttgtttttggcatgtctacaactggttcagctgttcagctgctcattgtggttgcagtcaaccataagattgttgtcttagcacctttgatatgtcttagcaaaaactcccagttcactctttgatatgtctagattgaaccagttcactctttaatatgtcttagcattgaacttgttttagattcaacaaatattcttgtcacggtgccagcaatatattaaatctacattgtgtaaaaaaaaaaaaaaaaaggcttgggttgctagctttaactgcatggaatggaattagtccaggctgaaacgaacgaactttagtggccaccaggtttcatttcagagccggatctataacagaccaggttccagtgaaccacccggatccactctatatggaccagaaataaatacatgtctgttttcaaaccaaagcaaacgaacgcggccttaaagttcttcaggccctggtgtagcagctgaactacctagtttgatggtgaagaaagagctctaggtgatctaaagatggtgatgagataaaagcaccaaaaagtgtacagtgggatagcaaggatatgactgtcatgatgcctcagcgccaccgggctacggccaagaagcccatgtggataatcgtgctcttgtctatggtttgcatcatgttgattggggcttacgtcttcccaccacggcgcttctctaagtgctacctctctgcttc

SEQ ID NO: 6290 - DNA, 3644 bp, Zea mays
cgtgagtagtactcgtactgtgaagctgtgtgggtctcatgatggcacttgaaaaggctccatcttgtacagagagagaaacgaggcatcgtctctgattctttgcagatggcatctgttcttcagctttcaagtatactacaccaccaccactactcgcgggggcatgtgccaagcaaatctcatcttggtgtcatggtgtggtgtggtgtgccttagcttttctcgtagtcatgggctgtctagcgttacatctaccagattttacaggccgtgtggtccatttggaaaaccaggccctgtcacttccctagccttttgcgttatcagtttgttgtcaaatcattttccatggtccacttagggcttgttcggttattttcaatccatacggattggaggggattgatatggattggaggggattttgacttattagggattgaatccctctcaatccccctcaatccatatggattgaggtagaaccgaacatagccttaacggtctcattaggtacgtacattacacctcatgtgatgcatgcatgtcatgaatcgctttcctcgccctttttttgctggtactttatgcaggctaaaccaaatgaccgcttcttttcttacatgctagtttgaaactcaaatcatgagttttcaaactaggtctaagctagtttattagactgtttctagtaaagtgtgaaaaatagagaacacgaaactgtagataacactgtttgtttgcagagagaagcttcaaatagaagataagataggagatctgatggagatagatagctttagcggctaaaattttgtgccatttttcatctcacccttcccttgtttttttcgtttcctgggtactagttcaggggtgatgctaatgctaatgtttggattcatcctttcttcactgttttccaggtctgttgcaactgagctggcagtggatattgtcgtcactgtaggggatgtcaagttctaccttcacaaggtaccaccagcccaattcttccacttcaacattcttagaccgtgctcagaaaatcatgtatatggatgagcaaaacatcattttatattgtagaccgcactgtttactgaaggatgtttgaaatagaaattgggatagaaagtggataaggattctgctggagatggccttggtctctgtcttggcacacagcaaaacttagatctgaaccttcagactgtaatttctttccttacaatccattgaaagaaataacttgcacacaaagtgttcttgacacatgcttcattacatttattacgtgttttttctgtgattgaaactgaacttgtgactgatcagagatgttctgtttcaaaattcaacacacacacacacacagttccctcttctgtccaagagctcccgcctacaaacgctggtggcctcgacaagcgaggagggcagcgacgaggtggacatctccgacatcccgggcggcccggcggcgttcgaggtctgtgccaagttctgctacggcatggtggtgacgctcaacgcctacaacgtgctggccgcccggtgcgcggcggagtacctggagatgtcggagacggtggagaaggggaacctggtgtacaagatcgacgtgttcctgtcggccagcatcttccgggcctggaaggactccatcatcgtgctgcagtcgacgaggccgctgcagcggtggacggacagcctcaaggtggtcaaccactgcgtcgacgccatcgcctcccgggcgtccacggacccgtcggaggtcgactggtcgtacacgtacagccggaggaagctcccgtcggagaccgacggcgacgcgcgcggctggaacggcgtcaggaagcggcaggcggtgccgagggactggtgggtggaggatctctgcgacctcgaggtgtgcctgtacaggaaggtgatcctggcgatcaaggccaaggggaggacgggcggcgccgtcgtcggcgaggcgctgcgggcctacgcgtgcacgccggctggtcggggccctggaccacgccgtcagcgacgggctcgactgcaccaagcaccgcgcggctcttgaagccgtcgccgacctgctgccggccgagaaggggtcggtctcctgtggcctccttctcaagctgctcagggcctcgtgcctactggagtccggtcaggcctaccgcggcgagctgatcaggaggatcggcgcgcagctggaacgggcttcggtcccggaccttctgatacctgcggactccggcgacggcgacggcgacgcgacgtacaatgttggcatggtggctgcgatgctggaggagttcttgctgcatcacaaggtaaatggggccgaggcggagaagcgggaagatggcgaggacgacgtggatgttgccgctgacgacccggtcacttcttcgaagctggccgctgtcgcaaagctggtcgatggatacctctccgagatcgccaaggacccgtgccttcctctggagacgttcgtcgccctcgccgaatcgatgccgcccctgtctcgcccggtgcacgacgcgctctaccgcgccatcgacgtttacctcaaggtatgcacgcgcaagattatgctctgaaagcaattctgcatcatatctgtctgcaattccagtttcagaaatgcgcaaaaatctgcgatttcagtagctaaaaagaatgcgcaaaaatctttgtacgattgtgcgctgtcgaatctctctctgctgtgcacacgcgcgcaggagcatccgggcatgtcgaagggcgacaagaagcggctgtgcgcgctgatggactgcaggaagctgacggcggacgcgagcgagcacgccgtgcagaacgagcggctgcccctgcgcgtggtggtacaggtcctcttcttcgagcaggtccggcagtcggcggcggcggcggcagcctctgccgcccccgcgcgctcgctcatcctgcccagggacgacggcgcgtcgtacggcagctcgaggtcggcgaccacgacggcgacggaggacgagcagtggggcggcggcgccgtggtgggcgcgcctgtgacgacgtcgacgtcgggcggcgccggcgacgccagctcgctccggtccgtgagccagctgtcggccaacgagaacgggagaagcggcggcggcggcgacaggaagaaggccaagggcggtgcggtggcgccggcgccggtgaagagagtgctggggaagctgtggtccggcaaggcgagcagcgggtccgaccacacgtcggcgagccccgttgggtccctcaacctggaggagaccaagtcaatgtcatcacagatcacgaggcattctgtgtcatagttactatattactgtatatgttctctctttttttttgagtgattgttttgttggattggatttgacttacataattatggagggtgtttggtaattggtacaggtggtaatggagaatttctcgtcacgaaatagcttctcatctccatccaagcatctccatccaagcgacaaaaaaatatcctcgtcgttagacatttcttccccatctctgttaaaccctaaacccttaaatccccgacggagatcctcgtctctgcttaaattataactagaatttattaatttaaaatatgtcac

SEQ ID NO: 6291 - DNA, 1134 bp, Zea mays
ctcacaataattagattatctccacagtcatattctctctgcagctaagttctcggaaaaggcggtaaaaaagttgaccaaaaggacacactggatgcacattgacagcttactctcccgtcgcagcctgaagctgtgcgccccggttcggtgggcgtgaaaggggagaaaagagggcgggaaggaccgcggattttgctagggtttgcggtttctgcttcacactgcctcctcagtcctcaccaccacagccgtcgcgcgcaggaggtttgggaggatgccacgtaagatcaccttggtcaaggagggggagccgcagccggtggacgctgctcaaggggagcccgctccggcaccggcggcaccgacggccgcgttgacggaggcggaggtggacgagctgcccagggccatcgtgcgccgccttgtcaaggacaagctttcccacgtcgccggtggggaaggagccgaggtcatcgtcaacaaggacgccatggccgcgttcgccgagagcgcccgcatcttcatccactatctctccgccactgccaatgatatgtgcaaggaatcaaagaggcagaccatcaacgctgatgatgtcctcaatgctcttgatgacatggagttttcggagtttgtagagccccttaggacttcactgcaagagtttagaaacaaaaatgcagacaaaaggtcagaagcaaagaaacaacagaaggaaaagagaaggaaattaaatgaagagacacttccgcagaaagaaaatgatccagctgatgatgccaaggagaatggagtagcttaatcgcaagaaaaatgaagaatgaatacaattaacttctctgctggaggggcagtaacacgcagaatcaaaaccatggcagtatttgttggtagttgtatttgcttttgctccatgtagcctctactccaaaacactttcttgacttgatatgatgctgtataattctagtgtcctatcagttttcagcttgcttatggtgcaattaaaattctatgtgcctgatgaaattgttcttatgaatgaagaatgataccagcactatgttcgttggcaaattactggattttattcttccaatacgagaatagctcacgacttccttagatgtt

SEQ ID NO: 6292 - DNA, 1309 bp, Zea mays
cctgccggcacagatagaggagggtttgcccctgcacaccgctgcgctactgggaggagcacaagtgtatcgctgtggctgcggcgcccggcagtccgccacaagcacacgcgcacacaggggccaagcgcctacacctacagaggagagacaaggtctgccgtccgcgcgtgcgcggaagaggggacggaggaagaaggctgccagcaatcagagatggaggtggggttcttgggtctgggcatcatgggcaaggcaatggcgaccaacctcctccgccacggcttccgcgtcaccgtctggaacaggaccctcgccaagtgccaagagctcgccgcgctcggcgccaccgtcggggagacgcctgcctccgtcgtctccaagtgcagatacaccatcgccatgctctccgaccccagcgccgccctatcagtcgtcttcgacaaggatggcgtgctcgagcagatcggtagcgggaagggctatgtggacatgtccactgttgacgctgcaacttcgaccaagattagcgaggcagttaaacaaaaagggggagctttccttgaagctccagtttcagggagcaagaagccagctgaagatggccaattggtcattcttgctgcaggggacaagccattgtatgatggtatgattcctgcatttgatgtactggggaagaagtcattctttctgggagagattggaaatggggcaaagatgaagcttgtggtcaacatggtcatgggaagtatgatgaattctttgtccgagggactctgtttggccgacaaaagtgggctgagcccccaaacacttcttgatgtactggaccttggtgccatcgcaaacccaatgttcaagctgaaggggcctacaatgctgcaaggcagctacagccctgcgtttcccctgaagcatcagcagaaggacatgaggttagcgcttgctctgggagatgagaacgccgtcgccatgcccgtctcagcagctgccaatgaggcgttcaagaaggcgaggagcctggggctgggagaccaggatttttcggcggtctatgaggttgtgaagggcgcgggtggttctggatctggccagccgtgatagaaggaccatttgtgactgtgttagcccatttccatgccgatttgcaacatagcgacgtacgagtacgtgtgtattcgagatttggaaccagaccatacgttgcaaaagaaataataaatcaaagagatggtgctagcttgcaaaaaaaaaaaaaagccaaaaaaaaaaaaaaaaaaagtactctgcgttgttaccactgctt

SEQ ID NO: 6293 - DNA, 2661 bp, Zea mays
  misc_feature (2)..(6): n is a, c, g, or t
  misc_feature (13)..(13): n is a, c, g, or t
  misc_feature (946)..(946): n is a, c, g, or t
gnnnnnagtgtgnggttatcctactgcccgcgccccagttgatcttgttaccgtgcttgatgttagtggaagtatggcaggcactaaactggcactcttgaagcgagccatgggttttgttatacagcatcttggcccatcggatcgcctttcagtcatcgctttctcttcaaccgccagaaggttgttccatctccaacggatgtcacactctggccggcagcaggccctgcagactgtcaactcgcttgttgctagtggtggcacaaacattgctgatgcactgaagaaagctgctaaggttattgaggaccgaagccatcaaaatccagtatgcagcatcattctcttgtctgatggccaagatacgtacaatattccctcaaatattaggggtgcccggccagaatacagttcactagttccatcctccattctaaaccgcacatttggcttagtgccggtgcatgggtttggttttggagtagaccatgattcggatgctttgcattcgattgcggaggcctctggcggtacattctcctttatcgaggatgaaggtgtgattcaggacgcatttgctcagtgcataggtgggctcctcagcgttgttgttcaaaacatgcaagtaaatgtggagtgtgtccatcctggtgtccagcttcgctccatcaaatctggtagttaccccagcaaggtggctgcacatgggcgaaatggttccattgatgttggccatctctacgctgacgaggaaagggacttcctactgtcggtgagcttaccacattgtcgtgaacagaccacacttctgaaagttgcctgtgcctacagagattcattgaccaacgaagagatcaagattcagggtggcgaggtagcaatcttgaggcctagatcacccgtatctgagccagtttgcatggaggttgaccgcgagaggaanccgtgtccgtgctgcggatgctatcgaggccgcaagggctgctgctgagagaggtgctctttctgatgccgtgtcaatccttgaagactgccggaggatactttcagaaactttttcaagcaggagcggggaccggctgtgcatggcccttgatgcagagctaagggagatgcaagagaggatggctaaccggcaacgctacgaggcttcagggagggcatacctgctgtctggcctcagctcacattcttggcagagggccactgcgcgaggcgactccactgacagtgacacacttgtttattcctaccagacaccatccatggttcacatgctacagcgctcacagaaccactgcccttctcctcaaggcccttcacaacctagggtcttggtgaaaccccagccaaggtagaaggcaactgagcaattcagcattatcttgcgaagcgagggcacagatgtcggtgaagaaattcaattcgtatggctgcgtattaggtcatagtgtagttctccagcacctttattttgttgtctaagtcgtggtggtgggtgggtataccagaggcggtgaggcgggcttggaggtaaatataatctggttgggtatactggggaacctaaggtgggggctttggtggtaaatacattgtggggggtatactcctgtggtgttaagaaataagtagggtagtagtagtagtagatgaggggctggagaaattgtgtaatagtttcaacgggttggagctaggtagtttagtggaggtcagttcttgtcaaagtctttatttgatctttggtgatgtagataagagggtatgatctcggggtggtatatcatggaatctctgtttttttgggtggtgatggtggtgttcaatgctattccatggattcaaactttcaattttattagctggtgtctaccagcacacgcctatgaattgtgattcaactcacaacttgtgttcgcttgtttttcgtgcttgttgcattggttgaatctgattgtggatatgaatctgcttgtcaactgaatcaatgactttatgcactcaccaattgattgagcagagttctgtgtgtaatccaaccatcggctctttgtagtagccaagctaaatgattgataaggtaaacacgaaatcttataaattcagaaactattaataaagtaagatcagttgtaattcgtaaactggatctatgcatcattaccactgttaaacctggagtcctaaaaataaaacagataattttaacaaaaaaatcattgcgtgaatgtagttaagcacttcactattttcggtggatgttggatccatcaaaagtacaaccacgccctccctctgctccgagctccgtcctcaaatcgtggtgggtgtatgcactcacggctcacgggaaaaaggcgggtacggagatggagccgccgagatgcggaggcgcggggctgcacggacacctaggccagcgcgcgagcttcgggcgccccagcgttgccgcatctgggagacgagcggaggaagccaaagatccgcatcagcaccgcaaggggggctgccgacggccgacctacgcgttgccgaggctggcacgcggagcttcgagcatgccagggcggggacgcgcgaagatgagtggacgagcagagcaagcgccggggcagagaaggtaataaagaaaaaaaaaactaatacactatccgg

SEQ ID NO: 6294 - DNA, 2462 bp, Zea mays
cttttttttttctttatcatgaatttccacaggtagacccttattttctcgtatttgtttctttatttattgattcactattgctagatatgtatgcaaaatgtgaaatagcattaaacttttatgctaaatcctcgcggattatttcttttgacctgtctgcagtatcacctgcatccagagattagcaggtttatgcaaaatgtgaaatagcattaaacttttatgctaaatccttgtgaattatttcttttgacctgtctgcagtatcgcatgcatccagagattagcaggtttccatctttacgtttctacggaaataaactgcctgatggtgtggaggtcgctgataaatcagcttcatttcattttcatgagtgtcttggtccatacatgttttttgatattgctgacggacgtgaacattgtggaagaaatgctgctacacagtcactctgtaatgattttgaagctgatgcagctcttgaaatactgtcatttctaaataacaggtgagggtattgtctctctacctgctcatgtttattattgtgtaggaaactaaggctatatactttctctgtgaacagatatccattggagttcacctctaggaaaataggaatcattactccatacagaagccaactctctatactccgttcaaagttcacttcctcttttgggcctgagattgttgccgagatggaaataaacactgttgatggatttcaaggtcgtgaagttgatatcttgctgttgtcaactgttagagcctcaaattcttcagatgatagccatcgcactggtgaagcacgcagcattgggtttgttgcagatgttagacgtatgaatgtcgcactaacacgtgccaggctttctctatggattgttggaaatgcaagaactttgcggattaattcacactggaattccttagtatgtgacgctgaagaacggaatctgtttgtctcaattaaacggccatatggtttgatgtttgaaaagggccaacctcattccagaaatactcataggtacactagtcatcttaagcagaaggataacaaaaaagctgctttgatgagctcaaagagagttggtgttaaattccaggagcaaccaacacatgctataaggaatgtagaaaaagaaagtctatcaaaagaacaatcaaaatggacatcattatgggaccaaaagattcctggaactcaagagtccgttatgagatctagtgaagacaagtcacagaagcatagtggtaatatgagagtcaccaagtgttcactgcaagaaaacatggatcaggattttgttatcagaaaacaaatggatgataaaaaattggctgtacattaatgataaacatctggggctttctaaaggcttggttaaacgaggtgatgatggctctattgtcacaatgaagacagaattgaatatgactgtggagcagaatctttgtaaggaaactaataaagcttcaactgaccaagagttgtttcagaattcaaaggtgaggacatgtaataaaaagagtgccagcgaaaacagcaagaaaaatgatgtttctccaccggcagttcctggtcagcagaagttgatacaaaagtcaaaagcaccaaggacggtttctgagaagcctagatgtgataatttaaatcatgaaaattatgatccagcgaataagaatgatggtgcttatccaccaacagaccctgatatgaagaaagctaataaggctagaggagctaggaagttttctgagcaaccaagacctgggaatttaactcaagtggatcttgcacgtccatctcattttgatgaagcaagtagccatgtgccagaactcaagaaaagccgatccagcaagttaactagtcaaaaagatttggttgcagaaagaaaacgacaacgcgaggatattgacactctgctttcgtcatctcttatatcatctacgaaaccttcctcaagtcgtaatactaagaaacagaaatgagaagactccagcaaagcttttgtgaagcaattttggtagcaatggtgcttggatcacgagtttccatcttccgaagcaagtagaggaaagctaactgcctgtaatctgggagctgtatgtgcagcaactgacaaacatccagtggacccaaggagccctccctccatacggttgcaaaagtgctggaattttttggacggctgttaatggtttattacgtcattttatttcccattttcatccgtttggatgcgagcaaaatgagaccatacagacaaatagagcaatcatactgcttgttgaggcgcaagccaattttgcagtgtacataactgtaagtagcacccttgtagcaagaaggcagattagcatttgaacatgcctggtggtgtccttaaaatgaaatgtagcatgtgtggtgtgcagccaaattacagccgaagctcttccgcccccc

SEQ ID NO: 6295 - DNA, 816 bp, Zea mays
aatcagccttggagtagcagtggaggcaccaagtcatatggtcaaaatcagccttccacttggaataatccagaggataacaaaccatctgtaggtgaacaaggtgatccttgggcaagcgaggtgtcttctactgaaggtaaaggacaacagaatgattcttggtcaagtaagatgacttctcgtggtgctgaggataccagcggtggctgggacagcaaggagaagggctcttcctgcaatggtgggggtgaaggactacaaaatgatccatgggcaaacaagattggttctaacgaaggtaaagaacaagaagctgatccttgggccagcaagatgtcttctgctgtgggtgctgatgacaagaatggtacctgggacacgacaacaaagggcactctatctaacgaaaaggctgacgacccttggaatagtaagcggggtaatgatgatgacagcaagaaaactgacgcctggggtgctggctcgtcaggtggggatcaggaatcttcttggagtaaacctattttctctctgggggatcaggaacctacttggaacaacccaaggtttggtgacgatgacaatgtaaataatagaggtgggtttggacgcggaaatcaaggcagagggagagggaggagttttggtggtggtggtggtggatcatcatggaatgaaggcaacagaaacggccgaatcagctgcgggaaggtctggagaaccatggaacagaaggggttttgatggcggcagaagaagaagccgctttgggcgaggtgaccgcaatcaaggcaacaacttggggtcaggaga

SEQ ID NO: 6296 - DNA, 1793 bp, Zea mays
gaccctcttggaggtctgataatcaggtagacaatgaggctggagagtctggtggatataggggaaggggaagaggaggaagggggcaatatggaggacgaggtaaagacaatggttggagaaatgatgatagaagcaattctgggtttggaagggaaaataacagtggcgatggaccaaaatggggtggtggaggtaattggaacgctacaaatccaccaagtagcagtgtaggcaccaagtcatatggtcaaaatcagcctttcacttggaataattctgaggataacaaaccatctgtaggtgaacaaggtgatccttgggcaagcaaggtgtcttctactgaaggtacagaacaacagaatgattcttggtcaagcaagatgatttctggtggtgctgaggataccagtggtggctgggacaccaaggtgaaagactcttcctgcaatgatgggggtgaaggactacaaaatgatccatgggcaaacaagattggttctaatgaaggtaaagaacaagaaactgatccttgggccagcaagatgtcttctactgtgtgtgctgatgacaagaaaggtagctggaacactacagcaaagggcattccatctaaggaaaaggctgatgatccatggaatagtaaggggggtaatgatgacagcaagaaaactgacacctggggtgctggctcgtcaggtggggatcaggaactttcttggagcaaacctaatttctctttgggggaccaggaatctacttggaacaacccaaggttcggtgacgatgacaatgcgaataatagaggtggatttggacgtggaaatcgaggcagagggagaggaaggaattttggggatggtggtgggtcatcatggaatggaggcaatagaaacgatgaatcaggtggcggaaggtctggagagccatggaacagaagggactttgatggtggcggaggaagaggcagaggtcgttttgggcgaggtgaccgtaaccagggcaacaacttcgggtcaggagatggtggcagctggggctctggcaggggaaatggtggccgcggtggttacaggaactggaacgataacaatgagcgatccttcggtgaaggtggtggctggtcccagtcccagtcttccgattggaatgccaacaaaggaaatggcgaaggaaatcaagctttctcgaaaagcaagcccagctgggaagcacaaaacacctctggtagagatggtcaggcaggaaagggtgatgcaaacaactcctggagtaagaacagatcatctccatctagcgcttggggcgctcccagtggaggagctggcggccgaggttcttggggaaagagcaacgaggatggctggaactcagcgggaggatcagccaaagagaagcctgcatggggtggtgggtcagaagcgtctaccaagaaagaggacaaaggtggtgaggggaacgggagccaaggaggaggtggtgtcagttcctgggataaaggggcagatgatgcatggaacggcaacacgggtagtgatattgggagtggtggatggtaagatttccgccaaaataatatgaactctgtcggtgcgtgtgtctagttcgtatccgttacttcgccatgtgtactctacactaaaaagaacatggcttgtgaccatttaaacattaccttagtggtggcagtaactaggtacctttgctccaaaaaaaaaaaaaaaaaaaactcgagctcgtgcaaaaaaaaaaaaaaaaaaaaaaaaaaaaaaaaaaaaaaaaaaaaaaaaaaa

SEQ ID NO: 6297 - DNA, 3214 bp, Zea mays
ttctttctcatttgtctcattcctcttcgctcatgtaaagcatcacttgggaggaatagatgctctgaactaatctttattgtaattatatatctttttattcaccaaaatgtttgatgggctgcagtgactcatggcaacccttttcaagttccacgctaccagtccagaatgcaggtaatatttagttttgttatttatttgtgtcaccactctttttttgcgcctttattgcaatgatttttttgtttcatcattcttagggaaaagcattacattattatctgttcagatgcttgctatgtgaaaccttcaaaaaaggtttagtggatcatatccctaggaacgaaatgatggaacgactctattaatttggtgaggattgaactaatgtgggattaaaagaggcatggtccattaatcaagatttcttccaagcttttgaatttattttattaaaaagtgtatacaaatggtacacttttcatgtggtttagccgtttagacttctctcgtgggtttggtttagacatttgctgcacttgcaacttgttgaaataagtgacttctgcaccttttcatttctggagcagaagcaggagttgcttcctattcatcttacacaaagtacgtcactccttacccaaacaaattgagatatgttagagatgagacccgacaagtgcccacattaaccaaaaagtattgcaaaattataaaatagtgatctaattctactgatatcaatgttatgttcggttgtccacggctccacgctcaccattgcgaacaaaccaaggaaaccgaacattgacgcaaaagaaacgataagtcaatccacaactccaaatgtaaattaaatgttcgacttagattagttataccctccaggacttgcactctgaaaccagtcattatacatggacctaaattgtgaaatggatgcccctgaagccctgggcatacatcatgaaacaggggtagtaaaagaaatttaggttgatggttcttgcagtattgcacatattgtcatttacgcttattaaataggctaagcacctttgccagtatttgaggttttcacagtttagctgggtgtggaacttgtacattttcaggtgcagaatcagaagctgatccatggtgtaagaaaacttctgctgaagatgattctgatccatggggtaagaaaacagacggtgattctgatccgtggggtaaggaagcggtatctgctgctgacggtgattgcaatccatggggtaaggaaacagtaccttctgctgctggtgattctgatccatggggtaagaaagtgttttctgctgatggtgattctgatccatggggtaagaaagcaatatcatcagctgttgaagtttggaacactagtgccacacaaaaggaaggttctagtggcaatgcatgggacaaacaagctggagttggtggatctgatgctgctggcagctcctgggacagagcggttgtcaataaggagagtgaaaagagtgacaactggggagaggcttgcagggttatggacatgggaactggagctgacacagacccttggggaagcaaggtcaaagcagtagatatggaaggaccaaatagctgggaaaaggctacaatgcctccagacaataagctggaggatgtcagccaaggatggaaccaacataagggcaactcaactgaagaccaagcaaaagacaatgtttctaaagatgaggacaacgctaggccttcgtgccgttctctgcccgcctctgcaggtggtacctggggcaaatcaaaagacgacaactgtgatggagcaggtggtgcaggaggttgggatgcttctgttgccaactggaacaaatcatccgttctggctgatgcacaggatgagggttggggaaaaggaaattggtccgctcccgtggccggacgcgcgggctttgtgctcggaaattggaacaaagctggagcttcggaccaagctggaccgaaatcttttggtggtgatggttggaacaagggtggtgatcagaatagcagttggaacagtcctggaaattttggaggtgggcgtggctttgggcgaggacgagggagaggtaggggtcgggaatctggagatttcaatggcagaaatgatcaaggaaattgaaagaattcatggggtggtgacaatgctgaaaaatcttcttggaggtctgataatcaggtagacaatgaagctggagattctggtggatataggggacggggaagaggaggaagggggcaatatggaggacgaggaagaggcagagacaatggttggagaaatggtgatggaccaaaatgggatggtggagataattggaacgctacaaatccaccaagtaatcagccttggagtagcagtggaggcaccaagtcatatggtcaaaatcagccttccacttggaataattcagaggataacaaaccatctgtaggtgaacaaggtgatccttgggcaagcaaggtgtcttctactgaaggtaaaggacaacagaatgattcttggtcaagtaagatgacttcttgtggtgctgaggataccagaggtggctgggacagcaaggtgaaaggctcttcctgcaatgatgggggcattagcataaatcatatgaaggaagtagattcacatgcacccgtgaagcagaagctacaattatttccaataaatgaagctactcttaagccatttgagaaggttgatttattagacagccctattgccagacttgacatagagaccacaacacttggagccacatatgttgctagcttagatgcaggagtttggaccaaggaacaagtatttgcaggttagcacaaggagaacgcgacaatctttcgcccaaaattggatgaggtgcacaagaagagggctgattcatggtacaagacggtttcaaaatcattcgatttggctgacctttctctgtaaatgtttcttgtcggcattgatctatctgtttttggaagatgcaaatgaataaattggtctttgctggtactattcttaactacttgttatttacggtctttacaaaagcgagtacaagaatatcctcaaattttcggcaggaagtgtttttctagaatatttatgtgcgcttccatagatttgaatggtttgcatagactatcccatcaacatagacaattggagaagctcaatttgcgatctgca

SEQ ID NO: 6298 - DNA, 853 bp, Zea mays
  misc_feature (35)..(35): n is a, c, g, or t
  misc_feature (70)..(70): n is a, c, g, or t
  misc_feature (747)..(747): n is a, c, g, or t
taaacttttcgcgagagcaacttttaatgaacaanaccatagtaatttaccatgaaatagagtatttttntgtgaaatcgttcacgagagaagtgtcgcttcacatacaaaacagtcagctacgtaggccccccccccccaatccatccggggtgtccatgggcctaattgacagtttgttgcaatcaatgccacctgtggttggtgtttctttagttgctgatgcaactgaggagctcgagcacgacacgattaactcaggaattttatgtaatgttgatgcaaggacactgacttttatcatcagaaagacttcctactgttgatggcattagcataaatcatatgaaggaagtagattcacatgcacccgtgaagcaggagctacaattatttccaataaatgaagctactcttaagccatttgagaaggttgatttattagacagccctattgccagactacctgacatagagaccacaacacttggagccacatatgttgctagcttagatgcaggagtttggaccaaggaacaagtatttgcaggttagcacaaggagaacgcgacaatctttcgttcaaaactagatgaggtgcacaagaagagggctgattcatggtacaagacggtttcaagatcattcgatttggctgacctttctctgtaaatgtttcttgtcggcattgatctatctgtttttggaagatgcaaatgaataaattggtctttgctggtactattncttaactacttgttatttacggtctttacaaaagcgagtacaagaatatcctcaaattttcgaaaaaaaaaaaaaaaaaaaaaaaaaaaaaaaaaaaaaaaaaaaa

SEQ ID NO: 6299 - DNA, 2129 bp, Zea mays
ctagaaatacctaccataaatcaaagagaaagggagcagcacatgaaaaacagagtgcttgcctagcgttcatagttcaacgccatgtatctcggtgccgagccggacgctatttcatggacatatgtcatcgtcacgtactcatgtgtgccgtcaatatggatctgatctctcacctcggcatggtaggtcagggtgccaaacccaggataaaaaaaataaaaaatgcccagagatccaaactcgaacattaaaaaaaaatcgggatgacactgcatggtcatctctttctattgtgagtgaatggagcaccgctggcctggggcgttgacgagacgacgcgtttaggctcgaagaagcgtcagcgtggacaggcgaaatatggcacctgaaaaggccctgagccagcagcggtgttgtagaggcaggcgtacctgtctctagttttcagagcatgcggcctgaggcggaagccggaagcgcaccatcggcacggcacggcacggcagctcaatttgcccgccgttgctggtggtggccgtggcgcctgggcccgttgacgcagtcacgcagtggctggctgcgcgtgggcgggatcccatccgacggtagaaacgaacagagaaactagtgtcgttttccacacgaggaaggaatgcacaaagctggggacagtgcagactaaaaaaacacccacgtccatgccggtagtacgtcgcagcaccgggtgtctttacagctcccggcacaaaaaaatcgtgctatatttgggaatgcctggtgggctggtactgtcaactgtcatcacggtgctctcacctcccagcttcctgttatattatttagtcattttgcgagaaagcttcaattttttttatagatagacgatactactacgtgattgtgcaatgataatctcttctcgactccatctccaactagaaggcaacgaatccaaaaagacaaaaatggggaaaaaacgagcgaagataggaaccagggaaccagttgagaaagccaggggccgggcagccgcacgcggacacgtcacacgtcgtcctggcaaggcaggcagccgctgagccctggcccgcggttaggccagccggccgtcccgttcgtcggtccggctgcacttccacgccacgttgaccaccgtccccacgtgttccattgcacccagccgcccccgtctctcgctcaaagcagactagtctcgctgcgtgcacgcacgcacgcacgcacgcggtgtgaaacggaagaaaaaccccaccgcctatttataccgcgcgtgctgagctctcgcctgcggtaagcgataggggcgcagagtttccacattgtagtaccatggaccgcggcatcaagaggagcgtcgcggcagcgggcggcggcccgccaccgcccaaggtgtaccgcgtggagcccagggacttccgggagctcgtgcagaggctcacgggcgccggtacgcccgccgccgccgccgctccggggccggcgcaccggagggcgacgctgaagccggccatggccgcggagagcaggcgcgcacaggccgctgcggccgtgcccgtggcggccggggcagagcagttcgactacgcggcgtcatggttctccgcgccgctgctgagccccgggtacggcgcgccgggcttcggaggcggccaccagcaccaggggaacactggctctctgttttagggccctaggtagaaacagagtccctgtatagctccgtcgtcacttgttcgtgcttctctggctctttttgtcttgcgtttcgggcatgactatacatacacaaccttcttgcgccgcgtataaaattcgaccaagaagttatacgggtagtgttcatttctgtattttctgatagaacgataaataaatctgtttttttttcctcaaaaaaaaaaaaattaagtatgcatcttcactttttttggtagagcatgtaatcgttccatcgtttctggctccatccagcggttgccaagcatttgttgatcagtgcggttaggaaccgctcatataggcccgaatattttgtattttagttattttttaaaaaaaatacgtttaaaaacttagaagatttaatttcggtttttcgaccctaagct

SEQ ID NO: 6300 - DNA, 1893 bp, Zea mays
gggaccctcgaggccggcccggccgaacacggatggaattggcgcgggcggcgggctggcagttgcgcagcaataactcccgctgcccaccggctcacctgtccttcatccgccccgatccgaccccaaatcaattccaaattcaatccggtctcagtggttggcccgccgctgccagtgccagatcgaatcggactctcggctcgtgtgcagcccaccggcgagacgccgaagctatatttttatgcccatctgatccgatgcgtggtgtggcgtcgtctccgcttttactagatcatcagtagccagctcaggagccgagcctggtcagggtagccaagcccatcccggtcctctcccggcgtcttctccctccgcaccgcggctccggcgatggcgggcgtcggctccgcgctgcgtcggctctacctctccgtctacaactgggtcgtcttcttcggatgggcgcaggtgctgtactacgcggtcctgacgctgcgtttgagcgggcacaaggccgtctacgccgccgtcgagaggccgctgcagttcgcgcagacagccgccatcatggagatcgttcatgggctcgtagggttggtgaggtctccggtctctgcaactcttccacagattggatccaggttgttccttacgtggggtgtcttgtggagttttcctgagacccagtcacaccttcttgttactaccctggtcataagctggtctatcactgagatcatcagatactctttctttggaacgaaggaggcatttggctttgcgccttcctggttattatggcttaggtacagcacctttatgttgttgtatcctactggtatctctagtgaagttggtctgatctacattgccttgccttacatgaaggcatcggagaaatactgtattaggatgcccaacaaatggaacttctcatacgattacttctattcatctgtccttgccctcctgatctatgttccaggaagcccacacatgtaccgttacatgctctcccagaggaagaaggcgctatcaaaggccaaagcggcatgatgatgccaagcaagggaatcggtggactggtttgcgtgatggatgccggaacatgttcaagttttcgacatcccctgtagaatctagtggtcgggggatatatattactagaatggggctcttcatatgaactgccccgtatgcgtaatgtgttgtaccggagtcatcatttcagatatcagctgttgcgtggttaaatcgtagtttgcttccggatcacccatcagttggggggtggattaccatgttgattatataaggcaatgcgttccgcatccttccctcaactggtgctgtgctctcttgtttctagcgtacgatgaatgatggattttatcccgggcctggaacattttgcatgctctagcttcatgttgattattatatagcaaaattagcaatgtatttcttacttatgacactgatttttttttaaaaaaaaaactgccaagggggatccccacctgaaaaaaaaaaaaaaaaaaaaaaaaaaaaaaaaaaaaaaaaaaaaaaaaaaaaaaaaaaaattgggaggatttattatctttctcctttttccccctcccctggaccctttaagcctaaccaggatcagctttgttgctgcggaggcaatccctgtcgcctgctccctttgatccccatgagagtaccacgccacacccttaaggtccagctggcctcccctcccattttttaagaacaatctgcaccatgctgctgctgctgctccatgagcagacggaattcttctatctggttcgcccgatgagaagaaagataaaaaaaagtcctccgaattctgctttctcacccttgctgttcatcgattcc

SEQ ID NO: 6301 - DNA, 1045 bp, Zea mays
ccggccgcgccgccggccggcatccgaatccctgccccttcgcccttcccctccggccgcagccccttccctgccgctccggcctcctccgtcgggaccgccgacgacgcgccgcgcggaagcctgcggggatattgggtaagcagttgtgatcctgttctcttgctcggatgccgggttactatgacatcgatgacatcctcatggaggatgagcctatttcagttgttttccaagtaactgcaaatggtgttggcctgctagatcctggtgctgaaagtaactgtgtagagaagggcgccaaggtggacctcccattttggcttgcgcatgggctgctgtctctggaacaagctgtgtcaataaacccacctccatgcttcacacagaaaacttggaaggagatccaagctgatgcggcctgtgtggatttgagggttcgttgcccgtacttttatgagctaggatgcaagattgttcctttggtgagtgacaatagcattggcctgttcttgcgatatgcattcaccagtaggtacaaagaggttctaagtaagtcccacagttcttccatgatgacagtgcccaagttcgttccacgccttacaaaagaagaaactcgggtgtttgaatctgccagagaatcgatgactggtttcaagaaatggcgagcaggtgggatgagactgcaaaaggcttccattcttggccggaagaggaagacaaagctgcctgaatgagttttaaggtgatgtgcgctgctttgatttgctagcaccgtgagcaaagagaaaagtgaatggcagattaaatctggatgtactatgatctgctgtacattgtgcacttgtgtacagcagctctgatcagtccgtcctttgtaaggaaaatgaacaccgtcttaaatcatgatatcatgtttggagcaggtgtcatgattttcagcagggtatcttgaatgagtttgaatcatgatatcctgtcttaaatttcacatgttctcaaaaaaaaaaaaaaaatgagctcgtcggcgcgcccggtaccc

SEQ ID NO: 6302 - DNA, 1857 bp, Zea mays
gggaccctcgaggccggcagaaaaaaccaaatcagcaaatcccccatccctatccagcggcttctggctcctccgccaggtcttgccgtccagcggcctcaccgccctcgagatttgctcggcacggtcgccttgtttgccgcctgcagcgttctcccactcggctacgggctacgcctgacgccaccgttaacggcgacatccgaacgggccccgacacccatctcgcgctcagaaaagggataagcagttgtgatcctgtcctcttggtcggatgcggggttactatgacatcgatgacatcctcatggaggatgagcctatttcagttgttttccaagtaactgcaaatggtgttggcctgctagatcctggtgctgaaaataactgtgtagagaagggtgccaaggtggaccttccattttggcttgcgcatgggctgctgtctctggaacaagctgtctcaataaacccgcctccatgcttcacacagaaaactcggaaggagatacaagctgatgcgtcctgtgtggatttgagggctcgttgcccatacttctatgagctaggatgcaagattgttcctttggtgagtgacaagagcattggcctgttcttgcgatatgcattcaccagtaggtacaaagaggttctaagcaagtcccacagttcttccatgatgacagtgcccaagtttgttccacgccttacaaaagaagaaactcgagtgtttgaatctgccagagaatcgatggctggtttcaagaaatggcgagtaggtggggtgagactacaaaaggcttccattcttggccggaagaggaagacaaagctgcctgatggaccacctacttcttgaatgagttttaaagtctccatggaaaagagtggttgatggttgaggtgatgtgcgatgttttgatttgctagctctctgagcaaagagaaaagttaatggcaaatctggatgtactatatgatctgctgtacattgtgcacttttgtatagtcggacgacagcactgatcggtccatccattgcaaggaaaatgaacacccgaaccatgatatcatgttcccattttcatattgctaaaaagtatctcttaaacttgtttttagtaaagtattgaaatcatctcgtggggggccaattggagcactgcattaatctattaagggcttattttataacaatgttttccaaaagcgtggttttactaagtttgtaattcttaccacaataccatagttttggttaacttcaaaaataatatggttttgagaaacattgtttggatacaatattgtaaactatggtatttagataaaagctatccatgctattaaaacttagggttggagtggactttttaatactctaaaaaaattatgttatctagaatatcatggttttgaaaatatagtttttaaaaatgtaatcaaacaccttatgacataaatactatgctattcttgtaaactacgatattttctataaaactttacttccaaataggcactaaaagtttcccaaaaattctcgacatacatggacatgttaatcaatactagtcctaattagggatgaaagcagattcaaaaaatttcggttttttggattttgtttttgtttttttcgaccgaattcatcggtaacagtatttttcgaaaacagaataagtcatcagaattttatatcggaatcggtttaacgttttgacgtctgttttcttcggttaccaattttaatcaaaatttaccgaatttaaatttcaatttttttcgaaaataaaaaacaatctaggtggcccaaggcccacgctccccttttcggcccaagatataagcatgcag

SEQ ID NO: 6303 - DNA, 2789 bp, Zea mays
acgagcaactcggctcggcttgtttacgagctcgagttggctcgtttagctcacgagctagagcagaaaaaaataatatatacataataattattttttagttaatttacaactattttaagaacacaaaccacgttaatgtaacaccaaatttgcacaactcatcactcatcaattcacaatcacatacattatttatcagtttaacccataattatatttgcatagaccaatttaacacataaacatattttattaattattagtttagcttataggctacaaacacctcacatatatataacatgttcatcaattattctgtaaatgctatgcatatagttttgttttgctggaatgtggtaccccatttagctcgtgagctggctcattaacgaactaagctaactcgttaacgaatcgagctagaatgtcagcacagctcttgaaaaaaattcaaacgagtcgattcaaattgactatgaactgaatgagccaaccagccacgagcatacgagcatttcgtacaaccatagatacaattattcaagaaagaaagacaaaaaaaaaaaatatttaacatccgaatccctgccccttcgcccttcccctccggccgcagccccttccctgccgctccggcctcctccgtcgggaccgccgacgacgcgccgcgcggaagcctgcgggtgagcgtccagatccacccgcccccttcggcattccccgccgctccagcctcctccgccgggaccgccgccgacgcgccacggggaaggcctgcgggtgagcgcccagatacagccgcccctttggccttccccgccgctccggcctcctctgccctaatccccttaatgcgtcgcctaatgagcgccttaccgccgcctgaggcgatagggcgacgccttacgcataacttaaggcgggtcgttggacgccttggttttttccggcgccttaccgcctaagcgtcgacgcttaggcgacgcctttatgttcttcttactcattgacaagacacaaattgctgctgtacaattagggatattgggtaagcagttgtgatcctgttctcttgctcggatgccgggttactatgacatcgatgacatcctcatggaggatgaggtaattctagatacaggctttcatctcctctcgtgcttgttgcttgtgtatatgtgctgagtatatgttttggctctgcctgcagcctatttcagttgttttccaagtaactgcaaatggtgttggcctgctagatcctggtgctgaaagtaactgtgtaagtgtctgcccgtgaatttggtgtgccaatgcttctattgctagacctgtgtacacatgttggaaaattcttcttatgtcctcatacttactgaatgcgatttatgcagttcgtgaacagtagttcgccgagaggcttcttatgcagtccttgacttgcttaaactgattagtgtcactgcactttttcttaattcttatcgttcaggctgcaatatctgtcacgaaccccaactgggaaagtgcgaattggaagttttgcattgtggatgaactttactctttctactaaaattgctaatagggatgtttcgcttgtataaaagaggatctgagtttcttttttatatccaggtagagaagggcgccaaggtggacctcccattttggcttgcgcatgggctgctgtctctggaacaagctgtgtcaataaacccacctccatgcttcacacagaagtagtttttttcagtgtttgttattgcattacaccatacacagaaattcttggatcaacagcaaagcatgggagagcaaggagtattcttatttggaaaaacatatatggaattccctatcaacaacttaataaaaggatctgatctttttgacaccattgtggcctactgtagcttttcatagtaaatagtagcattttgcagatctttctcttataacttgatgatagaacttattaaagacatgaatctattcaaacggttctccagaatttgacttttgctgcatggcttgggttttggttctgactatgaactaaagcgtgaaatacagattctgcagtattattctcctaacaaaatctgtattctggtatctccatatcatatatactgcagaacttggaaggagatccaagctgatgcggcctgtgtggatgggacccttcgttgcccgtgggtttatgagctaggatgcaagattgttcctttggtgagtgacaggagcattggcctgttcttgcgatatgcattcaccagtaggtacaaagaggttctaagtaagtcccacagttcttccatgatgacagtgcccaagttcgttccacgccttacaaaagaagaaactcgggtgtttgaatctgccagagaatcgatgactggtttcaagaaatggcgagcaggtgggatgagactgcaaaaggcttccattcttggccggaagaggaagacaaagctgcctgaatgagttttaaggtgatgtgcgctgctttgatttgctagcaccgtgagcaaagagaaaagtgaatggcagattaaatctggatgtactatgatctgctgtacattgtgcacttgtgtacagcagctctgatcagtccgtcctttgtaaggaaaatgaacaccgtcttaaatcatgatatcctgtttggagcaggtgtcatgattttcagcagggtatcttgaatgagtttgaatcatgatatcctgtcttaaagcgcccatgttctcaaaatttctgtttccttgagcttatcagct

SEQ ID NO: 6304 - DNA, 702 bp, Zea mays
gggggtacactccggtcttccgtctagaaggattttgcagaaggattttgcttggcatcaaggaacagtgcaaactagaagaaacctccgtcatcagcgacctctccccaacggcgccgacgatggcgcaacagcagacgcagctaaccactggctcgggcatcctggatgccgtcccgctcttcgtcgtcatcctcctcgcggcccacgtcctggccctcgtgttctggatgtacaagctggcttccgagaagcaaccaccccggaggaagacacagtgacggcgccgatctacgccatcggcgatccttcgctagcctctttatcggttccattttcatgtgaaccagtaccctccagaacattcaggccgtcaattattcagagatatccatatagtctttcaatttgttttatttatacttattgcattttgggtattgtttgataacaacttagcgatattctatgaatcactatccgtttgggtgataaataaatgttcctagttttagaccatctccaaaaaaaaaaaaaaaatccttcctttacagatccctgaaagaaattttccttttgatctcattcatctctaataggtcagtacccgtgcgttgcaacgggaacatataataccatgataacttatatacaaaatgtgtcttatattgttataagaaaaaaaaaaaaaaaaaagcggcc

SEQ ID NO: 6305 - DNA, 3387 bp, Zea mays
ttccttgtacgtgggggtccgcgaggccggcctcttccctccttccaggttgcatataaagtttggtcggagtcttttggcatgtaccctctacctatggtaaagagagtgagacaattctggacttcaatgaaaacttggttgtctgaaaactttcctgaggcatacaaaacgttatgcgaaggtgtttctgaagctcaattaaagtcagcagaggatgatcttggtttcaagctccctatgcccacaaagctgttgtatcgcttttgcaatgctcaactgccttttagtgaggaccatgacacaaataaaagcatttccacttatggattgattgggggctatgcgttttatgatcattgggtgaatgtgcatttgtcaccgcttgagcaaatagttgaagagacgaaggacttctatcgggagttccctgatgtatttcatgggcgcaaattcattgtagtggcaacttcatggtttcatccgaaaacatttcttctagattgctcaaatggtgaactttatgttggtacatacaacttaccgataggaggaatgcttccctgtgtgcccaaagcattgataaagccagcaggtaatgatctagcacaagatggactactcctgtggttagaagaacaccttaggcgtttacagagtggcatgatcaagacccgtatgctgatggcatcgagatatatcagcttatatccagaagcacctccatcatgcagttcagctgttacaaatggcattaaggtggtaattcttcacttcatagacagttatctagtcatttagttgcacgtgtcataactttctccatttcctacacagtcatctagtcattcagtagtaccacatttggttttttgagtacccagattgtgtttgtaaccactgtttggactgctcagattttctctacattagctaattttgccatggctatagtactgcatactgtagaccattcccatggatgatttcttgagccttggtctgacatatctgataccaataggtacgctcatctgctgtctttgtgccagaacatcctgggaggcctggggaaaaatttatgttcacttactcaattcgcatgtcagttccagaggcatgcatgctaggtggcgtgtactattcttcctgccagctttgctcccgccactggaccatcagatcgtgtgacagggttgtttctgatgtgagcggaggaggggttattggagaggtatcctggggaggaacagaactagttttttttttcccgttactgactacagtttcctttgaaaggtgattaggtaatgtgcctgatcaacatatctcgtgcagtatcctctactgttacctggtgaggatgagtttgtctacgagagttgcacgccactgccccaagtaccaggatctgtggagggctctttttcgtttgtgccgggcaagtatgttctgatttatattatctagagaagttatgtttatgtggatcctgtcacctccattctgtaaatctactggttagagatgctgtaatgttttgtaggcctcactgtttgtcatttgttggtcttgcttctctttgcaaggttgagccgacctgaagggaagccgttcgaagtcatggtggcgcctttccctcttgatgtgccagaatacatcttctgatgatcacagcagaaataaatgtatgtatggttgttgggaaaaagttcggatgcttgtaataaccttattggagtaatgtaaaataaggaaccgtgcgctcttcgtgtaaccagcgaaatgtgcctcgtacccgtatcctagcggggccccccgcgcctgtgctgggcaagtgggctgggccgcactgatgtgaagatatcaacttgctggcttaggctccgatccaacgtgatagcccacggcgagggcatgtcttgttgcacaagccgccccttttctccatgtctccagttagtagcttagggcttgtttgggagcaagtggaatgaagggaattgagggtgttagaattcctcactatttaaaattgaatagtggggtattctaaccccttcaatcctctccattactcttcctcccaaacaagcccttaaggacaagcaggtcagcttaagtttgcagcctaaatgcctatggtatgatgtcagccataaattctcttcgtggtcccagctcggttgggaaaagccgaggatttgaaatagaacttgctgcggagctgcattagagcaaccacactggtgtagatggcatactctagagcaatgttcatgtcatctatatatatcgtactatagtaaatttttgcaatgatgtttctatgtagatatatatagttgtttttaataattacataccctctttgtaccaccttgatttttgcgtataggcttactccaggtttatagtagcactaagatctatagctgttttaattctttgccacataggataaatgctgacagactttttatagagatcttgcaaaacccctagatcaacaaaattagtgttacatcatgtttacatgtccattgccaagtaccggtgtttgcaataaattatacatgatgaaaatactagggaagcatcaggtgcctaccaaggcagtatctcactcccttagcctatctccagcagccactacaacatatgtgatctatgacattctcgttacatcgtaaataagaggtgttttgtcataatctttgctgttgtgatgacttcgtgacgaatagtcatcgtcatagaaggtgtatgttaaagaaacttttttgatgagaagcaaaaaaaaatcgtcacaaatgtagtgacgaaaatgtattcgtcataaaatttatgatgctctaaattgtcatgaacgaggctaaaaacgttacaagagtataacattgaatcattgctatatggtaattttgtgacaagatgtttgttataaatggagtgacatgacagttgtaacacctctagtgttacgagaactaaaactttggcattggcatcatatgcactgacattaccttgttgtgatacacctagaatgcattcaccaagctaaaatttcaaaacaaaacatgtgatgtgatgcttgcttgagtatatggtatggtaaagggatccttaaatctaggtaggggtaaatctctcaaggactagtagtatgtaaccttatgttttaagcacaggggagtggtcttgccaagtttggtagacatgttttaaaaaataatgatttggaatttggagaggttaagcacttgaaagtaccttgggacacccaaaaccctagtttggagtccaaaaaccctaactagtgccttatagattatttcaaattctaatcacttttggccaaaagtgtatatatcaaagtagtag

SEQ ID NO: 6306 - DNA, 1839 bp, Zea mays
aaacattttttttctcgcgtcggcctgtctacctgctctgtctccattccgccacgcaacacttccgtgccctacgccccagaacctcccaccgcatcggagggctccgcgcctccgccacgccgatggcgtcccagccgccgccagagcccgcaccggccgaggcgggtctggaaagcatggagggcctcgtcctcgacacggtcatctcaagagccggcgcgcgccccgcagcggcgctcgcctgcgccagcacgcgcctccgcaccgccgttgccgacgactccctctggcgcagattctgcggtgaggacctggggctcgacgctcccgtcgatccagagggccggcctcttccctccttccaggttgcatataaagtttggtcggagtcttttggcatgtaccctctacctatggtaaagagagtgagacaattctggacttcaatgaaaacttggttgtctgaaaactttcctgaggcatacaaaacgttatgcgaaggtgtttctgaagctcaattaaagtcagcagaggatgatcttggtttcaagctccctatgcccacaaagctgttgtatcgcttttgcaatgctcaactgccttttagtgaggaccatgacacaaataaaagcatttccacttatggattgattgggggctatgcgttttatgatcattgggtgaatgtgcatttgtcaccgcttgagcaaatagttgaagagacgaaggacttctatcgggagttccctgatgtatttcatgggcgcaaattcattgtagtggcaacttcatggtttcatccgaaaacatttcttctagattgctcaaatggtgaactttatgttggtacatacaacttaccgataggaggaatgcttccctgtgtgcccaaagcattgataaagccagcaggtaatgatctagcacaagatggactactcctgtggttagaagaacaccttaggcgtttacagagtggcatgatcaagacccgtatgctgatggcatcgagatatatcagcttatatccagaagcacctccatcatgcagttcagctgttacaaatggcattaaggtacgctcatctgctgtctttgtgccagaacatcctgggaggcctggggaaaaatttatgttcacttactcaattcgcatgtcagttccagaggcatgcatgctaggtggcgtgtactattcttcctgccagctttgctcccgccactggaccatcagatcgtgtgacagggttgtttctgatgtgagcggaggaggggttattggagagtatcctctactgttacctggtgaggatgagtttgtctacgagagttgcacgccactgccccaagtaccaggatctgtggagggctctttttcgtttgtgccgggcaagttgagccgacctgaagggaagccgttcgaagtcatggtggcgcctttccctcttgatgtgccagaatacatcttctgatgatcacagcagaaataaatgtatgtatggttgttgggaaaaagttcggatgcttgtaataaccttattggagtaatgtaaaataaggaaccgtgcgctcttcgtgtaaccaaaaaaaaaaaaaacggacccgtatcctagcaagtatttttgcgcctgtgctgggcaagtgggctgggccgcactgatgtgaagatatcaacttgctggcttaggctccgatccaacgtgatagcccacggcgagggcatgtcttgttgcacaagccgccccttttctccatgtctccagttagtagcttagggcttgtttgggagcaagtggaatgaagggaattgagggtgttagaattcctcactattta

SEQ ID NO: 6307 - DNA, 6871 bp, Zea mays
  misc_feature (6065)..(6065): n is a, c, g, or t
  misc_feature (6267)..(6267): n is a, c, g, or t
aagccaaggccaaggccgcatgcttcttgtcactgaggctttgagattccaaagagaatatacccttaaaagttccaaaactttgtttccctaaaatggaacttaaacaagactaaaagcaaaagcgtagagaacaattcagaaataggacacgaatcttgccgggttcgatctttcagcggctgccactggacgtactttcattgggtgtggacgaatccacctttcctttcgacaaagctaaagagttgagaattgagatcggtccatcgtgacaagattgctgcgatgctggaaacttgcgtgcctgcagatccggaagccgcatctgtggggagttaacagtccaagcagcttactttcactaatactcaagggacacataagttgtactaatattgtaaatattttgtttggaaacatacataaatcgctctttcgtactcttacgaatttatgagatctataaatatattgaaatataagcagtagctaaagttatgtctggaataactgctctgctcggctttcttgcctgcctgcctccgttcaaaacaaggctggaaaatgttccaagacagaacacgagcagaacaattcggacttccggccgaccaatgctgacaagtagtataactccacagcacgaaattgacggctgggctcggtggaccacctgtcttctgtgtcactgtgtgctgtgattgtcggcatgtagaatttttatggagcttgtttgtaggtgcagcgtcactcttggaaaatccgtcggcttaattccttgcgcaggtcgcaccagccaccacgcacttgagttgcctcttttgttggatgtgccatgtttttttagcttatagagtatagttgatccttttgttatgtactaaaagggtgtttgggatggctctagatgtaagctacattatcaatttaaataattctaaaaaatatttttaatttaaataataaacaaagaactttatctaaatgtcttctaaagccttataattctatcttcataattttctagagcacataatgacctgctctactaactctaccgaattttttagagttggaactattctaaacatggcttaagtataccattcttgggaaaatatttcttccggtggtggaaaagttattacgcgttgctatagcactatacaagtcgagtcttatatatgaatcccacttgttccgctgctttccatataaatggtatttaaagatctaacacatggagtcagggtctcgatctttttatagcctgttgtcatcagtagacttcaataaatatactacaaaacacattgtaagtagaagagaaattaaaatatagatattgtgatatgtcttctcggtcatcttactcttttttttctcttcttcctttttttttctccttctcagtgacagatatctatttttttcgtctcttttctctcactcccacctgtgctcgcgcggctcgcctgatgctgtggctggtcgtgcggcttgcctaatgctgcggctggtcggtccaccgtccagcgcggccgtcggcgtccatggctgcgcggcagggaaggctcgccagtgcagcaaggaaggggttcgccggcgctacacgagagaggcgcacgagggcggtcaggaccgagcggtgcggccgtgcgcgagccagcgttgggggcggaccgcacgtggcgtgggatggcatcgggagggaagaaaagaaactccgtgaccatggggatgtacaaatctaatatttttgtgaacaatttttttgggtagatctggcctttagattcagagtttttttttgtcattttggatccaatgattatataatatttgatttttaaaaataataatacgcagaactgaatttggttttatgtgcagcgctttgagctgtcccagtcgcttagcccacacctaccccatgcctcttgtcacttgtactccaaaaggaaattggacgtggtcgtctgcactgtttattcgttgttactttcgaggacgttggtgttaccgcaataagtcgttaatatctaaagtaggatatgcttttcctaatacggtttgctgacatggtggcagactggcagtggtcacacaattgtcccggtggctcaggacaactcctgtcaggttccgacgacctatagcctcctattccacgtcaacgacacggcttgtgtccggctgcccgctggggagtggggggtgaactggtgaagtttcgtggcaccatccagtcttcagcacgccgcacgcgaggtcaagtcgtcgctgaaaagccatataaaaaaaaaaagggaaactcccaatcagcacgcacgtttcagcatccagtagctagagctgcaggctgccgccgtcagccgcacccgaggccgagagcccagagccgagaggcgagttgggcggctgtgctggccggccatggcgaagccaggcggcagcgatgagtcgtgggagtacagtctgcgcaagtatctcctgctgctggccacgctggtggccacggtgacgtacggtgcggggttcaaccccccaggcggcgtctggcagactgccgaccccgccgtcgaccgcatcgccggcgaccccatcatccgcgacacgaactacgcccgctacctgtccttcttctacagcaacgccaccgccttcgcctcgtcgctcgtggtcatcgtcctcgtcctcatcctgtccgtgctgcacgacaacgggggaatcaccatgctcgcgccgctgctcggcgtcctccgggccgtcatggtgctggacctgctcagcctcatgggcgcctacgcggcggggacgttccgggacacgctcacggcggtctactccctggtgctgtcggccggcgtcgtcgcctacctcgtggcccacctggccctggcctcgagggcgccggcggccgaggacaagagggggcagagcgcgccggagcggctccgcaaggtgctcatgctcctcgccacgttcgccgcgagcgtcacgtacgtcgccggcctcagcgcgccgggcggcttctgggaccactccgaggacggccaccgcccgggcgacgcgatcctcaagggagggccccacgacgcgcgcctcaaggccttcttcgtctgcaacaccacggcgttcgtcgcgtccctgctcatcctcgtcatgctcctggagaagaagctctgcttcagccagaaggtgcgctcctacgagatctacggcttcatcgccgtcacgctcatcagcctcctgggggcgtatgctgccggcagcagccgccagatcgacacgaccatctatgtgagcgctcttgttggtgctgttgccgtgtgcattctcatccaagtggttttcgttttgctcttccaagcaaattcgaccgaggggcaacaaacacgaactcaaggtcccctaacaaataatggcaatggcaggtacagtactggcagagggaccttggaattcggtgcaatttgttcgttctatcgccattttaatctcaccgatttctctgtaatttatcagtgatgagcgtcagcagactcaaggtccgcaaacaagcatggacagtaatgacaggtacgatcggaagcacataagtgctatcttttatctaaatatatatacacactgcaaattattggaattgcagtatgcaattcaacgacattttagttgaattttttttatcgtattgattttattgttatttgttagggatgagcagcagcaacaaacccacggtctgcaaactagtgatgacaatgtcaggtacggactggaagagcatatccctcatgttccaactctccaagtttactagcaatgttgcagtatgcagttcaaaactacttcccctgcaattttgacgggttggttttcactgtcatttatcagtgaccaccaccagcagcagcaacaaactcagagtcctcaaactagcaatggcaatggcaatgccaggtacaaacagagcaatgcaattggattctggtctctctatactctttgattgatggatctgtttcttctctttataatccaccagcgatgagcatgagaagcaacaaaatccagcgctggagaaggctcgctctcttgtcctgctgctcgctactctcgcagcggcaatcacctaccaagcgggcctgaacccgccgggtggcctctggcagagcaacggccgcctctacaagatcggtgatccgatcctcttgaccacgaaccccagacggtacaaggcattctactactgcaactccgtcgccttcgtcgcctccttggtcgccgttatgctggttaggaagaagacactgcaccaccacaacgcgctggaggccgccatggtactggacctgttcggcctcatcggcgcttacgccgccgggagctgccgggacgtcagcacgtccatctacgccatggcccttgcaggcgccgtgctggtctacgtggtcatccatgtcgtcttcttgacgctggacgaaaaggacggcagcagcgcgagaaggaatgatgacgcttccttcgaggagagagagaaaaaggaggcgggcctggtggagaagaggcgcaaacgactgctcctattcgccatcttggccgcgaccatcacctaccaagccgggctgacaccgccgggcggctttctggtccaggacgataaccgtaccggccgccatgccggcgacgcggtcctgctcaacaactacccgcgccgttacacggctttcttctactgcaactcggtgagcttcatgctgtccatcgccctcatcatcctcctcgtgaaccccaacctgtaccgccctgccattcggagcaatgcgctgtctgtctgcacggcggccgggttgattggaatcatgggcggctacgcggccggctgcacgcagcatctgaagacatccatctatatcttcgtgttggcggccgtggttctgtccactgtggtctttctggctgcggtgttccttgtgatccatctgagaaaaaaagacgataatgctaacagcaccaacagagcagcagcaagagaggcacctggggaagaacaagaagccaatgctggtgctggggtgccaaatgccatggggggcgagcaaagaggtccccaaggagccaaagctcgccgaaaagaaaagagggcacacgccaagcgcaagtatctgatgctgcttggaatcctcgtggcgagcgtgacctaccaggccgggctggcgccgccgggcggggcgtggcagtccaacgacggcacccacaccgcgggcgaccctgtgatgcacgactaccggagggcccggtaccttgccttcttctacagcaactccacctccttcgtggcgtccgtggtcgtcgtcgtgcttctgctgccggagtcgctgcacaagaagtggtggtggctcggggtcatgaacgcgacgatcgtgctggacctgctgggcctcttgatcgcctatgccgccgggtccagcaggacgtggaagacttctgtggttgtttccgctctcgttctcgctgtgctcgcctatttcgccatacatgtgctgctgtcaagctgcgtcaggagagggaagaagacagcccccgactctccgtctccgccccaggaccaggagaacagagaggaaaacgaagcggcaacgaaagaggtcgagctccagggtccagcttgctgaaactggagtgtacagtgcggagctgaatgtgtgtgcagtccagtacttgtagatttttttttcacgaccgtgttgtcgcattttttttttgtcaagaggtgtagtgtttttgttgatccacgtagcgggcgggaacgattgatgtgcaatcaagtgttagatgtaagtgtacaaacaagtctgcgtgcaagcgaggcttctctgtctttttagatcatgtagtcttcgcgtgggtcataaatgacttcacgggtttggaacagtcttactgaatatcagcgtacctgatgactggatattactgtacgagctgattcctgaggagtcaaaatctcctgcgaaaagcatgaacagaagcttgatgttcgtagatgatgatgntcgctgttgatcattatacggcgcatctctgtagccatgatgtctcagcctttatttgctactgtgcatgggtggaaattcttgccaaggatctgcagagatacgtcgattggaattagaagtactcatgtgactaggaacatggagagactgtccagaatgatggaacccaattcaatttacaaatgttaaagtatgcaanctccaaacatttagactgtgtcagaaaaggacatcttaaaatatactaacaagaggaagtgtccagactgatgcaactcaaataaaattccagatgctaggtaagtgcaggtgtgaggtttactccgaacaagggatgtttataaagtgtacccttgaatgatttaccaaagaagtatcagatgttcattcaatagatgatgtcccttgcatcctccttttgcaggcacatagtaaagttgtttggttcaattcaatgaaaaggattcgcttgattatataactatcgtatgttactttgccaaaagccaattactgaatggaccaatagatgatggaatgctctttggtgagggcacatctcctctagtttagaacccgaacattcgtaatcagacatatgctcttcagaatgggcaaattcagcaccaacgtttccttctgaattttcattttcataacctgactgttcaatttcaacaatatcttcatgcatctgtgggtactgcagctccctatttgcaatctcatcttcagagtcatcactagaatattcaactatttgactggtggtgactacaacatcctcagttctgtcacaaata

SEQ ID NO: 6308 - DNA, 1408 bp, Zea mays
ccgggaccgtggtcttcgccaaaccgctttccttcccatctaaaaccgccccctcccttcctcttctcctagctctcttgcctgcgcaccactcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgtaaaaaaaaaaaaaaaaaaaaaaaaaaaaaaaaaaaaaaaaaaaaaaggaaaaaaaaaaaaaaaa

SEQ ID NO: 6309 - DNA, 784 bp, Zea mays
cattgggtacctcgaggccggccggggtcaaacaacgccaagcgcgcctcccgtgaacccagcggcccgtcaagtcaaagcatggacgtgccgctcccgctgctgctcggctcccgctgccgcccggtccccggggctggccggtgctgggcaacctgccgcaggtcggcgccaagccgcaccacaccatgtgtgctctggcgcgggagtacggcccgctgttccggctccggttcggcagcgccgaggtggtggtggccgcgtcggcgcgggtggcggcccagttcctgcgcgcccacgacgccaacttcagcaaccgcccgcccaactccggggccgagcacgtggcgtacaactaccaggacctggtgttcgccccgtacggctcccggtggcgcgcgctacggaagctgtgcgcgctccacctcttctccgccaaggccctggacgacctgcgcggcgtcagagagggcgaggtggcgctcatggtgagggagctcgcccggcagggagagcgaggacgggccgccgtggcgctgggccaggtggccaacgtctgcgcgaccaacacgctggcccgggcgaccgtgggccggcgcgtgttcgccgtcgacggaggggagggcgccagggagttcaaggagatggtggtggagctgatgcagctcgccggggtcttcaacgtcggggacttcgtgccggcgctcgcgtggctcgacccgcagggcgtggtcggcaggatgaagcggctgcaccgcaggtacgacgacatgatgaacgggat

SEQ ID NO: 6310 - DNA, 2124 bp, Zea mays
ctaaaaatggccacgcctgcagcaggttttgtgaaaccaaagcccgcgaagaaaaatataaataggtacgaaattccagatcgcgggtaggtaggaggagcagctagattgttagatgaagcacgcaagtggcagctgtatatattgatgaaccactacaccctcgccaccagtcaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgcccggtccccggggctggccggtgctgggcaacctgccgcaggtcggcgccaagccgcaccacaccatgtgtgctctggcgcgggagtacggcccgctgttccggctccggttcggcagcgccgaggtggtggtggccgcgtcggcgcgggtggcggcccagttcctgcgcgcccacgacgccaacttcagcaaccgcccgcccaactccggggccgagcacgtggcgtacaactaccaggacctggtgttcgccccgtacggctcccggtggcgcgcgctacggaagctgtgcgcgctccacctcttctccgccaaggccctggacgacctgcgcggcgtcagagagggcgaggtagcgctcatggtgagggagctcgcccggcagggagagcgaggacgggccgccgtggcgctgggccaggtggccaacgtctgcgcgaccaacacgctggcccgggcgaccgtgggccggcgcgtgttcgccgtcgacggaggggagggcgccagggagttcaaggagatggtggtggagctgatgcagctcgccggggtcttcaacgtcggggacttcgtgccggcgctcgcgtggctcgacccgcagggcgtggtcggcaggatgaagcggctgcaccgcaggtacgacgacatgatgaacgggatcatcagggagaggaaggccgccgaggaaggcaaggacctgctcagcgtgctgctggccaggatgcgggagcagcagccgctagcggagggcgacgacactaggttcaacgagactgacatcaaggcacttctcctggtaagcttacctttcccgtacgagcgcaacgactgccggcagtgacggggacatgctttgtactgtacctttattgcaaattgcaattgaccccgtcccgtcgtgctggggagttggagttttgggtcttgttttctcacatggacggaaatactttctgtggccatatcgtgacaacagaacctcttcacggctgggacggacacgacatccagcacggtggagtgggcgctggccgagctgatccggcatccggacgtgctcaggaaggcccagcaggagctcgacgccgtcgtcggccgcgaccgcctcgtctccgagtcggacctcccgcgcctcacgtacctcacggcggtgatcaaggagacgttccgtctgcacccgtccacgccgctgtcgctgccccgcgtcgccgccgaggagtgcgaggtggacgggttccgcatccccgccggcaccacgctgctggtgaacgtgtgggcgatcgcccgagacccggaggcgtggcccgagcctctcgagttccggcccgcccgcttcctcccgggcggctcgcacgcgggagtcgatgtcaaagggagcgacttcgagctcatcccgttcggcgccggccggagaatctgcgcgggcctcagctggggtctgcggatggtcacgctcatgacggccacgctggtgcacgccctggactgggacctcgccgacggcatgaccgcggacaagctggacatggaggaggcctacgggctcaccctgcagcgcgccgtgccgttaatggtccgcccagcacccagactgctgccgtctgcttacgcagagtagaaatcgatgctcgccggccatccatgccgtccgtatgcatggatgcatggtcaaataaataagcgttgtacgtgggtatcagtgtcacaaactcacaatgtgtatctcatgtattgcttcgtcgcaaaaaaaaaaaaaaaaaagcggcctgtgtaagcgtccgattttt

SEQ ID NO: 6311 - DNA, 1844 bp, Zea mays
gtcaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgcccggtccccggggctggccggtgctgggcaacctgccgcaggtcggcgccaagccgcaccacaccatgtgtgctctggcgcgggagtacggcccgctgttccggctccggttcggcagcgccgaggtggtggtggccgcgtcggcgcgggtggcggcccagttcctgcgcgcccacgacgccaacttcagcaaccgcccgcccaactccggggccgagcacgtggcgtacaactaccaggacctggtgttcgccccgtacggctcccggtggcgcgcgctacggaagctgtgcgcgctccacctcttctccgccaaggccctggacgacctgcgcggcgtcagggagggcgaggtggcgctcatggtgagggagctcgcccggcagggagagcgagaacgggccgccgtggcgctgggccaggtggccaacgtctgcgcgaccaacacgctggcccgggcgaccgtgggccggcgcgtgttcgccgtcgacggaggggagggcgccagggagttcaaggagatggtggtggagctgatgcagctcgccggggtcttcaacgtcggggacttcgtgccggcgctcgcgtggctcgacccgcagggcgtggtcggcaggatgaagcggctgcaccgcaggtacgacgacatgatgaacgggatcatcagggagaggaaggccgccgaggaaggcaaggacctgctcagcgtgctgctggccaggatgcgggagcagcagccgctagcggagggcgacgacactaggttcaacgagactgacatcaaggcacttctcctgaacctcttcacggctgggacggacacgacatccagcacggtggagtgggcgctggccgagctgatccggcatccggacgtgctcaggaaggcccagcaggagctcgacgccgtcgtcggccgcgaccgcctcgtctccgagtcggacctcccgcgcctcacgtacctcacggcggtgatcaaggagacgttccgtctgcacccgtccacgccgctgtcgctgccccgcgtcgccgccgaggagtgcgaggtggacgggttccgcatccccgccggcaccacgctgctggtgaacgtgtgggcgatcgcccgagacccggaggcgtggcccgagcctctcgagttccggcccgcccgcttcctcccgggcggctcgcacgcgggagtcgatgtcaaagggagcgacttcgagctcatcccgttcggcgccggccggagaatctgcgcgggcctcagctggggtctgcggatggtcacgctcatgacggccacgctggtgcacgccctggactgggacctcgccgacggcatgaccgcggacaagctggacatggaggaggcctacgggctcaccctgcagcgcgccgtgccgttaatggtccgcccagcacccagactgctgccgtctgcttacgcagagtagaaatcgatgctcgccggccatccatgccgtccgtatgcatggatgcatggtcaaataaataagcgttgtacgtgggtatcagtgtcacaaactcacaatgtgtatcatgtattgcttcgtcagtggcgtgtgtaagcgtccgtttttttttgtattttattctttttccagaaaaaaatcgccgttgaaatcgcataacaaaaaaaaaaaaaaaaatttccggaccgctgtgaaaaaaaaa

SEQ ID NO: 6312 - DNA, 887 bp, Zea mays
tgcagatcgcatttccaaacgaagtcgatggcttccacgaccagctcctcaaagtgcaggacaacatacccatctgcgcctccatcatcgcgctccgccgggcgctcgggtccctcgaggccggccccgagtggatcaaagaaagggtgagagacctggtgaaaaaccgcgcgctgctcgtggacgcgctgtccccgctcggtgacgacaacgtcaggggcgggcagggcgccatctacctgtgggcgaagctcccggacacctgctccgacgatttcgaggtcgtcaggtggctcgcgaacaggcacggcgtcgccgtgatccctggcagcgccagcggaggccccgggcacatccgcatctccttcggagggctcaaggaggaagacaccaggctggccgctgagaggctacggcgcggcttgcaggaactggtggctgatggaacggtacagtaacggctccattggtgtaggtaaaaagcacagcattgtagttttacacaacgactccgattttccaatggcataactccgccgggattgattcgagagaagaactggaccttgttatgaagactgcattgttcggacgagagctgggacagaataaaaggcatccggtctgcagtcatctttgttataaaatatgagtactacatattataatcagcagtaagtatttgtttctgtttggttttcagttatctatattactgatggcacccatttgtacagaatcaaaagcataagcaagaaagtcctgacgtacggagctgcctgttaggccgtttccaacagtggacctaaagtttacctcaaagcactttttacattgttctgcattgtactgtttatagagtggaatttgaatataagtacaaggat

SEQ ID NO: 6313 - DNA, 3395 bp, Zea mays
gtgtttggatctctatccaacattttctaatattgcattgtcattccagaggatttcagatctgtgcaaaaatgctggtgcatggcttgtggttgacaatacctatgagtaagtcaacactgtaaattgctaacttttcacaagcaacaacataatattttgttgtatctgttagagagagaagagccatgaattatggttgtagtcaaagggacagatcatataagccattagaactctaccttgccctcttgaatctgtgtccagatgaaagacactctgatgtcgtacccagattgtatttctagaatacaccttaggccttgttcgtttcatcccaaaaccatgtggattgaggggtattggggtggattgaggtggattttgactactagtggatttattccccctcaattcacatggaattgaaacaaaacgaacagacccttagcaatttccacaagggaaagtcaagaatattgtggccataggagactcagaaagtagtcgtcctgcacaaatatgttgtgtcagaatatgtcgaatacagttatcatgtgcttttttggtttgtgataacttctcttatttaaactcattccagcttctaagcctttagaaatatcacacttactgttttattcaggctttatgtttgcctgaaagagtcgggcgttcaggcccatgttgaggaattaataattaatagaggaccttttccctgtaagcttaaagaaacatatcataagtggcttatctctgctcctcgttctagtttagctatgatctttagtacttgagccttgtaagacttgatgcttaggtcagttttcctgtgtcttttttgcaggtactttatgtatgatggaatggagcactactgcttagaagatgctcatattgtcaacctcttctcgttctcaaaggcttatggaatgatggggtggcgtgtaggatacgtgagtgcatcatactcttcatttaccgttttcttatgctttacgcctaccccaacctgcttgcagctagacttttttttgctcctcctcctcctcctgctgttaattaccactgtaccagccccgcgtccgaggggtggcgtgtaggatacattgcatttccaaatgaagctgatggcttccacgatcagctcctcaaggtgcaagacaacataccgatctgcgcctccatcatcgggcagcgcctggcgctctactcgctggaggccggccccgagtggatcaaagaacgggtgaaagacctggtgaaaaaccgagcgctgctggtggaggcgctgtccccgctcggcgaggacaacgtcaagggcggggagggcgccatctacctctgggcaaagctaccggacagctgctcggacgacttcgaggctgtcaggtggctcgcgaacaagcacggcgtcgccgtgatccccgggagcgccagcggaggacccgggtacatccgcgtctccttcggagggctcaaggaagaggacaccaggctggctgctgagaggctcaggcgcggcctgcaggagctggtgaccgatggaatggtaaagtgacggctccatgggtgtaagtaaaagctccagttttccaacggtgtaattccgccgtgattaattcgggagaagaaaaggaacttgttttcaagaatgcactgcgttgctcggacgagagacgggacggaataaaatgcgtctggtctgcagagtcacctatgttatgaatcatatgtagtgcatatatcatgagtgagtgagtaattgtttctgttcgacttccagttctacatattactgatcgatggcagcaaccgtacacagtcagcggcctaaccgtataagcaagaaccgtgagctgttcttgacgtgcagagcttgcctgttagcaaatatttctgtccagataacgacagcatctgccttcagaaccagcgtcacattctgtaatggcatggatgagtgtctccaagaaagataaatctactatatctacatgagcgttaaaaagtagtcctcaagtttgcactatcaaattacgagattaataatgaaatgcacagcacagttataaatctactctatctacatgatgaatggaatggcgcaggcaaggcaacgatcgatgcatgcgccgtgcatggcctcgtctcgactgactgacgctgtcagggctcagaaccccacggccatggccgattggccatgcatgtgcatctcatcattcgtgaacgaggtgcattcaagcgcaacagcaccactcgtaactgtacgtactcgtggcggctcacaggtgcttgcaagcgcacaggcccaaagggcacaggccacagccagatccaaactggggatcagagagattgatagtaacgtctaaggctttttcgtttgtgccggatttgtgggtcagaacgattcctaaccggattgcttctctaatttatataaactttgatgaactagaatgattttgggtacaatccgacacaaacgaaaaaggtctaagactatatgcaacaagactatctgcaacgttattctctaaattttccttcttatcgcacttttgcagtcactttaaccagatttcacaccctacttttcttcctcccgcaacaattctccccttatataccactactactataaattatcatttccatacctatttatcacctattatcaaaattttcccaactaataaataatggcgcacatagaaatcgatgcaagggggtcaggccagcacagtgtccgctagatctggtgtgctctcatgctgaaccgctgtgtagggaagagtgtagcggttgtcgctgcaccgtgggtgtgcccctaaacacgtacaagggtaggggagggggcgtcgggcggtaggtagtctaatgtggcttcctagatgttgtttggttcacgtagtgtaacgtaaatgacaataataatgatttacattcaaaaccagcgctatgaaatctaaataagtcggtattagttcttagtatgatatctgattaagattggacttaaacattactgttcacattacaaatatgtgaaccaaacagtccactggttcctacgcactacagcgcacggcaaaacgagcttcgagtcagctttcaggaactgcatggtgcacaataacagtaacacgggcagttctcttctcttctattctcttgtgcctatcaccgccaacaaacaggtaatacgccgcatccagtcctggaccgaaactgacaggcgggcaattggaaccttgttgggactgggctatttactgtgaggatccttgagacaactgcgttccaaatggaggtatggataggggtgctaatggatcgctatctaaatatttcttaataaattgttaggattctaaattattttt

SEQ ID NO: 6314 - DNA, 1749 bp, Zea mays
gattttttcttatccatccacggcgccaccccgcattcacggaacgtaataagccaaaagatgagagaaagagacagaagagtgacaaggaaaagcgaagaaaaagggaagagtagaaaccccctttgagcctttcggtttttctctgtcttcatgtgtgtttgttatagagaccctgccttgtcggggcagcacacttgggacgcgaggaggaggagttggtgagcgaactcgggatcagtgggtgaccgcagagttcttgcttcttcctcttggaggaggagggctgcagcctgcaggggccggagagagcaggaggaggcggagacatgggtagcttcgctaagctggcgaggagggcggtggagacggacgctccggtcatggtgaagatacaagaactgctccgaggggccaaggatgtgatgtcgcttgcgcagggagttgtttactggcaacctcccgagtcagctatggataagatcgaaaagatcatcagggaaccaatagtcagtaaatatggttctgatgatgggcttcctgagcttcgagaagcacttctcgaaaagctaagcagagagaacaagcttaccaaatcatctgtcatggtcactgctggtgcaaatcaggcttttgtgaacttggtcctcactctttgtgatgctggtgattccgttgtcatgtttgcaccgtattatttcaatgcctacatgtcattccagatgacaggtgttactgacatattagttggtggctgcgatcccaagacacttcatcctgatgttgattggttggagaaggttctgaaagaaaatgagcctatccctaaacttgtcactgttgtgcggacgcgtgggcggacgcgtgggttattccaaggcctatgcttgagagaatttcagatctgtgcaaaaatgctggtgcatggcttgtggttgacaatacctatgagtactttatgtatgatggaatggagcactactgcttagaagatgctcatattgtcaacctcttctcgttctcaaaggcttatggaatgatggggtggcgtgtaggatacattgcatttccaaatgaagctgatggcttccacgatcagctcctcaaagtgcaagacaacataccgatctgcgcctccatcatcgggcagcgcctggcgctctactcgctggaggccggccccgagtggatcaaagaacgggtgaaagacctggtgaaaaaccgagcgctgctggtggaggcgctgtccccgctcggcgaggacaacgtcaagggcggggagggcgccatctacctctgggcaaagctaccggacagctgctcggacgacttcgaggctgtcaggtggctcgcgaacaagcacggcgtcgccgtgatccccgggagcgccagcggaggacccgggtacatccgcgtctccttcggagggctcaaggaagaggacaccaggctggccgctgagaggctcaggcgcggcctgcaggagctggtgaccgatggaatggtacagtgacggctccatgggtgtaagtaaaagctccaattttccaacggtgtgtaattccgccgtgattaattcgggagaagaaaaggaacttgttttcaagaatgcactgcgttgctcggacgagagacgggacggaataaaatgcgtctggtctgctgagtcacctatgttatgaatcatatggtagtgcatatatatatatcatgtgtgagtaattgtttctgtcaaaaaaaaaaaaaaaa

SEQ ID NO: 6315 - DNA, 1852 bp, Zea mays
aagagatagaaaaagagtaaacagtccccctcgaacctttcagtttttccctgtctgtcttcacttcatgtgtctttgtttagagaccttgccttgttggggcaggggacttgggacgacagagaggggagggcggagttggtgagcgagcacgggatcagctggtgacctcagaggctgtttgcctcggggggcgggggaattctttagcaccccatcttccacatgtctttcgactggctgctgctctttcggttggtaatatccttggatctctgactctagaccgttccacgaaatctccagtcctttcttcctcttggaggaggagggctgcggcttgagcaggagacgggagacatgggtagcttcgttaagctggcgaggagggcggtggagacggacgcgccggtcatggtcaagatacaagaactgcttcgaggggccaaggatgtcatgtcgcttgcgcagggagttgtttactggcaacctcctgagtcagcaatggctaaggtcgaaaaaataattagggaaccaacgcttagtaaatatggctctgatgatggtcttcccgagcttcgagaagcacttcttgaaaagttacgcagagagaataagcttactaagtcatcagttatggtcactgctggtgcaaatcaagcttttgtgaacttggtcctcactctttgcgatgctggtgattctgttgtcatgtttgcaccatattatttcaatgcctacatgtcattccagatgacaggtgttactgacatattagttggtggttctgatcacaagacacttcatcctgatgttgattggttggagaaggttctgaaagaaaatgaccctatccctaaacttgttaccgttgtgaatccggggaacccctctggagcttttattcccaggcctatgcttgagaggatttcagatctgtgcaaaaacgctggtgcatggcttgtggttgacaatacctatgaatactttatgtatgatggaatgaagcactattgcttagaaggcactcatattgtcaacctcttctcattctcaaaggcttatggaatgatggggtggcgtgtaggatacatcgcatttccaaacgaagtcgatggcttccacgaccagctcctcaaagtgcaggacaacatacccatctgcgcctccatcatcgggcagcgcctggcgctctactcgctggaggccggccccgagtggatcaaagaaagggtgagagacctggtgaaaaaccgcgcgctgctcgtggacgcgctgtccccgctcggtgacggcaacgtcaggggcgggcagggcgccatctacctctgggcgaagctgccggacacctgctccgacgatttcgaggtcgtcaggtggctcgcgaacaggcacggcgtcgccgtgatccctggcagcgccagcggaggccccgggcacatccgcgtctccttcggagggctcaaggaggaagacaccaggctggccgctgagaggctacggcgcggcttgcaggaactggtggctgatggaacggtacagtaacggctccattggtgtaggtaaaaaacacagcattgtagttttacacaacgactccgattttccaatggcataactccgccgggattgattctagagaagaactggaccttgttatgaagaataaaaggcatccggtctgcagtcacctttgttataaaatatgagtactacatattataatcagcagtaagtatttgtttttgtttggttttcagttatctatattactgatggcacccatttgtacttttgtacagagtcaaaagcataagcaagaaagtccttgatgtcaaaaaaaaaaaaaaaa

SEQ ID NO: 6316 - DNA, 1357 bp, Zea mays
atggtatttatttctgggaaattagtttctgttcttgacttgttgtaagtcctgaatgcagggagttgtttactggcaacctcccgagtcagctatggataagatcgaaaagatcatcagggaaccaatagtcagtaaatatggttctgatgatgggcttcctgagcttcgagaagcacttctcgaaaagctaagcagagagaacaagcttaccaaatcatcagtcatggtcactgctggtgcaaatcaggcttttgtgaacttggtcctcactctttgtgatgctggtgattccgttgtcatgtttgcaccgtattatttcaatgcctacatgtcattccagatgacaggtgttactgacatattagttggtggctgcgatcccaagacacttcatcctgatgttgattggttggagaaggttctgaaagaaaatgagcctatccctaaacttgtcactgttgtgaatccggggaacccctctggagcttttattccaaggcctatgcttgagagaatttcagatctgtgcaaaaatgctggtgcatggcttgtggttgacaatacctatgagtactttatgtatgatggaatggagcactactgcttagaagatgctcatattgtcaacctcttctcgttctcaaaggcttatggaatgatggggtggcgtgtaggatacattgcatttccaaatgaagctgatggcttccacgatcagctcctcaaagtgcaagacaacataccgatctgcgcctccatcatcgggcagcgcctggcgctctactcgctggaggccggccccgagtggatcaaagaacgggtgaaagacctggtgaaaaaccgagcgctgctggtggaggcgctgtccccgctcggcgaggacaacgtcaagggcggggagggcgccatctacctctgggcaaagctaccggacagctgctcggacgacttcgaggctgtcaggtggctcgcgaacaagcacggcgtcgccgtgatccccgggagcgcagcggaggacccgggtacatccgcgtctccttcggagggctcaaggaagaggacaccaggctggctgctgagaggctcaggcgcggcctgcaggagctggtgaccgatggaatggtaaagtgacggctccatgggtgtaagtaaaagctccagttttccaacggtgtaattccgccgtgattaattcgggagaagaaaaggaacttgttttcaagaatgcactgcgttgctcggacgagagacgggacggaataaaatgcgtctggtctgcagagtcacctatgttatgaactaatgtgcttatttgagttatgcaagtgcctttccaaaaaaaaaaaaagcggcc

SEQ ID NO: 6317 - DNA, 1158 bp, Zea mays
aaagttacgcagagagaataagcttactaagtcatcagttatggtcactgctggtgcaaatcaagtaaaaacttctcatccagtgtgttatatgttttctatttgccttgtaaagttttcaaactggaccttatgtttctcaatttacatgtgtttttttaccgggaaatcaatttacttatgttgattacttctttgggggcacactcttcctttcctgttttactgctgaaccttgatcttgtcttattatctggtcttttcttacattgatttttcaggcttttgtgaacttggtcctcactctttgcgatgctggtgattctgttgtcatgtttgcaccatattatttcaatgcctacatgtcattccagatgacaggtgttactgacatattagttggtggttctgatcacaagacacttcatcctgatgttggtaagatgactctcctccttcttcctgttgcattggaaaaattggggagatgtcttatatcagtctgctctaagaaatttgttctactcagtgctgattcaagaacatctgcttcattgggacatggtcaatttcccttacaagtctacattatcttttagctgatgagaaggatatgcttttgtaaaatgcaacacgtctagtataagaaattatgcattgaccgtaattgatatcatttcattttggaagcatacattacaattatgtctaaaactgcagattggttggagaaggttctgaaagaaaatgaccctatccctaaacttgttaccgttgtgaatccgggtaacccctctggagcttttattcccaggcctatgcttgaggtcatttctctccacgaacacttgtgtttggaatcactattcaatattttctaatattgcattgtcattccagtggatttcagatctgtgcaaaaacgctggtgcatggcttgtggttgacaatacctatgagtaagtcaatactgtaaagcaataattttttcaaaagcagtaatatagtatttcgtggtacctgttagaaagaactgagaagagccgtgaattacggttgtagtagggacagatcatataagccattagagctctactccctcctcttgaaacagtatcaaaatgaaagccactctggtggcgtacacaggtaggagtt

SEQ ID NO: 6318 - DNA, 897 bp, Zea mays
accgcagaggttgttgtctcggggggattcttccctagcccctcttcctcttcttcttctttccttccgcatgtctttggactcgctgctgttcttttgcttggtacccttggatctctgactccagcccgttccccgaaatttccagttcttgcttcttcctcttggaggaggagggctgcagcctgcaggggccggagagagcaggaggaggcggagacatgggtagcttcgctaagctggcgaggagggcggtggagacggacgctccggtcatggtgaagatacaagaactgctccgaggggccaaggatgtgatgtcgcttgcgcagggagttgtttactggcaacctcccgagtcagctatggataagatcgaaaagatcatcagggaaccaatagtcagtaaatatggttctgatgatgggcttcctgagcttcgagaagcacttctcgaaaagctaagcagagagaacaagcttaccaaatcatcagtcatggtcactgctggtgcaaatcaggcttttgtgaacttggtcctcactctttgtgatgctggtgattccgttgtcatgtttgcaccgtattatttcaatgcctacatgtcattccagatgacaggtgttactgacatattagttggtggctgcgatcccaagacacttcatcctgatgttgattggttggagaaggttctgaaagaaaatgagcctatccctaaacttgtcactgttgtgaatccggggaacccctctggagcttttattccaaggcctatgcttgagagaatttcagatctgtgcaaaaatgctggtgcatgggcttgtggttgacaatacctatgagtactttatgtatgatgggatggagcactactgcttagaagatgctcatatt

SEQ ID NO: 6319 - DNA, 4549 bp, Zea mays
  misc_feature (687)..(687): n is a, c, g, or t
ctgttggttgttacacatgatgtgggtgttctcaatacatgtatgcttatatttaaaacgtgcgaaataatatattaggattgaatgatttgtgtgccgtcgcaacgcacggtcattgtattagtattcattaaaaccgcacttcattccacacttcatgtactttataaagaacacaaagctggagatgatgttattagttagttgtttttttacatgtctggattagagaatgtgatggaattttactttgattatgaacattagacaatggattgaagtctgaagctggtcgttatactattttttccttccggtgaaatgttttttaacaaggtagtcattgcactctagtaacttaatagaaatattaaggttctttttgtcaaaattgtttgtcttatcttttgttatgttttattaaatctattttaaaatgtgaatttcgggccataaattgaatttcgggttttttataatttcagatcgtctgaaatgagttcggcgcgtttaagagttatgtgtcgggccatgggtcgagacctaagactgtgggctggtcccgcacgccccgtgataattgtgggtcggtccgacctaaaattcaaatggagtggtccttttgagcttagctcgagcccgtctgagcgatccaaatgtacacctatatagtcaagcgaatgaacngagcgcctgttcccttctctctattcttttctccttgccaacgaggattttatgacgtggacaagtgtgcagcccacccagtaggatttattatacttgcccttagcatataactagagataaagcaagctaagtgcacagcatcgattattgcacgtactacgccaccggcccgccgcggagtgtttcttggcaggcaagctcagatgacaccgcgagggcgaggctggtcctgtcctgggcgtcgtcatttgacggacctgaccaaaactcgaatctgcccactttacctattgctcgtttgggttcacacctggtgtttaaacaataaacataggttagtagtagtgcatgttatgtggcacacgtggatatgttacaacgtggaccatcgtcccttttcgcgccaggtacacggacacggctcgtggagtgccattgtatatggtctaactcagtggaaaaacaagtggagagagaaatgataaatgatagaactgttgtctatattgcagagtgtcatgtatttatatagaggatacaaagtctctcaaggagggtgtcccttaggagtaactgtctgttgatcataggacaatattttgtaacactcctccttatcaaccaatatccatttgattgtctgcaagtttctggacaccgaaaccgctcctcttcttgcgagcgacaaattcttctatgatccgcgagcaaagtgctgataatatgttctaactcagtggaaaaacaagtggagagaaaattgacaaatgacagaactgttgtctttattacagagtgttatgtatttatacaggggatacaaagtctcccaagggttgtgtcccttgggagtactgataacaggacaatattttgtaacagtacagggcaagggcatatcgccgcgagactttccacgtcacgttctccgacttcggcgcctgcgtagaagctactgaacctctgccatcaaagtagccgtgcgggtacgatggataacaccgaccgaccgatgagctggtggtgctacgatttatttatttatttggtcttgcttggcccttgccatcagttgtcagctgtcagggctcaggcgggccttagtgaccggattgtgcacggctacgtgatccaattccacaccacagattccctttggcacacgcccgttcacacatatggccactccgggctccggcgacaaccactccaacagtcccacacgccgttcaattctcccctcacgtggacccaccgccaacctacaaatacgggcaggcacgcctcctcgcttcacacacccccccccggcacagtcacacagtccagaggcgtcagtccaccgcgccaaccccaacaagcaccaccagccactcgaggcaccgaatcgcgatggagcccgcgggcacgatcgtgttcgcctccgtcggcgtcaccaacttcggcttcgacgtgttctctgccaccgtccctgcgccgacgtccgcggaggccggcgtctccgcggaggacctcgacgagcggcgccacacggacggaatctccgtcaacttcaacgcccaattcgcggacgacgccggcgacgcggtcgcgttcgtgtccgagcgcaccggggcagcgagcctgttcctgtcccggccagggtccgaacccgacccgctcccggccgccgagggcagcctgttccacgaccgccccacggtgcgcggcggccgggtgtacttcgtctccgcgcacgagaagccggaccggccgttccggagctgggcggccgtgtacgcggcagagctaggcgcaggccgcgagcggaatccggagccgcagccgcagcggctcaccccgcgcggcgtcgtggacatgagccccgccgtgtccgcctcgggcgacctcctcgccgtcgcgtcgtacggcgaccggccctgggcgttcgacttccgggcgctcgagacggaggtggccgtgttccgcgcgtccgacccgtcccgccgcgccgtcgtcgccgcgcggggcgggtggcccgcctggcacggcgacgccgcgcttttcttccaccgcgccgcggacgacggctggtggagcgtcttccgcgtgggcgtgtccccggacacgctccagcccacggggcccgagcgccgcgtcaccccgccggggctgcactgcttcacccccgccgcgcccgcccgcggcggcggccgctggatcgccgtcgccacgcggcggaagggccgggcgcagcgccacgtggagctgttcgacctcgagacccagcgcttctccccgctcacggagctcctcagcccgggcctccaccactacaaccctttcttcacgccgtcgggcggccgcgtcggctaccaccggttccgcggcgcgggggctcccggtgactcgctggttccgcgcccgcggccggtgcggagccccgtgcgggccatccggatgctccgcgtgcacggcacgttcccgtccttctcgcccgacggggcgcacatcgccgtcaacggcgacttcttctcgacgccgggcgtcagcgtgctccgctccgacggttccaggcggtggacggtgagcaaggagcccgacctgttctacaccacctggagccccacggagcggggggtggtgttcacgtccaagggccccatcttcgagaccccgaaggcgacggtccggatcgcgcgcgtggagttcgacccggccgacctcacggacgacggccgcggggagggtgaggtgcgcgccacggtgaggccgctgacccggccggaggccggcaacgacgcgttcccggcggtgtcgccgtgcgggcggtggctggtgttccggtcgggccggacggggcacaagaacctgtacgtcgtggacacggcgcgcggcgaggaaggcggagtccggcggctgacggagggcgagtggatcgacacgatgcccagctggtccccggacgggagtctgatcgcgttctcgtcgaaccgtcacgacccggcgaacccggccgtgttcagcatctacctggtgcggcccgacggctccgggctgcgccgcgtgtacgtggccggggcggagggcagcgcggaggcggacaaggagcggatcaaccacgtgtgcttcagcccggactcgcagtggctgctgttcacggccaacctgggcagcgtcgtggcggagcccatctcggggcccaatcagttccagccgtacggggacctgtacgtgtgccgcctcgacggatcggacctgcgccgcctcacctgcaacgcctacgagaacggcacgccggtgtgggggccagcaagcgccgggctcgggctggagtcgctgtccatgggcccgcccgccggggaggacgccttgggccagttcgacgagccgctgtggcttacctgcgacgtctgatggtccttttgtaattaataatgtaagaataatgacgctgcattgctgttgaggacggccttttgtttgtttcgttgctgaataaaaaaggacgtgctgtacgttcaaaaaaaagagagaaggaataaagaggtgtttgcttgtgtggactcccgactccactatgcatttttgtcagcgaaagttgtgtttgagcgagatgaacctgtttcgtgaacgtcttcggctcttggcattcacctgatgccgaccgtttggttgcacgtaacatcaagaaagggtacaaagtgcaaaccttttcagcagggatgcaacgcccatgcagaggcagagcacacagagagatgagatgatcgatgacgattgacgacgatgatttccaggcagcagtcatggtgttctgggttactgggctgtaccgacatatgtttgcgcggagtcactttttagcttgtttgagccc

SEQ ID NO: 6320 - DNA, 1518 bp, Zea mays
gcgcccgcgcgccccgtggggacctgccattggatggcgctggatgcccttcactcccgtcccagattcatcgtcctgcagctcctcttccatctccgatctgctgccataccactaccacaccatggatagccaaactccactgcataacccgctgcgaagaaaccttctaaagtgactaagtgatcgatctccttgtcctgaaaggctgaaacctaaggcgagagaggccacgggagagcgccatggttctcctgctcctgggctgctctcctgcatcgtcgcgcccagactgctctccagcttccaggagaagatgcagcaccgccggacagaaaatggtcaggtgctctctgaatgaagaaacgcagctgaacaaacatggactagtatccaagcagttaatttcatgccttgctgcttcgcttgtgttcgtctctccacctagtcaggctattcctgcagaaacctttgcccgtccaggcttgtgccagattgcaacagtggcagccattgacagtgcttcagttcctctgaagtttgacaacccttcagatgatgtcagcacagggatgatgatgaggggtatgaccgccaaaaacttcgatccagttcgctactctggtagatggtttgaggtagcctcgttgaaacgtggatttgctggtcagggacaagaagactgtcactgtactcagggagtgtattcttttgatgagaaggcacgctcaatccaggtggatacattctgtgtccacggtggacctgatggatacatcaccggcattcggggcagggtgcaatgcctatctgaagaggacattgcaagtgctgagacagatcttgagaggcaggagatggtccgtgggaaatgctttctccggttccccacactgccattcatacccaaggaaccctatgatgtccttgcaacagactatgacaattatgcaattgtgtctggagctaaggatacaagctttattcagatatactcaagaacacccaaccccgggccagaattcattgacaagtacaagtcttatgttgccaacttcggctatgacccaagcaagatcaaggacactcctcaagactgcgagtacatgtcctcagaccagattgcgctgatgatgtcgatgcccgggatgaatgaggccttgacgaatcagttcccagacctcaagctaaaggcaccggtcgcacttaacccattcacaagcgtgtttgataccctgaagaagttgcttgaactgtacttcaagtaaaaaacagtgtagcattgtccagtagccaatagccaattgcccaacttctcgacttggatcttcaatggaatgaagttcagtttattctgacgtttgctagtcagttagttctttttaagtacattgtttttttgtctattatataagagtgggatatgtaagattaagatctgttcagctgttctcggttactgtttgtacaattgttctttttcccggatgtttttatacaccattgcgattgtctgtc

SEQ ID NO: 6321 - DNA, 500 bp, Zea mays
tagcgtgggcgcggccgaggtacttgacatcttaataacaaaattgtttgagatagggatggtatgtccaatcttccatgcactttgcatgatatactgtctgtaaacggatgtcatacaattttttttgggggaacttcagggagtgtattcttttgatgagaaggcacgctcaatccaggtggatacattctgtgtccacggtggacctgatggatacatcaccggcattcggggcagggtgcaatgcctatctgaagaggacattgcaagtgctgagacagatcttgagaggcaggagatggtccgtgggaaatgctttctccggttccccacactgccattcatacccaaggaaccctatgatgtccttgcaacagactatgacaattatgcaattgtgtctggagctaaggatacaagctttattcagatatactcaagaacacccaaccccgggccagaattcattgacaagtacctgcccgggcggccgctcg

SEQ ID NO: 6322 - DNA, 4087 bp, Zea mays
  misc_feature (3295)..(3295): n is a, c, g, or t
tttttcgaattattttattatttctggataacctatagactgcggacacaaaatctagggagtttggggtccaaaccataaattccaggacctagttttaattatttctccacgcgtgtggactaccggttagttttatagaaggctaagggcttatctgcaatttaccgaggccgaagggttatggctgtttctggccgcgcgataagatatggatgccccagattagacagtgacagtggcaacatacgtgagactgcgggtgggacccgcctgccagtgcatgttgtgggcggctggtgcgaggtgctcattgggccaggggtgcgcactcagtgggccgaggcggcatggagttggaccgccagtgtgggttttagcgtgagagccaagaagtaatccttttttgtttaatattttctattttcttttgtatttcagttttcaacttgttatttaaattcaaacttcaaacttaaatgcacaaacagacgcctagcatgtgatgctaatattttaattgtatttattaattactttattaatttattaggcaatgtttcaagtatgcactatatattactctttatagaaaatggtattttcactgtgtgataaaattgtaagtttcttcaaaaaatgaatattcatcaatcatttagttttgaaagaacttaacacatacctttcaccaagattcaatttagttcatgcacacacacaaataatttatattaagataacactcttttaaatgtatgatccgattaaagacatattcgaaaattcattgttttactacttatttatttattttgttattgttttttacacagattttgggctttacagctatgacatgtacagtcaagttctcagcggaggcggcgatggcgtggcaggcagcacaggatgggcggtcagatcggcgtaagcaccaccgcccgagatcctcatccgacggcaggcatcgatttgacggttagtcgtctcggccgcacatgcccgcgcgattcccgccactgccgggaacacccacagccacacgcgagagtctgtggctcacaactgtcttcttcaattacatgtgggaccgacggacgatgggaccgacggtcagtgaagacgaggtagatggacccgtcgctgtcgtaggatggctgcctttcatgggcggttggatccgtagctggcacgccgtactggtcggtgggtttgtttttctacccaagcgtgcaagttggttgcagaggctgctttggtttgcatggaagcccctagaggtttcctaggcgttgatatttacatgccgtaggctgtagctgtacgggtatactatacgcgtgtgtatattcggcaagatttcgctttcgaaagatctggcagagtcacgtggacggagtaagaccttcctcgcattaaagttgattattttgaccggtaccactataatttataaaaataaaaatattatagaagtattaaaatctggtacggattaaaaccaacccagcatctagctgaacaaaacaaaataatgaaacggtgtcatggatagtatattctttatataacgtttttggaaaatatttagatgatgtcacggataacaaggtactgtaaaatttattaagaggtgtgtgtggttaaaaaattagcatgcctaaagcacttgctaataacaaactcaagtcgtcgactttcaagtcaaccacgccaaggagtttcattatattatgggccaccgcggcgccgcccccggggtagccctcgcccggataggagcgactagcgagaagccaagcggcttggcacctcagcctgctgcctctgctcgctctcttcgccctctttctgcactaatcctcggctcaggcagccaatattctgtctagcgttgagatggcggacaacgtcctcatcgaccgatcagccagcggctttgagttccggcgctgggcggccggcgacgagttccagagcctcgccaccatgagcgtgctgcagcctgacgctcgcggtatctacagttccttaccatacgtttcgccgctgcctccgttccagtacgcggcgtacctgcactcttcgctctccctcccaccgctgaatcctcgccgccacccgcctctcctcccgctcccgccggcagctgctgctaaagggatgaagcaggcggcgcagaggaggacggggccgagagagtgcaagaggaagaagccgccgcggacgccgaggctgggggaagagcctccgagcgcgcagcgcaggaagccgctggagcgtgccacgccgctgccgcccgcgcccgcggtgcacgaggcgctggacgaccttgagcgccaggtgaccatggggttcgtcgaggacctcaagcacgcgctcgcgctcgcgccgccgccaagcagcctaccgctgcccaccttctcacttgtcagagctgcggctgccgcagccaaggccgtgccatcctgtactgtgtaaccactgcacagtgcggcgagccaacccccgtaccggcgacggtatccagcaccgccagtcgtcttcctttctccaagactttttctttggatggatcggaagaaaaatgctacaaggcattattctttttctttcataaaagaagggcggctatttaattactcccttattttctttacagtcccttttttatttcgtcttatatatggctgtgatgtgaaagtgaacctaatttatatggtcgtttgcatcacatatccaaagttaacttcttgatgggaagtctgtttttattggcttgtatcaagaattcaagattaagataagttgtacgcttcattatgtgtcggtgacaagcggcctacattatgctttgtcatttaataatttgtggttgtaggagtcgactcaagtatcactgctacataaataatttgcaaaagatgactgttttctctctctttttctagatgtagtcgtgataatgaaatggagccctactcttgtttaagtacggacttcctctagggccgtcatgaggcggagcggagggggtgcggaatggatcccttggacgttagtatttttttttgaaacatatctactctagaaacaaatacacagagatagatgtgctattgttctattttgtttagattttagattgttaaactaatgcctcaaatatttatcgattattaattactggacacatgatgattgcattagtggagagaagctttttaaaattgaaattattgagcaactatttgaggtcaataatgactcattggatgttaaatggtttgangattctatgtatcgataaaaagttaatggaagagattgatggtataatcgatgactttgtacgacaaaatattagaaaatatttttaacatgatatcaagtgacaagtaatgtttatgactatatttcacatttgtcatcttatgaacgaccttaaaatattgtacaatgatttttttatatgttgaatatttaataatatgtatatacttttatatacacacacgtataaatatacggctggatgagacctttataccggattttaccaatgaacctcaaaaaagtcaggaatgccttcctctactgtttccgggttctgtttaaaacataaaaataaagacccatacatcttttagcctgcctctagcagagccccaaaacacacgtgcatgtttattttgcacgcttgcaagtaacaattgtagaccctttcaacagaacgtagacgagggcatagaaaacccagaaaatgtgagttcaccctctccgtacccaatccaagaattctcttttttctcctagggtctatttgtgcgtcacgcgcgctctattgaaagcgatgccctgtttgcacgctcgcattcaccttatacatctccgtccgttatgcgcatgcaactaccagccgagacatctcgacagtgtttttcatgatataattgtgtgttttgtgtattctgtctattattttttaataagcgattttcttattttatagttgagggagctacccaatctctaatatagtattgttctacagattaaccccatcaacatactatcggaaccc

SEQ ID NO: 6323 - DNA, 1409 bp, Zea mays
  misc_feature (22)..(22): n is a, c, g, or t
ggtacccccgggttcggccggngtttcaactcaaagtccaactgataatatatgagctagcagtagccaatgcaagcaggtctcagcgagcccagccctgcaggttttctgctataacattgggtgggtctcgtccggcccggaaattaaggacgctctgcacgtattactattcatcttccattgttgctttgctttgcttaccggcaaccatggccagcactcgtgcagcagcaactctccttttgctcctcgcgctcgccggcacctcgtcggcgcagctgtccacgggcttctactcctactcgtgccccggcgtgtacggcgccgtcaagtcggtgatgcagtccgccatcgccagggagaagcgcatgggggcctccatcctccgcctcttcttccacgactgcttcgtccagggctgcgacgcgtcgctgctgctggacgacacgcccagcttccagggcgagaagatggccaaccctaacaacggctccgtcaggggattcgaggtcatcgacgccgtcaagtccgccgtcgaaaagctgtgccccggcgtcgtctcctgcgccgacatcctcgccatcgccgccagggacagcgtcgtcatcctgggtggtccgacctgggacgtgaaggtcgggcggcgggactccacgacggcgagcttcagcggcgccaacaacaacatcccgccgccgacgtcgggcctcgtcaacctcacgtcgctcttcgccgcgcagggactttctcagaaggacatggtcgcgctctctggtgctcacaccatcgggcaggcacgctgcaccaacttcagagcccacatctacaacgacaccgacatcgacgctgccttcgcgagaacgaggcagtcaggctgcccaagcacctcaggcgccggcgacacaacctggcgccattggacctccagacccctaccgtcttcgagaacaactactacaggaacctcctcgccaagaaggggctcctgcactccgaccaggagctcttcaatggcggagccaccgacgcgctggtccagtcctacgtcgggagccagagcgcgttcttcgcggatttcgtggcgggcatgatcaagatgggcgacatcacaccgctgaccggctccaacaacggacagataaggaagaactgcagaagagtcaattagcagatagctagctagggtccctaattaagacccatgcatggctgttgaactgcaagctaagtagtaaacccttgttgtgttgatgtgctcacatgtcgtcttttttttttgggtgaaggatggatgcatgtatcagatcccttgttgtttaattaatgccatttcagtctttgtccaatatactttaggcgccgccagaaaaaaaaaggagaataaaaaaaaaaaaaaaaaagcggcc

SEQ ID NO: 6324 - DNA, 1385 bp, Zea mays
  misc_feature (12)..(12): n is a, c, g, or t
  misc_feature (1356)..(1356): n is a, c, g, or t
  misc_feature (1358)..(1358): n is a, c, g, or t
ggttcggccggnaaagtccaaccgcgaggccggccggcatccgccaagcaggtctcagcgaggttttctgctataaataaggcatcgtccaggcaggccggcaatagggcaaagcaaatcaaggacgctctgcacgtactattcatcttccattgttgctttgctttgctttgcttaccggcaaccatggccagcactcgtgcagcagcaactctccttttgctcctcgcgctcgccggcacctcgtcggcgcagctgtccacgggcttctactcctactcgtgccccggcgtgtacggcgccgtcaagtcggtgatgcagtccgccatcgccagggagaagcgcatgggggcctccatcctccgcctcttcttccacgactgcttcgtccagggctgcgacgcgtcgctgctgctggacgacacgcccagcttccagggcgagaagatggccaaccctaacaacggctccgtcaggggattcgaggtcatcgacgccgtcaagtccgccgtcgaaaagctgtgccccggcgtcgtctcctgcgccgacatcctcgccatcgccgccagggacagcgtcgtcatcctgggtggtccgacctgggacgtgaaggtcgggcggcgggactccacgacggcgagcttcagcggcgccaacaacaacatcccgccgccgacgtcgggcctcgccaacctcacgtcgctcttcgccgcgcagggactttctcagaaggacatggtcgcgctctctggtgctcacaccatcgggcaggcacgctgcaccaacttcagagcccacatctacaacgacaccgacatcgacgctgccttcgcgagaacgaggcagtcaggctgcccaagcacctcaggcgccggcggcgacaacaacctggcgccattggacctccagacccctaccgtcttcgagaacaactactacaggaacctcctcgccaagaaggggctcctgcactccgaccaggagctcttcaatggcggagccaccgacgcgctggtccagtcctacgtcgggagccagagcgcgttcttcgcggatttcgtggcgggcatgatcaagatgggcgacatcacaccgctgaccggctccaacaacggacagataaggaagaactgcagaagagtcaattagcagatagctagctagggtcactaattaagacccatgcatggctgttgaactgcaagctaagtaaacactatgtgagatcgtcgcgttgatgtgctcacatgtcgtctttttatttgggtgaaggatggatgcatgtatcagatcacttgttgtttaattaatgccatttcagtctttgtccgaaaaaaaaaaaaaaaaacgagtcananaaaaaaaaaaaaaaaaaaaaagggcgg

SEQ ID NO: 6325 - DNA, 1395 bp, Zea mays
  misc_feature (1321)..(1324): n is a, c, g, or t
  misc_feature (1332)..(1335): n is a, c, g, or t
  misc_feature (1378)..(1378): n is a, c, g, or t
  misc_feature (1380)..(1380): n is a, c, g, or t
gcacgagaccattacccaggacagcccgggcaaaaatctcattctacagggaagacgaaaacacactgcagctggagcagcactgatatcgaccatggctccagcagcacctgcatctgcgacaaaatgcagcagcggcatcgtcatctctgtgctcttgcccctcgcgctgctaatggcggccgccggcacctcgtcggcgcagctgtccacgggcttctactcttcctcgtgtcccggcgtgtacgacgccgtcaagtcggtggtgcagtccgccgtcgccagcgagcagcgcatgggcgcctccatcgtccgcctcttcttccacgactgcttcgtccagggctgcgacgcgtcgctgctgctggacgacacgcctagcttccagggagagaagatggccaaccctaacaacggctccgtgaggggattcgaggtcatcgacgccgtcaagtccgccgtcgagaaggtgtgccccggcgtcgtctcctgcgccgacatcctcgccatcgccgccagggacagcgtcgtcatcctgggtggtccgacctgggacgtgaaggtcgggcggcgggactccacgacggcgagcttcagcggcgccaacaacaacatcccgccgccgacgtcgggcctcgccaacctcacgtcgctcttcgccgcccaaggcctctcccaaaaggacatggtcgcgctctccggagctcacaccatcggccaagcacgctgcaccaacttcagagcccacgtgtacaacgacaccaacatcgacggcagcttcgcaagaacaaggcagtcaggctgccctagatccctcaggctcatcaggcgacaacaacctggcgccattggaccttcaaaccccgaccgtcttcgacaacaactactacaagaaccttgtctgcaagaaggggctcctgcactccgaccaggagctcttcaatggcggagccaccgacgcgctggtccagtcctacgccagtggccagagcgagttcttctcggactttgtgacgggcatggtgaagatgggtgacatcactccgttaactggctccggtgggcagattaggaagaactgcagaagggtcaattaattaataaccaactaataacaaggtcggccggcggtgcacactatctaacagggggcttgctttcagtcgttaattaagtttgtaatctttctacttcgtccacaaaattgtgagatcatcatgcatgttgtaccagccaaccaaggtgttgagacgatgttgttcgtcgtttgaataagtaatccatcatttgttcttcttccaacgaaaaaaaaaaaaaaaannnnaaaaaaannnnaaaaaaaaaaaaaaaaaaaaaaaaaaaaaaaaaaaaaaaaaangnaaaaaaaaaaaaaaa

SEQ ID NO: 6326 - DNA, 10494 bp, Zea mays
  misc_feature (225)..(225): n is a, c, g, or t
  misc_feature (3050)..(3050): n is a, c, g, or t
  misc_feature (5728)..(5728): n is a, c, g, or t
gagggaatttgtgaagaagcaaaaggcatacttcgcagatgtggatgcctttgaactggcggaggaggaggtatcagaatccgagctggagtgaaacctgagagctgaaggtcctccccagaactacgtacgtgtcctgcctccatgtacaggagtagttacttctacggcgatgggcggccagggcccagggtcatgttatcgatgtataggcatagctaggtnctcttgtaacacgcggctgatcactggagaacacctcagtataggcaaggcaactaacgcccgtaggaaattagcaaggacgagggagatcgacttccaagcgtatgagagcacagtggatggtgctgggtagaatgtggtgtgcgcttttgatcttttttgcagcgtagtacaacacggctacaggcatgtggaatggatggtggtgatatccggatctagacatcaagtagtggtgctccttgtgccttcagagccagcatctgtgtgtgtgctttttttaatggcggccgatggatgttgcgtatggctgcattggtacttttgaagtcaatgatctccatccagttctccaaatctccgattttttttctacggatgagtatttaactagcgcatgatgtggattggaattttctgtgaacgagagttatcgaggacagaatgcctaacaaatcacatcaatattttatttacagcagtcttgccaaaacgctattggctgatgtaaacataacttgagcgaacttacctgcacggctgcattgccatagagagaaaaaaaatgaggcctcgaaatctttcgtgcatacagctagctagctgcgctgtctgtcaaacaggtcattgacaaaaaaaaaaaaaaagaagagctcgggtttctgcgctgacaaatgttgcttgcccggccggcgtcaaagtcaatagctcaaaaggtgtcaaaatcatacagctgcttgccatgcagcacgagacgacggccggccggcgacgacgagtcgacgatgacggcgacgatcacctacccttcctacgtacagcatccactacacgtctccatcactccatgctagctgcagcgctgaggcgctagaggcacgcaaaggtcttcgtcttttctcctttgaggctaatgatccgattcgattggtagagctagacagcttaccttactcgactttgtttagtttcatttagttagctaggttatgcaatcgatccacctcaggccggcttgtcagctcaatgcatatatacaatctgtctgcagcgcctagctagccaatcaccatcatattgtcagtgtgtaaataaatatttatatttgtctaataatacatgctaagttttgatttgtaaaaaatcttgtgacctccggaccagctggctagctgctacaacaatgatatatacgtacgcgggcatgcgatggccaccaacaaatattaaatcttgatcgacacaaaatctttgcaggtcagcggcatttcatcggtttatattatatagccacctacgaaatgaaaatcacatatatatgtgctatcatatatccgatccttaatctatccctttagatgtttcctttcgtttagaaaaattgaaatcttactattagaatatgctattttttagaatgtgacattccactacttttcatagttatcatataagcctatcttaaattcataggacgagagatgaaaattgattctatagatttacatgctatttttccgatgtacaacttatagcacactattctccttacttcgttataacataaatatagtatataactatctctctcatataattttaaaataatataaaaacatatgaacttaattagttttatctaaattataattattaaaatgaaattcaattccaacgaaacaaacagggcttatattatttggaattgtattctccgtccttgagactactgactcccttgaacttgaagcaaagcagtggccggggtggttgggctgggcgtgtgtgaacagtgggccgttatcacattctttgaccaatgcacctgcaaacaaatatttcgatatcaaccatactgtatcgtcgtgcttgtgtggtgcatatgcgttgcagaaagtagctagacaagacggtggatgcacatgcatatacacaataatatttatatgcattaccgctgtcatattcacaacaacaactcaacttcgattgattataaataaagcatctgtttgactctttggcatgtatgcatcgaacgcgttgtggcgaacaaatggatggagctagatggttaacaaactaaccatctagccccatttgtagagagtaatgcgacaaaaggcaggcagacatgtgtaggaggggggttgggtaaatcctctagctagtttctgtgtgggggcagaagagaagtagatgaaaatcaatagttcgtttctattagtttaaccaatatagtcgacgaaaattattgtttttataaatttttttccatggccgaggagaattagtaatatatataggtagcatgaggttggaatttcagcctatatgcctgtgatgtaataaatagacagattttatagtagtgcgcccaacaaatttgactagcccacgaatgtctgcagcacctatatatatgacgtggatggaaacgaatcacgtgagacccaggtcctttgttaatctgtaagacctgatctgtctttgcgccacgtggtactccgaatctcaaagccacaactcaccgtaacattttatgggccttgggccatatcctatcggtaaaacacaagcaggaattccaaccgacgccatctaggtaacgagcaaagccttgtcttgcctagcgccgcctgtaagccggaaaggctgatcatctagacggcaaatcatcccgacggcagcaactggttgcactcacgaggacggattgacatcggcagtctaatcactccggcgacagagctgatggtactttagagatggaggtcagtgatgtttttctatgttgtacaacagagtaataagattagtaaaangaagatatatttagtttggtctttgctgctttagaattgctctttagacctgacaaactacttaatttcgtgttaatattcattgtagggcaatcatcaaaatttatccttagaacaagtaccacaggttggcttaacctttgaatctgaagatgctgcatacaatttctataactcatatgcaagaaagattggatttagtatcagaaagtgtcatgttaagtacagagctgatggtactttagcttccaagtacatggtttgcagtaacgaaggtcacaagaatagtaatccgacacaaccgcctaagaaagaacgtgcttcaacaaggtcagaatgcaaggctcgtgttcagttttatatttcccgtgaaggtatttggaagatgcaaaaagttgaattggcacatactcaccctttcacaagtcctgacaagactcatatgcttagatcacagcgacgtttgctaccggctgatgaacatatcattagcaaaatgagagaagcaggggttaagtcaacagaaatatttgaattttttcaggtgtggtctggtggagctgaaaatgtgcagttcttgcagatggattgcaacaactttattagtcgtgagcgtaaaaagtatttggaaacacaagatgcaaaaactttgttggaatacttagaaaacaaacaagcagaagacccgtctttcttttattctgtggagctagatccagataatggcggtcaaatttgtaatttcttttggacagatggccaggccattgcagattatgcttgcttcggtgatgtcatttgttttgacaccacgtttcaaacaaataagtctgaaatgccatttgcccctattattggaacaaatcatcacagacaaactattgtttttggagctgcactattgttcaatgaaagttcggaatcatttgcttggctgtttaaagcctttttgaaagcaatgtctgggaaaaaacctaaaacaatttttacagatcaatgtgctgcaatagcgaaggcaattatgatggtattcccaagctcgtgtcatcgtctctgcatatggcatatataccaaaatgccggtaagcatctaagccatgtgattgccaataatcaagaatttttgaaggatttcaaaaattgtgtgtatgaagaaaagtcagtggaacacttcaacttgagatggcaagagttgatagctacttacagcttacaggacaatgcttggatacaaaacctgtatgatttacgtgaacagtgggccacgatatatagacatgattcattttgtgctgatatgacatcaactcaaaggagtgaaggtatgaataatgtatttaagaaaacatttcgcaggaaactttcaatttcagaaatcttggtagaatatgacaagtgcattgcacgtcttcggcggaatgaattgtatgaagaccataaatcacgcaactcagaaccaattctttgtatcacttccttgccattgttgaagacagccgctaaatcatatacaagaaacatgttttctgctttccaagatgaatttcagaaacagtttactctctcatccacattgataaactgtgaggggacaatcagcttatacaaagtggtggctatgggtaacagtgagaatgaagccagagtcatctttaattcagatgatttgaatatatcatgttcttgcaagaagtacatcagtcttggtatgtatattttctcgagtgctctactgtacagtatttaaaacatttatttttttatctctaataaatataaattatacaggtatattatgcaagcacatcctacgagtattcaaccaaaatgatattgttgatttaccccctcagtacatattaaataggtggacaaagtatgcaaaaagaggcgtatatggatgcaggacacaaaaccagagtgggaacttggcatcacaaagtacaaatctttgtcgaaaaatgatatccgtcacattgaaatgtgcagtttcggaagaagttatgcagcacttggaaaatggttttgacaagttgactctggaagttgaaaatttactaagcaatataacactggttgaaaataaatctccggaatgttttcttgaatgcactgaagaagttgcaaaagagcgtatctcattcaaagctcctccacataaaaaaggtgcactagaaaaaagatcaagaagtgtccttgagagaagaaagaaaaatcatcgtactaagacaacaaggaaaggtatttgtactaattcaatatgttttttctttcttatactaacatccaaaagatattttatactgtcatatctttccgcatgagcagaatcaaagcaatcatcagatgcaagactatctaaagtttcacagataattgtaagataatcaagaaatttgagtcaattgtcccatctactatttatttgagtactcagataactttgattttttgtgtaggaacaagagacaaatgtcacttctactgacactactgttttaccaatgacaaatattaacttgccatttggagagaatcgagagatgcccatgttcttcccacccatccaaggagaatttacaaatctgttacttggaactcactttgaagttgctaccacaacttctcgccgtttagagtttgatgaagacttccctaccaaatcaactacttagtgncattaaagtttgctatggtgtattaaaatatatggtaccattagattatgaatgtttaagtactctcatggttaagtacactttatttttctggctacatcatggattgacgaatgctcggcgtttacatcaggaacgtttaagctactctgttcagcagcttcacggtaaaaaagcaagtcgcctgggctccagtcttgagaagcgaatacgaccaaatattgtataggctaagaatgtagcacaggcacaggctgcacagcccagaaaatgttacggtgagttgtggctttgagattcggagtaccacgtggcgcaaagacaagtcgggtcctacggattaataaaggacctgggtctcacgtgattcgtttccgacgtggatgaccagagcaaagtcccatcagatgacagagtaaaaaccgttgaaaaagtgctgctcgatgaccagacaaattgatcacaccaacagtacgtgtatgtgcatggatccatgatatatacatgagggccggtgatatagggcatgtttgttttaacttttttcaaatgctgagaaactagctgtcagaaaaatctgaattttttttagataatggatacttgtccagcttctcctcttttggaggattagccaatgcaccaaaagtttttacatgaagtagtcacacgactagccacatatggagggacagacctcccgaaacacaccatagaagaccatggtttgataaccagaaaaagacacacaatccatagacaaaactacgaagcaattcgatttgtaaacctccatccatgctgagcaaaaatctgtagagccgtgcactctaaccgtcgacaagcttcctttatttgaataccctcttcttgtttatgaagaacagcccacgtcctaaaccaatgcgtcgccctaaagagtacctgcaagtatgttaacatgggttttttttgtcaaaaactaaattattcctacttatccagatagcccagcatatagcagcaacacctgaaataatcaaatgtttagttttcgaaggcatcccaaaaagccaattcccaaaagcgtgtctaactgatctcggttgattgaaacccaaactccaaaaaactaacctccatatgaactgagcatagtgacaagcaaaaaacaagtgttgaatcgattcatccgagtgacaaaaggcacactttctatcaccatgccaattacgcctcagaagattatcttttgttaaaaccacccctctaattaaataccacataaatatttttatcttcaaaggtaccttcaaagaccaaagagtcttattataagtcacatgattattgttaaggagtgctctatacattgacctgaccgagaaaagacccgtcacaaataaatcccatttgaacatatcattttccccacatagctcaacctgagctactctgagaaccaacagatgccataacctcaggttttcacccaccaatgctctttgaaaataaacattaagcggaaccgagaagataagattttgtagagtttaggatctagatagtgacagatacttactatgacgacttggccaatttgatattcacgttgattttagactctttttaccaagcggttctcacaaaaacgggctaaaaagctagacgtttgacagtccggagcaacttctagcggttagaaaaagttgaaacaaataggcccataagataagatagttctcctagctaagcttcaagcttgtatacataataacggcaacatgcatgtgcggcaaagacgctatgcatgtatagttggagatactacatgcgtcgtcgtatctaaataacaatgttcccatgagcgcatatatgcatgcatgctgccctagctagactacagtgctgcatatgcttttacaaagttgagttcagcagtagactttccaaccaactctgtctcgcgccctagttgttggtggtgtgaaacgcgtgattcctttcgtcgttttgctttctagtttcaactcaaagtccaactgatatatgagctagcagtagccaagcaggtctcagcgaggttttctgctataaataaggcatcgtccaggcaaacaattaatagggcaaagcaaatcaaggacgctctgcacgtactattcatcttccattgttgctttgctttgctttgcttaccggcaaccatggccagcactcgtgcagcagcaactctccttttgctcctcgcgctcgccggcacctcgtcggcgcagctgtccacgggcttctactcctactcgtgccccggcgtgtacggcgccgtcaagtcggtgatgcagtccgccatcgccagggagaagcgcatgggggcctccatcctccgcctcttcttccacgactgcttcgtccaggtacgacgtgcaatttatacaggcagggctgctgcttaattgatttgtacgtgatccatcacccgtacgcgtacgtgccatctatacagggctgcgacgcgtcgctgctgctggacgacacgcccagcttccagggcgagaagatggccaaccctaacaacggctccgtcaggggattcgaggtcatcgacgccgtcaagtccgccgtcgaaaagctgtgccccggcgtcgtctcctgcgccgacatcctcgccatcgccgccagggacagcgtcgtcatcgtgagtaccactatatatactagtgcttgcatatatatgcagctctctctctctccattattgatatcaactgatggatgacgctgatctatccattccatgcatgtatgcagctgggtggtccgacctgggacgtgaaggtcgggcggcgggactccacgacggcgagcttcagcggcgccaacaacaacatcccgccgccgacgtcgggcctcgccaacctcacgtcgctcttcgccgcgcagggactttctcagaaggacatggtcgcgctctctggtacgttacacattattactacttctattattatattcataaaattcctaaaaccattaactatcttactactactaccgtgtatgtgtgcttaattgaaaacgaaggagaataaagcgccactccgatccacacaagctttatttagaccttttattattagtagctagctagctggtagacacttcaccgacaggattgacagctcagtaacaaattaagaagaacagtactaagtactaggcatatacatggagactgaaaaacttgaaaagaagttttttgttgcaaaaggtttttttttatatattccatgcatgcatgtttttaatgttgccgactacttcaacaaccaacttcgccatcacatcagatatatatcgattattttaactccatggaataacgaaaagcaataaagtcgacatctttcccagctattaattaactccatgacacacacacacacaggtgctcacaccatcgggcaggcacgctgcaccaacttcagagcccacatctacaacgacaccgacatcgacgctgccttcgcgagaacgaggcagtcaggctgcccaagcacctcaggcgccggcgcgacaacaacctggcgccattggacctccagacccctaccgtcttcgagaacaactactacaggaacctcctcgccaagaaggggctcctgcactccgaccaggagctcttcaatggcggagccaccgacgcgctggtccagtcctacgtcgggagccagagcgcgttcttcgcggatttcgtggcgggcatgatcaagatgggcgacatcacaccgctgaccggctccaacaacggacagataaggaagaactgcagaagagtcaattagcagatagctagctagggtcactaatcgtcgcgttgatgtgctcacatgtcgtctttttagtaaacactatgtgagatcgtcgcgttgatgtgctcacatgtcgtctttttatttgggtgaaggatggatgcatgtatcagatcacttgttgtttaattaatgccatttcagtctttgtccaatatactttaatctgcatgagaaaaaaggagaataagtactagccagcgtgtgaagtgtatatatgcgcagcgcaacaagtagaatatgaagagtttcaaacatccaaactcatataataaacgcatatctttacgaaaagtttcaaacatccaaacgcgcgctactacacacatactgaaaaataactcagagctgtcaaagttagacatgtgataatcggcttcaaatgcaaaaaaaatttaaataaagcgtcacttggagaggaagcttagccatatagcatcttataaagctagagttgtcacttgaataatataatgctagagcctacgactagacagctttagttgtgcctaaccatagcatccgatctctgtagttcgttgacaagaatgattggatctctcaccattttgttctgcttactctagcggttcagcatatgtttattgcttagtattccaacgtgttgttgattcgtcctgctggtgtagctagctaggatcgagtgcagagcaagttttccacccgaggggtacatgtatgcttggaacaacatatgattggaaaagttcgcgtcgacgcactgggtccggttcgttggacttattctgctgccattgtcggtttcaaactgcaaatactatgcctttatttactcaaataattcctaattaatttacagatataatgtagcaattatcatcttctgttgttgatttatcctcatgtgatagcaattgccctccaaaccgatcgagc

SEQ ID NO: 6327 - DNA, 1107 bp, Zea mays
aaccgattgggtgcacctccagagcctagagatgcatgccgactgatcccaactctgaaataagagaacctttattactgttcactcagaggacccgccaccctgaattcctcgccgccgtcttcgtccaccagaaccatggcctccgacaccgcctcggcagttccgtcgtctgtggtctcagctgccgaggagacgctcggatataccgaatccgtaggggaccatctctcccatctgctcgcggcggcggcggcggaccccgacgccgtggccgagctcccaccccttctccgggcgcgcgctttccttgccttggcgcaggccgcgacctcccttctcggagttcgtttaaggtgttcgggagttgaccctgacgagcaccccatcagaaaggagtttgaaaggttaagcctaatgcaggagaagttaaatcaatttgagaactgggacaaagcaccacttcgcccttctactacactaaatacacaagcagcagcaaggttcattggacactcactttcccatctgacatccgatcagaagaggagcatgcatgaaataagtagaggagaaaggcggagttggtctgggcagaagagaaagcctgaaccttcagtagaaaagaagtctgttcgtgctgctgcagaagagttccttgcaaaggcttctcaggaacttattggacatagtgatagcagggtcaagggtcctgttatactcatttctgatgaagatgaggactagatcaaaaaaatgggcgcttaccagattacatgcctgattcatcggctaggataagggaaggtagaagttcctggtgatgaagataaacttatgtacattgctgtggtgatgaagatgaatttatctgcattgctgtgttgttctacatgtaacagggaatggagcaaagctgcataggcttgcttaagtccccagttctgggagcaattggcctcgaatcttgagtgcaatttatctgagtttctttccggaaagaattttgacattctatttgctagtggaactggagcagcaacatatgatttatgtgctacagtacccccatataatgagtgctatctatctatacattcgaatgac

SEQ ID NO: 6328 - DNA, 1564 bp, Zea mays
agagaagaatgggaatccaaaatcctataagaccctcctcccttcatgcacagctctgccgcttgcctccgccggcgagggaagggacgaggcgccgagccggcaaccgttttcggggttgctggcggcgattggctgcggttccgcatcaaggctggtcgaacgctgcccctcctgattggtaggtagctcgagatggatctgattcttccatataaggttggggacctcgcggagtccaaatccttggtgagcggttacagaggtgcatggtttcgctgtaagatacataatatgcgtgtcaggcttggatacctggagtgttacttggaatacattgattatccaggcgaaaaaaaggaatgggttaggctctttcgaaagaactctgcaaggtccaaccaaaattcaagtgatagtattcacaccatgataaggccttcatttccaaaatggtattttgtgcatgaagttcctgagcagttcccaaatagtgatgtcacagcaattgttgatgaaacctggcaaattggtgatcgagttgattggttgaaggaaggttgttattggtctgggacaattactaagataatcaatgaagatctggtcgagatagagctgccggcacctcccataggtgaaggaaaatgttataaagctaaatgtagtgatctgaggcctactctcgagtggtctctagcaagaggttggatggtccctctttcacaggcaaatggaaaaggttggcatgctgctcgtctacttcaacattataaatctgaatcagatgatgataatgacgacaacgatagctgcgatgcccggcaaacggtgtgcagagcttcaaacacgcatgaggaagctccaggccccatggtccccgcacctccgtcagccacaaacaacgctcccagccacatgtatcagaaggatgctgctgtcgcatccacagaggacctgctgaagcccagctcaacatccaagtcgccagaccccaggcacgacgcccaagctagcactcaacctgcaggtacgggggtctccatgaagccggaaccggttattggagtctcaacaatcaagaaagaggactcctccttggcagaaggtgaggttgatggcggcacggaagagtgcctggagaagctgggcgcgatcaaagccaggctcaaatacctcatgcagggcacgcggctggaacatgagcgcagcgccaccttccgtgggtagtcaggcagatgaagctgcatcaaaggtgcaacttcacgcaggggtttagagtttagggtttagggccatctaacgcctgttgtggttgctgaattttgtgtcctgtggttacaggtattattgtcctgaataatgatgctgtgattaagtggtttgcttttttgagtgcggcaatttgtaggagctaagaggaatgtgttgcttttgcattaaactgtatccagtagttcatttatatggtcatcccaaacactgcacagtggagtttgaatattggtatgaagatagataagctggtgcagatagctttatgttgccaaaaaaaaaaaaaaaa

SEQ ID NO: 6329 - DNA, 1435 bp, Zea mays
cctcgaggccggcctggagcgcatttgtccctctctccttccactcgtccgatagagacacgcaccactcgaaccagaaccaccaggctgctggtgctggaagggggcgcggcagctgggcagctggcaacggacatggcggcggccggcggcgagaccatgatgacgagggagcagctgctccacctcttctcccgcttctccttcgtcacctccctccccgaggtcaagcagcggattgccgacgccgtcagggacaagcaggaggctgtggccgtgaccactgaaatacaagaggagattcttcgcgagatgggagtagatccaagttttggtattggttgcctaggaaaggtgaatgttgtttacaaaaatgacaaggacttgatgattaaattctatcaatttgttgccaaagaagaaatggctattgatgaagctgagcttgaacccagagaattggctgaaaaactacatgctcaacaaataatgcaagaaaagcaactgaacatgctagttgaaatgaggaaatatagccgagagagccaatctgtcatacttgggactttgcacaaagaattggaagaagctaattttgacatcaatgcatcgatcttgagcccagagcaaatgcaagagattgttcaaaagtgatatatttccaacaaatgagatcagtacctgccttgtctacctttgtggtgcttgtgtctacctttgtataaattgctaaaaatagcaagcactcctgtctatatgagaagtgtagctgttacaagtaaccctgtagaacatattgatcgtgcaaagatagttcacagggatgtaaaacattctgaattttacaaacataatactttttgtggatgctactttcttagcttgaatatggtcatgtaaaccactacagacaatactgtttacagagtgaagtttaaaatataacatgtgataggagagctgttggagaccaccttatccttttgggagttcaaatattgatgcacactagaagcaatcttgaaacaggaagaagacatgtaataaaatattcttcataaattttcttagatttgttcagtcttgcatgatagattgtgttatggcagctgtgtaatgtctattgtaatgagttgtatttgtgtaatgggcttaggcccaactacttatataaatatctctctcaaccttggttagggttagggttttagttacactaacatgttatctagctaggttttagcctttcttctctcctccctgtacttgccaccgccagctctccctctcgctttgctttgtctgttgctgatcttcagtacctccacatcgccgtggccattggccctctccccgtccctcgctggcgttactccgctagctgtgcttccacccccgctgtgtcttgctagcttcgtcctacctccacttcgtc

SEQ ID NO: 6330 - DNA, 1320 bp, Zea mays
  misc_feature (639)..(639): n is a, c, g, or t
cctcgaggccggccgggccgggattccagatacacgtattctgatgtgcttcttcagcatgctcagaaactattcacttttgctgacacttatagaggcctctcaagtgagagctatcccaagctccaggatttctataactccaccagttacgttgatgagcttctatgggcagcgagttggctctaccacgccacaggcgaccagacgtatctcaactatgtaactgtacagaacgggaaaagttatgctgattggggaaggccaacatggttcagttgggatgacaaaaatccaggcacacaggtgcttttgtccagactaaatttcttcgggtccaaacagatatctaatgccgaaaatgaggggttgaaaatgtatagagatactgcagaagctgtcatctgtggtctgattccagattcgcctcaagccactgccagcagaactggaggaggcttggtgtggataagcgggtggaattctctccagcatgccaccaacgctgcgttcctatctgttgtgtacagcgactacatgctctcgacgcggacagcggcagtgcagtgcagcgggaagtactacagccctaccgacatacgcaactttgctgcatcacaggctaactatatcctgggnagacaacccgatgaagcttagctaccttgtgggatatgggagcagctacccaaagcaagtgcaccacagaggggcgtcgatccccgcggatgcgaaaacaggctgcaaagggttcgagtatctccactcacccagcccgaacccaaacgtggctacgggcgccctggtgggtgggccgttccagaacgacaccttcgtggactcccgtgacaacgccgtgcagacggagtccagcacctagagggctcctcctatgttctggcctggagcgatgcgtgtacgagtacgattgcagtttttttgcttggcgtggctgatggtgatgcgcgatctgtgactgtgagagagaaagcttggttgccaaccgttcagttcagacggatggcatatgcaggatgcagcagtagtttagtagtgcccacgcgtttcttctgttgtgacagtcaatgacggtgctgctcctgcagctatagttttttcaccgcgtgctcctatctggtttgctggtgtgcctgtaaggctgtagccacgagtaatgtattagactatttgtaggacgtatttcatttgttgattctgtggtgaggtagttcagcagagctttgtacaagcactacagcatcggcgtgcacgagagcagcctcacggagcagtacctctactcaatttcggcgcgcctgc

SEQ ID NO: 6331 - DNA, 3359 bp, Zea mays
ctgcagtagctcgcattcgattgaggcaactgctacgagtatgctcgaggtagccagccagtcactcgctgtttgctgcgcgttcaaggctattgcagtacagggcagcgggcagccaactcccacgggccggcccgccgtgcaaccgttacctatcggtgtacggcgaaagcacagcgcccgcgacctcgcttccggagttccgggtcacagaggatccttccttccgacggaccgacgcggccgttctcattgtcctgtcggtgctcgacgcctcaccactcgccagtcgccacgctcacccgctcccctcactgccacttgcggcccaccgcaccaatcatgcccgcacgggcccgcagacagcgacccaaaacttccttctcactcctccggtgaccgtgcacccaacaattccttattactacggagctgtgcgcgcccgccccgccagcgccacacccacacccacaccgcaccaaccaaccccggccggccagccagcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacggccgcgatgttcgccatcatgaagcgcaagcccgggggccgccacatcaagccgctgccggtgccggggccgccgggggccatcgactccaagtacggcgacgcgctcggggtcgcgctccagttcttccaggtccagaaggcggggaagctggagaacaaccagatcccgtggcgtggggactcggcgttgaccgacgggaaggaagcggggctggatctttccaagggaatgtatgatgctggggatcacatgaagttcaccttcccgatggcattcacggcgacggtgctctcgtggtcggtgctggagtacggggatcagatgagcgcggcaaagcaactggaccctgccctcgatgcactgaagtggattacagatttccttattgctgcacatccttctgacaatgtgctgtatatccaggtcggtgatcctgatctggaccacaattgttgggaaaggccagaaacaatgaccgagaaaagacctctcacacagatcaacaagaagactcccggatcagatgttgctgctgaggcagcagcagccatggcagctgcttcaatggtcttcaaatccagagataccacgtattctgatgtgcttcttcagcatgctcagaaactattcacttttgctgacacttatagaggcctctcaagcgagagctatcccaagctccaggatttctataactccaccagttacgttgatgagcttctatgggcagcgagttggctctaccacgccacaggcgaccagacgtatctcagctatgtaactgtacagaacgggaaaagttatgctgattggggaaggccaacatggttcagttgggatgacaaaaatccaggcacacaggtgcttttgtccagactaaatttcttcgggtccaaacagatatctaatgccgaaaatgaggggttgaaaatgtatagagatactgcagaagctgtcatctgtggtctgattccagattcgcctcaagccactgccagcagaactggaggaggcttggtgtggataagcgggtggaattctctccagcatgccaccaatgctgcgttcctatctgttgtgtacagcgactacatgctctcgacgcggacagcggcagtgcagtgcagcgggaagtactacagccctaccgatatacgcaactttgctgcatcacaggctaactatatcctgggagacaacccgatgaagcttagctaccttgtgggatatgggagcagctacccaaagcaagtgcaccacagaggggcgtcgatccccgcggatgcgaaaacaggctgcaaagggttcgagtatctccactcgcccagcccgaacccaaacgtggctacgggcgccctggtgggtgggccgttccagaacgacaccttcgtggactcccgtgacaacgccgtgcagacggagtccagcacctacaacagtggcaccctggtcggtctcctctccggcctcgtcaccacttcctccgtggtacagtcgttcacctagagggctcctcctatgttctggcctggagcgatgcatgtacgagtacgattgcagtttttttgcttggcgtggctgatggtgatgcgcgatctgtgactgtgagagagaaagcttggttgccaaccgttcagttcagacggatggcatatgcaggatgcagcagtagtttagtagtgcccacgcgtttcttctgttgtgtgtgtacaatgacggtgctgctcctgcagtgcagctatagtttttcaccgcgtgctcctatctggtttgctggtgtgcctgtaaggctgtagctacgagtaatgtattagactatttgtaggtcgtatttcatttgttcattctgtggtgaggtagttcagcagagctttgtactgtaccgatgaattgcaccgtctcccaactgaaatgtgccttgggattcacagctggaggtgaatggcacgcattcgtgcggctcttcgctccatgtttttttttaaaaaaaactgggataaaatagggaagagaaacatttctggtaatacaatggctcccaggcccagctcctggtgtatgattcctggcacgtgttttttggttggtggtggaaagtggcatcgtcgacgcctctacggtgaagcgtaacgaggggagttccttccctttgcgtccgagagagagagagagaagaaagggatgtatcaggagggttcagggggagccggtgcaaatggtgaccaaagttcatggccacccacatgctaggtccagatggcagatgctgtacccaactaagatttgaggtctcaaattctcgaaaagatccaatgaaattcctggacttggaaaaagcgtactagtggctagtgctgtgcatacatacttgtactgtgtgtatgcaactccgaaattccttcctggggccagccaaccatcgattgccaaacaagaacagaaccctgcactgcacgccttccgctgtactactaaccgttttccgggtgcccaatccctgcataggctgcatgttcaatgcgatccctcctacctcatcagtttatgtttatcccacccagctccattaataatccaattaaaaaaacttggagctattgccagaatccttctgca

SEQ ID NO: 6332 - DNA, 1248 bp, Zea mays
  misc_feature (1153)..(1201): n is a, c, g, or t
  misc_feature (1204)..(1214): n is a, c, g, or t
  misc_feature (1217)..(1219): n is a, c, g, or t
  misc_feature (1224)..(1225): n is a, c, g, or t
  misc_feature (1231)..(1231): n is a, c, g, or t
ccacgcgtccgctcagctatgtaactgtacagaacgggaaaagttatgctgattggggaaggccaacatggttcagttgggatgacaaaaatccaggcacacaggtgcttttgtccagactaaatttcttcgggtccaaacagatatctaatgccgaaaatgaggggttgaaaatgtatagagatactgcagaagcgcccgccgggcgtcggattccagattcgcctcaagccactgccagcagaactggaggaggcttggtgtggataagcgggtggaattctctccagcatgccaccaacgctgcgttcctatctgttgtgtacagcgactacatgctctcgacgcggacagcggcagtgcagtgcagcgggaagtactacagccctaccgatatacgcaactttgctgcatcacaggctaactatatcctgggagacaacccgatgaagcttagctaccttgtgggatatgggagcagctacccaaagcaagtgcaccacagaggggcgtcgatccccgcggatgcgaaaacaggctgcaaagggttcgagtatctccactcacccagcccgaacccaaacgtggctacgggcgccctggtgggtgggccattccagaacgacaccttcgtggactcccgtgacaacgccgtgcagacggagtccagcacctacaacagtggcaccctggtcggtctcctctccggcctcgtcaccacttcctccgtggtacagtcgttcacctagacggctcctcctatgttctggcctggagcgatgcatgtacgagtacgattgcagttttttgcttggcgtggctgatggtgatgcgcgatctgtgactgtgagagaaagcttggatggcatgcaggatgcagcagtagtttagtgcccacgcatttcttctgttgtgtgtgtacagtcaatgacggtgctgctcctgcagctatagttttttcaccgcgtgctcctatctggtttgctggtgtgcctgtaaggctgtagctacgagtaatgtattagactatttgtaggacgtatttcatttgttgattctgtggtgaggtagttcagcagagctttgtaccgatgaattgcaccgtctctcaactgaaatgtgccttgtgaattcacagctggagatgaataannnnnnnnnnnnnnnnnnnnnnnnnnnnnnnnnnnnnnnnnnnnnnnnnccnnnnnnnnnnncgnnncgaanncccccnaaaagaatcgagggggg

SEQ ID NO: 6333 - DNA, 3015 bp, Zea mays
aggccagtgttccaagctgccggtcgggtacgtgcagctgccggtgggcgtcgccgggccgttgttgctcgacggccggaggttctacctgcccatggccaccaccgagggctgcctcgtcgccagcaccaaccgaggctgcaaggccatcgccgagtcgggcggcgccaccagcgtcgtgctgcgggacgcgatgacgcgcgcccccgtcgcccgcttccccaccgcgcgccgcgcagccgagctcaaggcattcctggaggaccctgctaattttgacacgctttccgtcgtcttcaacaggtcgagcaggttcgcgaggctgcagggggtgcagtgcgcgatggcggggaggaacctgtacatgagattcagctgcagcacaggggacgccatggggatgaacatggtctcaaagggcgtgcagaacgtgctggattttcttcaggatgacttccatgacatggatgtcattagcatatctggttcatcttgctctctcggtttttggtaaagttgaattacctcagtttactgagtcacgtagtggctgcttagtgtactgaactttcagagcattcttctaccatttaaaaactaaaatggattcccacgtcaagcgttatcttatttgaatcctgaccatacgcccattctaaggagtcttcaatgaacaataagtatgagagacctattggcagtttaaatacccagcactatttgttctatacttctattgaatcattgagggaagcttggggacaaaaaggtggattgttgaatataactgcacctgtttaaatttagttggtcagtgaaccagtgtggcatggtctatgaagttttaaggactccatcactttgctacgcactatggtttcaggaaggaaaaaaatggcttattttttcatacaagataccagacaacacccttagtattttgtaatacaacaatactgcacataaaccaagactgacttcaacttatacttattataagtagttacgactaggttttcttggacatcatccatactactaaaacgatcaggagacggcagaccaactacaaaaaaaaaaccaagaggagacggcacaccaactaccaaaaaaaaaactagaaagaacatttcaagtagaaacatcagtgcttcttttacacaagcaacaaggccagtgcttttacaaaaaacaaaaaaaaagcatggaatatttgactgtactattaaacacctggttacatcagagtaatcatgttagattacaagaaacagtatttcaaggcggcgagttgctgccacttgcccactactctgtttactcaagttagtagctttggtgttccatgaaaatgtcttcggtgactctttctgaacctggtcaaaaccgatcccatcagcataattttgtgcatcgaatgactgtacaactggagacgcaagatcctacagcaacgtattctgtacatacattcctgcaactttcccaagctaaccagcatctccgcctcctgaaaccaggcaacttctgctccgacaagaagccgtccgccgtgaactggatcgaggggcgcgggaagtccgtggtgtgcgaggccgtgatcggggaggaagtggtgaagaaggtcctgaagaccgacgtgcaatcgctggtcgagctgaacacgatcaagaacctcgccggctcggccgtcgccggcgcgctgggggggttcaacgcccacgcgagcaacatcgttacagccatcttcatcgccaccggccaggaccccgcgcagaacgtggagagctcccactgcatcacgatgctggagcccgtcaacgcagggagagatctccacatttccgtcaccatgccttctatcgaggtacgcgacagtgccccgcccgtttatgtatccaggccgctatccaggcttcggtgctggtggtgatacgattctgcctagaatatgtttggtcccgctcggatcatttttgtgctgcagcaaatgtcgctctcacatgacatgaccacatccttctccatggatgattggcatttgagttcttttgatcgttccatctgctactaaacatcccttaaataaggaagaggtgacatgatgaacgtcatgttgggctgcattccttcctctgtcatcataaaaaaaaggaatccttttcttgttgctctcctattgttcaactcatctatttgctggcttgagtaagcttttgcactgattatggcgaggaggcatatacaataattctaaggatttgtctttgctaactatgacgacacgacacacaccgagctgcctgagatttatttgttgaataccgtacaccttgtgattgaagggaacctcgcccatacccaatcgttccatgatgaaatcatcaagaccctggaacaattagaaattacgagatgattgtatccggagcccagagacacgagcactgtgcactgacgggtgactggtgaaaatgcaggtgggcacagtcgggggcgggactcagctggcgtcgcagtccgcctgcctggacctcctgggcgtgaggggcgcgagccgggaccgtcccgggtcgaacgcgaggctgctggccaccgtggtcgccggcggggtcctcgccggcgagctctccctgctgtcggcgctcgccgcggggcagctcgtgaagagccacatgaagtacaacaggtcgagcaaggacgtctcgtccacgacggccaccgagaagacgcgtcaacgtgaagtggacgtgtgaacagcagggattttagtttttgttcttccttttggtgtgttcataagaaagagctctggccgtctaggcgcagaaagaagtgttgtttgcaggtcgtggttggttggttggtagattagatctctctctctctctcctttgttgttctttcggcttggttgatctctctccttccctctttgcgtcaggaagcagcagcttgcaaacctggtctcagcactgtaattatttcttctgttctactaccacatcttttgtt

SEQ ID NO: 6334 - DNA, 720 bp, Zea mays
atgaaaatggaaaagagtgcattatgagcacggcggctctatcagagcgtgatacattcacaagctgaagagggctcggtcatccggaccgatcgaaaaaaaggcattagtgcattagcatcgtcaccactcgcgccgtcgtactacctcgccgactccctcgcttcgcagatcgcactaaagggaacacatggatctagcttgattttgtaccaaattcagagcaactgatcgtggggattcgattctccatagtttatttgcggggccgttccgatcagcgatggtgaagaggctcaggcgcaagggcgacgtctcctccgcgccgccgcctaaggccgccgcatctcggtcaaccaatcccgacaaatttaaaaagaagggggtcaaaaccgatccggagaaattgaaggcggcctgcactgaatccgcaaacattgctgaggcgtctgcttcagcgcagacacccaccccgaaaccagtcaagacgagtccggcggccgccgccgccgcagagattgcagatgatcgggtcgcccagagcaaaacggaggacggaaagtttagtaggaaggagacgatgaagggaagagaggagcagaagggagaaggggccagtgatggggtcacccagaccaagactgaggatatgaatgtgactaggaaggaaacgatgaaggggggagagaggaagggggacgggagtaggaatgagatgat

SEQ ID NO: 6335 - DNA, 1971 bp, Zea mays
ctcatctagggtttaatcctctcagccacgctttcagaaacaattcgttgattgctattcgatagatcgtactaaaggaagctcgcggcgccgggaccagccttatcgcccccgttagggtaacgcaagtacccgtgctcaccactcgcgccgccgtctccctctcttcgcagccatggtgaagaggctcaggcgtaagggcgacgtctcctccgcgccgccgcccaaggcctccgccccggggtctaccaagtccgtcaagttaaagaagggggtcaaaaccgttccgaagaagttgaaggggctctgcactgaatccgtgggcatcgctgaggcgtctgcttcggcgcagacaccggccccaaaatcaatcaagacgagtccggcagcggccaccgccgcagagaccgcagatgatcgggtcgcccagaacaaaacggtggacagaaatttgagtaggaaggagacaatgaaggggagagaggcggagaagggagagatgaccagtgatggggtcgcccagaccaagacggaggacaggaaggccagtaggaaggaaacgatgaaggggatagagaagaaggcggagggggaagagaagaggacgagtaggaaggagatgatgaaggggagggaagaggagcgtgtgaagagggaagagaagagaaggaagttgacagggaaggaaaaggagaaagagagtgcctctggattcatattcatgtgcagtgcgaggacaaagccagagtgctaccagaacggcgtgtttggcctgccccgggggaagatggatgtggtggagaagatccggccaggtgctaagctgttcttgtatgattttgacctcaagctaatgtatggggtatacaaggcagatacaaggggaggattggatcttgtgcgacatgcctttgatgggaaattccctgcacaggttaaatttagtgttgacaaggattgtcttcctattcctgagagtagtttcaagcatgccattaaggagaactacagctcaaaaggcaggttcacccaagagctgaactctaaacaagttcaaagactattggcaatgttcaagcctatcgaccttcctcaatcagctccacaacatatcgaggaagtgcgacaatcacatatcattgaagatattagaaacccgagtgactatgaagatagaagacgattgcaacatattgaagaaagaggtgcacctattgatgtccatgcatatcctcttgaagatcagtacaatatcacacgatcattacatcctccactttttgatgagcctcgacgtttggtgctagatccttatcatatgcaagagcctcaacatgttcctcttaattactatcaccaagtggctactaggtccccatactgtcaacctcatatggatattatgcatgaaagaactgcagctgaggcaaccctgatggatccacttccggtaagagatcaccgagcactgccaggagagcttgctgcacggtctgaacgcgtggatgagctgtaccgttcttacaaactctctacacgcgggatggacttcaatccgggagcatcctaccagacaacttatcacccgtctagtagtgtttatggtgaaggcattcagaggccagttttggcaaggggtaatggcccaagtgtgcctgtgtccagccgttattcctttaatggcccaccagcatattgatggattgcctagatgcaagcactcaaatcggccccagcctattgtactgcgtaccagttaatgtaggcaatgccttcttgtataccgttggaagccaggatagaacttgatggtagttaggggccctaatggtagtagcttcgcagtttgttcatcgccgtgggattcattttgcaagataaatgtatgaaatgaaatgttaaccttgtttgatccaagttgtttaaacaaaaatgcaaagcgattaatgtctttctgtcgaaaaaaaaaaa

SEQ ID NO: 6336 - DNA, 2265 bp, Zea mays
agccgggggaaaaaaaggcattagtgcattagcatcgtcaccactcgcgccgtcgtactacctcgccgactccctcgcttcgcagtttatttgcggggccgttccgatcagcgatggtgaagaggctcaggcgcaagggcgacgtctcctccgcgccgccgcctaaggccgccgcatctcggtcaaccaatcccgacaaatttaaaaagaagggggtcaaaaccgatccggagaaattgaaggcggcctgcactgaatccgcaaacattgctgaggcgtctgcttcagcgcagacacccaccccgaaaccagtcaagacgagtccggcggccgccgccgccgcagagattgcagatgatcgggtcgcccagagcaaaacggaggacggaaagtttagtaggaaggagacgatgaagggaagagaggagcagaagggagaaggggccagtgatggggtcacccagaccaagactgaggatatgaatgtgactaggaaggaaacgatgaaggggggagagaggaagggggacgggagtaggaaggagatgatgaaggggagggaagagcgtgtgaaaacggaagagaagacagggaaggaaaaggaggaggaaaagagtggctcaggattcatattcatgtgcagtgcaaggacgaagccagaatgctaccagaacggcgtgtttggccttcccagggggaagatggatgtggtggagaagatccagcgaggggcgaagctgttcttgtatgattttgacctcaagctactgtatggggtgtacaaggcagatacaaggggaggattggatcttgtgcgtcacgcctttgatggcaaattccctgcacaggttaaatttagcgttttcaaggattgtcttcctattcctgagagtagtttcaagcatgccattaaggagaactacagctcaaagggcaggttcacccaagagctcaacactaaacaagttcaaagactattggcactgttcaagcctatcagcctttctaaaccagctccacaacatattgaggatattcgaaaaccaagtgattatgaagaaagaagacagttgcaacatattgaagaaagggctgcacctattaatgtccacgcacatcctcttgaagatcggtacaagatgacacggtcattacatccgccactttttgatgagcctcgacgtggtttggtgctaaatccttatcatatgcaagagcctcaacatgttcctcttaattactatcaccaagtggctactaggtctccataccatcaacctcatatggatattatgcacgaaagaactgcagctgaggtaactgtaagagatcaccaagcactgccaggagagcttgctgcacggtctgaacgcgtggatgagctgtaccgttcttacaaactctctacacgcgcaatggacctcagtccgggagcatcctacctgacaacttatgagcacccgactagtgtttatggtgagggcattcagaggccagctttgacaagggttagtggcccaagtgtgcctgtgtccacccgttattcctttgctggcccaccagcatattgatcatccagatgcaagcactcaaatcggccccagccgctgtacaagttactgtaggcaatggcttcttgtacaccgttggaagccaggatagaacctgatggtagtagctttgcagtttaattattgcctttggtttcttttgcaagataaatctatgagatgtaatgtggaccttgtttgacccaagttgtttaaactaaaatgcaaaacgatggatgtctttgtgttgatttgcagcagagttcttgcatttttttttgccttgccaggggtctttcacctcgtctttgtgaatctggatgcagttactcgtcggagccagtggatcataagatcgtcccgtcgtgttcctatcatgacctattttgttagccagtggaagcttgtcttataaaaaaaggttggtcgacgtgtactccagaagcttgtcatgcagatagaatgttctacaagcaaaacatgaaaataggtgaaattcatctttcagtttttgcgttgcggtcttgcgaatagactgttgcatgtgttgtcagttgtctcaatcggttccgaactggtcgtctttaacaacattagtctttattaacatcattatgccactggctagtgcagtagtagtttttacgtgatgccattccgttgccaggccacccgcagaccgtccacgagtaacatcacatcagcatactctgca

SEQ ID NO: 6337 - DNA, 5516 bp, Zea mays
tattccattctctgttaaaaaattggccacgttataggtatatgtgcattagtcatttagtgtgtaaaatccatatattattagattcatgttccagaatgctgtcactatatattagttttgtttctctaagagattattttatgtgaaaataacagccagggtctacacttgaaccttgaaaggtcaataaaaacaagcctagtactcttcaaccaagggagtaatactaatatgattttcggaaagttaacctcagtacaataaaccttcaactccattttctttttgaaatggtcctagaacataaaaggatcagcagaactcatttggaaagcatgcaatgtgtggtatttagggggggggggtacccaacacttagtgcaaacaagttaattattctccctattttattaaattagtttatgccactaatgagtgcaatgaaatttgcatggcttagtgaatcactggcactagtgtcctcttggataagaatttatataccttgtgttgataaaagcctaaacccctactctgttgcaaattgcagattgttttagttttgtccaaagtcaaatatctctaactttgaccaagtttcgagaaacataattagcatatacattatacaataccaaattgtggatttgatgaaagttattgatgtggtacatgtctgtgaatttcttttgaacgtggtcaaacatagaaaaaattaacttaggacagaactaaaacaccttacatttgggtctgagggagtatattttagttgttcatacatttaatgttcatttttgtatgatatatggttcaacaacaccttttactgacataaggtactacaaacagttacattcatgacatcaattcagaatgagatgttaaaacatcgtgattgaatgccaaatccttcattgtgtggaacaaagcaagcagtacatatgtgtcttcttgtcagaaattatcttcacactacccctgaatgtatggactttatgtttagcgtgcctagaatcttgtgcttggatcatttgtttttatattttgatttgaagcactacaacatttatgatagtattggttgttaataggttctcttatggattctattggttttatgtctctatgcactgccattatgcatgctgcttgttgtttgtacgttcacccatggattaaaatgcctttttcaggattaaggaaaattggtttatccatgcttttgtgtttaattactaccgttttatttatgcatcatggatgattctcaatgtacttaacgtgatttgattgtttaaattgatcaaactcgtagatgaaatattttgactgctaatccaattaactatctgttatgattctggatatagtttttcttaaagataaaaacaggccactgtttgtgtcatcatttcaattttatttttacttgagtcaacacctgattttgtcatatattgtggcagccatctactgaatagacgtgtggttagtatgcatgcactggcagttttcctgattttttttggtatttcgtgaatctgtcaggtaaggctctttctttcagaggattccccttctcaagctggattaagaccacaggacaatctccaagcaaaaggctcatggttaatgcatgcagcgggcccgagctcagatgattctctgccacctggcttcgaatcattgcagccaaccagcgatctcaaaattgacatgtcccaaatcgctcttattaggtggagatgcccaccacaggtaattagggcctgtaatcttgaacattgcattctactactggcaagttgccaaggtgacatcagatcattcgcgcaacccccccacaagtcaagtttttttttttacaattgttgcattctttggttgcagatattgtataatcctgattggtgtgtcgctgctggagaagaaagtgaggaggttgccttgcagaatgagaggatgtttggagcactggaggctatatatccacgaccatcgaacattcctccaaagtaagcgagctgcattttagtttgccactcttctaatctctctctctcttctcatttcttgtacacttttttctgtgccaatccagcccactggttactcctgatgtgaaagactcccagtatgatgattcccgaacccaattggttcctttgctcccagttgaagaggatgatgcctctgaccagttcgaagaaccacctgttggtctaccaagtagttaccaccagtcagataagtatgatgatgcaatatccagggtcccacaagcctcagatgctctctttaccactgcacaacagcagccgaatggttccatcaacacaacaaggtctggtgtccccgccgaagcagacgtagtggctgctgcatctgctgcttacactgcaataatgcaaagcaaccaaatgggaaacatgattgaccaagatctgctcatcaaaatactaagtgatcctgcccaaattcagaggctaatgaaagaatatggtgcgcttaaacatgaacagtcaaccaacagttctgtggcgtcaatggtgcaaggtccaccaccccagatgacagctagtgtccccgtctctatcccagaccgttccaatgcatttcacaacataaaccctaagctgccgcctccacctgttccgaatcgtctacctccagcttcagttaccatgaatgcaccagcgagttcaagtcaagcaattagctttccaagtggcccaaccaggggtttgaactattaccagaacctgatccatcagcatggaggggagaggcaggagccacttcagcagcatggaatgcagtttgcaatgcatcaccagcctcttgcctcgcaggccagtgccgctgatgttgtcagcagtggtgctatgccagctagggataccaagcaaaggcctacgaagccttgtgcttacttcaacagcgcgagaggatgccggaacggtgcgaactgcacgtttctgcacgatgtgtctgccgcgaggaaagaacagtcaaagggttccaaaaggattaagcttgacagcagaatagccgggcggtattgaggggctgctgccgccggttgatttttgactgttcatttcgccttttttccccttcaaaaacgtttcagtaaatattgcgccccagctccttgtttctttcacttagccaatttctctttgttgactaaatgaggtgttttagaagaaagaaaaatatcccacgatttattggagctatgtcgtggtcgctacgccgtggtcatttgtgttggttctgctttttttttttgtcaagaccgagaaatgcatagttgcatactttaacatatagaccttaaataaaaagaacataaaacgcgaaaacagagtcgtttgtcttgtgtcttggtccatgggagccgataagctgttggaaacttggaatatcgttttgcttggtgcatctctattttgcccgacttggtgcttgtaagagcaactccaacaactcctaagaaaattactcctatacaaggaatttgggatctccctaaatcatgtaattccaaaaaaaaatgttcaactccaacaaatcccaaaaatataagttagttatggtggacccacaacatctctttagccggacctctcgcaaaaatctgttgaggcttctgcgccgccattcaaagtcaccgtgcagaaactttcttctgccatcaatcttccaaaggagtagcaggtacgcaccaggccagcagtcggccgatgttgatcaaatcaatgcttaccgtacacactcttttccgtttgattcgtcgtcgactgattggtggagctgacgaggcaggtgccaccatcgttggagctgaccaggcaggtgctgccatccctggaccttcaccatcgcacagaaggcagaagctgcacacgaaatttgagttcctgcacaggtacctgaaagcaggtgtcggagttgctcccttgcttgtatgtattagcaaattatctttttttaccatctgaccattagacaaaatggtgtgccatgatgctaatgagaaaatatggtcgttgtattgtatttatttgcagcctttacacagtaccttccatcatgagtcatcgaccatcgctattgcaaagaattttggatgagtcttcatccgatgatgatgatgatattagttttggcgagtacaatattttccatcatccatcgcatattcatcgaaaacgggttggttctatgcctggacatatagttaaatatcgagacagacaaggaggtcacgcaagaatgtttcaagattacttagcagataattctacattcagcttatctgattttaggcgaaggtttgtttaattccatttggtacctttctttcaatcacagatgccatattgatattttattattcttggttccacaggtatagaatgagtcgtgatttatttaaacgcataatggctgcagtataagatcatgatgattacttccaattaaagttcaatgcagcaaatatagctggattaagttgcttccaaaaggtgaccgcagtattccgtatgctaacttatggagtagcagcagatgccacggatgagtatgtacgtattggagaaagtactgttatagagagtctgagaaggtttgtcaaggcagtaattcaagtgtttggtgatgaatatttgagatctcccaatgaaaatgatacagctcggttacttgaattaggagaacaaagaggatttcctggaatgttaggttcaatagattgcatgcattggaggtggaagaattgtccttctgcatggcatggtatgtattccggtcatttccatgagcctacaattatactagaggcggttgcttcaaaaaacttatggatttggcatgcattttttggtttgcctgggtcgcacaatgatatcaatgttctccatcgatcgccactattttcaatgctagctgaaggccaagctccacaagtgcattactccataaatggtcataattacacaatggggtactatcttgctgatggcatatatccatcatgggcaacacttgtgaagactataccagagccacaagggaataagcgaagatattttgccaaagcacaagaagctgtaagaaaggatgttgagcgtgcatttggagttctacaatctcgttttgctattgttcgtggtccagcacgtttttgggatgaagagacattaggtgacatcatgaaagcatgtgttattatgcacaacatgattgttaaagacgaggaagaaatcgaccctgatgaacgttttcaggatggtggacaaaatgtgcaaccttcacatgatcatcatcaagatttggatgaattcattgaggtccatagaaaaattagggacaaagaaactcaccatcagctgcaagaagatctggtggagcatatatggcggcatcatgctgatgaatattaatttttttccacaaaaactagggtgtactcgacattggtctagttgcgttcaaaataa

SEQ ID NO: 6338 - DNA, 1634 bp, Zea mays
  misc_feature (81)..(81): n is a, c, g, or t
gagcaggttatctaaaaatggagagctaaagtatagagataaagactactaaatttgaagagttatttatcttaatctgtngtagacatttttttataataataactaaatttacctttacaaaaatattcaactagtttttttggagttgctctcatttcctatctatatatcatgcaaaacagttttacgatccgccgaactgatagcgaaattcgctgcggaaaggatccattgccatctaacccatccccgctcctaggtggcgtggggcgtagcatccatctatgttcgtcttcctcgatcctgaacgaaaaccagtagccaaccttccccgcgtgctccgtgctcattcattccccatctcgtctcctcccaaaccagaagacaaaaccctagcctcctccgtgtgatgggatgccgtccaaaccctacccccagtccctgacctcctcttcctcctccgccgtcgcccccgcgacctggatgtccgcatccgcatggacggtgcccgagtcctgatcgccgccggtgccaccgccgtctgctgcttcgtctgcgccttctgggtcttccgttcctcttcgtcctcctcccccgcatccccaaagaagcaccaatccccttccaccaactgctgtggctgcgcctcctgcggctgccgcgacgccaagcccgccaacggcgagatggccgtgggtggggagaacaagaagaaggcgccggagccggatccgccggaggcgccctccatgatggagcagctcgtgcccgagatcaccacccacgcgctcagctacctcgactacaccagcctctgccgtctctccatgaccaactccgccatgcgccgcgcagccaacgacgacggcgcctggaaggcactctaccacaaggattttacggtggaacagggtactataaatcctcctaatggatggaaggcatactatgcagctacaaaagccatcattaatcttaacgcggagttctacaatatcatcagggaaggatccttgccagcaatgagtcgtttctggcttaatgcagactatgtcaagtgtattcatgcgactggggagttctgccctggatacaactcagtgatggagagctggggcctgctattcagctggggccaagacggagggcagggcattgggttccagataagggatgtccgtgtccgtgtgctcggtgagatggcatgggtgaacatgaaggcgaatgttgatgttgaccctttggtgttccatgtgacgaacgtgtacgagctctgtaatgggaggtggtatatggtccatcaccacagctcgctcatggctcaccctgctccgcacaatatgtttggttgaagctggagaaggaaagcaaagaaaacctttgggaagaaaatttgatgtggtatgaatgttttcttgaccggagatagattgtcggatgtatttgagttgaggagagatgagattccccccacccccacccccaccctttttctccgttgtggttctgtttgttaatattgctcctctggagcttcgttccgcagttttgtacaaatatgttttaggtgaatggaaggttatgggccgcagctgactttgatttatctggtgccaaaaaaaaaaaaaaaa

SEQ ID NO: 6339 - DNA, 1600 bp, Zea mays
cctcgaggctgccggagaaccaccctccaccaccgcgtgctccgtgctcattccccatctgccatctcggctcctcccaacccaaacgacaaaaccctagcctcctcttccgtgttatgggatgccgtctaaaccctatccccactccctgacctcctctacttcctccgccgccgtggcccccgcgacctggatgtccgcatctgcatggacggcgcccgagtcctgatcgccgctagtgccaccgccgtctgctgcctcgcctgcgctgtctggatcttccgctcctcttcctcctcgttccccgcatcctcaaataagcaccaaccccctcccgccaacttctgcggctgcgcttcctgcggctgccgtgacgccaagtccgccaacggcgagatggccgtgggcggggagaacaagaagaaggcgccggagcctgctccgccggaggcgccctccatgatggagcagctcgtgcccgagatcaccacccacgcgctcagctacctcgactacaccagcctctgccgtctctccatgaccaactccgccatgcgccgcgcagccgacgacgatggcgcctggaaggcactgtatcacaaggattttacggtggagcagggtactataaatcctcctaatggatggaaggcatactatgcggctacaaaagccattattaaccttaatgcagagttctacaatattatcagggaagggtccttaccagcaatgagccgtttttggcttaatgctaatcgaaaaaagtgtattcatgcgactggggagttctgcactggatacaacgcagtgatggagagttggggcatgctgttgaactggggccaagacggaggaggggggcagggcattgccttgcagataagggacgtccgtgtgcgtgtgctcggtgaggtggcatgggtgaacatgaaggcgaacgtgctgttccatgtgaccaacgtctacgagctgtgtaacggcaggtggtatatggtccatcaccacagctcgctcatggctgaccctcctccgcacaatatgtttgcttgatgtgctgctattcttgagcgaagattagataatcggacgaagatttcctccctcctccccacaacccttttattcgttgtggatctgctgtttgttggtattgctctggatctccgttccgcagttttgtacagatttgttttaggtggtaaggcttattataaattggtgaatgggcgccctggtggccgcggctgactttgatttatatcgcctgcttccagacggtccgagttgatgagtaaaatcttctagaacggtcgaagcccaatggtgtttgttctactgacctggactgagtcatggtctctggcaggtaggtagctgatgatgattccgaatctaggtcattcatactatggccttgtttgggagggctctggcttctctgaaaatagctctggctccggcttctctgaaagacgagctcctctgcaggagccgtgtctttttttaaaaatcgtttggcaaaacggcttcttgtatattttttttttttgtggaggcaaggatatgctgaaaaatattatggataaaaattttatgg

SEQ ID NO: 6340 - DNA, 680 bp, Zea mays
actctcttcagtctctccccttcgcggctcccacccaccgcgtgccgccgccctacgccaggtgccccctacgtacgtcgtcatcgtgcccgtggccgccggcgacgaacgcccagcagggggaaagggagagggaggaggaggatgggcgagttcgacgactactgggcgcgggcgtacaggggcgaccccgcggtcccgcactccgacccgcagcggctcatctccacctggaccggcgcctttgccctcggcgcggccgcctgcgtccaccaccacgcctccgcgctcgcatcccacctcaagtccctaccggcgactttgcaagacatgacattggcccttgatcaaaagcgatggaagaaagcttttgagaaaaagcggcagcaaccttaagctcattgttctttccaacttcttgggccagttggatgagcactgtgtctggtcatcaattgtggcgcatgaagcttcaaaattctctctatatacatatgatgtattgactgaggttctacttttggttttcttgtttagcgttacaactttctcagtttgtgtatttgctccatctcagatcatcagatgacattcagaatgatttgtctattcttaaattctctattatctttttaacatgctgctccctcatcggctccgttccaaaaaaaaaaaaaaaa

SEQ ID NO: 6341 - DNA, 691 bp, Zea mays
gccggccgggccgtcctctcttcagtctctccccttcgcggctgcctcccaccgcgtgccgccgccctacgccaggtgccccccacgtcgtcatcgtgcccgtggccgccggcgacgaacgcccagcagggggaggaggatgggcgagttcgacgactactgggcgcgggcgtacaggggcgaccccgcggtcccgcactccgacccgcagcggctcatctccacctggaccggcgcctttgccctcggcgcggccgcctgcgtccaccaccacgcctccgcgctcgcatcccacctcaagtccctaccggcgacttggcaagacatgacattggcccttgatcaaaagcgatggaagaaagcttttgagaaaaaacggcagcaagcttaagctcgttgttctatccaacttcttgggccagttggatgagcacgtgtctggtcatcaattgtggcgcatgaagcttcaaagttctctctatatacacatgatgtattgactgaggttctacttttggttttcttgtttagcgttacaactttctcagtttgtgtatttgctccatctcagatcatcagatgacattcagaatgatttgtctattcttaaattctctattatctttttaacatgctactccctcagtggctccgttcccaaaacaaaaaaataggcccctaaaaggcccca

SEQ ID NO: 6342 - DNA, 4077 bp, Zea mays
gtgtgcgtgacgaatttgatgcttcaccttgagtatacaaccatttagagccaaatacattatgatcacttgctattttgataagaagccttttgaaattatgtaaaagttccatgtatcaaatggtttactgattattaagattaatgttcaccctttcagtctcaactgcaatcactgagaaagccttttagctacaaaacttatcaaaaacatctacgaaataaaatgggagatgattttatgcgcatctatatagaattgatagctatgatcaactctcatgatataatcaaagcttttaatttgaccgatcatcgtagaggcaaattattttgatctatgtttgagttaattaatatacgattatatggtgcaagtgtttttttatcaatttttatctatgttatacgtaaattagtatacgcttatgtatatatcctacaatatttttcacttatagtatttgatgacttgctcgaccctgctataccgtaatcctggctcggcctccaaactcaaaccaagaccctatttgttgataaccacttatccatcccgaacaacaaaggcacgtatcaactttgttcgcacaaaattatggtgagtttccgacgaccaggggaatgctttcctctatagattttcattttactaagaaaaattaattatttctttctcaagaaaatatgattcccttgtaaaaatggagtttccaaattaatcctaaatatcaggcaggcaactacgcaacgtagtcgacagctgttgtggtacaccatatcagcagctccggaccacaaccactgtgcggatttggttggtcgtctggccgttgtcattgattgaacagttttggccatgatcgtgcaataaatgatgagatccataagaggatgcaatgtgtggccaccaacgagatgcagcattgcagcacgacacgactgcacgaggacgaaaaaaaaaatatccggacatccggtcacggttgccattcttttcctgtaaccgaaccctgaagggtagcgtcatcatccagaccaccattaccagagtgctctgctctcgctggaggccgtggttcattcacgttcatggaggccgccgccattcccaccagtgccccggaaaccaggtccgtacgtgccataccctcatgctttgcttcgttcttgcagtcgtccgtgcagtctttacgagaacacaagtgtgcgtgcagtccttcaactgacctggctggaactggaacctaccaggttttccttacaggaagtcgtagtttctacctactggtactgtacgtaaaaaatgtaacacagatcgatacaactcctggtgattgaccctggccttagcttgacaggattgccgttgtcaccggcggcaacaaagggatcgggctagaggtgtgccggcagctggccggcgccggcgccaccgtcgtcgtcttaacagccagggacgagacgaggggtgcagccgctgcacaagagctcagagaatctgggctctccgatgtcatcttccatcagctggacatcaccgacgctgcgagcgtcagtcggctggctgagttcctcaaggctcgttttggaaagctagatatcctggtacgtagctagtaggctgcctttctatagattcgatcaaaaggcgaatcgatatggaagacgacagcgatgatagatgagctattgttttgtatataggtaaataatgccgcagttggtgctgttgagtacgtccaagatcctgctgacagttcaacgagcgaggaagaggtgagctttccatcttcagctactggaaatcaaaggatcctctccagcacaaactgatgagaaaaggtttgttttgttgttgcattgtgtgtccaacagctgagtggcatggatatggtccaaaggcttcagtgcatgcttaagagagtccgggagacctacgacgctgcgacagaaggcatcaagacaaactactatggcataaagcatgtgatcgaagccttgctgcctctgcttcaagcttcctccgatgggaggatcgttaacgtctcctctgacttcggactgctaagggtaacaactaaccagtatatatatataaactctatctttcagcaacaacgacagacattttaattcagttcagaaaagctatgtaattaatttggtggtgtggtgtagctgatcaacaacgaggaagctaaggcaggagctaaacgacgtggagaagctcaccgaggagaggctggacgaggtgctggccgcgtacctgagagacttcgacgccggcgaggtgggggcgcgcgggtggccggtggacttctcggcctacaaggtggccaaggtggccatgaacgcgtacacgaggatcctagcgaggagccacccggggctgcgcgtcaactgcgcgcaccccggctacgtgagcaccgacatgaccgtccacaccgggcctctcacgcccgagcaaggcgcggccaacgtcgtgaaggtggcgctgctgccggagggcggcccgaccggcgcgtacttcgcgttgggagaggaggcgtcctttatgtgacgaaagcaccgtcgtcgttaagttcgtcgttgttcgccaactccctgttagtcgatttctaaatcgacgtacaatgaaatacatcatcgctgcaaactcacaaatgaaaacaagggaaccttgtagcaaaaaaaaaaagaagtggacagaataatgaataagcatgtcaaatatctcttgagtatctatttgttcaagtatgaatgactttgtacaagtatcaaagattgtgagtggaaccaaattaagcagggctttgtgcatgtatgaacgactccaaatgacagaacgaaggaagctggtaacaccgccggtgtcctgcaaaacatgcatactagccttcatgagattatcatcatcagatagataatgaaattacatcaagcaccaaaattctgttgagtacctatttacagtgaacagggactgaacttgtcgtcttgctggactttgtaacacacagtactcggaaagcagcaaagcacagaagaaaacagcggcatatgccagtaaatatctccattatcttggatacttaccacaaccaatacaagaatacttagtacaccattactcctcaacagtagatgttgttatcgtcagagatattgcacatcatttttttataaaaaaaattatgccctgttgatgagttgttaaaatgtattactatactacatcatcaaaatgagtaagaatttcctgtaactccttacatattaataatagtagtaattaatcaggaacaaacaagtgggttattaacggagactgaacaactcgccaaaccttcataggtgacgaaatcacaaaatgcactctagaccgtatggtaggcggtagcacaagatgcatacaatacaggttaaagtcacgattaaagtaaggaaattaaagtaaggaaagagacactgaaaaatctttctgcagctagataaccaaagtataacatcgagtggcttacaacatttccaataacttgattgacacggcaggcaagtgatgctgaaagccttaaagtctggttgcagaatagcaggcaatgggcctaaaagaaacaacaagcatagtaattcagcatcgattacacgaataaatccaatacatggagcaaacgaacagtgcaagaattaataagaagagcaaacttttgtttactactttcaagggagaagggccatattcaaaaaatttgaccaatcaaatttgaaacgatagttcaagatataacatcgttgaataatctgcaaatagaccaatacatgcttaatctctccgacatcccaaatagtattgttgtaacgaaaaaaaaagtcagaacaggcatagtgcacattagtacactagtactatctaatgatgtagtatgtgaatcatcgccgattagagatttgcgacttgtttgccggaacgagcgaccgactcaagagggcaacagttttcccgcacaccggtggggatgctgaaagctcttgtggatcaaaggggcatgagtagccaaataccaaatac

SEQ ID NO: 6343 - DNA, 1349 bp, Zea mays
cacgactgcacgaggagaaaaaaaaaatatccggacatccggtcacggttgccattcttttcctgtaaccgaaccctgaagggtagcgtcatcatccagaccaccattaccagagtgctctgctctcgctggaggccgtggttcattcacgttcatggaggccgccgccattcccaccagtgccccggaaaccaggattgccgttgtcaccggcggcaacaaagggatcgggctagaggtgtgccggcagctggccggcgccggcgccaccgtcgtcgtcttaacagccagggacgagacgaggggtgcagccgctgcacaagagctcagagaatctgggctctccgatgtcatcttccatcagctggacatcaccgacgctgcgagcgtcagtcggctggctgagttcctcaaggctcgttttggaaagctagatatcctggtaaataatgccgcagttggtgctgttgagtacgtccaagatcctgctgacagttcaacgagcgaggaagagctgagtggcatggatatggtccaaaggcttcagtgcatgtttaagagagtccgggagacctacgacgctgcgacagaaggcatcaagacaaactactatggcataaagcatgtgatcgaagccttgctgcctctgcttcaagcttcctccgatgggaggatcgttaacgtctcctctgacttcggactgctaaggctgatcaacaacgaggagctaaggcaggagctaaacgacgtggagaagctcaccgaggagaggctggacgaggtgctggccgcgtacctgagagacttcgacgccggcgaggtgggggcgcgcgggtggccggtggacttctcggcctacaaggtggccaaggtggccatgaacgcgtacacgaggatcctagcgaggagccacccggggctgcgcgtcaactgcgcgcaccccggctacgtgagcaccgacatgaccgtccacaccgggcctctcacgcccgagcaaggcgcggccaacgtcgtgaaggtggcgctgctgccggagggcggcccgaccggcgcgtacttcgcgttgggagaggaggcgtcctttatgtgacgaaagcaccgtcgtcgttaagttcgtcgttgttcgccaactccctgttagtcgatttctaaatcgacgtacaatgaaatacatcatcgctgcaaactcacaaatgaaaacaagggaaccttgtagcaaaaaaaaaaaagaagtggacagaataatgaataagcatgtcaaatatctcttgagtatctatttgttcaagtatcaatgactttgtacaaatatcaaagattgtgagtggaatcaaaaaaaaaaaaaaaaa

SEQ ID NO: 6344 - DNA, 1398 bp, Zea mays
gcgtcatcatccagaccaccattaccagagtgctctgctctcgctggaggccgtggctctggctccctcgtggccgcccccgccattcccaccagtgccccggaaaccaggtccgtacgtgccataccctcatgctttgcttcgttcttgcagtcgtccgtgcagtctttacgagaaccacaagtgtgcgtgcagtccttcaactgacctggctggaactggaacctaccaggttttccttacaggaagtcgtagtttctacctactgcttgacaggattgccgttgtcaccggcggcaacaaagggatcgggctagaggtgtgccggcagctggccggcgccggcgccaccgtcgtcgtcttaacagccagggacgagacgaggggtgcagccgctgcacaagagctcagagaatctgggctctccgatgtcatcttccatcagctggacatcaccgacgctgcgagcgtcagtcggctggctgagttcctcaaggctcgttttggaaagctagatatcctggtaattaatgccgcagttggtgctgttgagtacgtccaagatcctgctgacagttcaacgagcgtccaacagctgagtggcatggatatggtccaaaggcttcagtgcatgtttaagagagtccgggagacctacgacgctgcgacagaaggcatcaagacaaactactatggcataaagcatgtgatcgaagccttgctgcctctgcttcaagcttcctccgatgggaggatcgttaacgtctcctctgacttcggactgctaaggctgatcaacaacgaggagctaaggcaggagctaaacgacgtggagaagctcaccgaggagaggctggacgaggtgctggccgcgtacctgagagacttcgacgccggcgaggtgggggcgcgcgggtggccggtggacttctcggcctacaaggtggccaaggtggccatgaacgcgtacacgaggatcctagcgaggagccacccggggctgcgcgtcaactgcgcgcaccccggctacgtgagcaccgacatgaccgtccacaccgggcctctcacgcccgagcaaggcgcggccaacgtcgtgaaggtggcgctgctgccggagggcggcccgaccggcgcgtacttcgcgttgggagaggaggcgtcctttgtgtgacgaaagcaccgtcgtcgttaagttcgtcgttgttcgccaactccctgtcagtcgatttctaaatcgacgtacaatgaaatacatcatcgctgcaaactcacaaatgaaaacagttaagggaaccttgtagcaaaaaaaaaaggtggacagaataatgaataatcatgtcaaatatcgcttgagtatctcggccttcgagtatgaaaaaaaaaaaaaaaaaagcggcc

SEQ ID NO: 6345 - DNA, 1033 bp, Zea mays
actcctatgggcgattgggttccgcccggccggccggggagttcacgaacgatcctctccctctccctctccgtcccccaagcaaagaaaagaagctagctagctaggcgtagaacgaatgacgacgcagggcggcaacaggtcgacgacgacgctggtcgccgccgtggccgtagttctggccgtggcggcggcgtcgtccctggccggcgtggcgtccgcggagaaggcgggcgggttcgtggtgacggggcgcgtgtactgcgacccctgccgcgccgggttcgagacgaacgtgtccaggagcgtggccggcgcgacggtggaggtggtgtgccggcacttcggcgcgtccaaggagacgctcaaggcggaggcgacgacggacgacagcgggtggtacaagctggagatcgaccaggaccaccaggaggagatctgcgaggtggtgctggcccggagccccgacccggggtgcgcggagatcgaggagttccgcgaccgcgcccgcgtcccgctcacctccaacaacggcatcaagcagcagggcgtccgctacgccaaccccatcgccttcttccgcaaggacccgctcaaggagtgcggcgccctcctcgagaagtacgatctcaaggacgcctccgagacgccatgatcgtcctccgtcctgtgcatgcctgcatccattgctgccctgcccgctcgcccaagaattgaagatggtagctgccttccgcgttttttgtattgtgtatgtctatgcactgcattcgagggcagcgataatgggcctggcctcgtaagcaaacgttcgatccgcttcttttgatgggcctaaatctgcatgcatgcagatgtactgctacttctgctcttttatattgcttttttttttaattttattaacttctcgttttctccctcatccctcgtcgaggaggaagggtatccgttttgtttttatgatgcaaaggtatccgttttgtttgtatagtacagtatctcatctaaaaaaaaaaaaaaaaaagcggcc

SEQ ID NO: 6346 - DNA, 2168 bp, Zea mays
  misc_feature (471)..(471): n is a, c, g, or t
atatagtacaacatgtccaaggttttaaactaatacgtgcgacttactctttgttaatgtacaatcaaagcgaccaagctacacgcagtcacacaacacacccacacctaaaagatagaagacggaaggccagatattgacactctccactcactaaccgccataaattaagttggtcagacaggtgtaactttacggtacccctctagacaggtatgggtatccattgggtatggaatacccgtcgggtcgggatatgagtttggtacccgtctacaggtatgtgtattgaaatggggagtttttagtttaacgggatcggatttggtaccaagtacgacgccgttcctgaggcgggcctgcgaggcgcggctggcggtgggcgtggctccccggaacatgctgcggacgcttgaggtcgccgagctgagctccagcgccgcgctcatggagcgcgccatgggggcggtngtggagcacgccgaggaggtcgtgttctcggcggagtacgagcggttcgccgcccggaacgcggggctgtgcgtcgagatcacccgcgcgctgctggccaggatgccgacggcggcgaggagtgacggcgcccgtgcttagagcttgaaagcagctgtgatgcgtgcagttcggcagttgtatcggaagatggatcggaatacgatacgatcgagaactctagcttgcttcagtttcgagtgtttttttttttttttatctaaatgcataagttgtgaaacacggcgagcacgatgagcaagactgcaagaacaacacaacgcggcgtctcatcgatcaccattgactcgttctgcttttgccactgcatggacttgcgcttggacttccaacacgcgttctgcgcttggacttccaacacgcgttcatcgacattcgacaggcagcttcccgggatgggcttgcgcttggacttccaacacgcgttctgcttttgccactgcatggacttctggccctgaattgcgtgaaagaactcatctcatccagaactcacaattgagggtcgaatagcagggatctgggtaggtaggcgaatgaacatgcctgagttcacgggacatgcaactctgaacaagtgatcggagttgcttctccctcgagtcgagagcctggacgacgacttgtggttgtgggcttgtacacctgccgccagtcgtcgatcttggctacccctcactcaggaagaactgtttttctttacctgaagaaacaagaccacaggcagtggccctcgctccctgcttgctcaaaagcccatagctcatttacattactttgacgcttttatcttgaagtaactatacccgcatcacttctctgcaaaaaaaagaaagaaagaaagaaagaaagaaagaaagaaagaaaaagagagagaaaatctagcccccaaaagtagggcgacttcaagtcttcaacattctccgacggatcctatatgtatatacgcgcgcgtatcgtctctactaccaaaagcgagacagcaaagcttccaagcattattctgtctactcgttccctttcagccagcagtagctacatgtcagtttgatcgtctgttctgtatttaggattattaaacaggggatatcttataaattcagctcatgagttccataagatttatcacacggctgaactataacttatgcgagacaaattccaaagaaagttatatatatagtagatttccttaatttatttatcctacaaaacacatctttgtgtctggacagtaaccatatttgagaggataaataaattaaacaaaccagctacataccttcttttaaaatttctctagccaagttgtagttgaagcctgtgatgaatcttaaaaaacttatgagtcgaattgtacaagaaatacactgttcaataattccaaatacaatactgtgcctgaatcctggcagaggaagtaatagtgtattgctctgaagtaccgtgcggctgcctgcaagctggtaaccttattatttgcaggggtatggtgctcgcctggatccgaggctgaagagagaagaactagatagaggtgctaatagtgccatagaggtgcaggtgtgggctactgggcttgacggacgaaggccgtgcgctagctactacctctccaatgcgccgagcgaggcgag

SEQ ID NO: 6347 - DNA, 2712 bp, Zea mays
gtaactgtgacagagacatttcgtctcttatattttttacacttatctttatttatctagtcatttgagtggcttgtacatgccctaatgttttgatccaactccaaaccccgatctcgatctatcggttatcgcatccgtccgttaattccatagtgaccgagagagaagcaccgcaccaacccaggagcaggtcagggcggtcagaccagaccacctggtgcaattttcccccaccaaccaacgtctttactaccagctagtccgctctgaccagtgctccaccaaacacgagcacgggcacgggcacgggcacgagccgtgcagtactccgcccctctcggccagacgggcaacccaaaccaacccagtttccctgctcggcgacggcgcacacggatttccgtcacaaaccaaggaaaggaataccgccacgtgttcccactgccgccaaccgaggcagccccggcggccaccgttatatataaccacgcgccaccacccaacaacagcacagcaacccagtgatcaattcaagcaacacaccgacgaagcaagcaaagccaagcggaaaagccaagcggtcagcgtcagaatagcatggcggtgtccgcggccaggatggccgtcgccacggccgtctccttagccgtgcactggctcctccggtccttcctccaggcgcagcaccccgcgctgggcctgctcttcccgaccgccgtcttcatcggcattgccgcgtctggcaacgtcgcaggcgctgccaacgacgcgccgccggggccgccggccgtgccggtgttcggcaactggctgcaggtgggcaacgacctgaaccaccgcttcctggcgcgcctgtccgcgcggtacgggcccgtcttccgcctccgcctcggcgtgcgcaacctggtggtcgtctccgacccgcgcctcgccacggaggtgctgcacacgcagggggtggagttcggctcccgcccccgcaacgtcgtattcgacatcttcaccgccaacggcgccgacatggtgttcaccgagtacggcgaccactggcgccgcatgcgccgcgtcatgacgctgcccttcttcaccgcgcgcgtcgtgcagcagtacaggggcatgtgggaggccgagatggacgccgccgtctccgacgtcgcctccgcggcccagcgcgccgccggcctcgtcgtgcggcgcaggctgcagctcatgctctacaacatcatgtacgggatgatgttcgacgcgcgcttcggctccgtcgacgaccccatgttcgtggaggccaccaggttcaactccgagcgcagccgcctcgcgcagagcttcgactacaactacggcgacttcatccccgtcctgcgcccattcctgcgcggctacctcgccaggtgcaaggacctgcaggccaggcggctcgccttcttcaacagcaactacgtcgagaagaggaggaaggtcatggacgcgccgggggacaagggcaagctcaggtgcgccatcgaccacgtcctccaggcggagaagagcggcgagatcaccccggagaacgtcatctacatcgtcgagaacatcaacgtcgccgccatcgagaccacgctctggtccatcgagtgggcgctcgcggaggtcgtcaaccacccggcggtgcagcgcaaggtccgcgacgagatcaaggccgtcgtcgccgaccacgagcccatcacggagtccaccatccaccgcctcccctacctgcaggccgtcatcaaggagacgctgcgcctccactccccgatcccgctcctcgtcccgcacatgaacctcgaggaggccaagctcggcggctacaccatccccaagggctccaaggtggtggtcaacgcgtggtggctggccaacaatccggagctgtgggacaagcccgaggagtttcggccggagcggttcctaggcgaggagaagagcgtggacgccaccgtcggcgggaaggtggacttccgcttcctgccgttcggcgtgggccgccgcagctgccccgggatcatcctcgcgctgcccatcctcgcgctcatcgtcggcaagctcgtgcgcagcttcgagatggtaccaccgcccggcgtggagaagctcgacgtcagcgagaaaggaggacagttcagcctgcacattgccaaccactccgtcatcgccttccaccccgtctctgcataatagattgattgatagccaaccacgaatgctgcgcgtcgttttctgcatatcaatgttaccctacccacccagtcatttttttcgcttttatttactagccatttctcaggtataagtatctccaacaacaacagtgtgacctataaaaaatccctataatttgtttgaattaaggcactaacaaatatacggctcccacagggaaagcggacagtccactgcggttcccaatttattacttgtttgactttttattataagtttaatcaacccgtcttattcaaaaaattgtattcaaaaaattgtgaaaaaaatcaaaaaatcgctgtgttttatttattatcaaatatatttaacatttttgcatgattttttttaataagacgacagatgaaagttagggttaaaaaaagtcaaatgaattatattttaaaacggagagagtagtatatttgagacatctaagagagtgccctatagtttttgatcaaaattttataaaatataatattgttg

SEQ ID NO: 6348 - DNA, 791 bp, Zea mays
ccggccggggccgtgacgcgaggcagccaggaaacagcaacccagtgatcaattcaagcaacacaccgacgaagcaagcaaagccaagcggaagcggtcagcgtcagaatagtatggcggtgtccgcggccaagatggccgtcgccacggccgtctccttagccgtgcactggctcctccggtccttcctccaggcgcagcaccctgcgctgggcctgctcctcccgaccgtcgtcttcatcggcattgccgcgtctggcaatgccgcaggcgctgccaacgacgcgccgccggggccgccggccgtgccggtgttcggcaactggctgcaggtgggcaacgacctgaaccaccggttcctggcgcgcctgtccgcgcggtacgggcccgtctttcgcctccgcctcggcgtgcgcaacctggtggtcgtctccgacccgcgcctcgccacggaggtgctgcacacgcagggggtggagttcggctcccgcccccgcaacgtcgtcttcgacatcttcaccgccaacggcgccgacatggtgttcaccgagtacggcgaccactggcgccgcatgcgccgcgtcatgacgctgcccttcttcaccgcgcgcgtcgtgcagcagtacaggggcatgtgggaggccgagatggacgccgccgtctccgacgtcgcctccgcggcccagcgcgccgccggcctcgtcgtgcggcgcaggctgcagctcatgctctacaacatcatgtacgggatgatgttcgacgcgcgcttccggctccgtcgacgaccccat

SEQ ID NO: 6349 - DNA, 3311 bp, Zea mays
aaccaaccctcgcccctcgtcttcattcgctcgtccgatcaggaaggacggtggatgaaaaagcgccctgcacgcctgaacgatcggcattattgttcactatctccttttgttttccctctcccgtccatctctctcctctttggccttcctttccttgcgacgacgactgggacgagcgccccccgcgcttctgcaggcgagcaccccgccaccagtcggagatgaacgcgtccaggaaatccagccatctctccagcaaggacagtgcagagaccgcgagggatatcatcaccacgtccggccaaatccaacccctcaaaatcccggacgctgttgctgcgctcgcacaggctgctgcaaaggcaaatgatcttccagggtggccgttgttctcgcctcctaaggtgcagctggacaagtgtaccaagtgctccagagaattctgttctgcaatcaacttccggaggcacacacgtgttcatcgtagatccctcaagatagatagggattttccaaagaatagagaccttctcgctgcattctggaataaactcactgtggatgatgccagcaaaattttgtccttgacaggtgttgttattgagggtgtaactggttcatcaattttgacagcactgtcatcatggatgtgtaaaccagggtatgcttcgttgccagttgcatatgccagagctggcagtgagcttctggatctaattcaagcaaagccttcaatgcatctgcctgtttcatcggatgaactatttagtttgctcgatgaagcaagtgaaaaaacatttctttgcacaaatacagctgcttgtatacagaagtttttatttgatggagaggtagaaaaaaattgcaactgagttgaaaaatgttgtttcgtgcgctagttacatgcttgaacaaaagctgcttgaagcatggtgtgctgataagactgctgaagcattaagatgccagaagttgctggaggatgaagaggaagctgctcagaaaaggcaagccgaactgatggaaaggaagcggatgaagaaacttaggcagaaagaacagaggttaaaaaacctcaaggatgaggatgcgacagttcagtcacctgaaatcatggatgatgcgacatgttctactgccattcaaagtgtgaattccatttatgatcctgactgttttgagcaagaagaatcgcagtatcttcaatttccagcactaattactttggaaactgacaatgattttaatgtggacctaccagtagaagatatcagttgtgatttggggcctgaaatggataaaggtgttgtattaaggcaacaagttgtttcaaggcatcatttaggcagaacggagaagcttgctgaaagtagcattttatctggttccgtagttacttcaaagcatgcagctttagcaaggccttcaaattacaaggatccaaatgtctgttctgcaccaagtagaaacaaaacttgtgaattgaaactacggtctgagattgaagaacagtgccaaaaacatgagttagatgtagatgaacgtggcattggtcctagcaaaaactctcgtgtgctaataggatctataattgtcgcaattaaagattgtagtgaacacttgctggacttaggttccaagaatgacccagtacctcccaatgtaaagacaaagaaacatgcatcagtcaaggtggtgcaacaagttacccatgagggaaacagaaatgaaggtgttcctgatagtgataaccgttctagcctcagtgttactacagatgaaatcagttattcaacctgctgcgatgcagatttggcagtggatgaacatttacaatgcaccacgttttccagtgaagaagcgacagcctttctttctcaaagatggaaagaagcaatagccgccgatcacgtgaaacttgttgtgtcctgaaaactaaaggaatggcagaataaagaaattctgttgagggcaacagcatggaagctccggccgacttgtcgccggatcccacagccctacaacataggtggttcttatctagcctgcagggtgctatgaaagtttggatgtcaagtttgtgttgcggcatgaatggttgtaaaatggcaggtgcattttgcagctgatttgagattgaagcagagggttctagttttacaaggggacagcttgtgtgatgggatctgtttttggtaaggaaaaaaaagagtgatttgaataatggtttggtcgcacaagttcctaatcttttgtactcgttagagtctgctaaacacgaaatgcatgtgtgttgaacatgttgtgcttgcgggttgcggctttcattttgtcccagttctttctgctgtcagttcacgtaactcgcgttcattttgtatcgcttcgtgctgtataacccgtactatttgcaatctattctggaagtctgcagaaactaagtaatttatagattgaactatttgatgatgagcatgtaacagactagttgggaaactcaagtactcttcgaaattagagggtaagtttccaaactagcttttaggtctcctttggattctttgggagagaagaacatgtgcttttagacgtaagggagatttctcccatgcacatggcaatcttggcaacacccgtccgattgttatatccagtggcggatccaggaactgatgacagcctaggcgagaatacggtgtgatccccacgtctgtgctcgtgccacgtgctgcttacttccgtgcactgtgctcacgcgccttgccctccattgcagccggcgagccagcccaggccaccgcctgcggtgcctgggtggtgagtccgccgctggttatatctttcctttcattagaacgagagccatctccaggaatatatatttcatgagcattaatctcccataagatttaagttaagagtggtggttcaaagattaacttgatgtctcagagtggtaatatatacccatacctatcaatcacgaggatactgataatctttatctatcatatcaagttgttatttgagggagcataagctcattggctttctctgcacgaaaattcatccgagagtatagtgcgttagcaattttatacggaagcacttcaaatgagttaagctttctcatgacagatcgaaatgagatatgatgatcctttaaataagattgtgtggttcagtgttaaggaatgagacaagattattctattgttgtcccagttatccctcaaaaatagagggacaagagaggacgccagaagacgttcatgtcatgtccgttcctggcctaaggtaccgagcta

SEQ ID NO: 6350 - DNA, 1036 bp, Zea mays
cggggggatgtagctcagctcgtccgatcaggaaggacggtggatgagccggcccggcccacgccagaccggccggcattattgttcactatctccttttgttttccctctcccgttcatctctctcctctttggccttcctttccttgcgacgacgactgggacgagcgccccccgcgcttctgcaggcgagcaccccgccaccagtcggagatgaacgcgtccaggaaatccagccatctctccagcaaggacagtgcagagaccgcgagggatatcatcaccacgtccggccaaatccaacccctcaaaatcccggacgctgttgctgcgctcgcacaggctgctgcaaaggcaaatggtgagaccgagaaatatcttccagggtggccgttgttctcgcctcctaaggtgcagctggacaagtgtaccaagtgctccagagaattctgttctgcaatcaacttccggaggcacacacgtgttcatcgtagatccctcaagatagatagggattttccaaagaatagagaccttctcgctgcattctggaataaactcactgtggatgatgccagcaaaattttgtccttgacaggtgttgttattgagggtgtaactggttcatcaattttgacagcactgtcatcatggatgtgtaaaccagggtatgcttcgttgccagttgcatatgccagagctggcagtgagcttctggatctaattcaagcaaagccttcaatgcatctgcctgtttcatcggatgaactatttagtttgctcgatgaagcaagtgaaaaaacatttctttgcacaaatacagctgcttgtatacagaagtttttatttgatggagaggtagaaaaaattgcaactgagttgaaaaatgttgtttcgtgcgctagttacatgcttgaacaaaagctgcttgaagcatggtgtgctgataagactgctgaagcattaagatgccagaagttgctggaggatgaagaggaagctgctcagaaaaggcaagccgaactgatggaaatgt

SEQ ID NO: 6351 - DNA, 985 bp, Zea mays
cattggttggccccccgccggccggccggggcaaaagaacccgcagcaggggagactgggagatagagagaggagagggagggtttcctcaaagagaacccgaacccaaacccaagcagagaacactagcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggggtccactacgaggtgcaggccaccgacccctccgagatgggcttcgacgtcatcagaggccgcgcgcaatgaggcccgcgctgcgctctgctcctatttacgtacttacctgtgcgtgggcgtgttctcctactactcactgctcagtagtcatctgcgttcgtgtgtgtgtgattggccggatgctaattggcgttggtgtgctcccgtagcgatcgatgctgccaatctgacgaggcttcgcgtgtgtttgctttgctattttcgcttctcgggagagatggtgcaggcgtggtgtgttgatgttgatgggtggagtagaagctcaggggagtggcagcggactaatgaaacgtccacctctgcgacgtggaattccactgaaaaaatgctccagtgtaccataagctgcttcaaatttgatcgtgttttctctccaaaaaaaaaaaaaaaaaaagcggcc

SEQ ID NO: 6352 - DNA, 861 bp, Zea mays
  misc_feature (715)..(715): n is a, c, g, or t
cggaaaagacccgagcggggagagagatagagagaggagagggagggtttcctcaaagagaacccgaaaccaaacccaagcagagaacactagcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgttcaagatcgacgactgccgctacgccgtcttcgacttcgacttcgtcaccgtcgacaactgccagaagagcaagatcttcttcatcgcctggtcaccggcggcgtcgaggatcagggcccagatcctgtacgcgacatcgaagcaaggcctgcggcggctgctggacggggtccactacgaggtgcaggccaccgacccctccgagtatgggcttcgacgtcatcagaggccgcgcgcaatgaggcccgcgctgcgctctgctcctatttacgtacttacctgtgcgtgggcgtgttctcctactactcactgctcagtagtcatctgcgttcgtgtgtgtgtgtgtggtgtgtgatccgccggatgctaattggcgttcggtgtgctcccgtagcgatcgatgcggccaatctgtcgaggcttcgcgtgtgtttgctttgctattttcggttctcgggacagatggtgcaggcgtggtgtgnttgatgttgatgggtggagtagaagctcaggggagtggcagcggactaatgaaacgtccacctcttcgacgtagtattccactgaaaaaatgctccagtgaaccataagctgcttcagatttgatcgtgttttatctgccatccgc

SEQ ID NO: 6353 - DNA, 1048 bp, Zea mays
cattgggcgcctccgggccggccggggtggcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggggtccactacgaggtgcaggccaccgacccctctgagatgggcttcgacgtcatcagaggccgcgcgcaatgaggcccgcgctgtgctctgctcctatttacgtacttacctgtgcgtgggcgtgttctcctcctactcactgctcagtagtcatctgcgttcgtgtgtgtgtgtgtgtgtgatcggccggatgctaattgccgtcggtgtgctcccgtagcgatcgatgctgccaatctgacgaggcttcgcgtgtgtttgctttgctattttcggttctcgggagagatggtgcaggcgtggtgtgttgatgttgatgggtggagtagaagctcaggggagtggcagcggactaatgaaacgtccacctctgcgacgtagaattccactgaaaaaatgctccagtgtaccataagctgcttcagatttgatcgtgttttctctcccatggtggtgattagtacctgctaccgtttctacctacatttttcttagaaaacacatttctagttactcgttcagttctg

SEQ ID NO: 6354 - DNA, 1117 bp, Zea mays
cttgcatgcctgcagcggggcgggtgccggcggcggcggagtgacgtattcttgccggtagtggtactcttgctggggtggcgacggcctccgcctgaaaccgccgccttcggcttcctcgacggagtcgtcgtcctcggtgaccgcctggacggtcctgggcgccgcccgcgacacctgtcgacttcctcaccttccgagcctgacttctttaccctgggcggcgccggcctcctctcaccctcccgcgcagcaggcgccggctcggaccggctcctggcgtagtgcgccgacgcgatcgtctcttcctcctccaccggagcggatacatcctgcgcgtggttcggcggcgtggcgccgtactcgggcgggaagtccccggagcggaagcggtacaggccgagcgacctgaggcggtcgaggacagaggacgtgcgcgcgagcggcgcgggcggaggcggcgccgcgtacagcgtgtgcgtgtggtccgggtggtagtagtggccgtaccccggctgctccatctgcgggtgcagcgtttcctggtggccgtggccgtggctgtggccgtcgtcgtggtagtagttctccctgcggcggcgctgctgggtggcacgggaggtgagcgcgatggtgccgatgacgaggttgacgacgaggaagaacgtggccggcgtgaagtagccccggatccacgcgcccagcgccgtcgccgcgtcggcgctgtccatctggcagccggagtgagaggcaccgaacagggttacagaggtggctcgggggacggaggggaggtgaggttgggcggcggtgatcgggattggcgtctggtgcagggggattggattggcgtctggtgacccggcgttaaatggtggctggggctgcggggagcacgcggcgcgccgcggaggagcggatgctctgctgctgacttggtgggtggaaaacgtgggaatccaagtgccgcccctcgtgcccgcgcgagccgacccgccgggattgcaggcagagagagccagcggtcccccatgcctttcttcatgacatctgccctctccgcaactgccacgcggcctcgtgcagagtagacagtatagacccggacccggccggc

SEQ ID NO: 6355 - DNA, 845 bp, Zea mays
ataaagccaaaaggacccgcagcaaggggtgactgcatggcggataggattaggagcctgaaagatcgagaagccaaacccacaggcagagaatagcacggtttcgtccatccgatccgcgacgatccacagccatggcgatggcttacaagatggcgacggaggggatggacgtgaaggaggagtgccagcgctggttcatggagatgaagtggaagaaggtgcaccgcttcgtggtgtacaggatcgacgagcggtcgcgcgccgtgctggtggacagggtgggcggccccggggaggggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatacgggccaagatcctgtacgcgacgtcgaagcagggcctgcggcggctgctggacggggtccactacgaggtgcaggccaccgacccctccgagatgggcttcgacgtcatcagaggccgcgcgcaatgagagcgtgattggcgttggtgtgatgagctgagcctcccgatgatgccggccggtctgacgaggcttcgcgtgtgtttgctttcccccccggttttccccccggttcttccgagagatggtgcagtgcaggggcgtggtgtgctgatgctgatgggtggagttactggagtagaagctgagggagtggcagcggattaatgaaacgtccatctccgcgacgtagaattccactgaacaatgctccagtgcaccataagctgctgcttcagatttgtttag

SEQ ID NO: 6356 - DNA, 663 bp, Zea mays
cgccggctcggaccggcttcctggcgtagtgcgccgacgcgatcgtctcttcctcctccaccggagcgggcacatcctgcgcgtggttcggcggcgtggcgccgtactcgggcgggaagtccccggagcggaagcggtacaggccgagcgacctgaggcggtcgaggacagaggacgtgcgcgcgagcggcgcgggcggaggcggcgccgcgtacagcgtgtgcgtgtggtccgggtggtagtagtggccgtaccccggctgctccatctgcgggtgcagcgtttcctggtggccgtggccgtggctgtggccgtcgtcgtggtagtagttctccctgcggcggcgctgctgggtggcacgggaggtgagcgcgatggtgccgatgacgaggttgacgacgaggaagaacgtggccggcgtgaagtagccccggatccacgcgcccagcgccgtcgccgcgtcggcgctgtccatctggcagccggagtgagaggcaccgaacagggtttgtgaggtggctcgggggacggaggggaggtgaggttgggcggcggtgatcgggattggcgtctggtgcaggcgtggtgtgttgatgttgatgggtggagtagaagctcaggggagtggcagcggactaatgaaacgtccacctctgcgacgta

SEQ ID NO: 6357 - DNA, 1066 bp, Zea mays
gaccctcgggctggccggaaaaaagaacccgcagccgcgggggctgggagatagagagaggagagggagggtttcctcaaagagaacctgaacccaaacccaagcagagaacactagcgttccctcaccagggcgggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacaacgagctcgtggccgcgctgcccggcgacgactgccgctacgccgtcttcgacttcgacttcgtcactgttgacaactgccagaagagcaagatcttcttcatcgcctggtcaccggcggcgtcgaggatcagggccaagatcctgtacgcgacatcgaagcaaggcctgcggcggctgctggacggggtccactacgaggtgcaggccaccgacccctccgagatgggcttcgacgtcatcagaggccgcgcgcaatgaggcccccgctgcgctctgctcctatttacgtacttacctgtgcgtgggcgtgttctcctactactcactgctcagtagtcagtagtcatctgcgttcgtgtgtgtgtgtgtgtgatcggccggatgctaattggcgttggtgtgctcccgtagcgatcgatgctgccaatctgacgaggcttcgcgtgtgtttgctttgctattttcggttctcgggagagatggtgcaggcgtggtgtgttgatgttgatgggtggagtagaagctcaggggagtggcagcggactaatgaaacgtccacctctgcgacgtagaattccactgaaaaaataatgctccagtgtaccataagctgcttcagatttgatcgtgtgtttctctcccatggttgtgattagtacctgctaccgtttctacctacatttttcttagaaaacacatttctagttactcgttcagttctgaattataaaatgtttt

SEQ ID NO: 6358 - DNA, 882 bp, Zea mays
cattgggtccctcgagcccgccggggaatgtcaaaagaacccgcagcaggggagactgggagatagagagaggagagggagggtttcctcaaagagaacccgaaaccaaacccaagcagagaacactagcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggggtccactacgaggtgcaggccaccgacccctccgagatgggcttcgacgtcatcagaggccgcgcgcaatgaggcccgcgctgcgctctgctcctatttacgtacttacctgtgcgtgtgcgtgtgcgtgttctactactcactgctgtgctcagtagtcatctgcgttcgtgtgtgtgatcggccggatgctaattggcgttggtgtgctcccgtagcgatcgatgctgccaatctgacgaggcttcgcgtgtgtttgctttgctattttcggttctcgggagagatggtgcaggcgtggtgtgttgatgttgacgggtggagtagaagctcaggggagtggcagcggactaatgaacg

SEQ ID NO: 6359 - DNA, 1671 bp, Zea mays
actcctaagggccattgggttcctcgaggccggccgggaatgtcaaaagaacccgcagcagggaagactgagagtctgggagatagagagaggagagggagggtttcctcaaagagaacccgaacccaaacccaaaccgaagcagagcacactagcgttccctcaccagggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacgaggagctcgtggccgcgctgcccggcgacgactgccgctacgccgtcttcgacttcgacttcgtcaccgtcgacaactgccagaagagcaagatcttcttcatcgcctggtcaccggcggcgtcgaggatcagggccaagatcctgtacgcgacatcgaagcaaggcctgcggcggctgctggacggggtccactacgaggtgcaggccaccgacccctccgagatgggcttcgacgtcatcagaggccgcgcgcaatgaggcccccgctgcgctctgctcctatttacgtacttacctgtgcgtgggcgtgttctcctactactcactgctcagtagtcagtagtcatctgcgttcgtgtgtgtgtgtgtgtgatcggccggatgctaattggcgttggtgtgctcccgtagcgatcgatgctgccaatctgacgaggcttcgcgtgtgtttgctttgctattttcggttctcgggagagatggtgcaggcgtggtgtgttgatgttgatgggtggagtagaagctcaggggagtggcagcggactaatgaaacgtccacctctgcgacgtagaattccactgaaaaaaaaatgctccagtgtaccataagctgcttcagatttgatcgtgttttctctcccatggtggcgtttctacctacatttttcttagaaaacacatttctagttactcgttcagttctgaattataaaatgttttgatttttctagatgtattgcttttgctacgtttagatatacccaatgtctagatagatagttaaagcaataaatctaagaaaaatcttataatttagaacgagccaatatgattcagagcaaagttgggttacgagagcaacatagaagaaaaaaaagtccaaagtggggaatagccatggcaattaaaatgaagttgtgtttaaaaattgcttgctccagttctcaggatctgcctagttttccggtccgttttttagaatcgttttgatgaaaatcgtccgaaatcgacataaacatgccgagtcgtagtgatagtagtaatccgtcacttttaaaacctaaaccatataaactcgtttatctttctttgcacgtaattcttacgatactcatattaataaaagtttgttagaaaaaagctaaaacaaatagtcccatattaggtactctcacactttccagtctagaccttgtactatatagttgggccaactacctctcttgggcctggacgcagcggcgggctgaagagcgaagtccgctccttcgacaaccaactgatctcccggatcagagacaccaaggcg

SEQ ID NO: 6360 - DNA, 1797 bp, Zea mays
ctgcagggtttgccgttttggacagcgttctcctgactgatgaggttgttaccgtttctgaaactagattgttgtgatggttacccaataaatcacatagcctcttctgacacaacctaataaaagaaattctaccccatgttattttgcagccattttgtagtgctattcaatcgtctgacagttgtaactagttcaccttcaagtgtcatcaatttttttattttgttcattagtcttggaagttggaatgttttagcagcacctatttttctcatctctcccaagtaccatctgggaaatttcaattaagcccacttttctttttcatgttgttgtttttccagtgagacagcagcgaggtggcagagctatgggtgacacctgacctgcattagtgacagtgcccacagtcaactcaaacgatgacaatatcaactgcaatcgtaggggaaactatgaaattgcttacagaattgcggacagtcggagaagatggcagtgttacgttatgatatagtttcatgtttgtatgctggttgaaaatgtagggaaactcttgttttcactagaaaggaacccctggagggggggagtaacggtgtagaaggtttatgttgtcacagttggcatgcattcatataggaatagctagctgatggcaccgttatgccaacacagttataacaaatatcaattgtaaattttatgattggttatcgactaagcaaaacaattttataagaaattgttgtgcggcaatatcctttgactaaatcttagtcagatgctcgaatattgctatggtttgtaaatataatatatcatatttatagattttgttgtaataaaacataaaaatatcgtgttctattagttatgtgggtgtggaagtagggttaacagctaagattagtctgcatttggaggattgtgtaaagtaggaggcatagaactgtagataatatattttttatatattaattgaaatatgatgtgatataagatataaagtgagatagagagtgtgtctgacacgttgactaaatcttagtcagctgttcaccgccacatcgtatcttcgagcaagcagctatctagcacgtttcaacccggccgtatgcagcccccaatgcaggcccatgatggcggcgaacatgtagtcggagctggacagcatcggctccttgctcccgttgttcccctacatcacgatcgactcagagtacgcgggcacggtgcattgcccatccgcggcgtagcgtgagcggtacgttcaactcaagaagaacgttgatgtggtgcctatcgtgcagctcggcatcacgcgctgtgcgatgagtacgggaatctcccgctcattgtcgacggcgaaggacgtctgttcgggcttgcgtgggaggtgacgttctcggactttgacatccgacgcgaccgccatgcatgtcccggggtccgtcacgttcctccggtcacatcacagggcgtctgcttcgaacaggcctgggcgtgcgccgtcagctccacggcgttcgcggccaagctggcagccgtgctatcggcgacgccgcagcccgacaagctcacttgggcggcgttcggcggcgcgttcgatttcgggtatatgggctcggggtcctcgccaccctcctcgcgcgttcatggcccagacccacgctcttctcggcggcggccgagtgttcgacgctaaatacatgacagagcactgtgaacgagcagatttgtaagtggtctaggtttgaggtgcatgggccgccacccatatagtgggacttt

SEQ ID NO: 6361 - DNA, 1675 bp, Zea mays
ttgggtacctcgaggccggccgggtgctatcgatcatcctttcctggccttggctcccttgtcagtgaacttcacaggacctcgcgcaaaccagtatggaaaagtattaggcctagatcctaaaaggattccacagaattgggcagccactcaatttgctgaagcattgggcagagcatgggccgagtataacaatgacagtgctgttgttttgatggttgtccaacctgaagaaagaaatatgtacgaccagtactgtcttgtcaatcatctgaaggaatcatatggtgtggcaactataaggaaaacattggcacaagtagaggctcaagggcaggttcttacagatggaacacttgtggtagatggtcggacagtggctgttgtgtatttcagagccgggtatgcaccaactgattacccttcggaagcggagtggagagcgaggcttctgatggaacaatcatctgcagtgaagtgcccttcgatagcctaccatttggtaggaacaaaaaagatccagcaagaactagcaaaacctaatgttcttgaaagatttcttgacaacaaggacgacattgccaaactacgcaagagtttcgcagggttgtggagcttggataatgaagagattgtgagatctgcaatacagaaacctaacctgtttgtcctgaagcctcagcgagaaggcggagggaacaacatatatggtcaggatttgcaggacacactgatcaaactccagaaggaacagggggaggcgcttgcggcgtacatactgatgcagaggatttttccaaaagcatctcttactcctctagtcaggggcggtgattgctttgaggaccttacaatctcggagctgggaatatacggagcctacctgcggaacagagacaaggtgatcttgaataaccagtctggctacttgatgcgcaccaaagtttcttcttcaaacgagggcggcgttgctgcagggtttgccgttttggacagcgttctcctgactgatgagtgagacagcagcgaggtggcagagctatgggtgacacctgacctgcattagtgacagtgcccacagtcaactcaaacgatgacaatatcaactgcaatcgtaggggaaactatgaaattgcttacagaattgcggacagtcggagaagatggcagtgttacgttatgatatagtttcatgtttgtatgctggttgaaaatgtagggaaactcttgttttcactagaaaggaacccctggaggggggagtaacggtgtagaaggtttatgttgtcacagttggcatgcattcatcatataggaatagctaggagatggcaccgttatgccaacacagttataacaaatatcaattgtaaattttatgattggttatcgactaagcaaaacaattttataagaaattgttgtgcggcaatatcgtttgactaaatcttagtcagatgctcgaatattgctatggtttgtaaatataatatatcatatttatagattttgttgtaataaaccataaaaatatgtgttctaggccccttgggcctgtggaagtagggttaacagctaagattagtctgcatttggaggattgtgtaaagtaggaggcatagaactgtagataatatattttttatatattaattgaaatatgatgtgatataag

SEQ ID NO: 6362 - DNA, 640 bp, Zea mays
atccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagcacagtgtttagggtgatgaacagtgacacactgacacgctatatctgggggagagagagaggggaccgacacgtagggggcgctgtaggggcaccgctgcggccataagactgtctgcagcgccgcactctagccctcctctcccctattcctattcattgcttaggggctacaggtgacctctacgtcccgcagcgcagccctctaccgttgccccctcgtagg

SEQ ID NO: 6363 - DNA, 950 bp, Zea mays
cgcctccccctcttctttcgccccctcctccatccatggtgcgaagaaagtgtaagcatccaagcactttgtcggaggagagggaaagagaggatcaatcaatcaattcgtcctaaatttaaccctcctaaaaaccacttatattactactttatttatataaatccgtccccatcccaaccatccgccagcccacccgccccgcctgatccgtcccagcgattgctatgagtttaggtgattttaccacagatcttcctctttttttgagtatgtaaataaagtttgaggtccaggctcgtcatgtaaattcgggagcgagtgaaatcgggtacgtaggaattaggagcagagggacaagagggcctggctgcttggcaacagcaacaagaagaaaagggggaaaaaaagagagaagggccctcttggatgatttgatcaagaatcaagatctggtcacctgtctgtccctgccccttctcctctctcggggagggaggattggttagtcgttggattaggttggggagcgggaggtcgggggagtagttaggtaatctgtcctagttcatcaatcaacgacgtttttctttttctctttttgggttttcgatggaattgtttttgtccgtccgtccatgcaaccaagaaagaaaagaaatttccaaggcccatggagaatctgtacaaaagagtggctacgtacgtacaagagggcagcgttgagtctgtgagcagaagcaagcagcagcagctaggttgttcagtcaggcagtggatgagctgtgtgtgtgagagagagagacatttatttgtggcgtttttcctttttttttctccccttttctctcctgattattgtatgttgtaatatcctgctgtgattgaaatgaaatcaagctgtataatactagtaaaaaaggaaaaaaaaaaaaaaaaaagcggccctt

SEQ ID NO: 6364 - DNA, 2522 bp, Zea mays
caatcgactcgacccggcccgaccgagctccccgtgcccaacaaaccctcacaattaccagttccccatcgccgacgccgtacaccggagctcgaccgctccgcgtggtgtccgattctacttcgtcgaagactacaagcggcctcctagagttccacctcaactgcgcaggggaagggaggctcccaacgcatccccgccgacctcaacgccgacggtcctttcctaacccgcagccgccggccgcagtctctctcttccggtccagtgggggctgctagcttccaggaatattggagatgtgccttcaacactctagggctcgattgcctccagatgagcaacttgctgcagaaaaaagtgttgccttgtattgcaagccagttgaattgtacaatattatccagaggcgagctattaagaatccaccttttgttcaaagatcccttctttataagatacaggcaaggagaaaaaagaggctccagaccgctgtatcactttctgcaagtacaaatacacaagcacccacgcgcccgcccccgcgtgggcttttagctagacctaccagtaatatttcgcttgaggggcattctccgatatatcgattcagtagggcttgtttgcttacaaattttagtgaatttggaaataaagacaaaactgaagccacattcatcatccctgatgtgaagaatttatcaacctcccgtgcttgcaaccttaacattatatttattagccgtgggcaagtaggacaaattattggtgaagatagctgttccgggaatgatgtggaaggatcttccctccaaaagcttgaagggaaatgttcctggggtaaaatgccgactaatttacttgcgccctctttggagaaatgtgtgactttaagtacaggagatgctgtggatttgacttctacagttacaatgaacccaagcttcttagagccaaaatttctggaacaagacagttgcttgacattttgctctcataaggttgatgctacgggttcataccaattacaagtatgcatatccgcagaagaggctggcgcaagagaattacttttatctccttattattgcaattactcatataataatgtcccaccttctctattaccagaaatcataaggttgagagctggaaatgtactttttaattacaagtactacaacaatacaatgcaaaagactgaagttactgaagatttttcctgcccattttgcttggtaccatgtggaagcttcaagggcctaggatgccacttaaattcatcacatgacctgttccactatgagttgtggatatctgaagagtgccaggctgtgaatgttagtctgaaggctgatgcctggaaaactgagtttgtggcagagggagttgatccaaggcatcaaacattttcctactgctcgaggtttaagaagcgtagaaggttggaaaccacagctgagaaattcaggcatgttcacccacatattatggaatcaggatcacatgaagatgcccaggcagggtctgaagatgactatgtgcaaagggaaaatgggctttctgtagcaaatacttcagttgaccctagtcagcctgtacatgggagcaatctttcaccaccaacagtgctacagtttggaaagtcaagaaaactatctgccgagcgatctgaccccagaaaccgacaactgttgcaaaagcgtcagttcttccattcacacagggcgcagccaatgccattggaacaagtcctctcagatcatgatagcgaagacgaggttgatgatgacattgccgactttgaggatagacggatgctcgacgattttgttgatgttacaaaagatgagaagcttattatgcatatgtggaattcatttgttcgaaagcaaagggtgctagccgatggtcatataccgtgggcatgcgaggcgttctccagatgccatggacaacagcttgtacaaaaccctgccctgctgtggggctggcgtttcttcatgattaaactctggaaccacagccttcttgacgcccgcgccatgaatgcttgcaacacaattcttcaaggctaccaagacggaagtgcggaccccaagtaaatctacaatccagagaaatcgttggccagcgtgtgtaagatctgccggttccggcggttatttctgaaccccaaaacagctatgtgaagaactggaatggggccatagcggcatttgttttaaggtttagggttactccatttttccaagggaggaaactaatttcccttggaaaaatgaaaatccattgggaaaaatgagtttcccaaactagccattaaaagggtagcttcctcccacctagggggaaaaaaactaggagggaaaagctggatccttggccgagacaatcatcattgcttcattcgtgattcggttgtatttatcggtaccagttgttgttggcatgtggagtttgtatggatgataatgataaatgaagtgattcactgcagcccttgtagaaaaaaagcggcc

SEQ ID NO: 6365 - DNA, 2086 bp, Zea mays
gcgcacgagaccattacctagaacatcctaatcgaaaaatagtggtctatgtcaaatcttctagcgctcgcaattcttctcctctccaccacgccggcgccgacggccggtgaacagaccatctgcagcgatgccacgtacgagcgaaacagcacatacaagtccagtctgaggtcggtagccggcgcactgaccggggacgccgcgaggctgcactcgtccaccggcgctgcaggggagggccccgacaaggtctacggcgccgtgctctgccgggcggacacagcgggtgctgactgcgccaggcgcctccgggacgcccttgccgccatcaccgacggggacggccgctcgcgttgcgcgctccacagggacgtggccgtctactccgagctgtaccagctccgtttctccgacagggacttcctcgccgacttcagcaacgcgccggaatgggtcgacgtcacgaacccaggccccgtgccgctcgccgtggccgcgcggttcgaccagcgggtcacggagctgctgagcgcgctcgctgacgcggcggcggggcgaccgggcaggtgggccgtcggcgaagcgccgtggtcgtcgtcggggggcagggaccgggcggtgtacgcgctggcgcagtgcacgctggacatgccgccggaccactgccgggcctgcctcgatggcgccatggcagagcggcgacggaaggtcggcggcggcaagatgggcgcggcagtcttcggggcgcggtgcaccctgcggtatgagatggatctgcagttcttcaacgtcactggcaacagcaagatgctgtccctgcttgggaagaagaaagaccgtgcgttcgtcatcgttgcaacagcttacgcttcggcaatcctctgtacacgcttgcttttctggctgctaagcgtctggaggaaacaaaaaaggaaaatggacttgacggaggagccccagaatgtggatgaaatactcaggtcatggagaattgaagatgctagtttagagttctcgctgtatgatttctctcagattgctgatgccacagtcaacttctcacccaaaaatatgataggggagggcggatttggcccagtttacaagggagtacttactgatggacaagaggtagcgataaaaagactgtctgctcggtcacgacaaggtctagtagagttcaagaatgagatccaggttatagcaaagcttcagcacagaaacctcgtcaggctccttggctgttgcatccatgaagaagagaagatgctggtctacgaatacctgacgaacaaaagcttggaccacttcatttttgatccaatcagacaggcatcgcttgattggaagagacggattaaaatagttgatggtatagcccagggactcctgtacctccacaatctctcgagaatacgcatcatccacagggacttgaaagcaggtaacatcctgttagattctgacctaaacccgaaaatctctgatttcgggatggcgaggatatttccatcggatgccactcaagcaacagccagcagactcgtgggcacatatggatacatggctcctgaatatgtgtctgatggccttctctcgatcaagtcagatgttttcagtttcggggtcctgcttcttgagattataagtggaaagaggagctcaggttttcagcacaatggagagttctacaaccttcttgaatacgcctgggaactgtggaaggatagaagatggaatgagttcattgatcaatcctttggtgatgactacgaactggaagagctgatgaaataccttgctgtggcattgctgtgtgttcaagaaaaaacagtagatcgtcccacaatgcctgatgttgttgcagttcttagcagcgatggcgtcactttgccagaaccaaagcagccagcttactcctatgcgaaagtagatgtgtcagtaaatgtcgctgtgttgagtagcagaaatgatgttaccatcactactacaaatggcagataatagaatgtaatactgttaataaagtgtgcgctacaggtcttggtcatcctccttgtgttaacgaaaaaaaaaaaaaaaa

SEQ ID NO: 6366 - DNA, 2129 bp, Zea mays
gcacgagaccattacctagaacatcctaatcgaaaaaaagccactcgctgactcatctccatccacaacatcacatactcgctccaacagtcccacccacgctacctagacagtagacacgtgtaccatggtgttcttcaaggcgcgtcgcatggatcctgagttggtgttgccggcgcggccgacgccggccgagacgaaagcgctctccgacctcgacgaccagcggacgctgaggtactacgagacggtgatcgccttcttccgcagccggcgtggctacagcagccacagacgacggccagacgatccagccaaggccatcaaggcggccctcgcggaggcgctcgtgtactactaccccatcgccgggcggctcagggaggccgccggtgggaagctggtggtggattgcaccgcgcagggggtggtgtttgtggaggccgatgcggatgtgcggctggaggagctgggcaggcctctgttgccgccgtacccgtgtgtggaggaactgctgtgcgatgcgggtgaaacaagagcggtgattggcaagccattagtcctcatgcaggtgacgaggctcaaatgtggcggatttgtcattggattccacatgtgccatagcattgcagatggattcggcatggttcaattcttcagatgtgtcgccgaactagctcgcggtgaaaaagtgcccacacttttgcccgtgtggagaagagagctcctaacacgacacaggtcaaatactactgcatataatcacacagccacggttaggtccgagtccgactccgacgactacaaatctgacgacgtcatgctgtcaactccaatggacgacatggtagtccagtacttcctcttcgggccaagggagatcgcaaccctacgaagccacctgaggggagacgaccagctgctgctcgccacctccgctacatccttcgagctgctagcggccgtcatgtggcggtgccgcaccttggcgctgggctacgagtcccatcggcgcgttcgcctcatggttaccatgaacgcgcgcgggaagtggaaccagcacacgcccatcccgcggggttactacggcaacgcgcacgtgtcccccatggcggaggccaccgccggcgagctctgcagccagccgctcgcccgcacggtcgatctcgtgcgcaggaccaagctcagcgtcaccaaggaacgcatggagtcgatggtggacacgatcgcttcgacgcgccagtggccgcctccgacgatggacaggatctacgaggtttctgacaccaagtggattgccaccaatgcgacgcagtttgggtgggccgagctggtgggtggtgggataccactggctggcgaccttgcctccaagctgggaagcgaccacatgagctgcaggaaccaggatggcgaccactcgaccatcgtgtcgatgcttctgcccaagccggcgatggacaagtttagcagtgagctgtctgtttggttgaacaacaagcatgatcacaagaacttggttatactcagttctctctagtctaccaacagatttaaacaatattaatgtacctacaatttgttgtacgaaagagaaatgattggctcaatgagaatgaaataatttcggtgttcttctacagttcatattatctctccggccgtttcatgcctcctgccgccatggcgagtcaccgcgcacacatctgcgccggagacgaaggtggcagtggcgccatcaccacagacgacggatccaatcgcacaaggggctgtcaccggtgccaccactcctctgatgggcgccctgccaccggtgccagcactcctctgatgcacaagttcttgaggcgcggcagggtttacaaaaccggtctgaaaccgcggttttaaggtcggtttctctttcccggcctggtttgacaacgagtttttcggctggtttttaaaaaattcattgaaaaattcaaaagattcgaaacttttttataaaaatcaggaaaattatgataaaaaacgatatgtcacttttggtaaaatcaacgaatttcgttgaaaaaatacggtttttggctgaaaaaaccgaaaactgtttttttttaaatttcaaagtctacacacccgaattt

SEQ ID NO: 6367 - DNA, 1573 bp, Zea mays
ttcaaaaggagagtgagtgtcagacatccttttccccgtttcaatcgcgaccacgcgctcgcagccgcaatcgactcgacccggcccgaccgagctccccgtgcccaacaaaccctcacaattaccagttccccatcgccgacgccgtacaccggagctcgaccgctccgcgtggtgtccgattctacttcgtcgaagactacaagcggcctcctagagttccacctcaactgcgcaggggaagggaggctcccaacgcatccccgccgacctcaacgccgacggtcctttcctaacccgcagccgccggccgcagtctctctcttccggtccagtgggggctgctatcttccaggaatattggagatgtgccttcaacactctagggctcgattgtctccagatgagcaacttgctgcagaaaaaagttttgccttgtattgcaagccagttgaattgtacaatattatccagaggcgagctattaaaaatccaccttttgttcaaagatcccttctttataagatacaggcaaggagaaaaaagaggattcagataactgtatcactttctgcaagtacaaatacacaagcacagaatatctttcccctttatgtacttttagctagacctaccagtaatatttcgcttgaggggcattctccgatatatcgattcagtagggcttgtttgcttacaaattttagtgaatttggaaataaagacaaaactgaagccacattcatcatccctgatgtgaagaatttatcaacctcccgtgcttgcaaccttagcattatatttattagccgtgggcaagtaggacaaattattggtgaagatagctgttccgggaatgatgtgggaaggatcttccctccaaaagcttgaagggaaatgttcctggggtaaaatgccgactaatttacttgcgccctctttggagaaatgtgtgactttaagtacaggagatgctgtggatttgacttctacagttacaatgaacccaagcttcttagagccaaaatttctggaacaagtatgcatatccgcagaagaggctggcgcaagagaattacttttatctccttattattgcaattactcatataataatgtcccaccttctctattaccagaaatcataaggttgagagctggaaatgtactttttaattacaagtactacaacaatacaatgcaaaagactgaagttactgaagatttttcctgcccattttgcttggtaccatgtggaagcttcaagggcctaggatgccacttaaattcatcacatgacctgttccactatgagttgtggatatctgaagagtgccaggctgtgaatgttagtctgaaggctgatgcctggaaaactgagtttgtggcagagggagttgatccaaggcatcaaacattttcctactgctcgaggtttaagaagcgtagaaggttggaaaccacagctgagaaattcaggcatgttcacccacatattatggaatcaggatcacatgaagatgcccaggcagggtctgaagatgactatgtgcaaagggaaaatgggctttct

SEQ ID NO: 6368 - DNA, 4145 bp, Zea mays
  misc_feature (2257)..(2257): n is a, c, g, or t
  misc_feature (2383)..(2383): n is a, c, g, or t
cgggaccttaatgaataacttgctagctccgatccattacgtgcatcgtatatacccaggaccacgaaccacatatacccaggaccacgaaccacagttgcagtctctctactagcaacaagtgactcaaagcagagatagtacacccagcacatatatacacgctgcaacacatcgcaaagttgctaaagccactcgctgactcatctccatccacaacatcacatactcgctccaacagtcccacccacgctacctagacagtagacacgtgtaccatggtgttcttcaaggcgcgtcgcatggatcctgagttggtgttgccggcgcggccgacgccggccgagacgaaagcgctctccgacctcgacgaccagcggacgctgaggtactacgagacggtgatcgccttcttccgcagccggcgtggctacagcagccacagacgacggccagacgatccagccaaggccatcaaggcggccctcgcggaggcgctcgtgtactactaccccatcgccgggcggctcagggaggccgccggtgggaagctggtggtggattgcaccgcgcagggggtggtgtttgtggaggccgatgcggatgtgcggctggaggagctgggcaggcctctgttgccgccgtacccgtgtgtggaggaactgctgtgcgatgcgggtgaaacaagagcggtgattggcaagccattagtcctcatgcaggtatataagagtacatagaaattctcttgtatatatgcttttacttatataggtggattgacattgtccctcccttttgtgcatttttttctaattcaaatacaggtgacgaggctcaaatgtggcggatttgtcattggattccacatgtgccatagcattgcagatggattcggcatggttcaattcttcagatgtgtcgccgaactagctcgcggtgaaaaagtgcccacacttttgcccgtgtggagaagagagctcctaacacgacacaggtcaaatactactgcatataatcacacagccacggttaggtccgagtccgactccgacgactacaaatctgacgacgtcatgctgtcaactccaatggacgacatggtagtccagtacttcctcttcgggccaagggagatcgcaaccctacgaagccacctgaggggagacgaccagctgctgctcgccacctccgctacatccttcgagctgctagcggccgtcatgtggcggtgccgcaccttggcgctgggctacgagtcccatcggcgcgttcgcctcatggttaccatgaacgcgcgcgggaagtggaaccagcacacgcccatcccgcggggttactacggcaacgcgcacgtgtcccccatggcggaggccaccgccggcgagctctgcagccagccgctcgcccgcacggtcgatctcgtgcgcaggaccaagctcagcgtcaccaaggaacgcatggagtcgatggtggacacgatcgcttcgacgcgccagtggccgcctccgacgatggacaggatctacgaggtttctgacaccaagtggattgccaccaatgcgacgcagtttgggtgggccgagctggtgggtggtgggataccactggctggcgaccttgcctccaagctgggaagcgaccacatgagctgcaggaaccaggatggcgaccactcgaccatcgtgtcgatgcttctgcccaagccggcgatggacaagtttagcagtgagctgtctgtttggttgaacaacaagcatgatcacaagaacttggttatactcagttctctctagtctaccaacagatttaaacaatattaatgtacctacaatttgttgtacgaaagagaaatgattggctcaatgagaatgaaataatttcggtgttcttctacaaaaaaaaaaaaaaaaccggccgtttcatgtctcctgccgccatggcgagtcaccgcgcacatctgcgccggagacgaaggtggcagtggcgccatcaccacagacgacggatccaatcgcacatggggctgtcaccggtgccaccactcctctgatgggcgccctgccaccggtgccagcactcctctgatgcacaagttcttcaggcgcggcagggtttacaaaaccggtctgaaaccgcggttttaaggtcgatttctctttcccggcccgctttgacaacgagtttttcggctggtttttaaaaacttcattggaatttcaaaagatttgaatttttttataaaaaacaggaaaantttatgataaaaaactatatgtcacttttggtaaaaacaacgaatttcgttgagaaaatacggtttttggctgaaaaaccgaatttttttattaatttcaaagtctacacaccgaatttcctcganaaactgattttttcccgattaataacaaaaaaatgatcgagaaacaccgaaaactgcccaagaaattagaatctcatttaaaaaaatttgaaaaatcaaaccgatagttttttagtggtttctcgttaccgccaatcacaaaaaaaaaatgaagcaaaaacgggatagttaaccctggcactacgcgtgggaggcttacctggcagcccaccatgtaggtgacccctcctagagaaagccaaggacttccgtcagatgacatcaatgccgattgctttaaaaacctcgattttaactatcgcggccctactggagaattagtgctagttggtgtctctaaccagtcctaattttattatagcgactccaattggtaccgatgagttaacattagtatcagatggtgtcttcgaacggtacaaatgttgctacttataaactctcatcaactctgatcatgccgcccagctcagatattcagggcttcgattcgtggtgggctgttgtgctccaaaacaaatcgaaagaagatcaactcactgtttcgggtttgcttatgtacttcacctggaatatttggaaggagcggaatcggcgtatttttgagggcaagcaagcatcgacacaagtggtctttcatctggccaaacaagaaatggcgttgagacgagctgcagttgggcatccatgtgtagtgtaatgtcttctcttttttggattgtgtttgagtgtttttcgttatatgtaataacaactttttaagactcttgtttcccttctctccttaaatgaaatagcagagctcctgcactaagttttcaaaaaaaaacaaggaaacataacacgtgggtggctcttgaatcctggtgaagataattgtgttgtttgccttcatctggctacatggtctctatatttgtagtctctatttatagtctctagaggacttatttttccaagctaactagggtagccctaacaaatagttctattttgtaacaaataattctatttcctaaacgaggaggagcccttgtcgatttggattctcttttgatcttttcctaataaatacttctatttcctaaacagatactgtttatgcctattgcatgtaatttgagcccaatacctgcgtgggccgttttatggtgcgcataagatataccgatcataacaaatattgttacttttcctatttttaacttgaataggttgaaatcaaaagggacaagcaccataaagaagttcgtgtattttctgatccaggcagaattatgagaccacttcttgtagttgaaaatctaagaagaatcacaagaccaaaagatggactatactcttttcaggaacttatagatcaaaacatagttgagctgattggtgttgaagaagaggaggatatccaatgtgcgtacggaattagacatctattctccagcagggagaaagaagactggtcttcttctggctatactcattgtgaacttgatccttctttcttgctagggctgagctgcagtctcattccctttggcaaccatgataacgctaggagggttcagatgcaagctgaaaaaatatcacagcaggctatcggctactcccctacaaattctcagtacagactggacaccctttcacatcaaatgttctatccacaaagacccttgtttagaactgtggtgtcctacggtcttggagaggcgaagacagactgcagctccggacgaaaagacgacttcaacacaccagaatattc

SEQ ID NO: 6369 - DNA, 1749 bp, Zea mays
aggcatcaccttgctgtggcgccaccggcgaattaagggaatcggacctatgcgacgactcggaaaccgctctctcctccccagatggaccgtaggttggttataaaatggagtgtatccttgcgcaattgagcgtatccttgtctgttgggcgaaccgtggcacaggtactgcggaacaggattaggtgttgtcacggtttaggcccaccagcagctgaggcttgctgaggcccgagcgtcgcttgctcaggtccgactgtccaaggctctgaccggctaaccggctgaccagtgaccgctgaggtgctgctgactgccttctctgtccctctggtaaatttgtgtttcgattggagttgttgacagattgctagtaaggatttggacagataaattaaactggtttggataaatgcttacgggttttattcaactttaataggtcataatataaagattgatggatcgaagttggatgaaagaatcaagattggacactgcatacaaaaatggtgttgaggagtttttagcatttgcttaccgggaccttccacaaggtagcgagatactttgtccatgcataaactgcaaaaatagatacaaccacagctgtgatgaggtcaggacacatctgagatgtgatggtattattaaaggttatactatctgggttcatcatggtgaaaaatatgacaggccatctatagaacttgctgatgtaccaaatatcagtgcaaatttgactacttcaggtccaatacgagaccgccaggatggaagattggatgacatgcaagaactcttgcaggctgcatttggaagggctgcaagtataattggtgctgaagcagatgatattcagtctggatctgtagatgtggaacataatgccactgaggataatgtgaatctagcggaaggagatactttggggaggcaacagaatatatatgcaagcttattgaaggatgcagatgcaagaatattttcttctgggtgtaaatattctaggctgtcatttttagtccacttatatcacttgaagtgcttacatggttggtcacaagaatcatttacaggactaatggatctgctatctggtattcctggagctaatctacccaagacatactatgaagcgaagaaaatcatccgtgacttaggtcttgattatgagagaatccattcttgccccaaagatgcctttctttttcgaggtgattttgctaaacaagatttttgtcacgtgtgtgagctctcgttggaaagttgataagaaggattcaaatgcctctgtagtgaaatctaaggggaaaaggaaaccagccaaagtgttgcgttactttccattgattcctaggatccaaaggttattttcatctaccaaaacttcagatgacatgcgttggcatgatgaggggcgaacaaaggatggaaaactacgccacccagcagatggtgatgcttggaaagactttgatcgtagatatcctgactttaaagaagatgctcgtaatgtacgccttggtctagctagtgatggatttaacccttttgggaacaagaatttaaagcacagtacatggccagtaatgcttgttccctacaaccttccaccttggatctgcatgaagcaaacatctttaattttgtcaatgatcatacctggaccaaattctccaggtaatgatgtagatgtatatttgcagcccccttatcgatgaactattacttttgtgggcgggaa

SEQ ID NO: 6370 - DNA, 2462 bp, Zea mays
cattgggtacctcgaggccggccgggattacaacatgtacccctgcactaggaacattgggaccctcgaagcacggccgtgagccgccggccccccccgtgtgaccaattcctctccgggccgagcagccgttccaatccgctcacgccgcctctctcgctgccccgcttgaccgcctgctagcgctgcagtttgatgctgatgacctgatccctccgttgggtaggttcttgggcgcggaaagaacaaagaactcgtggtgggtccgggtccgcaagaccctaggtgttcgtcagcagcgaggatgcccggcctgcctctgcctcaatcgttaaatcagaatattggatgtgaatatgcctatcctgggtctacaggccaggccttccgtcagcagctaagaactgcattgtctccagatgagaaacttaccgctgaaaaagatttggctctgtattgcaagccagtcgagctctacaatattattcaacggcgagccatgaaaaatcccctttttattcaaagatgccttctttataatatacatgcgaggaggaaaaagaggattcagataaccatatcactttctggaagtacaaatactgagttgcaaacacattatgtctttcctctttatgttctgttagctagacccactagtaacctttcacttgaagggcattctccaatttatcgattcagtcgggtttgcttgcttacttcctttagtgaacatggaaataaggacaacagtgaagctacattcatcattcctgacgtgaagagtttgtcaacctcccgtgcttgcaaccatgatattatctttattagctgtgggcaagttggacaaagtaatggtgaagataactgctctgggaaccatgtggaagattcttctctccaaatgcttgaagggaaatgctcctggggtaaaataccaactaatttacttgcttcatctttggagagttgtgtcaatttaagtttgggacatattgtggagttggcatctaaagttacaatgagaccaagcttcttagagccaaaatttctggagcaagacagttgcttgacattttgctctcataaggttgatgctgtgggttcatataaactacaactatgcatgtccgcacaagaggctggtgcaagagatatgtctttgtctccatatagtagttactcatataatgatgtcccaccttcgtcattatcagacctcataaggttaagatctggcaatgtactttttaattacaagtactacaataatacaatgcaagagactgaagtcactgaagatttctcttgtccattttgctatgtacgatgtggaagcttcaagggtctaggatgccatttaaactcatcacatgatctattccactatgagttttggatatctgaagagtaccaggttgttaatgttagtctgaaggctgatgcttggagaacagagctttttgcggagggcgttgatccaaggcatcaaacattttcttatcgctcaaggtttaagaagcgtagacgatcaaagaacacaatggagaaaatcaggcatgtacactcacatattatggaatcaggttcacctgaagatgaggcaggatctgaggacaactttgtgcaaggggagaatgggacttctgtagcaaatgcttcgattgatcctgctcaatctttacatggcagcaatctttcaccaccaacagtactacagtttgggaagacaaggaagctatctgagagatctgaccctagaaatcggcaactcctgcaaaaacgacagttcttccattctcacagggcgcagccaatgcaactggagcaagtgttctcggaccgtgatagtgaagatgaagttgatgatgatattgctgacttcgaggatagaagaatgcttgatgattttgttgatgttacgaaagatgaaaaacttattatgcatatgtggaattcatttgttcgaaaacaaagagtgttagctgatggtcatataccttgggcctgcgaggcattctcccagttgcatggacgacaacttatacaaaatcctgctctgctgtggggttggcgtttcttcatgattaaactttggaaccataacattttagatgcccgcactatgaacacatgcaatacagtccttcaaattttacaagaagaaagcacaggactaaagtaattttgatgcttctgatgaaaattcaagggaagaagatttctttaccatttccaagaagaaagcatagaattggagtaactttttattgataatttcattcatatctattgtcaattgtattaatggtttttaaaagagacaaatcatgtctaactctcacgctgtaatattctaagtcgtacgtgaatttgatgaatattcattgttgttttacttaagagttatcgtattgagatccttaacatattattcgatttttcaaaaaaaaaaagcggcc

SEQ ID NO: 6371 - DNA, 2495 bp, Zea mays
agaatgcccgctggaagagagagagagagaaatgtcagaaaataatgatccaagctgtatttgtgcagaaagaaagagaagagtatgaggttgtgatcgaggatggcaagttcatgttcaagaaaagcaggcaaatcctagacacgtccgatggaccaagagattccaagtggatctttgttctaagtacatccaagaatctgtacgttggacaggtaacttccgcctgctgccttggtggtgctgccagcaacacaaagtagcttcctggttcactatctcgtcatgtgactaacactgtcaatgaatcccaattgcagaagaaaaagggcacatttcagcattcgagcttcctcgctggaggagctacatctgctgctggtcgactagttgtggaagatgggatcctcaaggtacagatctgccttataaaaccacatagtaacattaacatctagtggtgatgaactgctgatgcaattacttttttccgggtctagtacacacgtattaaccaaaaaaaaaaactgatgcattctgatgttctttcacaggctatttggccacacagcgggcactaccgcccaacggaagagaacttccaggaattccagagcttcctcaaagacaacaatgtcgacctcactgatgtcaaggtgaggactcttcggtgataccccgcgcttcaaaaaaaaaacttgttgcatgcagcattttaaactgttccgtcctcaatgctgcagatgagcccagatgaagacgacgaggagttttggagcaggctcagaagcatctcttccgactgctgcgccgtcgctgacaaacccgaagaagatcaacaggccgcagctcaagaaaccagcaacagttgccaggcacctcaagtcactgaatcgaccacacctgacgaagtctctccctccccgtcccagcaggaagaaaccagcaagagtctcagtcccactgcaactgtcacgaggcaagattcatcagaggacgccgagacctcaacgacaagccaccgtgccctgttcgaagatggtcaggaggaggaccacgctgccgcggccaccgccgccgacgacaatacagccgtgccgagggagaagatcctgcagaggatcagctccaagaaggagaccaagtcgtaccagctggggaagcaggtgtcgttcaagtggaccacgggcgcggggccccggatcgtgtgcgtccgtgactacccgtcggagctccagctccgggcactggagcaggtgcacctgtctccgcggagcggcggcgccgccgcagccgcaggggccggtagggcggcctcgtcccggttcgcctcgccgcagcggtgcggcagcccggttgcggcgagagggcgccgcgagcctctggcgtcggcggggtgcggcagggcggcctcgtcacggttcgcgtcgccgcagcggtccagcagcccgatggcgagagcgcgctgcgagcagctgacgccgagggaggcgttccggacgcacctgatggccagaggttaaccggatcggatcagccattcagcaaagcagccgatggatggagtcatggagagacacttctcttcttcctttttccccctcttgtgcataggagaaagaaaaagaataaagatgggagtgaaaaattgcttcccgtgttagatcttgtagagcgccacacacacacacacgtgaatacgtaatcaaatacagaattctttcattctttggtaccatgatgaaataatgcaggctctaattctacgcgaatacataatcaatacaaaattctctaatttttcgtttgtcctgattatgatgatgaaatactgctgcaacctatccaatgctactgatttgactttgaaactatgtgcagttgtgcttgaaatgcctgtataccattcaaacgattgactacattaattatacatagtattcttactctgtttgatgctgcagtttagaactttgagtataacatttaggtggtgtttggtttgaagaatcaatccattctatatgaggtgttgcatcatgagttcattctataaatttggtgaaatgaacgcattcctcgtattattactattattagcttatgagaaatgaaatagtgatggattaactcattctattccacaaaccaaacaagtaaatgagaagtgagaagatgatggattacctcattcctcaaaccaaacaccccattaatttagtattattagaactctcaaaaagaacataattttagtttttgttgattctaaaatcttgatatttgttgattatgaaatttctattttatattgttagggctatctcaaaaatgcaagcaccttttgaaaattagcgtatgtgtatgtagtaagggcatctgtaagggctctcaattgatattcccaaaacaataattcagagtagaaatgaaaaaactcggtacaattgctcgtgatctattctcctaaattttccaatgctacaaaaccagag

SEQ ID NO: 6372 - DNA, 1061 bp, Zea mays
ggtagtcacaccaacccccggacgtgaaacggatcaaacacctacacatatcaccaccaacacacacacaggcaaaacacatcaagctcaacacacatggctgacaatgccggtctagtaggcctgctcttggagcagcaccagctgcgcccaccagcagcagcatcaagagcaccacctcaaatcacaagcaaggccactcgtcccctcctcgccaccgccaagaacgacgtcgtcgacaagggcagctccgccgccgcttccttcagccgctcttcctcttcttcttcttcccgtgcaccggcgccgacggtgtcgccgacgaccgcctgccctttcctgcaccggtgcttcttctgccacggggagctcgccgacggcagggacatatacatgtacagaggcgagagggcgttctgcagcgaggagtgccgctgccgccatatcctggcagaggaggacgatgacgacactactacctcggtcggggtcgtggcagcggcagcggactgctccacccagctccgccatcaggcccttgctgccagcttcacgttctgaggtggtgtccggccgagcgggcgggcgggtagaccaccgaggactcgtacggtgggcctgccaccggcggcttgccgtggaggaagcaacgatgtccatcaccttgagtcagatagcttgtccaaacacagatgggtgtcacggactcatgcacggctgatataatctgattgggcttcaatttcaacgtttcaaaatgatgggttaagtttcttgttttttgttggaggtgaatgttttttttttgcaaattgtcttcttatacagtatattattctgtcgaaactaccttcttgttttcagtgctctatgattatctcttgttaagtaagttggatagtaagtttgtacatttctatcctctttaagcttttgtatttatataattatatcaaaaaaaaaaaaaagaaaaaaaaaaaaaaaacatttgtgtttaggctagtggataggtttataatataggttgtataggttgtataacttcttgcagtataaataac

SEQ ID NO: 6373 - DNA, 1968 bp, Zea mays
tgccaatgcgcaagactttatttctcgcactgcacctgcacgcaacagagacgtactcattcaggcgatcgaatccatggagctcgtgctcactacacctgatctcccaaccccgctgctgctctccaccttaacgatagtgtccgtggtcgtatgctatgtcctcttctggaagcagcaggcggcggcgaggcgagcgccgctgccgcccgggccgaggggctggcccgtgctgggcaacctaccgcagctgggcgggaagactcaccagacgctgcacgagatgaccaaggtgtacggcccgctgctgcggctgcggttcggcagctccaccgtggtggtggccgggtcggcggccgtggcgcagcagttcctccgcgcccacgacgccaacttcagcagccgcccgcccaactccggcggcgagctcatggcgtacaactaccaggacgtggtgttcgcgccctacgggccccggtggcgcgcgatgcgcaaggtgtgcgccgtgaacctcttctccgcgcgcgcgctcgacgacgtccgcggcgtccgggagcgcgaggcggcgctcatggtgaggtcgctcgcggagcaggcccacggcggcctcgacgcgccgccggcggcggtgccggttggcaaggccatcaacgtgtgcacgacgaacgcgctctcgcgggcggccgttgggcggcgggtgttcgctgccgccggcggcgacgggggcgcgagggagttcaaggagatcgtgctcgaggtgatgcaggtgggcggggtgctcaacgtcggcgacttcgtgccggcgctccggtggctcgacccgcagggcgtggcggccaagatgaagaagctgcaccgccggttcgacgacatgatggacgagatcattgcaggttatagggaggccaggagggttgcggcagacggagaggagagcaaggatttgcttggcttgctgctgtcgatggttgacgagcggccgttcgacagcggggaagaagtcaggatcaccgaaaccgatgtcaaggcactcattttgaacctgttcgtggcagggaccgacacgacgtcgaccatagtggagtggtctctcgcagagctgatccgccacccggaaatcctgaggcaagcgcaggaggagatggacgcggtggccgggcgcgggaggctggtcacggagtcggacctccgaagcctcaccttcttcaacgcggtcatcaaggagacgttccgcctgcacccgtcgacgccgctctccctaccgcgcatggccgccgaggagtgcgaggtcgcgggctaccgcgtccccaggggctcggagctgctggtcaacgtgtggggcatcgcccgcgacccggcgctgtggcctgacccgctggagttccggccggccaggttcctgccgggcgggtcgcatgcggacgtggacgtcaaaggcgccgacttcgggctcatcccgttcggcgccggccggaggatctgcgccggcctcagctgggggctgcggatggtcacgctcaccagcgccaccctggtgcacgcgttcgactgggagttgccggcagggcagacgccggacaagctgaacatggaggaggccttcaccctcctgctgcagcgggctgttccgttagtggctcgtccagtacccaggctgctgccgtcggcgtatgagatcgcataggaaggctcgctcaagggcctcagcttggctgtatcaagcacgtacaatggcgtgaaagacgacgtgtgtatgtattgttgttcactttgttgacttttgtaaacactagtaaatgttcttgctatggctaatatctgtaacgaatttttatattttgacatgattacgcttctggcttgtaaccatgcacctttcatgtggatcaatataaactcacaatccacatgcatgaaaaaaaaacaaaaaaaagcggccaaaggaataaaaaaaaaaaaaaggcggcc

SEQ ID NO: 6374 - DNA, 3403 bp, Zea mays
gaaaccaggggaaggcgcagcggtttgccggcagacgggcgggcccaggccgaggaaacaggcaggtgcatccatccagagccacgccggcgccgcccggcgaacagatcagagcacgcgagagtggtgcagcgaggttgaagcaacgacccgcatccggccagcccccgagctgcgctgctctgctcttgctctcgttcgtcccactccctcctgcccaccgaggggagagacaaccccctggctcctgcctgctcgacggacccaaagcatcgcctcctcttcctacccctctcctcaatcggctcgtccggtcgtcgcttagcgccctccacccgccagccaccccactgcgacgccgcgttctccccttcttccgacgtcgctgtctctctctcagcccagctccaggggcgaggctgtgaaagaagagggaggaaagggagaaaaaaagaccctcttttcttccgtcggcaggcctcgtgaccatggatccgccgcccgccgggctctcgacgctgccgaggtctgctggagatccgtagccagcccacgtgtagacggttatggtgctagtaccggtgccaacgctgtgtttcttggcgggcgttgctgctcctcctccgcttgaggattgctgctgcatccggcaggagggatggtcggaggcggaaggagcgtcggcacccgcagcgtggaatcgacgacgggcgcctccagtcggttcagaaatgcgcaaatgcgcgtctgaatgaagcctggttggaggtggtagagccgatggtggtgggaacggcactgctgcgcggggtttcctccgcgtggatcctcctgttcctctcctccctgctcctctcgccgtcagcggcgtctgtcgatttcggccactgcggcggctgcgacgacgccgacgacggcgccctctccagcacctataacatcctgcaatgccagaaggtcagcgacttcctcatcgccgcggcctacttctccatcccgctcgagctgctctacttcgccacctgctccgacctcttccccctcaaatggatcgtgctgcagttcggcgccttcatcgtgctctgcggcctcacgcacctcatcactgtgttcacctacgagccgcactccttccacctcgtactcgcccttaccgtcgccaagttcctgacggcactggtctccttcgcgacggccatcaccctgctgacgctgataccacagctcctgagggtgaaggtcagggaaaacttcctgatgaacaaggcgcgtgagctggaccgggaggtggggaggatgaaaaggaaagaagaggcgagctggcatgtgcgcatgctcacacaggagatccgcaagtcgctcgacagacataccatcttgtacaccaccatggttgagctctcgaaggcactggaactgcagaattgtgctgtctggatgcctgatgagaccaggagcacgatgatcttaacacatcagctgagggaaagggatataatggacccacagaaacactcgattcctattgatgatccggatgttcaagaaataaaggcaaccaaggatgcaaaagttcttggcccagattcggcgctaggggtttctagccgaagcaagcatgaagcagggcctgtggctgcaataaggatgccgatgttaagggtgtcaaatttcaaaggagggactccggaagtgatgcagacgagctatgctatcttggttctggttttgcctaatgatggttcattagggtggggtcgaagagagttggagattgttgaggtagttgctgaccaagttgcagtcgctctgtcacatgctgcactcctagaggagtctcagctgatgcgagagaagcttgccgagcagcatagggacttgctgcaggcaaaggatgaagccatgagggcaggggacgctaggaattccttccagactgcaatgtacgatggaatgcgaaggccaatgcactcaatccttggtctcgtctcaatgatgcaacaggagagcatgaatccagagcaaaggcttgtgatggatgccattgccaagacaagcagtgttgcatccacactgatgaacgatgtgatgcaaacatcgacaatgaactgtgagcacttgtctttggtcaggaggccgttcaaccttcattccttcattaaagaagttgttggagtggtcagatgtctaactggttgcaagggtgtggagtttgagtttcaagtggagaattctttgccagaaaggatcattggtgatgagaagagagtcttccatattgtcctgcacatggtaggcactctaacagaccgatgtaatgctggctgtatctcattatatgtaaatgtccataatgaggttgaagataggcataatcatgactggatgctgcgaagagcaaacttctctgggggctatgtatgtgtgaaatttgagattaggattagaaaatcaaagggctatctgttgagttcatcaagcagtcagataagtcagggatccaaacccaacaattctgagatggggcttagcttcaatatgtgcaagaagattgtgcagatgatgaatggcaatatttggtcagtatcagattctaaaagcatcggagaaactatcatgctagtcctccagttccagttggaacctgtgactccggtctctggagcgtcctcagatttgtacagatcatccgcaattcccaactttaatgggctcagagtcctccttgcggacagcgactgcaccaaccgagctgtaactcacaggctcctagagaagcttggttgccgagtcctttcggtcgcttctggcgtccaatgcatcagctccttcgctgcggagtcgtccttccagctggtggttcttgatcttgacatgcagacgatggatggattcgaagtagcccgcgcgatcaggaagttcagtagcaatagttggctgccgttgattattgccctagcagcaagaatcgacgacaacatccgggatcgttgccagaggtcaggagtaaatggcctgatccagaaaccggtcacattagccgcgctgggagatgaactgtatagagtccttcagaacaattaaaagagcctgacggttctcatttctttcaatctcaatagattgctatagcttgatcggtaactaatttctgccaggttagctccatacaatcacaaaaaaaaacattttgaggcaaaagggaaatgtataggaagctgaaagcatcgctttctgcttggttcctcggtgaaggaggaggaggacgactacgacaggaaggtacaaaaaacttggagagatcatactgttagaacttagacccattcatctgtaaaccctcagataagcaaagaattagattcatgcactaacactaaccacgatataattagtttggacg

SEQ ID NO: 6375 - DNA, 1833 bp, Zea mays
  misc_feature (175)..(175): n is a, c, g, or t
  misc_feature (210)..(210): n is a, c, g, or t
tcgacccagcgttttttgggcacaaggttcagcagaagcccaggtggggggtgggagcactgttgttcagtccgttcgaaacctctcacctgctacaacctcagacgggcaggtcacacatcaaaatgctttgcagaactcacaatcagacagaacacattttgggtggttttgncaagggactacacagaagcgcgcgaggcgctatcngaagaactctcagaatgagcagcactgtggggggtctgacccacctcatgggtcagccacagttagaattgctggtggaactgttggacctagtcgacgtcatgttggagctatgggtccctcgaggccggccgggggccgttcaggttctcagatgcatgcaccaggtggttcttcctatgcaaatattcagagggggagttttacctcagtaggggcatctgggcgttactcagctgtcatgtcaagaaacattcaacaaaacctgaggcctgatacaacatttcgtggaaggcccactggtagatcttttattgcacaaaatgtcaacaggtatcaccagggccctactaccaaccaaaaagcagtacaccctattaaggagtggaagccaaaattgacaaagaagtcacccaccatcgatgcagaaaacagtatagctgatgctgcatctccttcagcaagcaactgtgaaaatgccaacacaacagatgtaaacgggttgcctgaaaaactttcacaagctaacttgcatgaggtggagcatgttattattccggaacatcttcgtgtaccagaatatgagcagacaaagttaaggtttggcagtttcacacctgatttggatttggaacaagtacctgacttgaccccacaagacactgagcaaccagaacatgtacaagaaccagttcaacaggtcagtgaaggcgatagtttggatgatggacatgatgacatggatgagcaagctagatcttcacaacacctgtcctcatcaacagctgagatttccttgtccccatctgaggatagtgatcaaatgagtgggcaagtagagaatgatgatgggctgggcttagttcagagtgacactccagttggagcagcagatggtgacagtacccagatcacctcgactttgactgctttttcggcttatggtcataaagatcctaatattcatacaaccaatgaggcccagctatatggactggtggagcctaatgtacatccacaagcattagcttcctcttctcagggatacccttcagaaaatccagaagcagataatgctgtgcaagtcttcaggatgccagattctaatgttcactcacaagttctcccgtccacatctgaggccctaaatccacagatcgtgagcaacagccctgttccgatctcttcacagcagcagcatatctctcagcaacaagctgcaacacagatgtaccctcaaatgcatgtgcaacattttccaaattttatgccatatcgccaactctattcaccagtttatcccatgcctatgccaaactattcgccaaatgtcccttatccatcaaatggaaatagttatcttcaaatgcccagtggaggttcgcatttaactgcaggaagcgtaaaatatggagtttcacagtataaaccagtcccatctggtaacccttctggctacgggaaatacactcatccagctggttttacaatgggttctcctggtgttattggagctgcagttggtgttgatgatgtccataggatgaagtaccaggacaacatttatgcctcaactccacagggcgagacatctgacatctggattcagacagctagagagat

SEQ ID NO: 6376 - DNA, 1460 bp, Zea mays
gctttgttgatgcttcacatgtgttgaggagtttttatttgacattttctttgccagattattagttagatagtgaaattgcaattctcgtttccagagtcttttagcatcgtccatgacatgcagaacgtgaatatctgcaggcttatggtcataaagatcctaatattcatacaaccaatgaggcccagctatatggactggtgtgcctaatgtacatccacaagcattagcttcctcttctcagggatacccttcagaaaatccagaagcagataatgctgtgcaagtcttcaggatgccagattctaatgttcactcacaagttctcccgtccacatctgaggccctaaatccacagatcgtgagcaacagccctgttccgatctcttcacagcagcagcatatctctcagcaacaagctgcaacacagatgtaccctcaaatgcatgtgcaacattttccaaattttatgccatatcgccaactctattcaccagtttatcccatgcctatgccaaactattcgccaaatgtcccttatccatcaaatggaaatagttatcttcaaatgcccagtggaggttcgcatttaactgcaggaagcgtaaaatatggagtttcacagtataaaccagtcccatctggtaacccttctggctacggaaattacactcatccagctggttttacaatgggttctcctggtgttattggagctgcagttggtgttgatgatgtcaataggatgaagtacaaggacaacatttatgcctcaactccacaggtcgagacatctgacatctggattcagacagctagagagatgccaccattgcaggttccttcatattacaacataccaggtcaagcaacacctggtgcttttgtgccaaatccagcaaatgcatctttcaatgctacatctcaatcccctcatgcgcagttcccaggcttgtaccatcctcagcaacctccctctattgtaagtccgcaccccatggtgcatcaacaggtgccatcggccattggtcccaatgttggggtcggggtggcagctccaggcccgcaagttggggcatatcagcaacgacaaattggtcatatgaattggagacccagcttttgaagaaggtttcttaattatctgtaattagggggggtcacaagagcctttatgtaacatcagtaggctccttttgacgggaagcacctttgtttttagtgcagctctttctgatctatttaagctataacaaggtttttgttagcttttccttcccccaggtgaattcaatgtcccatctgaactggtatgtagattgtgatttaaacattgggcaagatctcgcacgagcaccaaggttgagtgccttccattttgttctattgttttgtttcttaatctaagttgtgtacgttgcgtgccttccaaaaacccacacccgacggccgctcga

SEQ ID NO: 6377 - DNA, 3193 bp, Zea mays
cattgggtacctcgaggccggccgggaagaatagtggaaccaatagtctcaaaacccagggcctccggccgcgtggggcgattccggcggcgatcgcgagcgcctccaccaccacccgctcccccgtcctagcgcgcgtttgggcgatctcccctctcgcggcgggcatggctggcggcggcggcggggcacgcggctccgacagggcgggggcggcgcgctctcccacaaccaccacggcgatacagtcgaccatccaatcgatcaaggaggtcgtcgtcggccactccgacgccgacatcttggacaccctccgcgaatccaacatggaccccaacgagacggcgcagaagctgctcaaccaagatccatttcatgaagtaaaaagaaaaagggacaagaagaaggagagtgctggccagaagagctttgctgatagcactgcacaagttgagcaaaactcacaatggatgaagccacatacacaaaagatggaaaatgatcaaagaactcccaagcagggtcagatgtcaggccctactcgtgaatttcgggttgtgagggacaacagatttcaacatggtgtggtggagaacagaccagaattaggacacaaaggttcagcaaatgtacaaatgtctgataggagtactcttgttcagtctggtcgaaaccgctcacctgctacaacctcaggtgaccagatcacacatcaaaatgctatgcagaactccaactctgacacaacccaagggaagagggatgctcaaggtactacagagaagcatgtgaagccatatttgaagaaccctcagaatgagcagcactttccaggttctgacccagctcatgggtcagccaatgttagaattgccggtggaactgttggacctgctcaacgtcatgttggagttgttaattctactaggcaatttgctgcccgttcgggttctcagatgcatgcaccaagtggttcttatgcaaatattcagagggggagttttacctcagtaggggcatctgggcgttactcagctttcatgtctagaaacattcaacaaaaccagagacctgatacaatgtttcgtggaaggcccactgttagatcttttgttgcacaaaacaccaacagatatcaccagggttctactagcaaccaaaaagcagtacaccctattaaggagtggaagccaaaatcgacaaagaagtcaccgaccattgatgcagataacagtatagctgatgctacatctccttcagctagcaactgtgaaagtgccaacacactgaatgtaaacgaattgcctgaaaaaatttcacaaactaacttgcatgaggtggagcatgttattattccggaacatcttcgtgtgccagaatatgagcagaccaagttaaggtttggcagtttcacatctggtttggattcggaacaagtatctgcctcgaccccacaagacactgagcaaccagaacatgtacaagagtcagttcaacaggcaagtgaatatgatagtttggatgctggacctgatgacatggatgagcaagctagatcttcacaacacctgtccacatcaacggctgagatttccttgcccccatctgaggatagtgatcgaatgagtggtcaagtagagaatgatgatggcctgggcttagttcagagcgacactccaattggagcagcagacggtgacaatacccaaatcacctcgactttgactgctttttcggcttatagtcatgaagatcctaatatgcatacaaacaatgaggcccagttatacggactggtggagcctaatgtacatccgcaagtattagcttcctcttctcaggggtacccttcagaaaacccggaagcagataatgctgtgcaagtcttcaggatgccagaatctaatgttcactcacaagttctcccttccacatctgaggctttaaatccacagattgtgagcaacagccctgtttcgatctcgtcacagcagcagcagcatatctcccagcaacaagccgcagcacagatgtaccctcaaatgcatgtgcagcattttccaaatttcatgccatatcgacaactctattctccagtttaccccatgcctatgccaaactattcgccaaatgtcccttatccatcaaatggaaataattatcttcagatgcccagtggaggttcacatttaactgcaggaagcgtgaagtatggagtttcacagtttaaaccactcccatctggtaacccttctggctatggaaattacactcatccagctggttttacaatgggttctcctggtgttattggagccacagttggtgttgatgatgtcaataggatgaagtacaaggacaacatttatgcctcaactccacaggtcgagacatctgacatctggattcagcaagctagagagatgccacctatgcaggttccttcatattacaacataccaggtcaagcaacaccaggtgcttttgtgccaaatccagcaaatgcatctttcaatgctacagctcaatcctctcatgtgcagttcccaggcttgtaccatcctcagcaacctccctctattgtaagtccgcaccccatggtgcatcaacaggtgccatcggccattggtcccaatgttggggttggggtggcagctccaggcccgcaagttggagcttatcagcaaccacagcttggccatatgaattggagacccagcttttgaagaaggtttcttaattatctgtaattagggggggtcacaagagcctttatgtaacaacagtaggctccttttaacaggaagcacctttgtttttagtgcagctctttctgatctatttaagctataacgaggtttttgttagcctttccatcccccaagtgaattcagtatcccatctgaactggtatgatgtagattatgagttaaaacattgggcaaaatctcgcacgagcccaaggttgagtgccttccattttgttatattgttttgtttcctaatcaaatttgtaggttgagtgccttccattttgttctgatgttcgtttcattatctgatttatgtacgaaaaaaaaaaaaaaaattagggttttagtgtgttatgcaatctaatgcaatgtgataacctggtcagggttctttgtaactgggtacatttggatggaaaaaaaaaaaaaaaaaagcggcc

SEQ ID NO: 6378 - DNA, 1780 bp, Zea mays
atggtggcaagtgagcagcaaacacacagctagactccgcgagaaccgtcaatgggttctataggaggacccacagccacagccaccgccgaccggcgccgccgcgtgctgttcttcccgctcccgtaccagggccatatcaaccccatgttccaactcgccggcctcctccacttgcgcggtttctccgtcaccgtcttccacaccgacttcaacgctcccgacaagtcccgccaccctgcctacgacttcgtccccgttcccgtccgcggctgcttgccgaagggcagctcggatgccttgcaggtgaccgtggagcgcatcctcgccgtgaaccgcgcctgcgaggctccgttccgggagcgcctggccgctctgctggcgcgggaggacgtcgcgtgcctggtcgctgacgcccacctgctgacgctgctggacgtggcgcgggggctcggcgtgccgacgctggtgctgcgcaccggcagcgcggcgtgcctccgcatgttcgcggcgttccccgcgctctgcgacaaggggtatcagccggcgcaagagtcgcagctggaggcgccggtgactgagctgccgccgtaccgcgtccgggacctgccgtccaccaccagcgcctgccacggcgtaataagcgaggtgatttcccgtttagtgacggccgtgacgacctcctcgggtctcatcctcaacaccatggacgctctcgagtgcggcgagctggcgtcgctccggcgagacctcggcgtccccgtgttcgacatcggcccgctccacatgctctctccggcggcctcgagcagcttgctactgcaagaccgcggctgcctcgagtggctcgacgcgcaagccccggcgtccgtgctctacgtcagcttcggcagcctcgccagcatgtccgccgccgagctggtggaaacagcctggggcatagccaacagcggctatcccttcctgtgggttctccggccgggcctcgtccgcggctcgcagacgtcggaggcggcgccacccctgcccgacggcttcgacgccgcgacgcgcgggcggggcatggtcgtgagctgggcgccgcaggaggaggtcctggcgcaccctgccgtgggcgcgttctggacgcactgtggctggaactcgacgctagagagcttgtgcgcgggcgtgccggtcattgcccgcccgtgcttcggcgaccagatggggaacgcgaggtacgtggaccacgtgtggcggaccggcctcacgctcgacggcgtgctcgagaggggcgaggtggaggcggccgtcgcggcgttgatggcgcctggagagcccggcgacggactgcgtcggagggcgcgggagctcaagagcagcgcggcggagtgcatggccaaggatgggtcgtcctgcacgaatgtcgacaagctggtagaccacattctgacactgtaggcgtttggtacaggagcagccacgtggtgctgttcttgggtactgtttttctttgcggttgaaaaataaataaataaaacccgatggagcttatgatcaaaaaaaaaaaaatcacagtcacagctatggttgataattgattctaattttccactatatgatttaaagataagatcagattagaattagaccttatttctatttatttttgaaataaaatttatttaaagttttgttattttgtgaagaaacatttgtatcagattagattaggatcaaatctaattttatttatttttgaactaaaatttatttaagatttatttattatatgaag

SEQ ID NO: 6379 - DNA, 2021 bp, Zea mays
acgcacttttaccgcccatactagcaaggaatggccggcgccgtctccgtctccgctcaccggcggcaatggcggtacacgtgggaagccctaacccatcttcccctcctccgcctctacctcttaccccgccccgcgctgtccttccgcatcccctcggacctccgcgccgaccttcgactccagggctctctcctccacctgtccttttcgctccccggggacggggctgccgtcgcgctcagggtccccgtcccgagggtgctcgtagacccttccgcccccgtagagtgccgcgccgccgccgcgggggaccacctcgagctccgcctcgcgctcgtcctgcccgtcgaccaccctgtcgtcgccgccgcgttccctccaccccccggcgcggagcctccggcttctctagcgctgcgcgatgatttgaagagtttatctactggagacgttcacttgtattgcaaaaattgttcgtcaaggttgacaaaacagccactaaggaaaatcatggaaatgccatctgtagattgggtagatgtgtctgacaattggtttggtggatgttgcacctcatttggtggtgcaggcgagaaacttgtatctcagtttattagggcatatggtcgtttagaaggaacaagtctactggatgcaacttccattactgtagaaacagacgatcttgaaacagatttagtgtctcaggtagcttgttcagcacttagtagacattttgttgctataaaagaagatatatttaatgttagtgtagaaaaagatcataccactgggaagataaagttgaagaattcagaagagcaagcaaatatcacagctactcatgcacaaccacctattattttggaagaggggcctagtgttagttgtagtgaaacaaacggagtcactcagactaatcagcctggcatttctcagacagaagctgatactgatgcgtactttgagaagtctgaaaatgactgttgtgttgagaaagtggggaaatctaagaaagaggttgatttgttgctggtagatccatgccgttgctgttgtgtcaatggatacagtgagaaagctgaagataacccttcacagttgtccttggtcaatgagaaaaagcagaatatgttggagattaaaagagattacaaattaacaaaaactatttctcttggtagtagcttcattgttaaagcatctaaccttttgaatgattttgagtgggttgaacttctctgtggtcaatgttcatcacctcttggctcatacccttctcagtgttcgcttggtccagctgatggccgcctacgactcttcaagtgctacacatctacagaaattcctgtaacagggcctcatgatgtgtttagggggcatactgtgcggcgcgcgtgccggccgcggcgccttgaagttgcagaagacgaaatatcttttcgcacattagtcagagatttgaaaaccaaaaggcccatgctgcaattagttcttcttagttcaaaagcatggttatcttctggttgctgttatgaaaatgatatcgatggttcacatggaacaacagatctgcagccaagtgttaaactcttgtattctgattatagcaatgcttcagaagcagatttaaggatagtagaagcgtgggcatccaaatatcgggctgaagagctgtacatgatgaagcgtcagatagacgaacttactgaatgcctaagctcaggaatggacaactttccagtttcttgttcttcccttgaagggatgcggctctcatcgcttaggcgctgacttcagtatatgacatggaaattgtgcctggactgatcatatttttgtactgatcaaaggagtctacagcatagaatcctgatgggcatacatgatcatcctcggtgtcttttgagctttcagcaagccccctaataatttcttatttaaaatttaagatgccatcccttgtcctctgctctgaaaagacttggtggcatccgaaatggagcaatggcttatcc

SEQ ID NO: 6380 - DNA, 2629 bp, Zea mays
agttcatttttaaactaaaatacgataaatagaaaaccctaaaaaccgtaaaagaaaatgcgtgttacgatcgttaatccctggacaccaaacaggaccgggtggatttgtgttcgagcgccttctgccgtctcgtctgtcgcggacaggataccgtgtagcccaatgcctcaagcctccaatcccagccttccttttgggatctgacggcgacacagccaaaccaacatctgggcaaggaacagataaggactgcaaaccttgtcactttgtcagggcttcggggacagccaaagaagacggacggacccagtgaggcgagcacgggcgctcaccggcgatggcgacgagggcatgggtggccgcggcggtggccttgaaccctcaactgctgcctctccgctcctgctcgcccacgaagtcggtctccccagcgcagcgctcggcgtcgatggggctccggctgcgcagcggccggccgtgcctggggaagttcgtgtgccgccgcgccaagaacgcgggatacgaggactacaagttcccggaccccatcccggagttcgccgagcaggtcagcctcccccttccccttcctcatgctgagtcgggaccaagacttcttcttctgctgctgctattattatttttttttctgatggctcacattcttttggggggggcgtttcaggagacgagcaagttcagggagcacatggcgtggcggctggagcagaagaaagaggactacttcggggaccatgtcgaggagatcgttgacgtctgcaccgaggcacgtacgcaattcctgaaattccaagcgcatagttgttggtttaattcctagtaatggcgagcgagtgctcttgcttttagtgtatggattgaatcgagtcgggagttggaaccacaaagttcgcttgcacgaattagcattgaaacgaacgaatgtgcaacagtagaagacattttgcacactacatagacagtgaagcttgcaaattgtatgatgctagactgctaggcatgtagattcaggcaactgttttgtaagctaatgccttaggctgactccaacggggagaagccattttggccatgcatttggtcttttgggggtcatcggtggtttagctagccatccaaattgttagtgtatccaacaaagaagccattttatccaaattgcagttgcactgtctgtgcgtgttcacatgtcccgtgaatttttcatgtcggcaagtcgatcttattcttagtagatagatacgatgagactacacctgtactgtacgtagacgagttaaactgtaccagccgtacgtccagcactaacatatggctactctcgctgtggcagcagcagatcatggggacattcctggagaacgattaccgtggaccagggacgctcctggttcacccgttcctggacatgaagggcgagatcaaggagagggggctccccggcgcacctcaggcggcacgggcggcgatagcatgggccgaaaagaacgtggacaaggactggaaggcctggactggggaatactagcactagaagaggtatcaataaagattttgccatttgaattggcatgagaagagagtaaaaactaaagaggatgtttctatgttttaccactgagcttgtatggtttagcactgtgttcctgctctattattctcagttagatcagaggttgcaccttgccagactggcatctacatctcttgctactacttgagcttgcacgtagtgtagagtgtagagacacggggtctgtttggtaggctgtctaagttgccacactttgcctaacttttctgtctaaagttagttcttcatttcgaacgactaaccttatataaagtgtggcttagttagccacaaaccaaacacattctaacagaaaagtcctcagacacggtaaagaaaggtagtctgacactgaaaacccctttgctagctagctaatgaacacacaatggctgtgcatcatgcagaattgcgaactccctgcaccctaggcagaataacacaatagtatatataaaccaaccccccatcattgttgttcagcatcattttagaatagcggtcaacactagtggctaatggggatcattgcagtagccaataacaggggcagtttggcatatcgtcttttgatgcttcttttccgtgtttccggaagggagtgtagctggcaaccaatgttggctgaggtgaacatgtcatggacacggaccgtggacatccagcttttcaaataaaggatttgctatgactttatactacagtcttgccttcttaatactgggaatgtaaagctcttttagaagaatttacaccaatataacttctgttgtagcatttgctatgactttatactcgtcttcagtactatacattatatcaatgtcgtgcttacatgtgcttcattgcaaaacgatatgtagacattctaccatctatatctctgctcaatatgcatatataaagcacttacaagagtgaaatttgacttcttaatttttagttctaaactagtggtctacttgatatatctcaatatcctcttgattcttgtccaatgaatagtacgggggagcatgctcaactgatatg

SEQ ID NO: 6381 - DNA, 863 bp, Zea mays
aaaccaacatctgggcaaggaacagataaggactccgaaaaaccttgtcactttgtcagggcttcggggacagccaaagaagacggacggacccagtgaggcgagcacgggcgctcaccggcgatggcgacgagggcatgggtggccgcggcggtggccttgaaccctcaactgctgcctctccgctcctgctcgcccacgaagtcggtctccccagcgcagcgctcggcgtcgatggggctccggctgcgcagcggccggccgtgcctggggaagttcgtgtgccgccgcgccaagaacgcgggatacgaggactacaagttcccggaccccatcccggagttcgccgagcaggagacgagcaagttcagggagcacatggcgtggcggctggagcagaagaaagaggactacttcggggaccatgtcgaggagatcgttgacgtctgcaccgagatcatggggacattcctggagaacgattaccgtggaccagggacgctcctggttcacccgttcctggacatgaagggcgagatcaaggagagggggctccccggcgcacctcaggcggcacgggcggcgatagcatgggccgaaaagaacgtggacaaggactggaaggcctggactggggaatactagcactagaagaggtatcaataaagattttgccatttgaattggcatgagaagagagtaaaaactaaagaggatgtttctatgttttaccactgagcttgtatggtttagcactgtgttcctgctctattattctcagttagatcagaagttgcagcttgccagactggcatatacatctcttgctactacttgagcttgcgggggggcccgggtaccca

SEQ ID NO: 6382 - DNA, 741 bp, Zea mays
aaaccaacatctgggcaaggaacagataaggactgcaaaccttgtcagggcttccgggacagccaaagaagacggacggacccagtgaggcgagcacgggcgctcaccggcgatggcgacgagggcatgggtggccgcggcggtggccttgaaccctcaactgctgcctctccgctcctgctcgcccacgcagtcggtctccccagcgcagcgctcgccgtcgatggggctccggctgcgcagcggccggccgtgcctggggaagttcgtgtgccgccgcgccaagaacgcgggatacgaggactacaagttcccggaccccatcccggagttcgccgagcaggagacgagcaagttcagggagcacatggcgtggcggctggagcagaagaaagaggactacttcggggaccatgtcgaggagatcgttgacgtctgcaccgagatcttggggacattcctggagaacgattaccgtggaccagggacgctcctggttcacccgttcctggacatgaagggcgagatcaaggagagggggctccccggcgcacctcaggcggcacgggcggcgatagcatgggccgaaaagaacgtggataaggactggaaggcctggactggggaatactagcactagttatgttgtttgacgttcccagcagctagctattgtgacacaaaattttgtccgcttcaaatgttcctctgtctgtcgtcatgccaaaaaaataaaaaaaa

SEQ ID NO: 6383 - DNA, 1417 bp, Zea mays
agtcgctcctctcagtccctcccttcccgtgtcccgtagtcgtctcctctccgcttcgctcatcagctgcgcctgcggcgtcgtcagccagcggcaagaaacaaaagcgccgcgataagtccgttcgttgaaggcaggcagccatgatccctaggacgtcctcggtctcggcggcggcggcgccctcgccgccggcgtggcaaagcgccagcagcagcgacggcatgttcccggccccgggcagctcggggcagcagcagctggccatcagcaacggggtgctcctcgccgccgtcatcttcctcttcatggtcgtcgtcttcgtcttcctcctctacctctacgccaagcgctacctgggcgcgaacccgctgctggcgccgtcgtcgccgtcctcgcggttcctcttcgttgccgcgtccccgctcccgcagcgcggcctgcccgcctccgtcctgcaatccctccccgtcaccgtctacggctcccccggcggcaaggacaaggacgcgctggagtgcgcggtgtgcctgtccgaggtgggcgacggcgagaaggtgcggacgctgcccaagtgctcccacgggttccacgtggagtgcatcgacatgtggttccattcccacgacacctgccccctctgccgcgcccccgtgggcgacctcgacgcgctgccgcgggaggagccctccggcgcgccgctggagttgcccgtgttccccaccaacgtcctgttctggggcacccacgacgagatcaccaacgccgggctcgtcgcgccgccgcgcgccgccccgtcggccagctcctcggcctccgggcgcaggaaggagaacctggtcatcgacatcccgacgcgggccgtggccacgaccacgaccacgccgccgcccgctaactccccgctgccggccagccggatgcccgggagcgccgacgagatgcggtccccggtgtccgccaggctgcggtcgctgcgccggctgctcagcagaggaaagcaggccatggtcggcacctcctcctcctacagcccacgcgacatcgaacaggggctcgcggggggcgaggccgccgccgccgccaccgcgcgcccgccaaagactccgaagacgcctccgtcggcgcacgcgcactgatccatccatcccgagctctgctccgggacgcatttggcccgactcgccgatcgccggagcgcgcgcagcgcatgcgttcattctttcttcttccccctttttttcttttacctttcatgattcgaaaaaggagttttttggttcgaaaattcctatgtaaacagaggaaaatattggtgttgattggttgccgttggtggtggggatgaatggtgaatttgttcattacttttagttaaaagacacttggatttcggctctcaaaaaaaaaaaaaaaa

SEQ ID NO: 6384 - DNA, 1347 bp, Zea mays
  misc_feature (729)..(729): n is a, c, g, or t
gtgtgtgtctagtcgtccccttctcccatcagcgggagggcggcgtcgtcagccggcaaaaaagcaaagcgtcacgagaagctcgttccttgacaggcagccatgattccaaggacgtcctcggtctcttcgtcggcggcggcggcggcgcccaccgcgggcgcgccgccggcgtggccgagcggcagcgacgcggcggcgttccaggcctcgggcagctcgggacatcagcaggtggtcatcagcaacggggtgctcctcgcggcggtcatcttcctcttcatggtcgtcgtgttcgtcttcctcctctacctctacgccaagcgctacctgggcgccgggaacccgctcgcggcgccgccgtcctcgcggttcctcttcgtggccgcgtccccgctcccgcagcgcggcctgcccgcctccgccctgcgctccctccccgtcgcggtctacggcggcggcggcggcggcccgggcaccaagagcagcaaggaggcgctggagtgcgcggtgtgcctgtccgaggtggccgacggcgagaaggtgcggacgctgcccaagtgcgggcacgcgttccacgtggagtgcatcgacatgtggttccactcccacgacacctgcccgctctgccgcgcccccgtcggcggcgacctcgacgcgctgccgcggggaggagcccttcggcgcgtcgctcgagttccccaccaacgtcctgttctggggcacccnacgacgaggtcgccaacgccggcctcgccacgcccccgcccccgccgccgcccgtcgccagcgccgtctccgcgagctcctcggcctccgggcgtaggaaggagaacctggtcatcgacatcccgacgcggcccgtggccctgaccaccacgccgcccttcaactccccgctgccgacgagccgggtggctgggagcgccgacgagacgcggtccccggtctccgccaggctgcggtcgctgcgccggctgctgagcagaggcaagcaggccgtggtcggcacctcctacagcccgcgcggcgccggtgacgtcgagcaggggctcgcaggagccgaggccgcccgcccgcccaagacgcctccggcgtcggactgattcagatccccccgagctccgggtcgcatttggctcgactcgccgatcaccggagcgcgcgtagcgtatgcgttcatttttgttccccctttttcttttttttatttacatcttgattcgaaaaaggaactatcggtcaaaaggttcctgtgtaaacagaggaaaagaccgatgctggttggttgttgttgggggaaaaaatggtggatttgttcatatgtttaccaagaaacttttcttg

SEQ ID NO: 6385 - DNA, 1228 bp, Zea mays
cagcgtccgcccagccgtcccaaaaatatggtcttgcgtgaattctatgactatgctgctgctgcagaagtcaacagtgagcaccccctggcaaaagcgatagtggagcacgccaaaaagttgcgtccagaaggaaaccacatgtggccggaagcaagggaatttatttcagtaaccgggcaaggcgtcaaggcggaggttagtggcaagagtgtcatcgtggggaacaaaggcctcatgctgtcctcgggcattggtatccccttggaagcttcagaaatcctcgtggaagaggaggggaaggcaaggacagggattatcgtggcagtggaccgagaagtggcgggcgtaatctctgtatccgatccgacaaaaccaaacgccctccaagtgatatcgtacctcaagtccatgaacgtggagagcataatggtgaccggcgacaactgggggacggctaatgctatcggcagagaggttggcatcgagaagataatcgctgaagcgaaaccggagcagaaggccgagagggtgaaggaactccagctgtctggaaggaccgtggcgatggttggcgacgggatcaacgactcccccgcgctcgtctcggccgacgtggggctggcgataggcgcggggacggacgtcgccatcgaggctgccgacatcgtgctcatgaagagcaacctggaggacgtggtgaccgccatcgacctgtccaggaaggccttcttccgcatacggatgaactacgtctgggcgctcgggtacaacgtcgtcggcatcccgatcgctgcgggggtgctcttcccgtccaccgggttccgcctgccgccgtgggtcgccggcgctgcgatggcggcctcgtccgtcagcgtcgtctgctggtccctgctgctgaggtactacaaggctccgaagattgccggcacagctaaagaaatttgaattactaccctgtaggcaggtatcactggccggcactgctgctgctgctggaatgggaaggttgtggctggctggctgctaagtgctaacaatcgctgaaacagaagtctaaaaagaatcgctggaacaagcaagctgtacatatgtgttacaagtatatatacggcgatgctaagtgaaagtggtggtgtaacgtaagtactactactgatctgccatcgttgcatggatgtataccgtttttcttttcctctcgaaatgaaaagtggtcctatggcac

SEQ ID NO: 6386 - DNA, 1521 bp, Zea mays
ccccgcgcccccggtgcgaggacgaggacgacgcgggcgcacgcagcagcaagctctgaccctgaaagctgaaaccgctccacgccctccccctccgcgcagagccagccaagccaaccagccagtcagaagaggaaccggggagcggcagctgcagcggccgagggcggagcacgcgaggcatggatagataccaaagggtagagaagcctcggaatgacacgccaatcagccagaatgagatcagaatcactactcaggggaggatgaggaactatatcagctatgggatgtcgctgcttgaggaaaatggacatgatgagattagtatcaaggccatgggacgggccataaataagacagttatggttgttgaattgatcaagagaagggttggaggtcttcatcagaacactgctactgaatctgttgatatcacagacacatgggaacctttggaagaaggccttctcccactagagacaactcgccatgtgtcgatgatcactgtgacactgtcaaagaaccctctggatacatcatctccaggataccagccacctatcccagctgaagaggtgaaacctgcttttgactatgatcatgaagaatcgtatcccactggtcgtggaagaggacgtggtggtggcagaagaggcaggggaagaggcatgagcaatggcccccctccacctgcttatggttacaacgaagagtgggaggaggaaggagattattataacagagggcgcgggagagggcggctacgtggacgaggtgggagagggcgtggtggctactacggaggtgggaggcgtggtggctacggttatgattatggctatgcccccagaggcgggtactatgaagagcaagacgaatactatgatgagcccgaggaatatgctcctccccctggccgcggacgtggcagagggagaaggggcggcatgccttggcgtgggcgtggaggccgcgggccaccgcgcggtggccgagggagctactactaggcgcgagaaatgcgacgtgccgaatgcgtgtgcttattagttatctgttagcgtttgctgcagtgctcttctatggagctccgaccccggactggaattatctcgtaggcccttccaggtgctactctacttcagctgctgtccctgtgcaactcgtccgggcaagttttgtggctcgctcgtggttttgtagctaggttaagcgagtgaagttacactcggtagcgcagtatttcctgcgagattgtttattcttctgttaatgtacctaccttactatttcgtttggattatggatactgggtgcatccgtttcatgtttattctcctggtaatctgtagctttaccgacagtgtgtacgctgatgcctgctgccatacggggcagaagttttttttatgctgcagaacagagcagcagggaaaaaaagtcacaatacagttcggcggggcgcccggtacccaaataaaaaattaataaaattaaaaataaaataaaagatgagga

SEQ ID NO: 6387 - DNA, 1390 bp, Zea mays
ctgaaagctgaaaccgctccacgccctccccctccgcgcagagccagccaagccaaccagccagtcagaagaggaaccggggagcggcagctgcagcggccgagggcggagcacgcgaggttcaagattatccggtttaaagacatcagaagaggctgcggcatggatagataccaaagggtagagaagcctcggaatgacacgccaatcagccagaatgagatcagaatcactactcaggggaggatgaggaactatatcagctatgggatgtcgctgcttgaggaaaatggacatgatgagattagtatcaaggccatgggacgggccataaataagacagttatggttgttgaattgatcaagagaagggttggaggtcttcatcagaacactgctactgaatctgttgatatcacagacacatgggaacctttggaagaaggccttctcccactagagacaactcgccatgtgtcgatgatcactgtgacactgtcaaagaaccctctggatacatcatctccaggataccagccacctatcccagctgaagaggtgaaacctgcttttgactatgatcatgaagaatcgtatcccactggtcgtggaagaggacgtggtggtggcagaagaggcaggggaagaggcatgagcaatggcccccctccacctgcttatggttacaacgaagagtgggaggaggaaggagattattataacagagggcgcgggagagggcggctacgtggacgaggagggagagggcgtggtggctactacggaggtgggaggcgtggtggctacggttatgattatggctatgcccccagaggcgggtactatgaagagcaagacgaatactatgatgagcccgaggaatatgctcctccccctggccgcggacgtggcagagggagaaggggcggcatgccttggcgtgggcgtggaggccgcgggccaccgcgcggtggccgagggagctactactaggcgcgagaaatgcgacgtgccgaatgcgtgtgcttattagttatctgttagcgtttgctgcagtgctcttctatggagctccgaccccggactggaattatctcgtaggcccttccaggtgctactctacttcagctgctgtccctgtgcaactcgtccgggcaagttttgtggctcgctcgtggttttgtagctaggttaagcgagtgaagttacactcggtagcgcagtatttcctgcgagattgtttattcttctgttaatgtacctaccttactatttcgtttggattatggatactgggtgcatccgtttcatgtttaaaaaaaaaaaaaaaaaaaaactctgggggggggcccgggtccccatttccccttataggatcgatttttaccaa

SEQ ID NO: 6388 - DNA, 1411 bp, Zea mays
attgggtacctcgaggccggccgggggcacagtttgcgaggacgatgcgggcgcaccggcgcacgcagcgaagccctgaaaccgcccccacgccccccagaaccagccaaccagccagtcagaagagtaacaccggagcggcagctgcagtggccgaggccggagcacgcaaggcatggatagataccaaagggtagagaagcctcggaatgacacaccaatcagccagaatgagattaggattactactcagaggaggatgaggaactatatcagctatgggatgtcgctgcttgaggaaaatggacacgatgagattagtatcaaggccatgggacaggccataaataagacagttatggttgttgaattgattaagagaagggttggaggtcttcatcagaacagtgccactgaatctgttgatatcacagacacatgggaacctttggaagaaggccttctcccactagagacaactcgccatgtgtcgatgatcactgtgacgctatcaaagaagcctctggatacatcatctccaggataccaaccacctatcccagctgaagaagtgaaacctgcttttgactatgaccatgaagattcgtatcctactggccgtggaagaggacgtggtggtgggagaagaggcaggggaagaggtatgagcaatggtccccctccacccgcttatggttacaatgaagagtgggaggaggaaggagattactataatagagggcgtgggagaggaaggtcacgtggacgaggcagagtgcgtggtggctactatggaggtgggaggcgtggtggctacagttatggctatggtgcgagaggcgggtactatgaagagcaagacgaatactatgatgatcctgaagaatatgcccctccaggccgtcgtgggcgtggcagaggaagaagggggatgccttggcgtggccgtggagtctactactagacgagagatgcgatgcgatgcgacatgccaaatgggtgtgctgaagctagcaatggcgtgcttggttggttatctgttctatggagttccgacccaggactagaattacccagcagggtccttccaggtgctgtgcctgtgcaactcgtctgggcaagttttgtggctcgctcgtggttttgtagctaggttaagcgagtgaagtttaatcactcggtagcagtgttttcccccttcggacggcatgcatgttgtttattttgctgctaatctacctaccttccaatttcgtatggatcgtgatggatactggatgcatcagtttcattttttttttctcctggtaaatctgtagtttttataaagacgggttacactgatacctgatgacaagatgaggcaggaagtttgttatgctgcaaaaaaaaaaaaaaaaaaaaaaaaaaa

SEQ ID NO: 6389 - DNA, 2875 bp, Zea mays
acctcgagccggccgggataccaattgttcttgacttcgcttgcattctattccaccgctcaccacaagaagccacctcaggctcacgccgcggttccacacgagcaaatcccgccgcttcctccccacgcaccccttcccatccttcccgaagcacgaggcgagccgggccgccggatatggcgccggcggcgccgtacggcggggccgagtcgcagcggcaggcggacctactcaagcaggagggcaacgcctttttcaggaaggaacgcctcagcgccgccatcgacgcctacaccggggccataactctttgcccaaatgttgcagtatattggaccaaccgagcactttgctataggaagcggaatgagtggactagagttgaggaagattgcagaacagctatccagcttgacagccagtctgttaaggcacattacatgctcgggttatctcttgtcaacagccaaagattatcagaaggaataaaatcactggagaagtccttggagcttggaaggggtgcacatcctgcaagctacatggttgaagagatatggcaggagctttctaaagcaaaatacatcgaatgggagagcttatcaagagaccgaacttgtcaactgcaaaagctgaaggtagcatgtaaagaggccctaacgagttacaacagccttgataacccagccgcaggtgcgccagtagaacagctaaatgagctcgaggaagttttcaagaaggctgcaaagactgatactccagcagaagtacctgaccatctctgttgcaaaatcacacttgatatcttcagagacccggtgatcaccccgagcgggattacctacgagagggccgtacttctcgaccaccttcaaacggtggggaggtttgaccccgtgacccgtgaggctcttgaaccgcaccagctggttcctaatcttgccatcaaggaagctgtgcatgcgtttttgagtgagcatggttgggcttacaagattagatgatcgctttggaatacaggttttggatactgtcggatgtgacggtgggatttttttgttcactgttggggggcagattttaatctgggatggctgcgtacagattcaccttctccagttgtgtacatatgagatgctcattatgatagtaattgtgaacagtacaccaaaggaagtgaagttgagcgtctgagttcctgactgcatcttcaaatttaaattgtgtgtgagggagggcgaactgtgctgtcaaagcacccatagaggagaactgagccgactgcgtgaagaactgaagaatgcacacatgggggatcttttcacgcggacgcaaagtggcatggcatcatgcaaagcctctcgttccattcgtgatatcctctatcacaagcagaatatatacagtgggtggttgtgtccagctagcgaggcgtgccaacatgaccatatatggaccgatgcaagctctcagccagtcagcaaccgctgaaatcctccagtctctagagacaagaaacctaacaagttgtgactactttgttgaatcctcaagcaacataacagctcagttgctcctcccctaatcgtcacctatggagtagtagcgtacagtatgtacttaccaaaactgcgcatgtacgcacctagctaggttataaacaccaccatgggtccatggcagacaatgtcactgcgtacgtgcaagaactggaggcggcgacattgcagtctgcaccatggggagcatgggctacgacaatgacaagaagcccagggagcagcaggccaggaggccgagtacggccaccatgttcctcctggtcctcaccaacgcggcctctgtcttcgtcttctccggggccggcgcggcgctccacgcgcacgtcgggcggcgctacccggccgtagtccacgcctggagctcggcgaagctgctccgcgagctcaacgccaccgggctggcggtcgccgccagccacgcggaggtggtggacctgtcgggccgcctcaccgcggccaacaaggtcctggaggccattctcggcggctcgaccgccaagcgcgacatggaggcggcccgggaggagcagcgggaagcggcggcgggcgggctgtggcagcgggagctaaagctgggtggcgagctgaagctggtggtcggcccgcacaggggcgggggcgcggacgcggtgacgttcccgtcgctggggcaggcgtgccaccggtaccgggacgagctggagcgatacatgaactacacggtgggaggggagtgcccctccgacgaggcgtcggcgcagcggctgatgctcaaggggtgcgagccgctgccgcggcggcggtgccggccgcgcacccccgcggggtacgtggagcccacgccgctgccggcgagcctgtgggcggtcccgccggacaccagcatcgtgtgggacgcgtacacgtgcaagagctacggctgcctcgcgcggcgcggcaaggccaagggcagctacgactgcaaggactgcttcgacctcggcgggcgggagaaggaccgctgggtgcgccgccgtgataaggagaagggcgacgagcgcaactcgctcgactacaccatcgacggcgtgctggggtccctgcccagcggcagcgtgcgcatcgggctggacatcggcggcgggtccggcacgttcgcggcgcggatgcgggagcgcggcgtcacggtggtgaccacgtccatgaacttcgacgggccgttcaacagcttcatcgcgtcgcgggggctggtgcccatgcacctcagcgtggccagccggctgcccttcttcgacggcacgctggacgtggtgcactccatgcacgtgctcagcagctggatccccgacgcc

SEQ ID NO: 6390 - DNA, 1150 bp, Zea mays
aggtaaattttttgggttggcttaaactaagttttaagagggttttaagaacaatgggccctaaaatctcttaaaggtgatttttaacgggctaacctataagtttaggttttagaaattctagaccatgagctaattttaactatttttttaacttcaattggtaataacacgtgtatcctgtcaggccctaaaatgttaatttggttaattcaggtactaaattaaaaaggaatttaaacactggtggccagaaggttctagaatctagactagagtgaccatcgaatcgacgatggagaaaaaccgctgaggcccggttggcaagtttgacaccacaaaacagacccactaaccccaacatccctccccctaggatctcaatccaacggcgcgcacaccctccctcactagctgaagagcggcggcaataagccagcaaggctcctgtgaacccgaagtgccggcaccgccgctgttgcagaagttgcctcttttttacgtcttgtttcttctccaccccggcgacgcgaatggagaagggcagtggaggcagcaatcctccgccgccaccgctccacatggaggacttccaactggaggggaagaagcccgtcaagaacccctttgtgcccatcggtatgtacgcgccgacggcccccctctctctgacgcccgaggctggccccgtaggacctagctagtcctttacgcgctgagaacggggacgagcagctgcccggatcgagactcgtggggtgtaattctctgggggcaggtttggattggtagggtgggggtggggatctggctccgttttttttcctagggccgtatttttgctgttttggattgcttatggtgccgctagattgatgaagccgctagcgtaggaattaaggtgtgaaaactggcatggaatttgatgcttgttgtttgatttgccacaatacgtaatacatatagactgctgtagtttgtctatttgttttacttcttttgcgtagcgtgcattctttattcgcattatatcagtaactgcactatgtggccggagcaggagaaaacgaaatttgagaagatagcaatttgccttgcattaatttttatgtccctgatttgtatgcatatggtggtcgaaattttctgc

SEQ ID NO: 6391 - DNA, 1021 bp, Zea mays
gtaccctccgggtcgtccattcggccctaaggacccatcgagcgaccgagcttgccctcggaccgcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgaaaaaaaaaaaaaaaaaaaaaaaaaaaaaaaaaggaaaaaaaaaaaaagactcctatagggcccggcccggccggggtgaacccgaagtgccggcaccgccgctgttgcagaagttgcctcttttttacgtcttgtttctcctccaccccggcgacgcgaatggagaagggcagtggaggcagcaatcctccgccgccaccgctccacatggaggacttccaactggaggggaagaagcccgtcaagaacccctttgtgcccatcggcgcactggttactgctggagttctgactgctggtctgatcagtttccgatatgggaactctcagctgggtcagaaactgatgagggcacgtgtagttgctcaaggcgctacagtcgctctgatgattggcagtgcttactactatggcgatcaaatcaagctgttcaagaaagggtcgagcccatgatcttcccatgaatattgctgtttttggtgtatggaggaatgccttgtatacgcataaatttcacctggactctgctgcccctttttaacatcattttggcctgacacgtggtagctaacaagaaatcgctgttggtccgatcggcaggattgaaaataaataattttgtttgttgatttttgtcaggatttgttggttgattaattaggctatatgcatcaattgttatatctttgtacaaacacgcgttctgttgtctgcaatcagcggctgaagtgaccattttgcaaatctggctaaaaaaaagcgatcctggagcctcgcgcttttggt

SEQ ID NO: 6392 - DNA, 2318 bp, Zea mays
ccacgcgtccggggccttctggatgcttcctctcccaaaacaacctgtcgctgtcagccgatcgatcgttgaccgatctctctttccactcctctcttaaaccctagccgctgcgcacaacaacctgctactcaatttgatcaaccgccatccattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagatgaggccgcgaaggaagtacaacttcagggtaaacgctgcaaaggagctgcatttcaacaaggatggctcggctatcaggaaaatgcaaaatggggtcaacaagcttgcagatctcgtcggggttactcttggaccaaaggggcgaaatgtagtcctcgaaagcaagtatggctcacctaaaattgtcaatgatggtgtcactgtggcaaaggaggttgaacttgaggaccctgttgaaaatattggtgctaaattggtccgccaagctgctgctaaaacaaatgacttggctggtgatgggacaaccacttcggttgtccttgctcaagggatgattactgagggtgtaaaggttgtagctgctggtgctaatccagtgcagatcacccgtggtattgagaaaacagccaaagcactagtcagtgaactccaaaagatgtccaaggaggttgaggacagtgagcttgctgatgttgctgcagttagtgcgggaaataactatgaaattgggaatatgatagctgaggctatgaaaaaggttgggcggcagggagtggtcacacttgaagaaggaaagagtgctgaaaataacctctattctgttgagggaatgcagtttgaccgtggctatatttctccctactttgtgactgacagtgaaaaaatgacagtcgagtatgagaactgcaagcttctccttgtggacaagaaaattaacaatgccagagatcttatcactatcctggaggatgctattagaagtggatatccaattctaatagtggcagaggacattgagcaggaagctcttgcaacccttgtggttaataggcttagaggtgcattgaagattgctgctattaaggcccctggttttggagagcgcaaaagtcaatatcttgatgacattgctactctcactggaggcactgtcatcagagaagaagttggattatccttagacaaggcagacaatgcggtcctaggaactgctgctaaggttgtagttaccaaggattcaacaacaatagtgggagatggcactacacaggaggaagtgaacaaaagggtgacacaaatcaagaaccagattgaggctactgaacaagaatatgagagagaaaaactaaacgagaggatagctaaactctctggtggtgttgctgtcattcaggtaggagcacagacagaaactgagctcaaggaaaagaaattgagggttgaggatgccctgaatgctacaaaggcagcagtcgaggaaggtatcgttgtaggtggtggctgtacccttttgaggcttgcatcaaaagttgatgcaattatagagacccttgagaacgatgaacagaaggttggggctgaaattgtaaggaagtccttgagctatccacttaaattgattgcaaaaaatgcaggcgttaatggcagtgtggttactgagaaggttcttgccaatgagaacttcaggtatgggtacaatgcggctacaggggagtatgaggacttgatggctgctggtatcattgatcccaccaaggttgtgaggtgctgcttggagcatgctgcatcggtggcgaaaaccttcatcacctctgatgccgttgttgttgacgccaaggtggctgagcaagcaccatcatctcctgcaaacccaatggcaatgggtggtggctcaggttttgggttctaaattgttcagctgcccttcgttccatcgcagcgacagaatcttagtttcgagatataataataaattggatgatgttagtttcgagatattagttggatgttgttattgttgtctcaaattataaaaaatcaagtgcaagtaaccaagacagctgaaaaaaatagttttgatgagatgctgcttcgtttttcttttctactaaaaaaaaaaaaaaaaaaaaaaaaaaaaaaaaaaaaaaaaaaaaacctcgagggggggcccggaacccaatccgcccaaaagggagtcgaataac

SEQ ID NO: 6393 - DNA, 1825 bp, Zea mays
  misc_feature (1)..(1): n is a, c, g, or t
  misc_feature (837)..(837): n is a, c, g, or t
  misc_feature (848)..(848): n is a, c, g, or t
  misc_feature (862)..(862): n is a, c, g, or t
  misc_feature (872)..(873): n is a, c, g, or t
  misc_feature (958)..(958): n is a, c, g, or t
  misc_feature (978)..(978): n is a, c, g, or t
ntatgccttaccttaaaaatgttcaatgattgttgtcaacgtggcaaaaggggggttgaacttgggggacccctgttgaaaattatgggtgttaaagtggtccgaccaagctgctgctaaaccaaaatgccttggctggtgatgggccagccactttcggttgtccttgctcaagggatgattactgagggggtaaaggttgtagctgcttgttctaatccagtgcagatcacccgtggtattgagaaaacagccaaagcactagtcagtgaactccaaaaagatgtccaaggaggttgaggacagtgagcttgctgatgttgctgcagttagtgcgggaaataactatgaaattgggaatatgatagctgaggctatgaaaaaggttgggcggcagggagtggtcacacttgaagaaggaaagagtgctgaaaataacctctattctgttgagggaatgcagtttgaccgtggctatatttctccctactttgtgactgacagtgaaaaaatgacagtcgagtatgagaactgcaagcttctccttgtggacaagaaaattaacaatgccagagatcttatcactatcctggaggatgctattagaagtggatatccaattctaatagtggcagaggacattgagcaggaagctcttgcaacccttgtggttaataggcttagaggtgcattgaagattgctgctattaaggcccctggttttggagagcgcaaaagtcaatatcttgatgacattgctactctcacatggaggcactgtcatcagagaagaagttggattatccttagacaaggcagacaatgcgtccttagganctgctgctaanggtgtagttcccanggatcaacanncataggtgggagatgccactacacagagggaagtgaccaaaagggtgacacaatccagaccccagatgagggctactgaccaagnatatgagagagaaaactaancgagaggatagctaaactctctggtggtgttgctgtcattcaggtaggagcacagacagaaactgagctcaaggaaaagaaattgagggttgaggatgccctgaatgctacaaaggcagcagtcgaggaaggtatcgttgtaggtggtggctgtacccttttgaggcttgcatcaaaagttgatgcaattatagagacccttgagaacgatgaacagaaggttggggctgaaattgtaaggaagtccttgagctatccacttaaattgattgcaaaaaatgcaggcgttaatggcagtgtggttactgagaaggttcttgccaatgagaacttcaggtatgggtacaatgcggctacaggggagtatgaggacttgatggctgctggtatcattgatcccaccaaggttgtgaggtgctgcttggagcatgctgcatcggtggcgaaaaccttcatcacctctgatgccgttgttgttgacgccaaggtggctgagcaagcaccatcatctcctgcaaacccaatggcaatgggtggtggctcaggttttgggttctaaattgttcagctgcccttcgttccatcgcagcgacagaatcttagtttcgagatataataataaattggatgatgttagtttcgagatattagttggatgttgttattgttgtctcaaattataaaaaatcaagggcaagtaaccaagacagctgaaaaaaatagttttgatgagatgctgcttcgtttttcttttctactatattggtgtgttggaaatagttttgatgagatgctgcttcgtttttctactataatatattaatattgcaagcaaaaaaaaaaaaaa

SEQ ID NO: 6394 - DNA, 378 bp, Zea mays
gcaaggtcgccaacttcagcggcgtggaggaacccaacctgtcctcctcggagaagttcgacatctaccgcaaggcctttgtgctgtaaacctcctctgcatcggccattgcaaactactgccgtctggactctttaaattgccgtgtcgggataataaaccagacgggcctatgtgtcaacaatgtgtctttgtgtcatcagtcacccgaggagaatatttgtgtttatgcacacgccaacaatggctccttgctactaaacctttatggcccattgtaataaggctattgtatctcttctacatgactctaaaataaactaagtgttatggtgctaattaatatcactttcagcgtagaagcgctcgcgatctaga

SEQ ID NO: 6395 - DNA, 1556 bp, Zea mays
aaacctaacagaagcaaccgaatatcccctcgcctttcaactcgtcttcctcctcatgtcgtcgcctcctatccctctatatcttctattctaagccacctcgatcggaccctagatagatgcaagaaaagaaaagagaagagcctctgtggatagtggtgggtgctggatcactgggcggagagcttctcatatcggatcgatcgattaattaatatatactataaacatacaatcaattacatacatatacgccaagagaagaggaacgccggcccgtttcacttgtctccttcctccgatccctcccggcggccggccgggctcgggcgtttttccccttttgtttcccatggaggacgccaagatggggaacggcgccaccatccgcgcggtgctcgccatcctccagtggtggggattcaacgtcaccgtcatcatcatcaacaagtggatcttccagaaactggagttcaagttccccctgacggtgtcgtgcgtccacttcatatgttcctccatcggagcctacatcgcgatcaaagtcctgagaacgaagccgctgatcgaggtggcctcggaggaccggtggaggaggatattccccatgtcgttggtgttctgcgtcaacatcgtgctggggaacgtgagcctgaggtacataccagtgtcattcatgcagacgatcaagtcgttcactccggcaacgacagtggttcttcagtggctggtttggaggaaatactttgagtggcgcatctgggcgtccttggtgcccatcgttggaggaatccttgtcacctccgtgacggagctgagcttcaacacggctggcttctgcgccgcgctggtggggtgcctggccacgtccaccaagaccatcctggcagagtcgctgctccacggctacaagttcgacagcatcaacacggtgtactacatggctccgctggccacgctgatcctgtcggtgccggccgtggcgctggagggcggcgccgtgctggggtggctgcggacgcacgagtccgtgggaccggcgctggcggtcgtcgtcacctccggggtgctggccttctgcctcaacttctccatcttctacgtcatccactccacgacggcagtcaccttcaacgtggccggcaacctcaaggtggccgtggcggtgctggcgtcctggatggtgttccggaaccccatctccgccatgaacgcactcggctgcggcgtcacgctcgtcggatgcaccttctacggctacgtcaggcaccgactctcgcagaaccaggcgcccagagcccgcttggagatgctgccgctcaccgccgtcgacaagcaaggcgacaagatataaaaagtcttttcgaataaaccatctgattctttctgatccacctagcctaaccgccgatcgagaatgcatccaccatcagagatgacaggaaattattttttgttggcagccagattttgataatgagtcagttcagttgttgcttaaagagaaatgtcatgaggtctataaagtcttttggaatgaaaaaaaaaaaaaaaaa

SEQ ID NO: 6396 - DNA, 1376 bp, Zea mays
  misc_feature (1255)..(1255): n is a, c, g, or t
cccacgcgtacgccgtagcatatgcatatgagcatatcctaaccacgattcggggggcaagcgaacggacacgatggtggccttgaccgcggggatttccgtagccaccggcgtcgtgttcagccccgccggccgccggcgaggccgcggacacgccgcctttcgctgctcgtcgtcctctgccggagagaggcaggctctcttcagccgcatcgcccccgtctacgatcatctgaacgacgtgctcagcctgggacagcaccggacgtggaagcgcatatgcgtctcttggtcgagagcgaagatgggggatcgagttcttgatctctgctgcgggagcggggatttggcgttcctgctgtctcagaaggtcggcttagatggagaggtgatggctgtcgatttttcaagtcagcaactacagactgctgctgggcgtcaggagcaacggtggaagctgtgttacaagaacatcaaatggatcgagggtgatgcacttgatttaccattcacagactgctacttcgatgctgtaacagttggctacggattgcgcaatgtggttgataaaccgaaagcgatgcaagaaatatatagggtcctgaaaccaggatcaagagcctctattcttgattttaacaagagctcgtcacttttcacagcatcattacagagttgggcgatagacaatgttgtggttcctttagctagtggctatggactaactgaagaatacaagtacttgaaaagctccatatcacagtatctaacaggagaagagttggagaaactggccagagaagctgggttctgtgcagcgaagcactacgagcttggtggagggcttatggggaatctagtagcgactcgatgagtagaatgtagaacggaaactcgagctgcatggttcctctgcatcattttagctgattgtacgctcttattctatgtatcggcctcagatgaggtcaatgacaggtgttgattccagaggggcctggacggcttgattatcactgtcttctgtttgaacctgcgcttctgtagagcatcgacgttgtgattacgatcaagatggaccgagacgctgacgcatgcttctgcagattacaccggcatgctgttctacagcgcgggagcattcaaaggttcttattaattatgcgttgcaatgtgtgagactgagagcatgtgggaatttcagcttttcactgtgcgttgcccattttgcccagaactgacatccagcttttcnaccgcgttgctcatttgctctgaactgaatcctttttccccctcagtaaaactgcgtgcagtcctctcctctaccctccggttctcccgtttactcggtccccattgcgacgggtgagatc

SEQ ID NO: 6397 - DNA, 1903 bp, Zea mays
aaaaaaaccaaaacctccactcttcctcccaccaaggcaccaacccgacgcaaagccgccggctttccccgatggcgacgacgatgtcagtttcggcggtgtccccgcccgccgcggctgtcacgcggccgcggacgatggtctgcgtgccggcgacggcgcgggcgccgcgggagatggcggcggagctggccgccgccgccgcgctcggcgccgacgtggcggagcttcgcctcgactgcctcgccgggttcacgccgcgcagggacctgcccgtcatcctcgccaagccccgcccgctccccgctctcgtcacctacaggcccaagtgggaaggaggcgaatacgaaggcgatgacgattcacggtttgaggctctgctattagcaatggagctgggagctgaatatgtggatgtcgagcttaaggtggctgacaaatttatgaaacttatttctgggaggaaacctgataactgtaaacttatagtttcatcccacaactatgagaccactccatcgtccgaggaacttgcaaatttggtggctcagattcaagcaacgggggctgatatcgtgaaaatagctacaaccgctactgaaattgttgatgtggcaaaaatgtttcaaatacttgttcactgccaggtgccaatcattgggctgctgatgaacgacagaggttttatttctcgggttctttgcccaaaatatggtggattccttacttttgggtcactcaagaaaggaaaagagtctgcacctgcacagccaactgctgcagacttgataaatctgtacaatattaggcagatagggccagacactaaggtctttggtataattggtaaaccagttggccatagcaaaagcccaattttgcataatgaagctttcagatcagtgggtttcaacgctgtgtatgttccatttttggtggatgacttggctaaatttcttgatacatactcttcaccagactttgctggcttcagttgcacaattccacacaaagaagctgctgttaggtgctgtgacgaggtcgatcccattgccagggacattggagctgttaacacaattgttagaagacctgatggaaagcttgttggctataatactgactatgttggtgctatatctgctattgaggatggaataaaagcatcagaatcagaaccaacagatccagacaaatcaccactggctggaaggctttttgttgttataggggctggtggtgcgggaaaagcactagcatatggggcaaaagagaaaggagcaagagttgtaattgcaaaccgtacctttgcacgagcacaagaacttgccaacttaattggtgggcctgcattgactcttgcggatttggaaaactaccatccagaggaagggatgattcttgcaaatacaacagccattggaatgcatccaaatgtgaatgaaactcctctatctaagcaagcactcagatcttatgctgttgtgtttgatgcggtctacacaccaaaagagaccagacttctccgagaagctgcagaatgtggagccacagttgttagtggtctggagatgtttatacggcaagctatgggccagtttgagcatttcacgggcatgccagtggatgattacaaattccgagcaattgcaagttcattggacaatcctaacaccatgaagcctcgtctgtgagagattcatccatgcccacaaacttccttgtttttcctttttagattcggattcagtgatcagtttgcctctcagccattgtaaattaatttgatgttccgagctgaaacattttggtgtgccttatttgtatcagcatgaacagcagtgggtttgaatcagtctcttcatatttgcgttccaaaaaaaaaaaaaaaaaacggcacgag

SEQ ID NO: 6398 - DNA, 1710 bp, Zea mays
ccccgcccgctccccgccctcgtcacctacaggcccaagtgggaaggaggcgaatacgaaggcgatgacgaatcacggtttgaggctctgctattggcaatggagctgggagctgaatatgtggatgtcgagcttaaggtggctgacaaatttatgaaacttatttctgggaggcctcctgccggcgggtaacttatagtttcatcccacaactatgagaccactccatcgtccgaggaacttgcaaatttggtggctcagattcaagcaacgggggctgatatcgtgaaaatagctacaaccgctactgaaattgttgatgtggcaaaaatgtttcaaatacttgttcactgccaggaaaagcaggtgccaatcattgggctggtgatgaacgacagaggttttatttctcgggttctttgcccaaaatatggtggattccttacttttgggtcactcaagaaaggaaaagagtctgcacctgcacagccaactgctgcagacttgataaatctgtacaatattaggcagatagggccagacactaaggtctttggtataattggtaaaccagttggccatagcaaaagcccaattttgcataatgaagctttcagatcagtgggtttcaacgctgtgtatgtgccatttttggtggatgacttggctaaatttcttgatacatactcttcaccagactttgctggcttcagttgcacaattccacacaaagaagctgctgttaggtgctgtgacgaggtcgatcccattgccagggacattggagctgttaacacaattgttagaagacctgatggaaagcttgttggctataatactgactatgttggtgctatatctgctattgaggatggaataaaagcatcagaatcagaaccaacagatccagacaaatcaccactggctggaaggctttttgttgttataggggctggtggtgcgggaaaagcactagcatatggggcaaaagagaaaggagcaagagttgtaattgcaaaccgtacctttgcacgagcacaagaacttgccaacttaattggtgggcctgcattgactcttgcggatttggaaaactaccatccagaggaagggatgattcttgcaaatacaacagccattggaatgcatccaaatgtgaatgaaactcctctatctaagcaagcactcagatcttatgctgttgtgtttgatgcggtctacacaccaaaagagaccagacttctccgagaagctgcagaatgtggagccacagttgttagtggtctggagatgtttatacggcaagctatgggccagtttgagcatttcacgggcatgccagctccagatagcttgatgcgtgatattgttctgacaaagacatagtgagtggatgattacaaattccgagcaattgcaagttcattggacaatcctaacaccatgaagcctcgtctgtgagagattcatccatgcccacaaacttccttgtttttcctttttagattcggattcagtgatcagtttgcctctcagccattgtaaattaatttgatgttccgagctgaaacattttggtgtgccttatttgtatcagcatgaacagcagtcatcgtgggtttgaatcagtctcttagcatttgcgttccctaaaaaaaaaaaaaaaaaaaaaaaaaaaaagaaaaaaagatacaaaaaaaaaaaaagtac

SEQ ID NO: 6399 - DNA, 3033 bp, Zea mays
cattgggtacctcgaggccggccggggtcactcgtccacacgcgaaggcacccagcagcagccgctcccgaactgaggaaccctaccacgcgggcgacggcggtgcgcgaccggtgacgggacagcggcagcgccccctcctccatctgctggtcccaccgcctcctgacgttatccgatactgccaatccccctcttcgccgttgacggagcttaccgaggaaagaagggcagggccatggcgggagccttcgctttccgcctcgtgcctcgcctcgccgcagagccggcggcgagggggaagggtggcggaggaggagccaaccgcgacgccggcagcagggcgctggtgtcaaagaaaccaaacaagcagcagcatttgtggatcaggaaggagacagctgggtcagggaagaaggctctccgtcttattgatgctgtttcgaagttaccaaatgaaagagaagctatttatggtgcattggacaagtggagtgctttcgaacctgaatttcctattatagcagcagcaaaagctttggggatgttgaaaaggcgacgacaatggttaagaataatccaggtaaccaagtggttgatgagcaaaggacaggtgctgacatggacaacatatgatacacttctgctcgcacttcttatggataaacgggtagacgaagctgagtcagtttggaacactgtaatacagactcatacccgctcagtgcccaagaggttgttctctcggatgatcttgatctacgacattcaccagcgcccagataaagttttggagatattcgcggatatggaggagttaggtgtgcgtccggacgaggatacagcgagacggatcggaaaggcattcgtggcttctggccaagaagaaaaggagaagcatgtcctcgagaaatacttgaagaagtggaagtacatccatttcaacggcgagcgcgttcgcgtgcggagggacggaccattggcgtagtgcccgttttctgaaaaatgctcgaacctatcagagtatcgtgccggtaggcggtagggcaggggagatgctgttactgccgctgtgacagtcaggcacatggatatcggcactagtccctatcctatgtatgtggaatggaacggaaactggagattggttccatggctctagcctgtggaggagacgagcggatggggggtggctggctactaccggcgagatagtgatttaataggcactacataggcgtccagtgattgcgatggctttaacttgcgtatgtgtctgcggaatggtcccgtgctatttcggtgacttgtgcttgtggaattgtgaacacccactggaaagtgtatatcatgagagggacgatacctgacgtctgggcccatggcttgctgatttcacgcaacgaaccattttctgcaaaaaaaaaaaaaaaagggttcacgtacttgttctgttcttgtgatctggcacagagctgttggcttatccatttctatgcccatccttcttcagcaaatgatcatgtgagttgcgttccgtttgttctgtctggcactcaacccacatggtgcgtgtcagtgtttggctgaatgatgttagagttttttttggcgtttatgataaggaacgctgctggagcttgggttcgtttcagccaggccaagcgacgggcgtggctgggcgacggaagcactggacagttgtgcttgccgcctggcaccagagcccctggcagtgtggcactagcaagcacccgcacgaagcgcgcgcggcctgcccgtgtcgctttcgccgtcactctatagtttgctagaggcttccggtctcccgcgaaacacgagagccacgtgggacgagccggtgtcctgatccggcggtcggcggcagtttcactcgacccggctggagcctctcggtgtgccgcacgagtggctcgaatgcgggcggtgtgccgcttcatcacctatccagttcagccccgacgcgtcctccccgtgggctgcgcgaactggccccggcgcagcgtctgttcctgcacctgcactcctcagagtctgctcgcgctgcatgcgatgcggtaggtgggtctgccgtcgtggcgtaaactaccggtgaattagcttttgcccttttagaaactcggcctggatcttggacgatagcttgtgccaagaggctcagatccgatcaacacgagacaagacttttttacactatttatattgtattatgaattacgaaagtttatcgatttgagtatatgaaaactgtaggtggacacgggtcgtagacaattctaaggatgtaatgcagttttgaaaaaaaaaaacatagttgacaattacacatgacacaaatactaaatcattattttatcttagcaaaaaccatattattgcttaaaaccaagacatgtttgatttcattggaaaaccaaagtatttgtgaagagaacagaagaaaactaagatcttaagtggactttccaaaactctaaaattatcatagttttaggtaaaatcatagtatttaaaactatgttttatctgtacaaactaaacttttttttggctttgaatatcataatatcattaaataccataatattgcctcaaagttgaaaaataccaagcttccaaacaaagtctcgatctagttacacttctttcgatgaaaacggcctataacactgcgttgactaattttcccacccattttttgtgtttacattgttatattttgtgtgtatagaaataggagagagatatagacagattttccactagttttccccaagggatccctttttttcattttctatgaatccgtatttatcctggtttcatttacagactgtgccaaacaattacacgttcaccatttaagcatgttaatatatactccatccgtaccaaaattgtatttgttttatttcttgatttttatgtatatattcaaataaataatgataaaacaaatacatatataaaacacaaatattaaaggctcgtttggatctcaatagctaagac

SEQ ID NO: 6400 - DNA, 4069 bp, Zea mays
cgacgggcaacgatggtcctggactcctgggtctcctgacgcacggtcgacgccggcgcggtcctggccctgcatggggcgccaccatcgccgcgtcgtcgccatcacacacgatatcgggtttgatcggccgggccggggggctacggcgtggacgccagcatcatgatcatgatcagctccggcgacggatcctctgcccggtcgagatccagacggctgcagcattcaatctagtttggtgcgggcagatcgtgccatcattcctcggtactccctcccgcgaccagcacagtgacgcacctcgcagtcgcagagacacagctttggcaacgaggtaaagtcgcctcgccgccgggcagctgcagctgcatgcacgtgccccattctagctcagaatgctagcggacgcgaggacaaaaccgtcaatgcatgccacacccacactctgccaccagtgccactgccaccctctctactataatctctttcagaagctcgtcaccgaccgagcactgtcgtccactccccgcgtcccgcccaagcaaaaaagcaaagcctgcaatggcatctgcagccaccgccgtggcgctcgtggttgttgccgccctggcctcgctgacgcagctggccgcgtcggagtgctcggcggcggaccgcgacgcgctgctttcgatccgcgcggcgctgtcggaggaggagcggcagctgggcgtgttctcgacgtgggcggcgggcacggactgctgcgccgggtggtacggcgtggcctgcgacccgaccacggggcgcgtcgcggacctgtccctccgcggggaggccgacgacgcggtgatggcgcccgcggggcggcccgcgtcgggggtcatgtccgggtacgtctccgacgctgtgtgccgcctggaccgcctctcgacgctggtgctggcggactggaagcggatctcggggcccatcccggcctgcgtcgccacgtcgctcccgtacctccgcgtcctggagctcccggggaaccgcctcacgggcgccgtcccgccgctgggcggcgggcagtcgcgcctcgccgtgctcaacctcgccggcaaccagctgtccggcggcatcccggcgtcgctcacgtcgctcaccgagctcaagcacctcgacctcgccggcaaccggctcagcgggcgcgtgccgccggacctcggccggctccggatgctcagccgcgcgctgctggcgcgcaaccggctgtcgggccccatcccggcgtcggtggcgtcgctgccccggctcgccgacctcgacctctccgagaaccagctgacgggcgcgatccccgagggtctgggtgccggccccgggaatagcggcgtgctcacgacgctgtacctcggcgggaaccggctgtcgggcggcgtcccggcgagcctgcttcggagcggcgggctcgggatgctcaacctcagccggaacgcgctgggcggcggcgtccccgacgcgttcacgccgcgctcctacttcatgctgctggacctatcgcggaaccggctcacgggcggcgtgccgcggtcgctggcctcggcggcgtacgtgggccacctggacctcagccacaaccggctgtgcggcaccatccccgccggcccgccgttcgaccgcctcggcgccgagtcgttcgtcggcaacagctgcctctgcggtggcccgctcggcaagtgcacgtgacacccctagcccgcccatacgcgggaagcatgtagacatattcgtgcggcttggttaacatgacatgcatcatgatgatttcgcggtgctgcatgtgcctgtctttttctttctttctttttatttatcttcttttgtttactttttaaaaatgcttgtggtttgtccatgtgtctgaacgaatggaagcaaaaattaagctcgtgtgtggataatgcccagccatgtcgtgtccgtgatgtgtcgttagagtcgccgtcacgttcacccatcccgagtctatcaggcccttcgcttccgggccacgcttggggtttgtccatgtgtctgaacgaatgaaagcaaaaaaaaaaaagtgtggttaatgctcagccttgtcgtgtccgtgcgttattttacgcacacgttcacccatcccgactcccgagtctatcagcccttcgcttcctccaccgccccccactcctcctcgttgctctgccattgcatttgtctgttcgtcatcaagtgcgtgctcagctctcattaattgtaaaaatgcggccgtcctactccaccgacaacgtaaataaggaggtgtttaggatgactacactttctagctctagtgacttatcaaaatgtcttctaaacatttaccgtttcagctttacgattttctggagcacctaataatctgctccattaactctacaaaattttctggagctaaacagggcctaaataactagcagaggcagagttcaaattccaagcaggtctcactcaacaaccgacagctagcgcgaccagactatgaatggttactgctgagtggccatgcactagctgttgctgggtaatgttaatcatggactatgtcttaatatgtagttatttagttgatgctggtaaaatttctttacagatctggctaaagttttaaaatttctagtttttgtctctaattaaaatgacaatcatttcccccttttttaaaatactagagagctcgccgaagtcgttgttgtgaaaactctacggaagtctgaaaacgcaattggtagcccatttcgtatcggccaccaagtctagcccgattcacttcgaaagcccacatcaagctcccagtgcagcccagtccagcctttctccgcctcccacaaactactcgtttatcatcggatgaggtatctttgaaatattacctcaacgagagattggcccttgtcatgagagaagcgaaaatcagactgtatcgaagggcaaaggttaaaaaccttctacaatgagatgacaatactcaatatttccatacggtagccattgtaaacgccaaaaatcaaatgatttataaattagtagatgataatggaacagacgttgaggaaacagagctgaagaaacatattactaaatattataaaagtctgtttgggaaactagaccagaacacagtacaattggaagagtcgtttactcatgacattcctcaggttactaactctgagaatgagattttgacagcgtcctttactgtagaagaagtgcacggtatttcacatggaacataataaagctctagggcctgatgggtttccagtagaattttatcaagtcttttgggaattgatcaaggaagacctgatggctatgctttctgatttccatgacaatatcctttcggcatatagtttgaattttggtgtaattacactaattcataaaaggataatgctatgaaaattcaagagtatcgccccatctgcctcttaaatgtgagctttaagattattactaaagtcctcacaggacggattggttcgatagaagataaaattattggaccttctcaaaggacattcatgccgaaccgtaatattttagaaggggtaattttgcttcatgagactattcatgagctccatagaaagaaaatggatggaattattcttaagttacatttcgagaaagcttacggcaaagttaaatagaattttcttcaacaagttgtacgtatgaacggtttctcaccaaagtggtatgaatggatacggaatatagtgtctggtgggcatgtgagcgttaaagttaatgatgacataggtcctttcttctgcacacacaagggtttaaggcaaggtgaccctttatctccaatcctgtttaatatagttgttgatatgctagcaattctaatgtctagagcgaaataaaatggacatttattggggatagtaccccacttggtcgatcaggggctatcaattttacaatatgccgatgacatggtgttattcatagatcacaatctagaacattccagaaacgtgaaattactcctttctatctatgagcagctatttgtgctaaaaataat

SEQ ID NO: 6401 - DNA, 852 bp, Zea mays
aacatcctaatcggggcactgattgggttggcagcgcgccgcggcagcagagggggagagagagaggcagagcgagcgagcgagagagcgctggtcatggcgtcactgtctgtcgccgccgtggcggccaccatagcgatgccaagcagcagcggtgggagagggcgccgtctcagggtcgcgtccatggccacccagaagggccagaagccgacgcccaagaccgtctccggcacgagaagatcgggcacgacgacggtgttcccggtgggcgagccgggcccgcggccggcgacgacgagcggcaaagcgccggttaagctgctgacgaacgtggagaagctgcggctgctgaccaaggcggagcgcgcgggcctgctgtcggcggcggagcgcgcggggctgtcgctgtcggcgatggagcggctgggcctactgtccaagctggaggagctgggcgcgctgtcggcggccacggaccccggcacgcccggcgcgctgcttgcgctcgcgctcccgctgctggccgcgggccccgccgtcgtgtacctcgtccccgaagagcaggcgtggcaggtggcgctgcaggccgtcgccgcgctcgtctgcgtggtcggaggcgccgccgcggtggccgcgtcccacgttcgtgtccaggctgcagggctcctccagctgacgagcgcatttgcagccgtacctaatttcccgtgcatggctaagcagagaattgctctatgcttataacgtaagcgtgcgttgccacgggaacatataatatcgcgataacttatatataacatgcgtggtatactgttattagcaaagatttcataatttatttatgatcct

SEQ ID NO: 6402 - DNA, 610 bp, Zea mays
  misc_feature (2)..(2): n is a, c, g, or t
  misc_feature (16)..(16): n is a, c, g, or t
tntttttttttttttntttttttttttttttttttttttttttttttttttttaggaagccaaagaagggagtaccattccactgtccagaattcaaatggttccaggaaaaaaaaaaactgcaactcgtgcgcttgggtgaaataatttcaccgttgcactaatcttggaccaatacttttggttgcgattctagcaagacaaacagtctctagagtctagatacgcttcaactgtccctgaccgaagtaagaacacatccaatgccaacaaaaaagggggtgtctctagttcacggtaggcaacttttgaaggctccctagatggccaccatatcaccacaggtgcgcatgaacaggatggatccagcgaacacaccaagagccttcgccaacttcttgtttttggcccagttcctctcgtcgtagagctgggagtacaggaacacggtgagcttgtcccacgcctccgtcaccgccgcaactggccccgccatgatcccgctctccgatcgccctccgcctcttctccgatgggtttctgaagggttttgctctttcgcctctagaaatgagttcgttgtttcttgcgctgcgttgcggcggtaatt

SEQ ID NO: 6403 - DNA, 1750 bp, Zea mays
gcatgtgtactttgtacacaaccaagaaagagcaaaatgaatgactaagcatcgcggtgacaaacgacggtgtcccggtcgtctgatcggcccaacaacacgaaagcctagctagcccacaaaaaaatcattaggtacttgggccagctattagatacgtactcctgtcctgtgcaaacgtacgacgacaggtatctaaatttgggcctagtaaacctggcctggtagtgaacttggataaaaggccagcgggcgaatcaagtcgggcttttctctttattacctttacaatagcaataacataatctatggttgtattaaaaacacggcagtttcattcaagattacagtttagtataatagtatgtgcgactagaatttttcactctcatgccaccttggttaattcattaatgtcgcttcgtattaaagctggttgtttagactctataatttacagagacataaacattcaggttaaagtcaagcgaacgttcagaaaaatagaggatttgcacacacccttcctctaaggctgctggtttcaacagctgtgctgcagctaatgcgcagtagctgattcttgaagaagctgcttcgttgggaagaaaaagaaaccacatgctaccgtgtcggccccctcgcgtccgcgtgtttcttctgcctttagttttggttcatcgcgtccgtccttcctcctccttcgccgcctcttgcgcctcccctcccctccccactcctctcctctctccccgaaccaaaccaaacccctcccactccaactcctcgattctcagagtgctgtacaagtgtctcgccctaccgcggccgtcaaaaatccgatctttccgccgtttccggaggccacacggctgcaagactgaccaatcccccgcggatcgagccgcagacgccagcagttcctgctcgcggaccgcaggcggggcccggacggagcatggggtcccgatccgccggcgcggcgctgcggctgtggctgctggcgctcctgctgggctgctgccaggggaggttcgtggtggagaagaacagcctcaaggtgacggcgcccgacggcctcaagggcacctacgagtgcgccattggcaacttcggggtgccccagtacggcggcaccatggtcggcttcgtcgcctaccccaaggccaacaggaaggcctgcaagagcttcgacgacttcgacatctcctacaaggccaagccgggggcgttccccaccttcctgctcgtcgacaggggaggtcagttaccggaatctcagcaccatagcacgacgcgattgcttttgcttctcctcctcctcacgcccgccggactggcggctggtctctgttaggtcacccatgcgtggacttgcgtttactaattacttagcgagtagcgagttggtaagactttagtatgcccagttgagttggattggatagagtgtatttgaaggtttgaccacagatgcctaattttctgtttatcagtcgtgaggaggtcttcaggtggatgtcttcaaggttggatctttccgtgcgattatgaggttactttggatatgcgttgacctgatttggtacaaagaccttgatatgtgcagaaagggaatttaacctgagagcttagcttactgtcactgtcttggttttggaccgtcctattgtgctccacttgcttttttgttttcaaccaacctgctagtatttatttaacacgacttcctgtctgctctcagatgttg

SEQ ID NO: 6404 - DNA, 2492 bp, Zea mays
gccggccgggtccggccgcgcttcgccgcctcttgcgatcccctcccactcttctctcctctctccccgaaccaaaccaaacccctcccactccaactcctcgattctcagagtgctgtagaagtgtctcgccctaccgcggccgtcaaaaatccgatctttccgccgtttccggaggccacacggctgcaagactgaccaatcccccgcggatcgagccgcagacgccagcagttcctgctcgcggaccgcaggcggggcccggacggagcatggggtcccgatccgccggcgcggcgctgcggctgtggctgctggcgctcctgctgggctgctgccaggggaggttcgtggtggagaagaacagcctcaaggtgacggcgcccgacggcctcaagggcacctacgagtgcgccattggcaacttcggggtgccccagtacggcggcaccatggtcggcttcgtcgcctaccccaaggccaacaggaaggcctgcaagagcttcgacgacttcgacatctcctacaaggccaagccgggggcgttccccaccttcctgctcgtcgacaggggagattgctacttcgcaaagaaggcatggaatgcacagaaagcaggagcagcggcaatccttgttgctgatgacaaagacgaacctctaattacaatggacaaccctgaggagggtggcaacacggattatttagagaacatcactattccttcggcgttaataaccaagagctttggggacaggctcaagaaagcaatcgacagcggtgacatggttaatgtgaatttggattggagggaggccctgccccatcctgacgagcgcgtcgagtatgaattctggaccaacagcaatgatgaatgtggcccaaagtgcgatagccagattgacttcgtcaagagcttcaaaggagcagcacaggtacttgagaagaagggctatacggagttcactcctcattacattacctggtactgcccagaggccttcattctgagcaagcagtgcaagtcccagtgcatcaatcatgggaggtactgtgcacctgacccagaacaggattttagcaaaggatatgacggcaaggatgtggtggtccagaacttgcgccaagtttgtgtctttaaggttgctaaggagcacaagaagccttggttatggtgggactacgttactgattttgcgattcggtgcccgatgaaggaaaagaagtacacaaaggagtgtgccgatggagttatcaagtcacttggccttgatcataaagcaatagataagtgtattggtgatccagatgcagatgaggaaaaccatgttctgaaagctgaacaggatgcacagattggcaagggttctcgtggtgatgttaccatcttaccaactctggtaatcaacaatagacaatacagagggaagcttgacaaaggagcagttcttaaagcactttgtgctggctttagggaaaccaccgagccagccgtttgcttgagtgatgatatacaaacaaacgagtgcctagagaacaatggtggctgttggcaagataaggctgccaacatcactgcatgcaaggatacattccgtggaagagtttgcgagtgtccagttgtgaaaggcgtcaaatttgttggcgatggctatactcactgtgaagcttccggatctggtcggtgtgaaattaacaacggagggtgctggaaagataccaagaatggtcggacatactctgcctgtactgatgatggctgcagatgccctgacggattcaagggtgatggcaagcacaaatgtgaagatgttgatgaatgtaaggaaaggactgtgtgccagtgcgaagaatgcagatgcaaaaacacgtggggaagctacgagtgcggctgcagcgggggcctgctttacatgaaggagcatgacacatgcataagcaaaaacggagcatcagaagccggctggggcttcctgtgggccgtcgtcttcggcctcgtcgcagcaggaattgcagggtacgcggtgtacaagtacaggatccggaggtacatggactcggagatccgcgccatcatggcccagtacatgcctctggacagccaaggagatgtccagagccacgcgcaccatattgagatgtgaggaggatgcatgcagacttgatgagaggagacggaggcttggtctagctagcttatataatacaccagaattagatgtgcatattcgtaacaatcttgtgtttagcacgcaaagtccttgaacatttggcgtctgtgttaggttgtaccatgacatggtcttgtttagcaataattgccgtcttttatttcggtgccaataaaggagatggcaaacgggcatgacttgtgtgttgctcagttgtgtctgaggtccatgatcagtggtaaaggaatctgagcccctaatgtaaaagaaaaaattgtgcctggtgtcaaaaaaaaaaccccatctaatttgtgccccgat

SEQ ID NO: 6405 - DNA, 1365 bp, Zea mays
ggatcaaaaaattggggttcacctcgaggcttcttcgccgcgtccctccgggccggccgggatctcgtctagccccggaaaatctctcccactccaactggtccatccgagcagtgtagaactctctccaacaccaacgccctaccccggccgtcaaaaatccaacctttccgccgttttcggggccgcacggctgcaagatcgatcaatcttgcgccgattgagccgcagacacaaccagttccgatccccagccggtgctcgcggaccgcaggcggagcccggacggagcatgggctcccgattcgccagcgcggcgctgcggctgctggtgtgcgcagcgctcctgctgggttgctgccacgggaggttcgtggtggagaagaacagcctcaaggtgacggcgcccgacgatctcaagggcacctacgagtgcgccattggtaatttcggggtgccccagtacggcggcaccatggtcggcttcgtcgcctaccccaaggccaacaggaaggcctgcaagagcttcggcgactttgacatctcctacaaggccaagccgggggcgttccccaccttcttgctcgtcgacaggggagattgctactttgcaaagaaggcatggaatgcacagaaagcaggagcagcagcaatccttgtcgctgatgacaaagatgaacctctaattacaatggacaaccctgaggagagtggcaacacagattatctagagaacatcactattccttcggcattaataaccaagagttttggggacaagctcaagaaagtaattgacaacggtgacatggttagtgtgaatttggattggagagaggccctgccccatcctgatgagcgtgttgagtatgaattttggaccaacagcaacgatgaatgtggcccgaagtgcgatagccagattgattttgtcaagagcttcaaaggagcagcacaagtacttgagaagaagggctatacagagttcactcctcattacattacctggtattgcccagaggccttcattctgagcaagcagtgcaagtctcagtgcatcaatcatgggagatactgtgcacctgacccggaacaggattttagtaaaggatatgatggtaaaggatgtggtggtccagaacttgcgccaagtttgtgtctttaaggttgctaaggagcacaagaagccttgggttatggtgggactatgttactgattttgccgattcggtgtccaatgaaggaaaagaagtacacaaaggagtgtgctgatggtgttatcaagtctcttggccttgatcataaagcaatagataaatgtgtttaaacacaataaagttggaactggaggggggaaaggagctt

SEQ ID NO: 6406 - DNA, 1278 bp, Zea mays
ttttttttttttttttgagcaagagcttgtatatcaaatatgtcaaggaatcacctttagtttccccttttgcgcagtatcaggcttacaaaattcaaaaccatactagtgaagaagagctagttacaaaatgtgcatcggtgtggcctagaagcaaaatgaatgttaactccaactgaagcttggggaaaaaatttggtatctgcagtctgttctcctgcatatctacgtaccctccctcgtcacagaaggtcaaatttgcacttctcgtagctcgggtctctggtgataatggtggcggtgccgccggtcgccttgttctgctgccagtagctgttgaacgcgaaggaggcgtgcgcgagcacggtgttggggtggtagcacgcgccgctgggcaggatggagtcgcactcggcgccggagccgcacgcgtagtccatggcctcctggatgatggggtccggcaccgtgggcttggccacgcaccacagcgtctgcccggcgcccggcagcatcggcggcgccagcggaggtgggtacacgatcggcggctggaacgggccgccgccgtcgccggatcccgagccaccgcctgagccggagccgggaccagggccgaatcctggcgggctcggcaccatgacgatgggggctcggcggcaccgacccaaacggcgctcccggacctgcctgcggcggcgagttcggtgtcgtggatgccggtgggcctccctggccttgacctcctcctccctggccttgatctcctcctccctggcctccacccggggcgccgttctccggcgggctgggctcgaaggacggcggcacgggggtgatcggcggcagcggcggcgcctgggcctggcccggcaacgaaggcgtggacgacgtggacggaggcgtcgtggatgacgtggatgacgtggacggaggcgtcgtggacgacggcgcgtctggtgggttgacgcagaacggcgagttggtgtcgcccgcggcgaggctgacggtggcgtcggcggtcggagtgggaagtcggcgcggtggctccaccgtgcggatgaagttgagcttgaacagcacgttgagcagcgggctggtgctcctgctcctgctcctgctcgccgccatgaccctcgcttcgcagcgagtggcgcagagcaggagcagcagcgacgccaccacgaagccggaagcagtgacaagcggcactgtgtccttgcgcgccatggctgccgccggccctccccggtacggtccctgtgcactgcagtctgc

SEQ ID NO: 6407 - DNA, 757 bp, Zea mays
actcctccgggcgggcgaaccccccccccgccccaggggcgtgtttgattccgaggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgtctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtagacttgctgtgctcttgtactctgaacctatgatgctccactccagagttaacagaccgtgtaataaagctccggattaggggactacaatgctgtactatctgtttcagatcccgttcggttagctgtgataagacctgaaactattccagctgatcagttttaatacaaataaaactatggaaccagttttaaaggaaaaaaaaagaaacaaaaaaaacccgccaacttgcggcc

SEQ ID NO: 6408 - DNA, 766 bp, Zea mays
  misc_feature (731)..(733): n is a, c, g, or t
attggccggccgggccgcgagggcccagccagacccaggtgcgtgtttgattccgaggcggggatgacgagcccaatggtggccaccccggtccagttccacacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaagtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtagacttgctgtgctcttgtactctgaaccaccgtgtaataaagctccggattagggtactacaatactgtactatctgtttcagatcccgttcggttagctgtgattaagacctgaaactattccagctgatcagttttaatacaaataaaactatggaacagttttagaggaaaaaaaaaaaaaaaaaggcccccagggcccaaaaaannnaaaaaaaaggaaaaaaaaaaaaaaaaggcccta

SEQ ID NO: 6409 - DNA, 778 bp, Zea mays
acacaaccggccgcctcagcttctgctccttttcctttcccagcgcatcagggaggcggcgattcgcggcggtgagggcgtccgcggagacgatggcgacggagaagctgggcatcaaggtggagcgcaacccgcccgagtcccgcctctccgagctcggcgtccgccagtggcccaagtaagtgagcgagcgtgcgagccgccctccctccctcccagccggcgtctcgatctcgaatctccccgccgccctccgcccgctccgtgcccgtgctgactgcggcctgctgatgaatgaatggaccgatcaggtgggggtgcgagaagagcaagttcccgtggacctactccgccaaggagacgtgctacctgctgcaggggaaggtgaaggtgtaccccgaaggccacggggaggagttcgtggagatcggcgcgggagaccttgtcgtcttccccaagggcatgagctgcacctgggacgtcgccgaggccgtcgacaagcactacaacttcgagtagccgccgccgccgactagccctgcggcgctcgatgtagacttgctgtgctcttgtactctgaaccaccgtgtaataaagctccggattagggtactacaatactgtactatctgtttcagatcccgttcggttagctgtgattaagacctgaaactattccagctgatcagttttaatacaaataaaactatggaacagttttagaggatcaaaaaaaaaaaaaaaaaaaaaaaaaaaaaaaacaaaaaaaaaaaaaaaa

SEQ ID NO: 6410 - DNA, 797 bp, Zea mays
cctgggccactgaccgctcactcctccgggcgttggggccctccaggccgggggttagttgctcaggggagatgacgagcccaatggtggccaccccggtccagctccgcagcaccggccgcctcagcttctgctccttccccagcagcgcatcggggacagcccccagtcggcggcgattcggggcggtgacggtgagggcgtccgcggagacgatggcgacggagaagctgggtatcaaggtggaacgcaacccgccagagtcccgcctctccgagctcggcgtccgccagtggcccacgtgggggtgcgagaagagcaagttcccgtggacctactccgccaaggagacctgctacctgctgcaggggaaggtgaaggtgtaccccgacggtcacggcgaggagttcgtggagatcgccgcgggggaccttgtcgtcttccccaagggcatgagctgcacctgggacgtcgccgaggccgtcgacaagcactacaacttcgagtagccgccgccgccgccatgtttggattgcttcctctagcttcctaccatgtgcttgtagacttgctgtgctcttatacacctatgctccattccagagttaaacagcgtaaaataaagctccggattagcggactacacaattcacaccaacgttctgtcaggcgtttttcctgttatgacaagtggaacttgtacatgttagtatgtgattcatgccctcaaggcctcaaactaaaaaaaaaaatcttggctcgaccgccgtccaaaaaaaggggcggccaaagcgggc

SEQ ID NO: 6411 - DNA, 7611 bp, Zea mays
atcctttatagtcaccctgcctgttagatgaattcaagaaatatatcttctggatgtaggttagcacgctggttgttgtctcatttggtgtggccgttgcaaccgttactgatttggagttcaatttctttggtgcttgtgtagcactagcttggattattcctagtgctgtaaacaaaatcctgtggtcaaatttacaacagagtggaaattggacagctcttgcgtaagttgttactgtgtttcatctcttttgtgacagcaagtatttccttaggttttatactaacctccagtttgtctggtcaggttaatgtggaagacaaccccaattaccatatttttctttattgttttgatgccattgttggatcctccaggccttttatctttcagttgggatttcaagaacagcagcacaattatcatatctgctttgttcggtttccttcttcagtggtctggtgccttggcacttgggtgagtcataaaaattgatgttacatgattggctttgcatttcatggaatcacatatctttttcttttccactttatttctctctcttttttacaaggacatggagatacatttgaatgcaagttttcactattttttatatttgggtattttaacttccatatggtggatatttgtgcatatctaatgtctagaaaatcctggttatacatgtctaggggtgacaatgggctctaaattttacactataaaatttaaggatcggatgggattaggatcgagccctatttctattcatttttaaactaaaatttattgagggccctaccattttgtgaagaagcatttggaacgagatctattaccacccttatgcatgtcagacatattcactttattaactaggagatatgagcacatagaagctcctttttcaaacctataaaaacaatcttaattattttaacgttgctgttaccaaatttgatattgcatacatgaacataataggatctgtaaactggacagacaagtagcatgcctttttaattgttttaacttgcggcattattttatatgccatatttctatgtccccgtggatgaaatattgctattatgcccaaacttgaagatagaaatatattagttaactttatgctgataaggccttttgaatccaactgacaagataacctttatttatcagaaaaacaataatcataatatttgtctccgtgacacccttttggtcttgaaagttcacatattttgggttttggaaatgacagtgtaaagtatttggtcattcattctcttcagtggctatcgaattttgcaaatttctggatctgaacataatttttcaatgtgttttggatgctgcagggcaacctcggctctcgcacatgttgtgctgggtcagttcaagacgattgttataatgctctctggttatctggtatttaaatctgatcctggattcaccagcctctgtggagctgttattgccctcgcagggatgtcagtgtacacttacctggggatgaaagagtcagccgccaacgctaggagaaattccttaaattcaaggcaaaattctcatttgaagaaggccaaggctattgtagatggagaaaatccagaaacaaagcctatggattctgtgtaaaatgagtgccgtcctcctgctaggtttaagaacctgccattggaagcaatgaggtttggtgagcatacttatggagtgagtttccttcaccaaccagttcatccgaaaacttaatttcactttctttagttcttgcttggagttctattattctttaggcaatggtggtcaaaattgttttcatcgttgatcacattcattgcacgtaggaattatcattgattctagttttaggtaactttggttactgttccaatccatatcctgtcatgctttatttgtttacttgccgtgtggattctgttcctcagaaaatagatgaaaggtggctgaaaatggttcctggttgaatttgacattgtgcatgtttggattctagtttctattttgtagtgtggagcattgtgtgctcatgacattgcgtttatgaaatctcacacttaaagacttcgggttcaacaattgttcataaaaggaaagaacgcacccataggcacggaaagagatgacaaaaatggaaatgtacaagcatgtcaaagcaggacaaataaagggtcaactcaaagctcagatcctaaaaagtatgcagcagtccacggaattactgaactgcatgaatcagccaacggagcaagcagcaaagctttggcatgtttgaagcacccccatgaatttctgaaacgaagggcaaagatttagaatgaaagtttacaaggacaaagctgtcagctgggttccgacctgaaggggtggtaatggatcgtgatctaaatatttcttcacaatttcttagactcctaaataatagttcaaaaatgaatagaaatagagcttaaccctaatgcgatctaatcattaaactatatagtgtaaaatttggactccattgtcatctctaactgctctccttttcttcaaatggaacttgcccaccttaggttgtggccagtagatcgtgtatatgaccatagaaaacactattttgtactattatacactttagactgcactatttacagaataaagagaaagactgctagaggtagctacaaataagtagttccggccgtccaatatactgagaaagttaaaaccaagaacgaagtacttgaagctaaccctcatggatgaatgcatcttatctataggtgcataaaaagattacaacacttcaaccttaaacaagtggggaaaacaaatattgattctaaggtacttaggtacatatcaattgaacaattcatttaatcacaatacaagcatacggtcaagggtcagcctctcatggttcctctgaagatggctgatggtttggaggttcaatttcaatgagtgcccacatcttcttcagacatggaacccactgttctccagtcctcttcatgacccgtgccattttatcgaaggacagcaagatgtgaacgacaatgtacatgaaaacagcaacgacgagcgcgaagacgtatacagaagtcttcagtttcctgcagctgccagcagcgtaagccccaagcagagcaagcaggtccagcaccattgccgttttcatggggaggagagacctcctgtacttgcttattgtgctgttgagcagcaggatgactatgaccaccgacgccatgaacgcggtggcgttgcagtagaagaatgccttgtatcgccgtggatcggcgtcatggaggatcgggtcgccggtgaaatggccgtcccggtcatcaggccaaagccctcctggcgggagcagcccagcctggtaggtgacgctcgccgcgaaggtcccaatcagaataagatcttttcgccatttatgctcaggtttctggctggccacgatgcttcgcttgccgtccttggatggatgcggactcttgaaaggagtggcacggagcacccactcgaagaagtagccaaccttctcttttgcaaaggtcagcaccagaagttgagccatgacgtaggcaaaaacaacagcaacagccaggatggcgtacactgaggtggatactctcctgcagcttcctgccgcgaaggcgcccatgagactgagcagatccagtagcatgcatccacgcagcaagtagccgttggtcccactttggcatagccttttgctaacgagcagcatgatcacggccaaggacgacatgaaagcggtggagtttaggtagaagaagaccacgtagcggcgtgggaactcatcgttgagcatcggatagcctgctcggtgcccatcgctgtcgtcgggccagaagccacccggtgggtttatgccagcctgatacgtgctcgacgctgccagaacagcaagcaacaccagaaacttgcgccgcttctccagatgtttcagttcagggtcgtcgccgtctacttcctgaaaagctgctggtccatcatcatcgccagagcctcgtcgtcgtgtgcacactaagagcaggacgtggaccatgacgtaagagaagacaaggaagaccaagatcatcacgtacaaagacgtggagaaggtccggctgctgccagcagcgtatgcccccatcataccgaagagggcgtcctccatgccggcctgcagcgcgtaccgtttcagggcaccggcagcgaccaagctgctctggagcagggcgatgatgaccacagatgacacgaatgcggtggaattgcagtagaagaacgtgctgtaccgcctcggactggtggcctccaggatggggttgccagcacgatgcccgtcctcattgtctagccaaaacccgccgggcgggttcaaccctgcttggtatgtaacggtggctgccaggatcccaagtagtagaaggtacgtgcgcagctttctcacatcattctgatcagtgcttgctaagacatgattggacgatggatgctgttgacccaaagctaatggctgctcctgctccttggttgtgctgctcaggaacgatttcagcttcagagtcagtttatccttttctcctttgatccattctatgcgctcgctgacaagctgtggcctgggtaggatgggtgcgacccactggatgacgagatacagtaggacagcagcgacgagggcgaagacatatatagaggtatggacttccctgcagctccctgcagcataggcagccatgaggccaaacaggctgacaagaacacacaggcgaagcgcattcgacctgacagcgcgacccgttgccgtgtcgctgaggagcatgacgaggatgacaagggacccggcaaaagctgtgtcgttgcacgccatgaaggccttgaagcgactggggtagtggtctctgagcgccgggtcaccggcgagatggcgagcgccgctgccgggccagaacccacctggagggttcagccccgctgcgtacgtcaccgtcgttgacaatgtggcgaggaccagtagcatgccgcgtttctgctccagctcttccgcctctttttcctggacacgagaagcatctggcatctgctccggttcttccctttttcgtcgtccctctggctcgtcgtcggttacgctcctgaacacgcgtgcgagagtgtccttccaggacctctggacgcccatgagtttttgtcgaagccatggagacgctaggtggcggaagaacacgacgtgaagcgcgacgtacgtgaagacaccggcgagcagcgcccaggtgtacagggacgttctgatctccctgcagctgcctgcggcgtaggcgcccatgagcccgagcaggttgagcaacatggcgaggtgcagcgagcggagccagactgcatggcagctgagcctccttaccaggagcagcatcaggacgatcagggacgccatgaacgctgtcgagttgcagtagaagaataccttgtaccgcttcggataggtggattgcaggacgatgtcgctggcaagatggccgtgctgctggtcgtcgttattgtctagccagaggccgcccggtggagcaagccctgcctggtaggtgatggttgcagaaaggattgctagcagcatcaagtacttccgcagcttccacaccagctctgcctcgtcagcgccgcttggcacttggtctccttgtcgccgtagttcgtcctgcagatccacgcttctctcagccacatggccgttgtttcctggctgcagctcaacctccatgcccatagggctcgacgaacaaaggcaaatcgtcgctgggtgccctaacgctgaggattctgaacacttgctctatttgtagtgttgcaggagtatttcagtactatatgccaaatcgtcaatatgctgtggccttgtatgtatcactgaatgttagactgatgtgtacgtagacataaacagtggcgttggatccaatgccacatttgaaaggatgttgtatcctatatggtaggcactatcagaatgatagaaaacttcggtttccgccaccaagaaagaaagaaagagtgcttgtttaaaaaaaggaaaacaaaacaatggtgcattccattcagtcggtacccacctttattgaacataggaaatgtctcctcttaggcagactattgtgattgtaagtgattggctttattcttttctacaacagttttttttaccgtcgaccacttgggacttcaagccctaccaccaagaacgcatccttcttattttctaatgctgaacttctcttaaaactcttaaaaattaatttttattttcggtggcctaactctgggcatcgaaaatatgtctgaccgtcgaaagtgatgtaaagtgctgttgtgtgtgatggattaacatttagatgtattgtgttgaactgtaaaaaagtatacataatcctgtgagtgcaatgacagtgagtttgggagtagggatatatatggaatgattggtaccggctgcgtcaacttgaggtcaggtccggtagatgcagtcaacgcttgtttggttgcttggacagtcttcgtggccaaaccgaattggttcccaaagcacctctcggctaggcccaacaggcacgtgggagatgaccttcccttcccttccctcccaaatcaagttggactgacgtgggcacgagaattgagatgtgtttttttagattttatgttatatctcttaatttatatatatcaaactaataaactgattccatcaccgtggtcatgacatttttatcgacaaaactagactacacttgttacataaattttactttattttattttttattctatatgcagccaaccaaacctgatctcttcccagcatggttcagtaaagaaaagtaaaactaaccatgacaaagtggttcgaatgagcttggttccaactcgatcaagtctggcaaggatcctaggtcaagtccagccaaccactcccatacttcccaccggcgtccataccaatggttggattcatccgtattccaggccggatagaaattgttcggttacaaatggatgaaaggagaataaatcttttatagtctaaattaaatagtggtgaaattaggcggacacggacggatagtacctcatcctgtatcttaccctaatgtatttaaaacagatttggcatcagatacagatagttagaaacgggacagatacgaataaagggaccggatatttattcgggtggataagtgacggatacgaatattatttggttgaatatcgaatacttgtcggataatgtattaattgcttatcataaaatatccttgttcgaccacaaaattgcaaataaattataaagactaataaacattttataagaagataacctcaagttgccacataaaaatggtacagtgaagtattaattatgttgaaacttggatacttagagtgatttcatatataactcacacaataagtggtaataaaatagaagaaacattgacatcttgtggattttatggtgtcattattttttatgactatatgtggtcatatgttgtatcttcgtataatttcatgaattac

SEQ ID NO: 6412 - DNA, 1800 bp, Zea mays
atctgctgatcctgaccggccgacccgtcggtccgtcgccaactcgtctgctcagcccatctgtatcacaattcccaagagcttgagctccaagtacccggcctgcgcccacggccgggcccaggaaccgccgttctgctgcaccggcggcggaagaagagacggatagcgtggggatccggctgatgcgccggcggcaatgggcatttgggattccattctccccggcggcggccggcgcttcatcaagcgcaaggacagcgacgccggtgaggcaggtcgggcactagaggaactgaggggctcactgtacaacgactttcatacttcagaaggggccaggcgccagcagcagaagctttgtggccctattgttgcactgacattcaactttgtggttgctgttgggattatcatggcaaacaaaatggtttggctgactttccaatcattttaaactttttatgtctgtctatttgcattccttttataaacgcctttccttgtaggtgatgggtgctgttggatttaacttcccagttgcactgtcattaattcattaccttttcgcttttgctttaatgtctgttctcaaggcattatacttgctgccaattgcttctccttccaaatccactcctttctcctcattatttgctttaggtgctgtcatgtctttctccactgggcttgccaatatcagcttaaagcataacagtgtaggtttttatcagatggctaagatagctgtaactccaaccatagtggtagcagaatttattcttttcaagaaaaaggtttcccttcgaaaggttagcacgctggttgttgtctcatttggtgtggccgttgcaaccgttactgatttggagttcaatttctttggtgcttgtgtagcactagcttggattattcctagtgctgtaaacaaaatcctgtggtcaaatttacaacagagtggaaattggacagctcttgcgttaatgtggaagacaaccccaattaccatatttttctttattgttttgatgccattgttggatcctccaggccttttatctttcagttgggatttcaagaacagcagcacaattatcatatctgctttgttcggtttccttcttcagtggtctggtgccttggcacttggggcaacctcggctctcgcacatgttgtgctgggtcagttcaagacgattgttataatgctctctggttatctggtatttaaatctgatcctggattcaccagcctctgtggagctgttattgccctcgcagggatgtcagtgtacacttacctggggatgaaagagtcagccgccaacgctaggagaaattccttaaattcaaggcaaaattctcatttgaagaaggccaaggctattgtagatggagaaaatccagaaacaaagcctatggattctgtgtaaaatgagtgccgtcctcctgctaggtttaagaacctgccattggaagcaatgaggtttggtgagcatacttatggagtgagtttccttcaccaaccagttcatccgaaaacttaatttcactttctttagttcttgcttggagttctattattctttaggcaatggtggtcaaaattgttttcatcgttgatcacattcattgcacgtaggaattatcattgattctagttttaggtaactttggttactgttccaatccatatcctgtcatgctttatttgtttacttgccttgtggattctgttcctcagaaaatagatgaaaggtggctgaaaatggttcctggcttaaaaaaaaaaaaaaaaaa

SEQ ID NO: 6413 - DNA, 1064 bp, Zea mays
  misc_feature (17)..(17): n is a, c, g, or t
  misc_feature (24)..(24): n is a, c, g, or t
  misc_feature (972)..(972): n is a, c, g, or t
  misc_feature (1003)..(1003): n is a, c, g, or t
ccggccgggactatccncggctcncattctgaaaaaaaaaatcgcagtagcctgtagaagacttacttgctagttgaatcccagacggactgcatggtagtggaggttgacaacgacggctgtaacataaaactatcaactttttttatgaagtgcaagctttaacttaattagtagtagaaagtttatcttgcctgcgtgcagcgggttatatcacaccatcagtttttacctccacatacttttttttttgtgtaacttgaagtgaactgcggatcttggtggattagttgttctaaatctcaatttcatggcaagtagtagtattacaatctcttgcaagtgttaccttatgattaagatgctggcaagtgtcacttgttaaagaaaaaacggtagcaggtatataaggcataggcattaaggataacggtgacacataggacttgatcatgttttgaatagcttatcatgacagcctacacttccttgaatcctagcagcccgccacccccctgtcacttgcaatgctttctcagtggcctcatcattttgttcacaccctattgcgctacccctgtttctgctgttacttgcgatgctttctccatggcctcacatcattttattcacatcctgttctccttttgtttttcaggaataaaaaaggggtggagctgagcttggtttgtcataatagtgttggaactgttgatgcgagccgttaggcatggaccgaaagtaatagctgtaatccggtcggtggaggcagtatttagatgcatcatcacacctggacagacgtggatgtaggctgcgtccttttgtgttcctgttttcgctaagtgtgttcttgtggttttagatgtgcagccgtgcagtgctgaacttactaatgaactggtaggtcagcctgaagtagttttgataaaagcagttgccaaagagtctgcaggtcggcacgatcgcctngctatatgtgcatgtccctgctatctttcgnaaaaattggggttgtgcataaatctgttcttccccttcttttaaaaaaatatgttcctact

SEQ ID NO: 6414 - DNA, 4357 bp, Zea mays
  misc_feature (1180)..(1180): n is a, c, g, or t
  misc_feature (2589)..(2589): n is a, c, g, or t
gtgttagtttctagagactaatttttaatctttttattttaatctatttagtgtctaaattattaaatacgaaaataaaactatattttagtttccgtatttggtaatttagagactacaataaagtaaaacagagggactaaaaattagtctctacaaactaaacacgctctaaatagcctgataagccactctaaacaagatctcagtgtggttaattggatggttctcgcgtaggtgatattattggtctttttatatatatgggtcaatgcaggtagataatttgcaaaataagtcaaaccggaatcggtcaatgttgatgattgatgaataattgtttttcagcttgtgatgcgctctccatcgaagtgattctagatgatctggaatgagcatcttgtgctggtggcaaatggcatgagctagtgcggtgatgctcgttagatggagcacctccttttggatacgcatagaaatagaaggatgtgaaaagatatgtatagtttggaagatatgacggtacttacgaacctgttcagtcaacacgtacacatttttggcgactggtgagtcgtgaagtgctactgttgtgtaaattgcaggtgtcgccgttcactgtgaagctgagtaagggattcagggaatgtacaataatgcaagtaaatgtgaatactttctccttacctcgaaagcgaaccttttcctttgattaataacatctataaaatttatatagaccacctgtataaagtttagaatactttcataatatatatttttaagtttagataatgcatttctaaaaaggttacccctccgtttctttttagttgtcgctggatagtttaattttgcactatctagcgacaactaaaacgaaacggaagaaatactagtcaaagtgatatcttctagattttacgtaaatttatctatttttttgtttgcataacactatacaaaccaacctaaatttaataataaagaaaatattagtcatatccctgtgcattgctatgttttttatatattatataaatattgttttttaatataacataaaaatatatgtgttttattgattagataattttcgaatctttacttgtgcataatttattttatttttgtataaagcgggaaggtaaacagaacttgatctgatgaatggcctacnatccatcacgtggatgttatttttctactgatgcctctattctaaattataatttattttaactttataaataattttagtttttaaaagtttacaagttcactggaaagacaccatcgtttgtaacatcaattgtttcaataaattatgttatgtattaaatacattttgaaattgcatttaattaaagtatagatgttaacataattttaagaaaaaacttaatcaaaatcacaaaaatttaacttactacagaatcaatttggaacaaatgcagtagttcgggtttagattatcttttccataaggttttcacctttgagttgtaatttggcggggatgacatttgtcaaaagtagactgaacatcaggtagagttgtatcaaggccaggttatagattgtttggcacagtccacaattaattcgtatatagtgtcgggttgggtcaggttggtctgtgccttcctgtggaacgcgtcgtcgagtcgttttttttttgctttgggtcgtgttttcggttaggtcgtgttttggataaaaaatcatggattgtatctatgccatggattgttgcgggccaaaacgtatggtctattcccgcccatcatattgtttgggttaggtttttttggcgagctagaccagggcgatcgagtcgaggggcccatacttaagtacagtaaaaaaattatctatagttatgatattcgaacttgtgttaccaataatttatttctatgtttttttattaattcctataacaacatgagtgagtctaaaaaatgaaactagtttgggaaacaaatgacacataggtactataacgacatgccagctaaaggggcagctaaaagcaagatagctagtgtatccaacagggaagacatagagagcaaccattttagataagatgacaaaaaaggttaaataaaagctagcaaggggtatctattttcatacatgtctctatgatagagaagtaccaccatccaccaacccaataccagtactatttgacataaatatagatcgtaaaatggcttctctcctgaatacactaacaagataaccaactaaactattgatggcagccacgatgtttggttccactcaaataaagtttagtcctattacatcgatgatagttgagtcttacatatagtctaattataaaaataattacataaataaagactaaaagacgaaataaatatattaatcctaactaagactatatgtaatacttatacttgatatccaaatatttgatttaacacaatctaaacttttgtctgttgaactaaatacttcctaaatgtcgctaaaatgacttctttctaatggaggccaaggcttgaattcagagtcgtccttgaaatttcgcgagtattatcaaccgcttaagantatgtacaattctaaaacggtggttcggtttttcaactacaaaagacagctaagagactatatgatataattctgatccactaaatcataaatacaattaaaaacattatgtataaagagtcatataaagagagtccatcttttttttcacttataaactcttaaaaccccctcaaaagcgtgtacatcccctagctatgcactattgcactctgccaagtctgcaggaggatgaaagcgaaacacaattttctccatccagcccccttaagatctaggaaatagcgataccgggctccgtcgaggcctttaaatgccggcacagatgttggccggagcaggacgccacgaggcgaacaaccaactgcttccttccgcgccgccgccgcctacaacgaccacttcacgtgacttacctcttctccgcctcaagtgttcacggctccatcctctctagagtctaagcccatctcgcgaagccgctaacgccgaaaacgaccctacatatggaggcgaagaagtcgggtcccgccgctgccggagccgcggcgccgccgccggctaacgggtacttcagcaccgtcttctccgcgtcgcctgcggtacggggccgtctcttcacaccatcgttctgatggattcttggggtcttagggatctttttcgtggttagtgaattggtgcgatttgctgatgagtccgttactatgttacgatttgcggagtgagctcaacgttttttttctcaatttaagtctgatgatgagggataattttgataacagagggagctatatgattctgtaaaatctatttggatatgacgctgacactgtggcttctgttttgcattcaaggggagcgcaaatgacgcaaagcaggccgacctgtacacgatgctgaacaagcagagctccagagggcagaatggcagtggcattacaggtagttctgggtactcctgtctatttgatatatttctcttcgatttaggttgtgttcacaagcaaagcgatacttagaacctttttttaccatcttagcttagcattaatctggagcatcccgagggcagaatggcagtggcattacagatggcaaatcacacggccgccctacttacaaggatggaaaacatgcttatccaaatgactcgtcagaatccccttacttcggttcgtccgtgcattacggtggtcgggaattctacagcagcacgttacagaagcagccagccaatgaaccccagacaaaatacaaggaggacaagccggatggctctgctactagaggtgattggtggcaaggttcactttattactgaacaatctgctgggaactctccttttttttgtgaacaaggaataaaaaaggggtggagctgagcttggtttgtcataatagtgttggaactgttgatgcgagccgttaggcatggatcgaaagtaatagctgtaatccggtcggtggaggcagtatttagatgcatcatcacacctggacagacgtggatgtaggctgcgtccttttgtgttcctgttttcgctaagtgtgttcttgtggttttagatgtgcagccgtgcagtgctgaacttactaatgaactggtaggtcagcctgaagtagttttgataaaagcagttgccaaagagtctgcagctcgcaggatcacctgctatatgtgcatgttcctgctatctttcggaaagatttgggttgtgcataaaaaaaaaaaaaaaatttttttaaaaaaaaatttggttctact

SEQ ID NO: 6415 - DNA, 1159 bp, Zea mays
  misc_feature (116)..(116): n is a, c, g, or t
atgctacgccaagcccgcaattaaccctcactaaagggaacaaaagctggagctccaccgcggtggcggccgctctagaactagtggatcccccgggctgcaggaattcgcacganaccattacctagaacatccccggccgggaggacccccgaggcgaacaaccaactgcttccttccccgccggccgccgccgcctacaactaacacttcacgtgcccccatccttttccgcctcaagtcaagtgttcacggtccatcctctcgagagtctaggcccttctcccgaagccgcagacgcagaaaacggctctacatatggaggcgaagaagaagccgtcggcccccgccgccgtcggagccgcgccgccgcctccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgctcatccaaatgagccatcagaatctccttactttggctcatccgtgcattacggtggtcgggagttctacagcagcgttttacggaagcaaccagccaatgaaccccatacggattacaagggggacaacccggatggctctgctaccagaggtgattggtggcaaggttcactttattactgaataatctgctgggacctctcccttttgtgaacaaggaataaaaggggtagagctgagaatggtttgttgtagtgttggaagtgttgacgcgagccgtcaagcatcgatcaatagtaatagttgtaatagttgaaagctgcgtcgtgactacaagcatcctgttggtggaggcagtattttagatccatcatcacgcctggacagatgtgggtgtccttttgtattcctgtttccctggtttaggtgcaggtgctgtactaaaatgatgaaactcgcagttcgataaaagcagttgccaaagagtcgcagctggcaggattacttgtctacaagccagctatatggcatggtttggcagccaccgtatctgaataaaatcatagtacaaaatctctgaatatatatgtcatacgcaaaaaaaaaaaaaaaa

SEQ ID NO: 6416 - DNA, 1107 bp, Zea mays
cagctacgtaggcccccccccccccccgaggcctttaaatgccggcacagatgttggccggagcaggacgccacgaggcgaacaaccaactgcttccttccgcgccgccgccgcctacaacgaccacttcacgtgacttacctcttctccgcctcaagtgttcacggctccatcctctctagagtctaagcccatctcgcgaagccgctaacgccgaaaacgaccctacatatggaggcgaagaagtcgggtcccgccgctgccggagccgcggcgccgccgccggctaacgggtacttcagcaccgtcttctccgcgtcgcctgcggggagcgcaaatgacgcaaagcaggccgacctgtacacgatgctgaacaagcagagctccagagggcagaatggcagtggcattacagatggcaaatcacacggccgccctacttacaaggatggaaaacatgcttatccaaatgactcgtcagaatccccttactttggctcgtccgtgcattacggtggtcgggaattctacagcagcacgttacagaagcagccagccaatgaaccccagacaaaatacaaggaggacaagccggatggctctgctactagaggtgattggtggcaaggttcactttattactgaacaatctgctgggaactctccttttttttgtgaacaaggaataaaaaaggggtggagctgagcttggtttgtcataatagtgttggaactgttgatgcgagccgttaggcatggaccgaaagtaatagctgtaatccggtcggtggaggcagtatttagatgcatcatcacacctggacagacgtggatgtaggctgcgtccttttgtgttcctgttttcgctaagtgtgttcttgtggttttagatgtgcagccgtgcagtgctgaacttactaatgaactggtaggtcagcctgaagtagttttgataaaagcagttgccaaagagtctgcagctcgcaggatcacctgctatatgtgcgtgttcctgctatctttcggaaagatttgggttgtacataatctgtccttacccttcttttttaaaaaaaaattatgttcctactattcttactaaaaaaa

SEQ ID NO: 6417 - DNA, 1096 bp, Zea mays
gtggcctcgtctccttccccacttcggcctcggcagttccgacttccgcgtgccggccggagcctcgtcccgcttcgcatctcgcacttcgcgccttcgccgctgcgattccttagcagctcctcggccgctccacccacccctgcgccggcgagatggagctcaagcccggcatgtcggcgctcgtcaccggcggcgcctccggcatcgggaaagcactttgtattgcttttgcaaggaggggtttatttgtgactgtcgttgatttctcagaggaaaatggaagagaagttgctacattagttcaaaaagaaaatagcaaatttcacggagatcttagaattccatcttcaatatttgttaagtgtgatgttagtaatgcagataatcttgctgcttgttttgagaagcatgtacagacatacaatggactagatatctgcatcaactgtgctggaattgctaataaaacactagtttatgatgatacatctgatggaactagaacatggaggcatgctgttaatgtgaaccttgttgctgtcattgatggtactcgcattgcaagtcaaataatgcgaaaccaaaagaagcccggtgtcataataaacattggttcagcggcaggtctttatcctatgttcctcgatcccgtatatagtgcggcaaaagggggtgtggttatgtttacaagatcactttctccattgaaacgccatggtgttcgtgtcaatgtgctctgcccagagtttgtccaaaccaatatggcggaacaaatgagccgcaaagttatagattcatctggtggatatttggagatggaagatgttgttaacggtacaccatttctgtaatgtagtgttattacaggactattagctttgtaaccatattttatgtgccatgatgatcaatgcaagcgtcggatgacttgttttaaacttctagtgttatgttgaggtggggtgttttaaagatgaactgcacaaaaacatttgttagcactgtaaaacatgtgaattccattgatataaattcaataatgtacatggtaggttgtgtaacctgcatgaataaaagaaaaaaaaaaaaaaaa

SEQ ID NO: 6418 - DNA, 877 bp, Zea mays
cggaactgggacagcaaaggaagatacggcgcgatattttagattacaggagagtaggagaccggcgccgaaagctccgtggcctcgtctccttccccacttcggcctcggcagttccgcgtgccggccggagcctcgtctcgcttcgcatctcgcacttcgcgccttcgccgctgcgattcctcagcagctcctcgaccgctccacccacccctgcgccggcgagatggagctcaagcccggcatgtcggcgctcgtcaccggcggcgcctccggcatcgggaaagcactttgtattgcttttgcaaggaggggtttatttgtgactgtcgttgatttctcagaggaaaatggaagagaagttgctacattagttcaaaaagaaaatagcaaatttcacgaagatcttagaattccatcttcaatatttgttaagtgtgatgttagtaatgcagataatcttgctgcttgttttgagaagcatgtacagacatacaatggactagatatctgcatcaactgtgctggaattgctaataaaacactagtttatgatgatacatctgatggaactagaacatggaggcatgctgttaatgtgaaccttgttgctgtcattgatggtactcgcattgcaagtcaaataatgcgaaaccaaaagaagcccggtgtcataataaacattggttcagcggcaggtctttatcctatgttcctcgatcccgtatatagtgcggcaagggggggggggggttaatgtttacaagatcactttctccattgaaacgccatgtgtttcgtgtcaatgtgctctgcccagagtttgtccaaaccaatatggcggaacaaatgagccgcaaagttatagattcatctg

SEQ ID NO: 6419 - DNA, 965 bp, Zea mays
cccacgcgtccgcccacgcctcgaggccggccgggccgggaggacgccacgaggcgaacaaccaactgcttccttccccgccgccgcctacaaccaacacttcacgtgcccccatccttttccgcctcaagtcaagtgttcacggtccatcctctcgagagtctaggcccttctcccgaagccgcagacgcagaaaacggctctacatatggaggcgaagaagaagccgtcggcccccgccgccgtcggagccgcgccgccgcctccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgcccatccaaatgagccatcagaatctccttactttggctcatccgtgcattacggtggtcgggagttctacagcagcgttttacggaagcaaccagccaatgaaccccatacggattacaagggggacaacccggatggctctgctaccagaggtgattggtggcaaggttcactttattactgaataatctgctgggacctctcccttttgtgaacaaggaataaaaggggtagagctgagaatggtttgttgtagtgttggaagtgttgacgcgagccgtcaagcatcgatcgagagtaatagttgtaatagttgaaagctgcgtcgtgacttcaagcatgctgttggtggaggcagtattttagatccatcatcacgcctggacagatgtgggtgtccttttgtattcctgtttcccctgtgttcttgtggtttaggtgcagtgcaggtgctgtactaaaattatgaaactcgcagttcgataaaatcagttgccaaagagtctcagttcgtaaaaaaaaaaaaaaaa

SEQ ID NO: 6420 - DNA, 1265 bp, Zea mays
gaccaggaaaagcacgcgagagcttgtcggagggctctctgtctctgtgataaaccgatacgcagaggaagctgcggagaggtgtccctgctctgccggtgagctgcggccagcgggtgaagagaagtggaccggacggggacgaaggagagagagaagaagaaaaaggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggctttccggccgccgaccaccatgaacttgctgtccgcgctcgacgcgccggccgaggagcccagcgacgcggccaaggccaccgtcggggagccagaaggccatggcccgcgcaccggcggaaatccaagggaggcagctggggaggaggcgcagcagctgaccatcttctacggcggaaaagtggtcgtcttcgacaggttcccctccgccaaggtcaaggacctgctgcagatcgtgagcccgccgggggccgacgccgtggtggacggtgccggtgccggtgccgctgtccctacgcagaacctgcctaggccttcacacgacagtctctctgccggtaaagcctcagctcctccctctttagtacttttcttactacgttggtgagaaagaaaaaaagaaatgctgctgttggtttcgcacgactttgtcggtgacgccaagtgttattgatcatttttgctctgtgacagatctgccgatcgcgaggcggaactcgctgcacaggttcctcgagaagagaaaggacaggtaactgagtcgtttttttttgccgaattctcagtgatgcatggaggacagttgcgttcaggatcaccggctgtgggcggaatcaagttcagataagcagagttctgacgaagttttttttttttgttccaaattccaggataaccgcaaaggcgccgtaccaagtcaacagttccgtcggcgctgaggcgtccaaggcggagaaaccctggctgggtctgggccaggaacaggaaggaagcgacggtcgtcaagcaggagaggagatgtgatcgatcagtagagactagattcgttcgtgcgcgcgtcgtcgtagcttcaggttaagggaaagaataatccaaccgtcggttaattgctcggcttaattacactgctctactacgtagtactggcact

SEQ ID NO: 6421 - DNA, 2895 bp, Zea mays
atattttgattttggaatgttttttgctccaacaaattttatagaagctgactgaaaagctgagcgtttggcaatccgcagcagcttttggtagccagaagctgccagaagcccaaacaaacaggcccaatgtaggcgggccgggcctgtctaatggtagctagctagctagctagtctaagaaaaccaacaatcgtcgtggcatcgtcgcaaaccaaagttctggccctggctgtgtaccacagttcagtgtaactgttcatccacggtctgaaaccttcgaccgtctccctatttgaatgaaaaaaagaaacttaccgaattagaggtaacttcagttgtctatagcaactacactgtatatatagtagaaccgtcgcaagcgtataccgcggcgtgacgtacacggcacaggcaacacgcggtacaccgctgtcctgaggtggcgcgtcccgtcttctcgatgtggccattgccagtaccacacccgtcgctgccatcgtcgcgtcctctcatcgtccccggcgcgcgcgcccctcctcccagatcacgtgtcgctaccacgccttcccgtcggggcgtccctctcgctcgcctgcccctcctcctcctcctcctcctcctcctccgtccgatcacgtcgccaccgcggcccctcggacccgtcgctctcccacattcccgttccccgaggaccaccatcctccgttccggcggcagccacgtttttcatgcgaggcgaaaggcggcctagtcgcaaaggccattttctccgtggccccccccacactcgccgtttccttggcacacgcgctattattaataaaggcgcaaaggccattcgcgaggcgaggggaggagaagtgtactacgcgagagcttgccggaggctctggatccctgtgataataataaactgatataagcagaggaagcggggaggaagctgcgagttggagggggccgggagaggcgtctctggttattgcttgtccctgcttcccggtgagctgctgggagtggacgggccgggaaggagacgagaagataagggcgccgcgcgcggccatggctggaagtgcgccggcgacggcgatggacaagaccagctttgccaccacgtgcagcctgctgagccagtacgtcaaggagaagaagggcggcctgctgcagggccttggtgccctcgccatggcgccggcagctggtaagggcaacagttctttcgtcgtgcgatccgctcctgtccgttaagtgccacactgccatgcacgaataagctagcttccccgtagacactaacactaccgtcaatgaacaataccgttctgcttatcgcacatcgatcgcgctcttcccatcgtcgcaggagaaggagctttccggccgccgaccaccatgaacttgctgtcagctctcgacgacgcgccggccgaggagcgcagcgagaaggccaccgccggggagccaaaacaccaggacaaatgcaccggcggaaatccaaggtatatatattgatgacgaaggaaggaaggaagcaaggtcgtgtgccttgaattaattaaccggaagaacaacactgcacgctcgggttcaaaagaaaaaggaaggaataacagcaaggtgtgagtgtgacatgtcgttcttgtcgaatacagtttaaaaagagaggcgttttggttcctgtagggaggaggcagccggagaggaggaggaggaggcgcagcagctgaccatcttctacggcggcagagtggtcgtcttcgacatgttcccctccgccaaggtcgaggacctgctgcagatcactgagccctggcggcgaccgcgtggacagggcaggcggtgccactgtccctacgcggagcctgcctaggccttcacacgacagcctctctggtaaagcctgtctgctcttgcagttctaccatggcgtcggcaacggcaacacgagtacttgtcggttacacaagtgcctttttttttgtgctgtgcgacagatctgccgattgcgaggaggaattcgctccacaggtttcttgagaagagaaaggacaggtaacggagtggtcgttcatatgcttttcttttctctcgggttttcagtgatggagaacagttgcattcagaatcaagtcctgacatactttgtgtgtgtgtgtgttttcattcgagttccaggataactgcaaaggcgccataccaacaagtcaacagctctgttgttggcgtcgaggcgtccaagcaggcggctggagctggggtggaaaaaccttggctggggctgggccaagaagcgacaacagcgaagctggagatgtgatgaatgttgcccgacaagaaggtgcagtgcacgagattcacggatggtgcaggtcgtagcttcaggttaaggtgaaggataacttaccgtcgggtactctactcactttactgctctactactactactgctggtgacgaagttagcaagaaacgttcttctgctaccggtgggtcggtcggtcagccgttcgttggcgagattgtttgctgctggagacggacgtgctcgcagcagtttcgctggtccgtgaccgcgccatatgttgccacgaatggttggttgttcggtacgttgaggaacgatgtgtatgtagtgtgcacgtttccggtgcatcttgttctcctcaagcctgtcctgtatgtttacccccctgcaccccctcctccctctttgtagagagagggtctgtatgttcagtggaagatggttgttctatttgatttttattttatggacatgtatgctcggtgatgtgttgtggtatgctgtatatcgggtatatcataattacgagggtccagagttatatccctaagcatgctcaacgtcatattttctcatatacttag

SEQ ID NO: 6422 - DNA, 1466 bp, Zea mays
gcaaaggccattcgcgaggcgaggggaggagaagtgtactacgcgagagcttgccggaggctctggatccctgtgataataataaactgatataagcagaggaagcggggaggaagctgcgagttggagggggccgggagaggcgtctctggttattgcttgtccctgcttcccggtgagctgctgggagtggacgggccgggaaggagacgagaagataagggcgccgcgcgcggccatggctggaagtgcgccggcgacggcgatggacaagaccagctttgccaccacgtgcagcctgctgagccagtacgtcaaggagaagaagggcggcctgctgcagggccttggtgccctcgccatggcgccggcagctggaggagaaggagctttccgaccgccgaccaccatgaacttgctgtcagcgctcgacgacgcgccggccgaggagcgcagcgagaaggccaccgccggggagccaaaacaccaggacaaatgcaccggcggaaattcaagggaggaggcagccggagaggaggaggaggaggcgcagcggctgaccatcttctacggcggcagagtggtcgtcttcgacatgttcccctccgccaaggtcaaggacctgctgcagatcatgagccctggcggcgacggcgtggacactgcagccggtgccgctgtccctacgcggagcctgcctaggccttcagcttcacacggcagtctctctgatctgccgattgcgaggaggaattcgctccacaggtttcttgagaagagaaaggacaggataactgcaaaggcgccataccaacaagtcaacagctctgttgttggcgtcgaggcgtccaagcaggcggctggagctggggtggaaaaaccttggctggggctgggccaagaagcgacaacagcgaagctggagatgtgatgaatgttgcccgacaagaaggtggtgcacccccagtcaggtgcacgtcgtagcttcaggttaaggtgaagggtaactttccgtcggttactctctactcactttactgctctactactactgctggtgacgaagttaggaagaaacgttcttctgctaccggtgggtcggtcgatcagccgttcgttggcgagattgtttgctgctggagacggacgtgctcgcagcagtttcgctggtccgtgaccgcgccatttgttgccacgaatggttgttcggtacgttgaggaacgatgtgtatgtagtgtgcacgtttccggtgcatcttgttctcctctgcctgtcctgtatgtttacccccctgcaccccctccttcctcttttgtagagagagggtctgtcagtgggagatgattgttctatttgatttttattttatggacatgtatgctcggtgatgtgttgtggtatgttgtatgtcgggtatcataattatgagtaaaaaaaaaaaaaaaataaaaaaaaaaaaaaaaaa

SEQ ID NO: 6423 - DNA, 1993 bp, Zea mays
tgctgcctgcaggccgctgcagcgtatcccgccgcgcgcgcgtgatggcacaggcaacacgcggtatcaccgctgccctcgggtgacgggtcgcccgtcacgtctcgctcgctcagcacaccacacccgtcgctgccatcgcgtcccctcctcggggccggccggccggccgccgggggaccgcggagctgggactgggagacccacacccagtcaaagaatccccctcgcgcgcgctcccgcccagatcacgtgtcgctagcacgcctttgcgcctgatcggggccgtcacggacccgtccggccgtccctgtcgcccgcaccctcctcctcctcctcctccgtccgatcgcgtcgccaccgccaccgccaccgcggctcctcctccgacccatcactctcccgcattctcattccccgaggaccaccactcgttccgccggtccgtcacgtgtttcatgcgacgcgactcgcctcgcctccgccccggccccggcccccgaccaggctggccccgtcccacttgccggttcattggcacgcgctattaaagggggggcaacccgcccgtccccccacgcgtccgcgcacgcgagagcttgtcggagggctctctgtctctgtgataaaccgatacgcagaggaagctgcggagaggtgtccctgctctgctggtgagctgcggccagcgggtgaagtgaagtggaccggacgtggacgaaggagagagagagagagagagaagaaagggcgccgcgggggccatggctggacacgcgccggcgagggacaagaccaccaccggcttcgccgctacgtgcagcctgctgagccagtttctcaaggagaagaagggcggcctgcagggcctcggcggcctcgccatggcgccggcgccggcagctggagcaggggctttccggccgccgaccaccatgaacttgctgtccgcgctcgacgcggccaaggccaccgtcggggagccagaaggccatggccaacgcaccggcgggaatccaagggaggcagctggggaggaggcgcagcagctgaccatcttctacggcggaaaagtggtcgtcttcgacaggttcccctccgccaaggtcaaggacctgctgcagatcgtgagcccgccgggggccgacgccgtggtggacggtgccggtgccggtgccgctgtccctacgcagaacctgcctaggccttcacacgacagtctctctgccgatctgccgatcgcgaggcggaactcgctgcacaggttcctcgagaagagaaaggacaggataaccgcaaaggcgccgtaccaagtcaacagttccgtcggcgctgaggcgtccaaggcggagaaaccctggctgggtctgggccaggaacaggaaggaagcgacggtcgtcaagcaggagaggagatgtgatcgatcagtagagactagattcgttcgtgcgcgcgtcgtcgtagcttcaggttaagggaaagaataatccaaccgtcggttaattgctcggcttaattacactgctctactacgtagtactggcactgctaccaccaccaccaccaccaccagagtgaccaagttaagctagggattgttacataggccggccggtcggccgttcgttcgcgagattgtttcgctgctggagatgcgcatgcacgctcgcagcagcttcgctggtccgcgtggccgcgtcttgtgttcgcgcaacgaacggtgcacgttccggtacgttttcatttgtctccgacctgtcctgtgtgtgtgtgcgtgtgtttttgcactggatattccccctcccctctcgtggtcgtagggagggtttgtatgttcagtggaaagatgtttggtatggtctactccattctatttcatgattcatgaatatgtatgtatgtatgtatgcgtgtgatgtactactgtggtatgctgtataaatttataaacacgcgctttattaaaaaaaaaagagataaaaaaaaaaaaaa

SEQ ID NO: 6424 - DNA, 1357 bp, Zea mays
ttggggacccccgggccggcccgctcactgccaaccacacgttcccaagccagccattggttggtagcaagccaagctaatcaagttagctttagatacccgctcccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcgacaacgacgggcggtggtgcctgccgggcaccatcaccgtcacggccaccaacttctgcccgcccaactacggcctccccagcgacgacggcggctggtgcaacccgccgcgcccgcacttcgacatggccgagccggccttcctccgcatcgcgcagtaccgcgccggcatcgtgcccgtcgcgttcaggagagtgccgtgcgtgaagaagggcggcatccggttcaccatcaacgggcactcctacttcaacctggtgctggtgaccaacgtggcgggcgccggcgacgtgcgctccgtctccatccggggctcccgcacggggtggcagcccatgtcccggaactggggccagaactggcagagcaactcgtacctggacaggcaggcgctctcgttccaggtcaccgccagcgacggccgcaccgtcaccagcaacggcgccgtccccgctggctggcagttcagccagaccttcgagggcggccagttctgaggatgaacagctagcgcgcgcgcggctagctattggataattaattacggtactgtcgatttggtttttttgccttgttttttttttgcgcgacgacgacgaagaggaggatgaagacgaagatgaagacgaggcctctctccgggtatattgaaggaaggagaaggcttttgcgcgcgctatgctgaggctgctaatctagcacccgcctagacgtttcccttttctctggtggattacggactggatcggaccaaagatcgatccagctcctagtactaataatatagttgtacttgagaaaatgaataattgtaatttattgtttttttgggacctttgatattattgtactcgcgcgcgccggccttgcgtcgaaattgaagttcgcaataaggccggcccccggcttttattcagcgtgccctctcgttccttcagt

SEQ ID NO: 6425 - DNA, 1268 bp, Zea mays
cattggggcccccctcgcgccggcctcactgccaaccacacgttcccaagccagccttctgacgaaggcagctgagatacagcaggctagcttcggagttcggggcactcagcgatggccattgccggcgctctcctcctcctgctcggactcctcgcgcgggaggccgctgccggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcgacaacgacgggcggtggtgcctgccgggcaccatcaccgtcacggccaccaacttctgcccgcccaactacggcctccccagcgacgacggcggctggtgcaacccgccgcgcccgcacttcgacatggccgagccggccttcctccgcatcgcgcagtaccgcgccggcatcgtgcccgtcgcgttcaggagagtgccgtgcgtgaagaagggcggcatccggttcaccatcaacgggcactcctacttcaacctggtgctggtgaccaacgtggcgggcgccggcgacgtgcgctccgtctccatccggggctcccgcacggggtggcagcccatgtcccggaactggggccagaactggcagagcaactcgtacctggacaggcaggcgctctcgttcccaggtcaccgccagcgacggccgcaccgtcaccagcaacggcgccgtccccgtcgtctggcagttcggccagaccttcgagggcggccagttctgaggatgaacagctagcgcgcgcgcggctagctattggataattagttacggtactgtcgattggccgcttttttttttttttttttgcgcgtgatgatcgagtgcatgcaagagaaagagacgacgaggagaacgacgaagacgaagacgaagcctctctccgggtatattgaaggaaggagaaggctttgcgcgcgctatgctgaggctgctaatctagcacccgcctagacgtttcccttttctctggtggattacggactggatcgaagatcgatccagctcctagtactaataatatagttgtacttgagaaaaatgaataattgcaatttattgcttttttgggacctttgatattattgtactcgcgcgcgccggccttgcgtcgaaattgaagttcgcaataaggagag

SEQ ID NO: 6426 - DNA, 8366 bp, Zea mays
  misc_feature (5943)..(5943): n is a, c, g, or t
gtaacggctagttgttagacctttggcaaagttggtcaccaaatatggtcaagttgagtcatcaaacactacactaaaacaggaactttcgacaaaatgttagcttttgacggacccaggtataccatgttaaaagttattaactttcgatgggttattccaactctcgtcgactacgtcagtaattttcgacaagtcaatgttaacacatcaaaagttaccctatagtacaccgtatttgagctgaagggatatttggggctccttggacccggcctgaagatgtgcctaatatatcgtgcatatgattgtacaacgctttattttgtattatatataacactgtttataatgtagagttcgaaataaaagatatgataggagaggtagcggtgatggctgagataactttgcagcgcccgattagggacgatcctacctgcagagtgcgagcgtaggcagatgcaggcatgcagggaccagggatgctgccctccttcattttccaggcttggatctgcgaccccatgcatccgcgccagtgctgcaggattgctgggcagcagggcgacggaccggccggcgatttatggagctaggcagcggccatgtgagagccactcgatcgccattacagcgcctggctctgctgcttcggtcggcagcggccgaggacgttgggcaggcggtgttaatgtcaccggacctaccctatctttagattaccatcaatcacgcgacaggccacaagcactgctcgatcgcgacgccggacgcaaatggcgaccgacggaattgtgctagcgcgacacatggcactgatggcagtggttataaggttggtggcggttgagagaattaactgtccctgcatcgcaattcatttcaagggaaggtgtattcgagcagggagcctcgttcactgtagcctgcaccgatggttccagggaccacttcatacacaaaatcgagcgtccgatgtagtgtgtgattacagtgcgtggcaactctgacggtcagtaagcccaaacaagaaacaaagacatccggcatcaacgatcagcaccatggctccaaacaagaaacgaaatcacttcttgttggcttcagtgaatagttcgacttctcttgccacagtccacactacgtactcctgctccgtgggaagcctggaataaccagcatagaggagaaaaacgacgatggagcgaaacgcgcggccaggcttcgtcggtggtgaggaaaggcgctgacacaacacgacgatagcaaaatcttcctttgcatactctgcgtctgccgtctgcgtatcaggatccagaaacagaggacgtgtgcttttctgcgaggaagccatgcccacatcacccgaattttcatcagtagtcgccggattttgaccgaggtctaaattgaggccgggtcgaggactgagagccaaaacaccacaccattgacagagatcatgctggtgctggataatgtctcacaagaaacaattccgtttaacagttgtcaaccaaaatcctttttctggaatctggagtagcgacatgtaacatgttggttgctggcttcgattttgagctacgcattgagtttgcagccacacatggcccttttattacaacgactgggcccgagtgcgcattgggctgcagcctatggcgctagggcctgccaactgcccagctggcccactgctctccagatttctattcgtacacgcccgagcccagaaaagcccctagtctatacgtagttgggccgttttcgaagatttcttggaccaggtgtaaatgttttttgttattccgcgcaacacaacaagggtgaagctggcagtggaaaagtctttgcgcgtcggttagcgcacaccgtagatccaattcaacacgagatgttatacacactaacacaccacgtcggaacccaatttaagtaaatccagttttagatggttggctaagattgagtactcgttttttttgttttaagacacaacatagtattatattcagccgatttcaatttagataaagagtgtgacatgagtgcattttatatgtgctccgtatttgtaacagaaaccccgcgcgcgctcgcggcgcacgatcgcgcgtagcagaaccggcacggtaccaagacggacaggccaccggccacgcctccctcccctcccagggtcccagcggcctccacagcagtcagcgacgcctgacccgacgacgacggtggtgtcgcttcggcacgcgccgcgggcacatggcagcaacagccgcgcaacggcgacccccgccctcgggagaggacgaacgaatgggacttgtcgcgcgcggccgcccgcgtgatggatagataggtaacgtgcaggcggcaactacccaccggcacggggaactggcgcgcgacgggacgagagccacaagcctcggcgagcggcaggcgccggagagcgacgcgggagcggcaggaagcggccatgcgcgcgggcacgtcggttcggttgggggccgggacctctcccgccattaacgaacggaaggcccggttcggtcgttagcccaggccgcgcgccacatgcatgacatggcatgacaggccaggccgggagtgcgcgcgccgtcgctgtcgttttgatcgcgcttttcttgcctggctcgccgttggtacgctctttccttgatggcttttgagtgagtggcaggacgcctgcatgcacttgtggtatgtactctaaacctaacgccccaagctgaagcgaccatgattctccctcctcccgcgcaatcatggttcatgagcagccgggcatggcatggcatggcatggcatgcgccctccccccaaccgctaagaatgggactgcctcacggcatgtcgagagcgggggttcggcaatggcaaggggatcctaaggtagtagtagtgtcctgctatgggattctctctagtacagacacagtcggcagctcgtagccttctcccggccccgaatttacagaaacctcttttcgacccgacgagtttcggagctccggtcgctgtcgtggggcgattttgcgatctatttccggcgtgctccccacatggcttcccctctcactccctcgtgcagccatcacatcgtcgtcggtgcccggacgtgcacagctccatcctgttttttctttgtacttttgtttatctacagaataaagataagccgtttccttttctgagggacaaagagcgaaactactgaaatgcgtttttttgtggcaatgctaatttttgggatatataatattttctctgtttttttatttatcgtgttttagctcataataaactagcaacggcaaatattcaagaacggaggtattatgtattaaagtgttgtcccatatttataacctgatagataatgcattggacgtatccttgttggtacgtatatagcgagaaagtaagacaatctgcatctgttatctgtatttgcaattgcaagatagtaagtgagtaacacagtttaccttaccactgttaaggcgacaggcggtaaaagtgaaatcagaagccaacgacccaacactagcgatctgtcgcagcacagcacccaagctaagcacagcctgaccctctcgccagggtaaaaaaaaaaagagagagagagagaaactgacaatttctatcaggtctatgaagcctatggtgctggtaccggggggctctagcgtagaagaatgcttccaagagaaggcgaatcaggcaggatcatcgctaatggcagggccctggccgtgatctccgggtggccacaggccgctatagccagggccatccctcccatgtgcgcccttcacatggcgcggggacacgaaagggatggttcatcagggtcggcaaaactgttgctttttcgaaagcgtggagctatagctagccattagccaacccgcacgttacgatgttccaaaggcacgcagcagagcagagcatggcaggaaccaggaaaagctagcctcgacgaactcctgctgtgtcgcgtaaatgtgcgcgcgcgttctccgatccacctggagatcgcgtgtcctgagaaattaaggagaagcatatgaaactctcatgcttttgcctgcttaagcagctgcgttggtttggtccgccggcctggtgcatgtgcacgcggagaatttggtgcgtcaaaaccgttgctgtttgtgtctgcagtatgtgaaatggagagacgagggagggaggcgtgaacatgaagcgcgtcactcacgtcttggttggtgtccggagagaaaaaaacagacgtgtgtgctgcagctaaaagcagacagagaacatggcagggtgtctctgccattgttcatctggcagctccagcatccacgtctgagcagtctaagcagccccgggagactggccgagcacgacacgcgctgctgtagacacctgtccagaggccacatgcatatgcatggtgcgactcgatccgctgctcctcgcgtgagtcggatcagacgaaatcttggacttgcctgcacctagctgcaggcaggcttgtctgaagagctggtttttttttaaaaaaaaaaaaccatctctgcatcctccacctacgccctacctacgtggccatgtccgggcaggcagccgggctcatgcaagcatgtgagccctgccttatcgacactataatctcaactaatcattgggatgagcgatgtatcgcagggagcaccgaatatttggtaggagattgtagttgtttattatgcatctactgcctcaagattagtctgatcacttgggctataaacgtttttttttctctctctctctcgatcgacgaatctatccggttcaaccgcgccctccctcagcttgcgagatccgtgagagcagccgaacgattaaaatcctttcagaaacagaatggctagcactgcacattttttagttgtcgatgcgggtaaaagcgcttataacttgaataacgcaagtttcgaatatctcagggagctttcaccaccgtccaccgtcgttggaaagggaagggcatccgatccccagagcatgcatgtgtgcggcgcttgaatgatttggttggttggcattcgccgtctcttttttttttttcttcttcgttgctagcattactctgtctacacgcaacatggattgcattgcatcatagagaaaatttataaaacaagcggatgcactgcacgcagtgacgcagtgaacgatatatctgttctaatttcttattccctttggcctagctattatacccgtactcttgggcccagacctctcccatggcttgcagtctcgcgagacggcgagagccatgtggggttatgcacgctgggcccgggcagcgccgggcctgtcctgtcctgtacacgcacgagcagggggcgtccgctacttgcgcgcgacgagcatgtgcgcctgattcgtatggggcaaccgccgtcgtgtagcggcgcgatcgtggtcggcgggggtgtagcgacgagcgcttctttctcgcccagcccccaccctcccctttatctcttttgtctccaattgcctgctgcccctccactccacgaaagttattaacgattccaactgccaggatcactgaccgttgctgggcgctggcctataagtacctggcctccgcgccccactcccttcacagccaagctagcaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggtgagtcgatcgactaacttgtactatagtagcgctagccagcntccatcgatcgtcggagatttattggagctgacgtcgtctcgcccgctgcacacacacgcgtgcattattcaggcggcgcgtgcggctacgggaacatgtacagcacggggtacggcaccaacacggcggcgctgagcacggcgctgttcaacgacggcgccgcgtgcgggtcctgctacgagctgcgctgcgacaacaacgggcagtcgtgcctgccgggcaccatcaccgtcacggccaccaacttctgcccgcccaactacggcctccccagcgacgacggcggctggtgcaacccgccgcgcccgcacttcgacatggcccagccggccttcctccagatcgcgcagtaccgcgccggcatcgtgcccgtcgcctacaggaggtgaggtttacttattatatttctcgtcggtttcgagctctcgtcatctcacgcactgaacggccggtcccagagatgagagagagagagagacgtgtgtgtggtgtggccgtgcgcgtgtcggtttctaaaattcagagttcggaccacgaccaaatatgtaagcaacggctggggttcaggccatgttacgtgggccagcaggcagattatctttcctttttctttttggttcggcttgttccgtcgtgcgccatgcatgcacgacagcgactcggcctgctgtttccgagtagattattaggcgtcacactgaccatattatgagcttccatgttagttgttagttgttacagtagctttagtctgatacaacgccatttccgcaagttgcaaaacgtcacgctcagcgacacttgtgcgctgtcatgctattagctgcacgccatgtgcggccgcttgaacttgaacctgttgcatgcgtgcgctttttgctcatcaccttttgcactcctcgtaccacgcattttgttgatagggtgccgtgcgtgaagaagggcgggatcaggttcaccatcaacggccactcctacttcaacctggtgctggtgaccaacgtggccggcgccggggacgtgcagtccgtgtccatcaagggctccagcaccgggtggcagcccatgtcccgcaactggggccagaactggcagagcaactcgctcctcgacggccagagcctgtccttccaggtcaccgccagcgacggccgcaccgtcaccagcaacggcgtcgctccggcgggctggcagttcggccagaccttcgagggcgcccagttctagctactactactccatcgacgagtgtgactgtgagcaagagagaaggagaaaccttcttcgctgtagtaaagaagaggctcccgccattccgaggctgcttattattagcacccgcttaggcatttccttctcttattattaccataggattgagctgtttattttctgcaccagtgattgtagcaatgggttaagcaaaacaaaaacctgcaaggctgattattgtagggctgcaggggagtggtgtcgtgcaacttattgtgttgttacgctgtactagtagcaacccccgaatctggccacatggtggtgggagatgtttgtggggattgcaccttttgggaccgtgaacatcaatgcttgtttatggtctattacatgcagtatatatgatatatatatatgctcgtggtttgatcctcggtttgtaaaaaaaaccacactagtcgcccctcgggccgtctctttaccaacttgcagaggcagcatgtgcatgtgtggtctgatgtgtggtcagtttgaagctttcagaactcagagaacgaaaaaaaggaaagatgaattgttctcagctggccaactcaagtatttcgatccaacttttttcttcttttgagctatatgcctagatggttgtctttttataaagtttagtatttagtatttagatccaacttttttcttcttttttcgagtgcttcagacactcggtaaagtctggaaaacacttagtaaactctttgccgagtgtgactcttggcaaagaagtctcgacgaacgacttctttgccgagtactttttgtcgaggactcaacaaaggctttatcgagtgccaactggtactcgactaagaaaagtcatcgccacggcaccaaatgacggtgacagagcctttaccgagtgtcctcactgacactcggcaaaggcttcctttttatcgagtgtctactggactagcgctcgataaagaaggctccggtgggcccctttaccagtccctttgccgagtgctccaagaggcactcgacagaggctccctctatgtcgagtgcctgctggactagctctcagtaaagggagcaccagtggcgccttttgccaagtcctttgtcgagtgctcactcggcaaagaaactttattggttcataggtgtgccttctttgccgagtgctacggtcatagcactccgcaac

SEQ ID NO: 6427 - DNA, 2952 bp, Zea mays
cctgagccgcttcagggctccacacagttaacgtgctgccgccgcggcggcgcatgcatgccgtcgccgtcggaatctgcaacttttttttctttctttctcgcattgggcctctctctcacgttcacagaaggctggacacaatctgccgagccgagcaggctcgcgcgagccatgtgggggagttggcctcgcggggcccgggacacgcgtgcagttggtgccctgttacgcgcggccgagggcgctcgcatgtgcgcccgatttgctcgtattaactgctccgtggaggcgtggacggtggtctctctcggtccctgcctgcgtctgtgtctgtgcgtgtggccgtggcccgcgattctttttattttgttttctgccggccctttatgttcgcctttctccctttcgctgcaccaaaccgcggagaaatttagatgcacaccgcccccgagttgtagttgtagccgactataaatagttgggggctgggagggcgagctcctcactgccaaccacacgttcccaagccagccattggttggtagcaagccaagctaatcaagctagctttagatacccgctcccgctcttcttcccgccgacgaagccagctgacgatatatacagcaggctagcttcggagttcggggcactcagcgatggccattgccggcgctcttctcctcctgctcggactcctcgcgcgggaggccgctgccggcgggtggcagagcgcgcacgccacgttctacggcggcggggacgcgtccggcacaatgggtaagcccctgactcgattgccctgctacctctctgtcgtactacgtttccatcggctcagcatcacacatgaagaaactgatccttcttctttcttctttcttcttcttctctgcgcgtgcacggacgacaggcggcgcctgcgggtacggcaacctgtacagcacggggtacggcacgagcacggcggcgctgagcacggcgctgttcaacgacggcgcggcgtgcgggtcctgctacgagctgcggtgcgacaacgacgggcggtggtgcctgccgggcaccatcaccgtcacggccaccaacttctgcccgcccaactacggcctccccagcgacgacggcggctggtgcaacccgccgcgcccgcacttcgacatggccgagccggccttcctccgcatcgcgcagtaccgcgccggcatcgtgcccgtcgcgttcaggaggtacttcagttgctcttcacatgctgtgctgcctgcgactcggcggtggtcacgcacactgcactgcactgcacacgtgacacatgcacgccggcccacagctgctacgacggctcgcaccaccaccacctacgtcctggctcgatcaattcgatttcaaaacgacccaaacgcgtcggacgtcggttcgaaggttggtgggcccggagcctaagttcggcccattagtttagtgggccaccctgcagatttgatacgggcgtggggataggctagtctgtggctgcagctgcagctgcagctgcaggcggcgcgcatgtgccctcagccctgccactgctgccagtgtcgcacctcgctcccataccaactctcggccgtcccaacccagtaaaacctcagtcacgcacgcacgtacgtagtgaccgttatttgcatgtgacgcgctgacctacgtagacagtaccagcaccgacgatttacttaatgttgttatatagctaacgtcgtataacttgccaacgctcgatcccattagctaacgtcgttcttaacccgacattaattaatctacatgtctatggcgcagagtgccgtgcgtgaagaagggcggcatccggttcaccatcaacgggcactcctacttcaacctggtgctggtgaccaacgtggcgggcgccggcgacgtgcgctccgtctccatccggggctcccgcacggggtggcagcccatgtcccggaactggggccagaactggcagagcaactcgtacctggacaggcaggcgctctcgttccaggtcaccgccagcgacggccgcaccgtcaccagcaacggcgccgtccccgctggctggcagttcggccagaccttcgagggcggccagttctgaggatgaacagctagcgcgcgcgcggctagctattggataattagttacggtactgtcgatttgtttgtttttttttttttttttgcgcgtgatgatcgagtgcatgcaagagaaagagacgacgaggagaacgacgaagacgaagacgaagcctctctccgggtatattgaaggaaggagaaggctttgcgcgcgctatgctgaggctgctaatctagcacccgcctagacgtttcccttttctcttctctggtggattacggactggatcggaccaaagatcgatccagctcctagtactaataatatagttgtacttgagaaaaatgaaataattgtaatttattgtttttttggggacctttgatattattgtactcgcgcgcgccggccttgcgtggaaattgaagttcgcaataaggccggccgccggcttttattcagcgtgccctctcgtcccttcagtagcttctggtgtgtagcagcgcggtggtgacttttggtgtttgctagggtgtaagtaacgccaccacgtacgtatcttcgcacatgggtggggcaagcatgtcctgtgtgctgacttgaattacccgcggccgcgaccggtgtcggctgcgtctgccggtgtggaatgcagccgtcgtgcactagcactactggtcctcttcagtagcctctattgacttattgagaagctagcttgtgtgcatcatccgtagatttgcttacccacggttcattacccctttctctgcgctgctgggcctgcctgtctgatgtgatgcatctctcgggcgacgcgcttactttgatcgacgttctgttcaggc

SEQ ID NO: 6428 - DNA, 1291 bp, Zea mays
  misc_feature (1197)..(1197): n is a, c, g, or t
  misc_feature (1213)..(1213): n is a, c, g, or t
  misc_feature (1290)..(1290): n is a, c, g, or t
ctcctatagggcattgggtccctcgaggccggccgggacagccaagctagcaactctctcgagtcgattcctaagcagctagccagtgactcgatcttagcgtgctacaatggcggcagctgctagtgccctgctcctcctgctctgctcagccttctgctcccttgcccaccgggcggccggcgtcgactacggctcgtggcagagcgcccacgccacgttctacggcggcggcgacgcgtctggcacgatgggcggcgcgtgcggctacgggaacatgtacagcacggggtacggcaccaacacggcggcgctgagcacggcgctgttcaacgacggcgccgcgtgcgggtcctgctacgagctgcgctgcgacaacaacgggcagtcgtgcctgccgggcaccatcaccgtcacggccaccaacttctgcccgcccaactacggcctccccagcgacgacggcggctggtgcaacccgccgcgcccgcacttcgacatggcccagccggccttcctccagatcgcgcagtaccgcgccggcatcgtgcccgtcgcctacaggagggtgccgtgcgtgaagaagggcgggatcaggttcaccatcaacggccactcctacttcaacctggtgctggtgaccaacgtggccggcgccggggacgtgcagtccgtgtccatcaagggctccagcaccgggtggcagcccatgtcccgcaactggggccagaactggcagagcaactcgctcctcgacggccagagcctgtccttccaggtcaccgccagcgacggccgcaccgtcaccagcaacggcgtcgctccggcgggctggcagttcggccagaccttcgagggcgcccagttctagctactactactccatcgacgagtgtgactgtgagcaagagagaaggagaaaccttcttcgctgtagtaaagaagaggctcccgccattccgaggctgcttattattagcacccgcttaggcatttccttctcttattattaccataggattgagctgtttattttctgcaccagtgattgtagcaatgggttaagcaaaacaaaaacctgcaaggctgattattgtagggctgcaggggagtggtgtcgtgcaaaaaaaaaaaaaaaaaaagcggcctagcaacaacctccgaatctggccacatggtggtgggagatgtttgtgnggattgcaccttttgngaccgtgaacatcaatgcttgtttatggtctattatattacatgcagcaaaaaaaaaaaaaaaaaagcccctagggnc

SEQ ID NO: 6429 - DNA, 2145 bp, Zea mays
ggaccctcccgcccggcccggccgggacattggaacgcgaacgctctcggatccatccacctccaaagtccaaaagcgaagcctacgcccgccccaacggtgaaaacgtcggaaccctagatccctctcacggtcgcgcctgtgctccaaaaccttagatccgacatgcatcagcccagagcccgctacccacccgggtatggctccagcgggggaggcggtggcgggggaggcggtagtggaggaggaagaggaggcagcggcggcggaggaaaccacaactactacggccggaacacacatccacagcatcaacaccactaccagcagcagcagcagcactcgcataggaactcctcgcaccagcagcagtggctgcggcgagaccagggccccgccgttgcggggccagtgtctggaaacgctgtgcctaagacggcgcctcagcttgacgctgttgactcgagttctcaagattggaaggctcaactaaatataccagctccagacacacgctacaggacagaggatgtcactgcaacaaaaggcaatgagtttgaggattatttcttgaaacgtgagttgcttatgggaatatatgagaagggatttgaaaggccatctcctattcaagaagaaagcattcctattgcgttgactggaagtgatattcttgcaagggcgaaaaatggcactggaaagactgctgccttttgcattccggcacttgaaaaaattgatcctgaaaataatgcaattcaagttgttatactagtaccaacaagggaactggctctgcaaacttcacaagtgtgtaaagagcttgggaaatacctaaacattgaagttatggttagcactggaggaaccagcttgaaggatgacatcatgcgtttataccaacctgttcatctactcgttgggactcctggccgaatacttgatcttaccaggaagggcatttgtgtgctgaaagattgttcaatgcttgtcatggatgaggcagacaagctattagctccagagtttcagccttctgtggaggcacttattcatttccttccacctagtcgacaactgttgatgttttcagcaacctttcctgtaactgtcaaggaattcaaagagaaatatctgcctagaccttatgtgattaatctaatggacgaactgaccctgaaaggaatcacacaatattatgcttttgttgaagaaaggcagaaagttcattgcctgaatacacttttctcaaagcttcaaattaatcaatccattatattctgcaactctgttaatagagttgagctgctggctaaaaaaataactgaactcggttattcatgcttctacattcatgctaagatgttgcaagaccacagaaatcgagtatttcatgattttcgtaatggtgcttgcagaaaccttgtgtgcacagatctgtttaccagaggaattgatattcaggctgttaatgtggttattaattttgacttccctaagacatctgagacatatttacacagggttggccgttctgggagatatggacaccttggtttagcagtgaacttgatcacttatgaggaccgtttcaacttgtataggattgagcaagagcttggaacagaaattaagacaatacccccgcagatcgacctggccgtatactgccaatgatgaatgcgacattcaggagcatcaaacacttctctttctatttgagaaacttatcaggcaaatacgtttgtacatagcaacccatcagggctttgttttggcaccttgatgacgtttgtaagcttacctggattagtagaggaagtgcttcctgtaggcactgatactaacccgtttagctgaggacatgcacgctgggctgcttggaggcccagaactatgatgagatgagacaatatcttacctcacttgacattttcactcgacttgtttgccagtctcagttctacttgacttgcctgttctcatttgattcatcttccgttttcttctttcctaatgttatgatgcatatggatgtctttctgtagctgtatgatgtgttgagtttattttttcttggtgtatgtatacagcttaacttgaaattatttccatatcaacttctttgcgagaaataaaaaaaaa

SEQ ID NO: 6430 - DNA, 2098 bp, Zea mays
cctcgaggccggccgggccgccacccttccgattggaaagcgaacgctcacagctcacagctcacgcacccatccacctccaaagtccaaaagcggaacccacgcctgccgcaacggcgaaaccgtcggaaccctagatctctctcgcccgcgctccgaaaccccagatccgccatgcaccagcctagagctcgctacccacccggctatggctccggcggtggaggcggagccggacgtggcggtggaggcggaaatggaggaggtggcggaaaccacaactactacggccgaaacccgcagcaacaccactaccaccagcagcagcagtcgcagcactctcataggaactcttcgtaccagcaacagtggctgcggcgagaccaggcccccgccgttgcgggggcagcgtccggaaacgctgtggccaagacggcgtctcagcttgacgccgtaggctcgagctcccaagactggaaggctcaactaaatataccagctccagatacacgctacaggacagaggatgtcactgcaacaaaaggcaatgagtttgaagattatttcttgaaacgtgaactgcttatgggaatctacgaaaagggatttgaaagaccatctcctattcaagaagaaagcattcctattgcgctgactggaagtgatattcttgcaagggcaaaaaatggcactggaaagactgctgccttttgcattccggcacttgaaaaaattgatcctgaaaaaaatgctattcaagttgttatactagtaccaacaagggaactggctctgcaaacttcgcaagtctgtaaagagctcgggaagtaccttaacattcaagttatggttagcactggaggaactagcttgaaggatgacatcatgcgtttataccaacctgttcatttacttgttgggactcctggccgaatacttgatcttaccaggaagggcatttgtgtgttgaaagactgttcaatgcttgtcatggatgaggcagacaagctattagctccagagttccagccttctgtggaggcacttattcatttccttccacctagtcggcagctgttgatgttttcagcaacctttcctgtaactgtcaaggaattcaaagataaatatctgcctagaccttatgtgattaatctaatggatgaactgaccctgaaaggaatcacacaatattatgcttttgtcgaagaaaggcaaaaagttcattgcctgaatacacttttctcaaagcttcaaattaatcaatccattatattctgcaactctgttaatagagttgagctactggctaagaaaataactgaactcggttattcatgcttctacattcatgctaagatgttgcaagaccacagaaaccgagtgtttcatgattttcgtaatggtgcttgcagaaaccttgtgtgcacagatctgtttaccagaggaattgatatccaggctgttaatgtggtcattaattttgacttccctaagacatctgagacatacttacacagggttggccgttctgggagatatggacaccttggtttggcagtgaacttgatcacttatgaagaccgtttcaacttatataggattgagcaagaacttggaacggaaattaagacaatacccccacagattgacctgtccatatactgccaatgatatgtgacagtttcaatgagcatcggacacattttatttattttgagaacatctgtacatagcaacccatcaagtgagttctccaactaaggcgcaactatttcagaagctacctaaatggctacattcctttgtcgtcacacatcaatttctcccccattctcgtcgggttttgttttaatgccttgatgtcgtttgtaagcttacttggattagtagaggaagtgtttcctgtaggctctgatctggtactaacctgtttagctgaggacatgcacattgggtgggctgcttggggcccaaaactatgatgagatgagacattatcttacctcgcttgacattttcaatttacctgtttgccaaaaacaataaagccccagttctactggagttgcctgtgttattatttgattagttttcc

SEQ ID NO: 6431 - DNA, 3212 bp, Zea mays
ccggccgggccgggacttttctttcttctttctcatctcagttgcagttcccctctctctcctctgccgtagcgaggcaggcaagccaccaagtccgagcctcggaggcatcgaccaacgccggcggcagcggcgccatgaggctgctcgtccccgacggcgcgcgccgccagcggttgctccagtgcgaggcgcccccgtcgccctcgccgccttccccgtccccgtacccgtcgtcgtccccgtccaggacggtcgtggtggggatcaggcgcgacgccgccagccgcgagctgctcacctgggcgctcgtcaaggtcgccaatgctggggaccgcgtcgtcgcactccacgtcgccaccgcggccgccgccgacggtttgctcgtgagactggatgagcgcagcagggccgcggactcgctcgcctccgtgctcgccgtctacgacggtttctgcaacctcaagcagattaatttggagctcaaggtctgtggagggtcatctatccggaaaactctggttaaagaagcagctgcttgtggcgcagcacatctcatccttggtgtcacgaacaattcccggtccttcggatcctccttgacatcagttgccaagtactgctcaaagagagttccagccagctgctcggttcttgcagtgaacaatggcaaagtcgtttatcataaagatgctggtcacgggttgcaacatgaactgtaccaaagcaataccacgatacctgagacaccaaggaggagctaccggaagctcttgtcgaccatgataggggataaactctgggatgagaatggaaaagacagaaggtgtgtgtctcgtgccgtcaccatgccaatgaggtctcccgcacggccaaaagaattttcactggcattagtcccggtgaagggttgccaacacgaatcgccagcggtagcaactggctggcccctacttaggaagaagttcttgccagaccggaaagcttctgcgcctgacaagtccaagatgtctgtggtgcagtgggcaatgcggctcccaagcaggtattcagcagtatcgccagtccattcagaatacagaaccacaaaaccggactccacgagcgccagccatatcctccgtgaccgtgtgattgttccctcaaggagcaattctggaaagtcttgtgtagtgattgaagaattggagaaggaaactccagaggaactgacgttgctcaaagagaaattctcatccatttattcttcattcagttacagtgaacttgcaaagatcacctctgacttctcaccagagtgtgtagttggacaaggaggcactagtcaagtttacagaggctgtttggcaaatggcaaggagctagcagtgaagatcctgaagtattctgatgaggtactgaaggagtttgtatcagagattgagattgtcagttctctcagccacaagaatgtgatatccctcgttggtttctgcttcaagaatgatgaccttctgttagtgtatgagtatttgcaacgaggcagcctggaagagatactgcatggtaaaaaagaatgcaagagcatatttggttggactgagaggttcagcgtggctatgggagttgctcgtgctctggattatctccatagtgataacaacagtcgtccagtgatccatagggatgtcaagtcatcaaatatcctcatttcaaaatgctttgaaccaaagttatcggactttggtctcgcagtctgggctgctgatgtgacatctcagatgacatgcaatgatgttgcaggaactttcggatacttggctcctgaatacttcatgcatggcaaggtgggcaacaaaatcgatgtgtatgctttcggtgttgtacttctggagctcatctctggcaggaaaccactttgcactggttgtccaaaagggcaggagagcctagtgatgtgggcaaattccatcatacagggaggaaagctcagacaacttgtagatccaaacttgcccactgaaggccatgtcgatgaagttgagaggatgacccttgctgcgtccctctgcatcagacaaacacctcagaaccgtcctgaaattgatgctgttctgaagcttctccacggtgacaatgataccctcaagtgggcaagatcacaagtcgggttgtcatgcgagagcagcgatatcgatgaatttgtgatgacaccgccagcgccgaggagtaacaccaacatccagtcctacatcaacctcgcctttgatgtcgatgacgactcagcctctgtcagcagcaacgacttcattgcagccaacacctccttggaagagtatctgaagggaagatggagccggtcgtcgagctttgactgacggacccatggtcagagttaaccctttattagtgtatagatcgttcttgttcttcttctaatttaagtttcaattttgcgccttggatgagagttggcacctgcaatgccctccaccaggaaatcctttgattatgtcttagttatttttttccttttcttttgggggtccctcttactctctgaagaggcaccctgttgttttactgtctgaagagacttatcatactcaggtagtctcatccaaagaggtgacaaataaagtcgggatcatacgaaactgtggctttctttccatacctaaatcaatcatcttttgttctgcacacgttgttattgctcaggactttgttttatcttttctctcctctactatataaagcactagattctaaggttttcactgtcatcctgccaccatatttaaatggtaaaaaactaaaattatgcataattagatattcgaaccataagtggtggcttcaaacatacatttatacctagctagttaacacaatacatgttttttttttgtttaacaaaggacggcgctttgctagtaagataaaaaaaaagattggttttgtgccatccgtcaaaagtgagtctgccagcgttgactcaacatgttcggatacatatagtaccttgaattttcacgagtagttttatttctcttgcgaaaattcaatcgattgctcgatgatgaagatatgataagatgaagtcagaatctgcagtttttatagttgtattatgatgctatcacaatacaataaaatacaccattatattaatctataagctgcagtccatgacgttgcatgtcccaagaattatacaggcactgtcggtt

SEQ ID NO: 6432 - DNA, 880 bp, Zea mays
gcacgagaccattacctagaacatcctaatcaaaaaaatttgtacccccaatccccttccacacaccgcctcgccacatcgcagagccagagcaagggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggccacggccacggacgcgtccacgggctcggcggcggcggagcgccggtggacatcgtggagagcccccgcgagtacgccttcgtgctcgacgtgcccggcctctccaagtcagacatccaggtgacgctggaggaggaccgggtgctggtgatgaagggcggcagcgggaagcggaagcgcgatgaggaggaggacatgaacggcgaagggtgccgatacatccggttggagcgcggcgcggcgccgcggtcgttcgtgcgcaagttccggctgccggaggatgcggacacgggcggcgttgcggcgcgctgcgagaacggtgtgctcaccgtcaccgtcaagaagctgccgccgccggagaagaaggccaagaccgtgcaggtcaccatcgcctagaagtcggcagtcggcactcggcagagtagcagcagtagaattgtagcgcgtacgtagtggcctgtcgtgttgggtggagtgctcttttgtttacgtttgtgctgctgatgagctgggtgtgtgtaacagaccgtgcttcttttctgaacaagaattattcaatcgtgtctctggtgcaaaaaaaaaaaaaaaa

SEQ ID NO: 6433 - DNA, 1005 bp, Zea mays
ctcccggtccttctggacgcgacagcacaccacctctacgaagcatctcgaactctcggtgccgctcaatttgtacccccaatcccctgccacgcgtccgcccacgcgtccgatcgcagagccagagcaagggaagacgacgcagatctcgccacgcgaacacagttagatcgagggagtaagtgagagtgagagccatgacggagctgttcgacacggccgtgaccagcctcctccacctgccggaggtgctggaccgcctcgccgccgcagacggcgaccggcggtcggccggccaccacgcggcgcacggccacggccacggacgcgtccacgggctcggcggcggcggcggagcgccggtggacatcgtggagagcccccgcgagtacgccttcgtgctcgacgtgccaggcctctccaagtccgacatccaggtgacgctggaggaggaccgggtgctggtgatgaagggcggcagcgggaagcggaagcgcgatgaggaggaggacatgaacggcgaagggtgccgatacatccggttggagcgcggcgcggcgccgcggtcgttcgtgcgcaagttccggctgccggaggacgcggacacgggcggcgttgcggcgcgctgcgagaacggtgtgctcaccgtcaccgtcaagaagctgccgccgccggagaagaaggccaagaccgtgcaggtcaccatcgcctagaagtcggcagtcggcagagtagcagcagtagaatcgtagcgcgtacgtagtggcatgtcgtgttgggtgaatgggtggagtgctcttttgtttacgtttgtgctgctgatgaactggtgggtgggtgtgaccgaccgtgcttcttttctgaacaagaattattcaatcgtgtcggtgaagctgtgcatttgtgcaaggagttcttgtggcctctcactggaatattattacaaggaagtgagtaacaaataaattacatgcccaggaataacagtcgagagagaatgttggt

SEQ ID NO: 6434 - DNA, 727 bp, Zea mays
gagtccaggtgattctcccgactgtctccccgcgacaacaatgttagcctcaagagttctcccccgacacagccaaccctagcctcaggatctcttcctcgatgctcggctccaccgtcttctgcgaagtcgtctccttcccctcgtcaagatatgagttcttgggagaagcaagttagacaatttttgttagatatgaattgaaaggaatggatggattaacagccgaggacaaatcatacgctttggtgctttttgaatctacgataaatatagaggttttcttaacaacaacgaagcatgatgttagagaaatttggctcaagcgcaaaattaggttgcttagaagcagtgtacagtgatgcgaggcatggatgcgagagtgcaaagtggaagcaacacatgaagtcgacatggagaagaaaaatacaacgacagtccacatgaaacttgtgaaaaaagaattaaatcccaaagttcctaatgaagatacttgtattacagttttatgttatattgtctatctatttgtgtgaatggagatgaccttgatggatggattagcttcgctaatgctttagtttgctgctgcttcagtttgctactgatgatgcctttactgtattttactactttagtttgctcgacaaactattgtgatgatggataaagtgtgatgtgatggtggatgaaccagtttattatgctcctaaaaaaaaaaaaaaaa

SEQ ID NO: 6435 - DNA, 4257 bp, Zea mays
ggctatgttttgggactaaaacagctttggactaaatccttggttgccaaagggtggcaggaaattatatcctagtggagaaaatcctccatagaaatcgaggtgccatttaaatcctattggtggattttttccatgggtttttttccctattgctgccaaaccagccctaaggaagagaaaaagtcccgcgttgcaaaggagtccatagaattcattgaagtttcctagagggaacttcgggcgcgtgtttgtatgtacggaggtgccacgtgttgatctgtcatgaatccattcacgacttatcatcttcactttcacttcataattgtgtcaaacggtcaatgcaagggcttccggagtttcagaaggcaaaatgacgggtactccagaaaaaaagggcatgcatcatgcatgcttgtacgacttcaccgcatgcattttagctaacggaacattggggacggatcaaattcactgtaaatctagcacccatggcccctcatccatggactacattctgatctcgagctaacccaaagggctctggcacgttgtcaccacttctcctaaagaagatggctctgacaaagtggaaggaatttatcagcctagaaacggaattaccgaggacaatagtgacactagcaatggccatatcgaacaaggaatagagagaccgaatagaagcgctatgtctattcccttataaacttaaagcctgtgcttcctccatcaacctgtacaaaagttccaaaattcccagtgacattcaccaatcaccaatcaccaccaccaccaccaccatcaggtcctctcaaagtgccccggaggccagagcctcacagaataacccaacaaccggccccacatgccctcaaaatgcagaggaaactgaagagagaagaagaagaagaaagaagatcgcatcctagctagtcagctgataattaataatctatactgtttcatgccgtatatatatatataaaatgctagctcccgtacgcagcagcggcggcagcatcctgggccgtccgagggaatatgccctggccgggccccaggatgcgcagcgggtcgaaccgggccttgcggtccgcgaagcgctcccagcgccggcccaggtgctgctgccagcgggccggggtcgggtggtgaggcaggtactgcttggcgccgaggcgcgcctccgcggcgtcggcgatccggcggtggctgcggaggagctcgtgcaggcagcggtgggagcagccgtcaccgtcttcttctggaccagggttcgcggacctgaggatgccgaccacgtacatcaccgggtcgtccgcggtgggcccggagtccgggatcacgaccgacgtgttggtgtcccacctgtcgtcaatcaaatcaaataaaaaaaaaagaaaggatgaagacagcaacaaacagttttttagagcttgctgacgagacgctgtgaatttcaaataagcggtagcaggaatttgtgtatgggtggtgtagctgacttcctgcagttcagcgtattctgactctctctctcgagagagagacttttggtttagtggtttttcctgaggcaagtcagaggtctctgttgggcctgtagattatatatacactagtccagtgcggtgaacgtggaactttgggtgacgacttcatcttttgttaaagctcaatcagttcagagttgacactgggatgcgatctagcacatacacatatttaaaccccttttgcatccatgtaaacttgtctaaatttattcggagggtatgaacacataacaagacgcttgtaactgaataacttgtgctatcgattacaagtttacgacgttgtttgcacttgttaaaaaaatcttttaagcctagtttggcaacctcattttttttctaggaatttccattttcttaagagtaattagttcaaatttttttttgagaaaattgtgttcctaaactagcccttaggtgaaaaaagaagaaaaacgaagactaattccaaagcagatcagctagctactactatgttttataatttccctgtcgccactctcaaggttgatgctactgactgattgagctcatctacagttttagctgattcatacaatgctgatgatgacgcagatgtgatgctatccgagggaccactagtacaaacacacgatagaacaacccatattcgcctctatacgacggcgtgggtcccacgagcgcctttgctggacatagggaaaaaacaaaccaacatgctaattaagcaaaagggatctatcatccctaatgcacgcacgataagtgatcacttttctcgtcacttcgtcgtcatctaaggtaatgtttgattgtgaagccggttagaatgaagtgactccgttcgagagagagaacgttccatagagaaaacggctccgtccaaaatattttctaaagataaatggttcaatatttaaatatatattttaaagtccctatctcctatataaaatcaatctaaaaacaacaaattaagagcggggcggcttcatatcccgctattactcggaaaccaaacagtacccatgtcgttaccactgtaggcagcgcaaggaggcaacttgctgtggataatgcaaagaaatgcttgcttgcccaacttggacttcttggaagctaatatgaagtgagaggacggtcggaagaggccgggattaataaaagcagataagcttgctttgagaaaagccgaaagtaggcggtatcttcatggatgtactactacatagcttttgtgtcatcataattattattattagaagagtggtacttacttgtctctgaggagtgggtagatgaggatgaggccctggaagctatccggcgagacgttgtccatgagcagatccctgaagccagcgaccccggccttgggcacgaacatgttgagccacgggtggtgcacctcctcccacatcccggcgctccgcaggctcacctcctccatcctgacccggttcaggaagtccaagtaggacacctccacgctgtacagctgggacgccatgtggctcatccgcctcgagatggcctccacggccgcctgagactgctgctggtaaccgtggtggtggtggaccgcgaactcgacgcagtagtagatcctagggctgctcctggtgccgaaatccgggctgaagtccacgctcgcggggaaggcgatggaggagctgtggagggaccgctcgttcaggaccatgaacccttccacgtagtccaccgaatccggaatcgacaccagcagctcctggtccctggtgaaggcgcccaagtcgtcgtagaaggccctcacccacgtcaccttctccggagcctcctgcagcaggatcctggccctggttatgatgccgaactggcctaggcctcccaggacggcattgaacaggtcggcctccttgctgggtgagcattccacaatctcccctcgtcctgtttgttatagagagagagagagagagagagagagagagagagaggttgtttgttggtcaagaaagagaggcagaaaaaaaaatctgatctttgtgtttcatctatgtaccatgcatgcacgcatgcatgcgtgcgtgtgtctcacctgtgactacctccagctggaggacgttgctgatctgtggcccgtgcttgaacgtctgcccgctgatgccggcattggacagcgtcccgccgacagtgaggtagaggtagtcggtccaggacctgggagccagcccaagcttcaggctccgctccaggagctcgatccacagaaccccgccgcccacgtcggcgtaggaggcacgcccttcgcctcccccgcggacgtggtggaactccatctcgccgggcaaggagcgcgtctccaccacaatgccgtccggggcctgcgcctgcccgtggatggagtggcctgcccccctggccgccaccgtgaccctgctcagcgagggcgagccggagaggaagctgagcagcatggagatgtccctcggcgactggggcctcagcaccgcggccggggcgcggaagagtatcctgccgaagtcgctggacgcggccgcggtgctggtggtggggagcaggttcagggggcccaggtccatggggctctgtatgaatttgtacggagagcagagggagaggacgaggatcagcaggctggctcttgcgctcacgaccatggcaacctccatggagatgggctgagcaatctcctgcaggggtaccgagc

SEQ ID NO: 6436 - DNA, 1236 bp, Zea mays
cgggtccgccaaggcgcaaaagccatcaacctctgcagctacaggacagcgtgcttgtgagtggctgtgcttccgtaggggtagtagggtgcttgcgttgcgttgcagtgcagaggacactgacggacggcgaagaatcgaagatggaggcgtacgctgctggagccaagttcgactgcttgctgttcgacatggacgacactctgtacccgctgagccttggcatcaacctagcatgccgcaagaacatacaggagtacatgctgaagaagctgcggatcgaggagagccaggtccccaggatgtgcctggacctgtacagggagtatgggaccacaatggccggcctcaaggttttggggtacgatttcgactacgacgacttccacgcctgcgtgcacgggacgctgccgtacgagaaggtgaagcctgacccggtgctcaggcagctgctgctttccctgccgcagaggaagatcatcttcaccaactccgacaaggcccacgcggccagagtcctggagaagctcggcctccaggactgcttccaagggatcgtctgcttcgagacactgaacccgccaccaccaaccgagaccgagaagaacagtggcagtgctgggacgatcctgtgcaagccctcgctggcgtccatggaagccgtcatcgagatcgccaagctcgacgccgagagaacggtgttctttgacgacagcgcgcgcaacatcgccgcagggaaggccgccggtttccgcaccgtcatcgtggggagctcggcgctggtgccaggggcggacgtggcgctggagagcatccacaacatcaaggaggcgctgccggagctctgggaggttgccgccgccgctgccgccggcgaccgcgtcgacgccgtcctccggtccaccaccgccgtggagaccacagtgattgcctgagcaataataccatatgacaaatgacattaaccgtcacggactcacggccacgtaatataatgctggcgtgtagtatttcttgtgacgtgcaaattaaaatgacttggaatgtggtgtgcctgattaagtaccgaccgaggtaactaatactactgtatatgacagaccagaactttactggtaataaggtttgtatagctcatccctgtcggcccgtgcttttttatggcgcggtccgtggtgcaaatggatgccacgtactgaatacaaataaatatatataaaaaaaatgctttgccca

SEQ ID NO: 6437 - DNA, 1183 bp, Zea mays
gcaggcgcaaaagccatcaacctctgtgcagctacaggacagcgtgcttgtgagtggctgttagggtgcttgcgttgcgttgcagtgcagaggacactgacggacggcgaagaatcgaagatggaggcgtacgctgctggagccaagttcgactgcttgctgttcgacatggacgacactctgtacccgctgagccttggcatcaacctagcatgccgcaagaacatacaggagtacatgctgaagaagctgcggatcgaggagagccaggtccccaggatgtgcctggacctgtacagggagtatgggaccacaatggccggcctcaaggttttggggtacgatttcgactacgacgacttccacgcctgcgtgcacgggacgctgccgtacgagaaggtgaagcctgacccggtgctcaggcagctgctgctttccctgccgcagaggaagatcatcttcaccaactccgacaaggccaacgcggccagagtcctggagaagctcggcctccaggactgcttccaagggatcgtctgcttcgagaccctgaacccgccaccaccaaccgagaccgagaagaacagtggcggcagtgctgggacgatcctgtgcaagccctcactggcgtccatggaagccgtcatcgagatcgccaagctcgacgccgagagaacggtgttctttgacgacagcgcgcgcaacatcgccgcagggaaggccgccggtttccgcaccgtcatcgtggggagctcggcgctggtgccaggggcggacgtggcgctggagagcatccacaacatcaaggaggcgctgccggagctctgggaggttgccgccgccgctgccgccggcgaccgcgtcgacgccgtcctccggtccaccaccgccgtggagaccacagtgattgcctgagcaataataccatgtgacattaaccgtcacggactcaaggtcacggccacgtaatataatgctgccgtgtagtatttctcgtgcctgattaagtaccgaccgaggtaactaatactactgtatgtaccagaccagaactttacggttacgggtaataaggtttgtatagctcatccctgtcggcccgtgcttttttatggcgcggtccgtggtgcaaatggatgccacgtactgaatgcaaatatatataaaaaatgctttgtccatc

SEQ ID NO: 6438 - DNA, 744 bp, Zea mays
ggaaaaaaaaaaaaaaaaaaaaaaaaaatccaacacttctctttcttaacatcatttgcgggcccccggcggcccgggcggggatcacaatagaagtttcaactaatcagcttactaggatgaagcctgcaacggtggcactgctcattttgttgaacatgatgtgcatagttgcatactttgatcatggaacgatggctgaagaaaccaccttgctggcaaattcgtatggaagaaatgaaggaaccaagggcatacatcatggaagaaagctgatggacaatagtattggttcaaaccgtgagtattcaatcgatgatatgtctcatccaaaggcaccacatactgagctcaagcaaccctcatacttagctcctggttgctcaagcaaccctctcaagcaaccctcatacttagctcctggttgcattccctaaagttcatgcatacatatatagccttccactcatcatatgctggtatccgatctatatatagacacatatgatatgttgcatatcgccaggttctcagatcaagtcccttgtgtagtatgagtggaaacctatctaaataatgtgtgtggcttctgaaatatgtggtgttattgtactgagctatgctcaatagtaaacaacaaattattgaaatatgtcacgtgtgcgataataaagtgacttcgacaaaaaaaaaaaaaaaaaaggccccgaccgccatctagaactagtaaaaaaaaaagcggcc

SEQ ID NO: 6439 - DNA, 642 bp, Zea mays
cccaaaaaagagatcgaattcccaaagacaagcaaagcttcaaagcatctctgcttggattttagcgagcggcaacgacgagcgacccaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcctcctcgccgccgcctgagccgttccacagcaagaaacaatggtccgaggctgtgtgactgagattcagacgtctctccatccatccattctactactactacttatatgtcttggtggtgatgttggatttatattctttcttctttaatttcgccctggctgtcttgagagtgtagattgagagtcaaatatgtgcttgtgtggatgttgtgatacgattgcaatcacactttatatcttctgtaatcaagcaaaaaccaatgcgttgcagtagaatggcttgtgtgtgtgactcctgcaggctgtatatgtgtttgaagattgcaactgagcatctccacaagatcttttataaaaaaaaaaaaaaaaaaactcgagcccgggcga

SEQ ID NO: 6440 - DNA, 2835 bp, Zea mays
gagtatggtggatgacatagggctcatcattaaaaatagtctcgaacgtctatttctttatttatgagattatgcatttttatagaaattagtagccaaggcccctcttgtctgaccaaaacaaatagttagaatagacacgtttgtagtacttttgacaacaaatacaacaacacatctcacgttgattaactataaggggtgtttggtttgagaaatcacttcatccaagataaggtgatgcatcatgagtctattcatcaaatttaatagaatgatctcattcttatattagtactaactatgagaaataaggtgatgatgaatcaactcattccattccacgaaccaaacaaaaaaagtgatgagtgagaagatgatggaataactcattcctcgaaccaatcaccctataagtatctaacaatattgtttgtcagagtataaatcccaaagcgaccaattgtttggaaacatacgctagtattttggatcaggtggtggacaggtggtctacatgacactatactaacaaaaaagagctgcacataaattagggaactagtctggcaaacctctgctgtcctagtcctagtactggtagtagaatcgtataggagtatttgtatgagctgtgtttaggcacaaaaaactgctttggctagcggataccgtcactttggacgcagcaaataatgaggcggttttatatggcaaagatgaaagggtgtagaagtctagaagatgagtcattaaggaatcagggttactagctcgttattacgcgtgggaattgtgcatttgcaatccctttcaaaatgactgagcgaaagagggcaaatgtgcgagttctttgctgaaccataatctcagccagatggtggaacatgctaccacagatgaagaggtcagaagtacagcacggggcagggcattcgtcactcgaccgttgcctccaggtacagactccagccatgccagaccatctccccaccctctaggtctaggacactagcgccaacgacaatggtcacttgccgctacactgttagacagtagccagcacactccacaagcttcttctcttgcaggctccccctgcagcccggccggcctccttccctaggattcttttgcagcttccattgtctccccggctatttaacccacccacccccgcttcgtctcccatgtcccatagcaaagcaaagcaaagcttcaaagcatctctgctgggattttagcaagcggcaacgacgagcgacccaaaaaaagcaatcaatagtcaccatatctgctcctctcgctccacacccccctcctctgcgacttgaggcaggacaggaggcagagacgggcaatggggttcgtgctggtggtctctctgcccttcatcttcctctccatcctcctcggcttcggctgctacttcctcggcaagcacaggggccgggaggagatgcggaccggcgtcggcgcgcagatctacggcacgccgctgccgccgcccggcgtcgtcggagcctcctcgccgccgcctcagccgttccacagcaagaaacaatggtccgaggctgtgtgactcagattcagacgtctctccatccattctactagtactactacatatatgtcttggtggcgatgttggatttatattctttcttctttaattttgccctagctgtcttgagagtgtagattgagagtcaaatatgtgcttgtgtctaaagatggtgtgtgtgtgtgtgtgtggatgttgtgatacgattgcaatcacactttatatcttctgtaatcaagcaaaaaccaatgcgttgcagtagaatggcttgtgtgtgtgactcctgcaggctatttatgtgtttgaagattgcaactgagcatctccacaagatcttttataacatctataaattctttagattcaatttaggatatgtcatagcagatcatctaaaacttgtctctcgtatttcttgaaatgtgctgtcagatgtctgaagttggggaaaaacgtctgaaggagcgttcgataggaagaaaaccaggtttctctcagaatgctgccaagttgcagaaccaggttaggccttatttggttattcgggaaggattttgacttaggccttgttcgtttgtgccggattggtgggtcggaacgattcctgaccggattgcttttctaatttatataaactttgattagctggaacgattccgggtgcaatccgatggaaacgaacaaggccttactaggatttaattcatatatggactaggatagaaacgaacaggccctcaaaaatcccctccaatgtatatagacttctctcgcgcctcgcgctagtctgtgaactttaattatataaaaacgtgttactttaattaataaaaacatgtgtagcaatatatatcgatatgttcacatagaaataatagaattatataaaaacgtgacattgatagatagatagatagctcaactgcttgtgctatgacagggaaatgaccaaatgaatgagaggtgggagatgagtctgacagttgtataacacaaacctcaacctttgctgggtatcagtttttgtttctttgtttaaagaaaattgtatgcatttattattagtactactactaaagcagatttcggtgcttatgattatgatgattcagaaatcaatggaggcgaccgagtagagcaacaatgggactatggaacaaactttggcaaagaaaaagaagaggacaaccgagagcaatctaggcctgcagacggttcgacattccttacacaacagtttagacggctgttgtagggacaataaagccagt

SEQ ID NO: 6441 - DNA, 2785 bp, Zea mays
ccatatcatatgatcttatatactcatactgaatggttatgttgtgttgaataatatatgaacatatggtcacactgaatattcaatgggaaaaagaacgacttaggctagcgggaatatagatgctagccttgaggaccccaaatgctttctctatagctcttttgaaatacaacaaatatctaccgttttagagtctgtgagagagaactagcagttttcatgaacaccaatcactgggagtagatgccatcgacaaggttgacaaggttgtacgttcatgtccatttattgtgaagttcaatttagtgtttctcccctagcacgtcagaacaacgacaattggttgtgcaccttgacatcattgatcggccccgctacccaaaagagaatgtcaaattaagtcatacacaggagtgttgaacatgctctttcctctaggatataaatcatttaacacaccttccaaacttttatagctttgatcaccaagaagaaagctcatactaatcaccagaagttggttggttgatgacattagactcatcatgaaaaatagtctccaacgtctatatcttttattgatgagataatgcgtttttatagaaattaatagccaaggtgtcacctcttatctgaacaaatagtcagaaagacacgtttgcagtacttttgacaacaaatgcaacaatagatctcgcgttgattaactgtaaatatctaaacaatattgtttgtcagagtataaatcccaaagcgaccaattgtttggaaacaggcgctagtattttggtcccggtggtggacatgtggactacatgacactatactaacaaaaaagagctgcacataaagtagggaactagtctggcaaacctctgctgtcctggtactggtactggtagtagaatcgtataggagtatttgtatgagctgtgtttaagcacaaaaaaactgctttggccagcggataccgtcactttggatgcagcaaataatgaatggttttatatggcaaagatgaagggtgtagaagtctagaagacgagtcatgaaggaatcaggattactagctcgttattacgcgtgtaaattgtgcatttgcagtcgctttcgaaatgactgagcgaaagagggcaaatgtgcgagttctttgctcaaccgtaatctcaaccagatggtggaacatgctaccacggatgaagaggtcagaagtgcagcacggggcagggcattcgtcactcgaccgttggagtccagactccagccaggccatgcagctcccctccctccaggccaccagcgccaacggcaacggtcacttgccgctacgctgtcagacagtagccagcacactccacaagcttcttctcttctcttgcaggctccagctgcagcccggccggcctccttccctaggattcttttgcagcttccattgtctccccggctatttaacccacccacccccgcttcgtctcccaatgccccaaagcaaagcaaagcttcaaagcatctctgctaggattttagcgagcggcaacgacgagcgacccaaaaaagcaatcattagtcaccatatctggtcctctcgctccacccccctcctctgcgacttgaggcaggacaggaggcacagacgtgcaatggggttcgtgctggtggtctctctgcccttcatcttcttctccatcctcctcggcttcggctgctacttcctcggcaagcacaggggccgggaggagatgcggaccggcatcggcgtgcagatctacggcacgccgctgccgccgcccggcgtcgtcggagcctcctcgccgccgcctgagccgttccacagcaagaaacaatggtccgaggctgtgtgactgagattcagacgtctctccatccatccattctactactactacatatatgtcttggtggtgatgttggatttatattcttagttctttcttctttaatttcgccctggctgtcttgagagtgtagattgagagtcaaatctgtgcttgtgtctaaagatggtgtgtgtggatgttgtgatacgattgcaatcacactttatatcttctgtaatcaagcaaaaaatttctgaaattgtgcttgtgtctaaagaggaaaaaaaaaaaagccaggatgttgtgctgtcagatgtcgtctgaagttggggaaacgtctgaagaaacgcaatcgtgtcaaaaaaagttctggatggcttggaaaccacaatcgtgtttccagcagcagtttctctcagaagaaacgcaaaaaccaccgaacgagcccttacttacaaatgcaatttcataataccgagagcatttattctatgttacaatcagaagaaactaaacctgacacatcagatcatttccttattattttacaaacagacaaaaccagcaccaaaattcgcagaacaaacagttctgcccagaacgaacaaggaggagaagaggccaagaaggcaaggcaagcagcacgtgctgatcgctccccacccgacctggctaattgcagagcaggaacctggtgagcacgagcaccccgcaggcggcggcgaagagcgcgaagacggccaggtccctggcctgccacctcctgggcctgtctgctgcgcccttggcctcggcgcggaggttcgtggccctgcgcagcgcgtccacctccttgagcaggtcgaagcggaggcccttgcgcttgagctcggtgacgcacctggccaggagcagcgtctcggctcccgccgaggcttgctccaggacggcctccgtgtcgg

SEQ ID NO: 6442 - DNA, 814 bp, Zea mays
ctgtggggcactcgggagccaccgttccatgccacaacaagacccagaacccacaatctttctttgtgcacagaaagaagaaagaacctatggcacagtcgtcgtccgcctccgtcaagctgctggttctggttgtcctccctgcgctcctcctgttcctcgtccaagcgcaaggggctcggccagcggcggcgaacgcgacgaccccgacccccgccaccaccaccgggtgcgcggcgtcgagcgtgacggtgtcgcagtccaacacgggcgacagggccgggtacgacccggtgttcgaggtgacggtgagcaacgcctgccgctgcgccgtccgcgccgtgcgcctccgctccgagggcttcgccagctcggtgcccgtggacccgcgcctgttccgccgcgccggccgcgactacctcgtcgccgacggccgccggatcgagcccggcgccgacgcgcgcttccgctacgcctgggaccgcgccttccggatgaccgccgccgccgtgcgcgacgactgctcctgatggagtgagtgagtgcggtagctcctgcctgcaacgagtgaattgcagtagctcctgtccttcgtgagagagagagactcgctctgtcgtgatccacagggaatttacctcggttttacgcttgtttattagcgcttcttcttaacgtattggctagttcgctggatcatacttcgaataaaaaaactccctctgccgcccgaacaaacaaaaaagtatgtttttttttcagtatcgtaaacaaagtcaatggttcacagtaaaaaaaaaaaaaaaaagcggcc

SEQ ID NO: 6443 - DNA, 937 bp, Zea mays
aatcttgacgggtctgtctacagtgtgcttattcatgggcattgtagggcaggaaatgttatgaaggctctcagcttcctttagctcgtcctgcagcgtggttttgctccaaattcaacaagcacgatttccttgattaggggtctatttgaaaatgggatggttgtggaagcagatcaggtgattcagcagttgttgaactgttgttcccttgctgatgcagaagcatcaaaggctcttattgacctcaacttaaatgaaggtaatgtggacgcagtcttagacgttctgcatggcatggcaaaggatggactgcttccaagtccaagatgagggtgattttcaacattcaagaaccaccctctctgtggaatactggagacctgatggtcatgtttggtacatattgtctcatgagtcataacacgagcatccgaatcagtgttatgtggtaagaacggtctgccctaaatcatgatgtgctccatatggaaaaggctgaaagaagttgcctcatgctgcattattgtgtaaagtgagcaaccatttctatctcattaaccgctctgctcttaacaagtgaaatgaattttggttcttgataaatacttgattttgaagggcaggctggtttagtgatgagagttgtttcactaagtcaccggatcttaggtttgaagcaacctctctgcatttgcagaggaaggctggtattgatttatcctttttctaggccccactcacgtgggagtctctggcactaggtctggccccttttataaatacttgattttgtattagcagctttttgtattgttgtttataataattattaggttagagaaggttgtactgatattttatgatgtattacttattgtcttacttttagacactataataaaagatcttgatatatgtagttagtgtactcaaa

SEQ ID NO: 6444 - DNA, 835 bp, Zea mays
  misc_feature (67)..(67): n is a, c, g, or t
ataatatgtataattttataactcataaaatatgtaacagttctccagtcatatcattttaaaaaanaatgtgtaaatcatcaacttctttttttttcagatatcatttaaagttgaaaaatagcagaatcaaactttcgtataggacctctatgtagattttcgcttagggcccccaaaatgtcaggaccggccctgatcctctggctgccgcccctccctattcttggtggtcgagtcttctcccatggatgctggccgtcgctgccctccctggtgctcgacaaaatgggtgacctacctcattctcgaccttgctgtggtggtcggtcacgccatggtcgtggatgctctacattctcgctatcgcgtctttaattgccgttggaaaggaaggtttcaggtttcggagctgatgaagtaagcgaagctcgaacgacgctctctaggtgtccgtcggatttccgatgccagacgtcgtcctctctgttccgtgtctccctgcatcttcatcgatgtagcatcggtcgtcaacctcgccgtggcagctctcaaactaggagtgttggtgcaaaaccgtcgtcaccccgtcattgcaggtcgctgcgctatcgtttgcttatgtttcatcatctgcgccatggcacttgctattgtccctagtttaattctatgtgtggttaatggtcgaagtctagattgcaaatgccaattttaatgaagggtatgtgtaggcatatatgtgatgagctgtcgaattaatatatgtaagataggtctagtgtttcgaaaaaaaaaaaaaaaaattcgactagaattatgtgagccaattata

SEQ ID NO: 6445 - DNA, 767 bp, Zea mays
  misc_feature (95)..(95): n is a, c, g, or t
  misc_feature (114)..(114): n is a, c, g, or t
ctgccgcccctccctatcttggtggtcgagtcttctccccatggatgctggccgtcgctgccctccatggtgctcgacaaaatgggtgacctacntcattctcgacctgctgtnggtggtcggtcacgccaatggtcgtggatgctctacattctcgctatcgcgtcgttaattgccgttggaaaggaaggtttcaggtttcggagctgatgaagtaagcgaagctcgaacgacgctctctaggtgtccgtcggatttccgatgccagacgtcgtcctctctgttccgtgtctccctgcatcttcatcgatgtagcatcggtcgtcaacctcgccgtggcagctctcaaactaggagtgttggtgcaaaaccgtcgtcaccccgtcattgcaggtcgctgcgctatcgtttgcttatgtttcatcatctgcgccatggcacttgctattgtccctagtttaattctatgtgtggttaatggtcgaagtctagattgcaaatgccaattttaatgaagggtatgtgtaggcatatatgtgatgagctgtcgaattaatgatatgtaagataggtctagtgtttctatcggctagttgtcatattcgactagaattatgtgagccaattatatggatacaatgatgacttgctttagaaattgtcgtgtcgatgttcagcatcagtgaaatgtcatagatgggtcgtcggtcatttagattaataaccttgtttaggtaatcaagtaaaatctgattgtgcttgagctg

SEQ ID NO: 6446 - DNA, 1399 bp, Zea mays
ccggccggagctcttgcattaaacatcccttgtggacggatttgatttgagggaagatataggttggaaccagactctgacaccgactacggagccaatccctcctgctggttcgatccaaaccctaccaaatcgatggccgacggcggcaactgcgggccgggcggcggcaatgcatcggcgccggtgtgcagtttcgtgaggaaaccacccaagaacatccggaagcgccccgccgcgcccgcggggtctgatgacgacgacgacggcggcggcggcgccctcgccgccgcgcgctccaagaaggggccaccgtcctcaaccgctggcaagctcgttttctccaccgcaggtgcttcctccgaggcgccgcggttccagtacgaatcgtcccggacgatccagtccacggacacccgcgcaactgccacgctcgagacggagacggagtttgaccgcgacgcgcgctccatccgcgagagacagctcaagcaggccgaggagtccctcaagaagaacccctccgctgttgctgcttccgcctccgcctccaccgctggagaggtgtacaaggggatccacggctacacggactacaaggctgggttccgacgggagcacacggtatctagcgagaaggccggcggttcgcatggtccgctccgggcgtccgcgcacattcgcctctcccagcggtttgactaccagcccgacatctgcaaggactacaaggagacggggtactgtggttacggcgattcctgcaaattcatgcacgaccgaggggattacaaatccgggtggcagctcgagaaggaatatgaggaggctgagaaggcccgcaagcgacgaattgccatgggtggtggtggtgagagtgatgatgaggcagcagatgacgaggatgaggaggaggcgctgccctttgcctgcttcatttgtcgggagccattcgttgatccagtggtcaccaaatgcaagcactacttttgtgaacattgcgctttgaagcaccactcgaagaacaagaagtgctacgtctgcaacaaaccgacgctgggcatcttcaacgctgcacaggagatccgcaagaagatggcacaggacaagaagcagcagcagcaggagtaggagagctcaaaacacaccgttgctaatttagctgtgttgtacaacgatgattggtgcgataactagagtccggtatttttcgccatcagataaaagagaccaagttttgaacgatcacaatgaatgcattcagatccagtcactagatccccacccccagacaggccatggtgcctgttggttcctggcgatgggcaaagctccaaaggtacagtgctagactgccaatgtgtttgtttgttgcagggcacccgaagctctttttttg

SEQ ID NO: 6447 - DNA, 737 bp, Zea mays
gtccgtggccttcaacgaatggtcatcgatagcgtaaataagtgcgacgttgacatacgaaaggagctattcagtaacatcttgctctctggtgggtcatcatcaattctgcagttaaaggagcgcctggagaaagaagtattggaggagtctcctcaagctgctcgtgtcaaggttatggcaagcggaaactcagtagagagacgtttcagtgtttggattggagggagcattctagcatctcttgggtcgttccagcagatgtggttctccaaagcagagtatgaagagcatggggtttcctatattcagagaaagtgcccttgaagccggggaaggaatatgtacaaccaatattatgctttacgagccttattgttgccaatgggttccttgtgtacaacagcctggtgccttgccatgttggccaatgaatactcgagactcttttcaagtgacgtttgttgtcttcgtggctagttagttttaggtgatgtaaggtgaacgcaagaactagaggtcaactgaaatatttatcattgacggtatgctgaatctgtctcccctgctgtagaatgagacgggaccccatattgttctgtaccggggctaactctttgccagcactcaaagagccaagacgattggtgtaactcgggttatttaaatcccatctgcagagcaaatactcagccgcaatcattctacaaaaaaaaaaaaaaactcgagggggggcc

SEQ ID NO: 6448 - DNA, 1905 bp, Zea mays
ggtgcccgcggagcccgcccgcgagaccccctctcgcttcgcccctccccatcctctctcctctctcctctctcccccgccccgttcgtctccggcgagctagggtttgcccccccgcctcgccaccccacggctcccgccatccttggatctccagccatgtacggcggagacgaggtttcggcaatcgtcatagatgtgggctcttacagctgcaaggcgggctacgcaggcgacgacacccccaaggccgtcttcccatcggttgttggttcaattgaacaaactgaagacacagatgaccccaagccagagaaggaagctgactctgcatcagattctaagaacggtgccaagcccatggatgtggacaaagccaagacaaaacgcagactttatgtaggccaagagttagagttcaggagggatcacatggaggtgatttcatctatgaaagatggaacggtaactgactgggatattgttgataatatatggaatcatgctttcagacggaggttgttgatcaatcctgaagagcatcctatgctcattgctgaaccatctacaaacactgcacagcaaagagagaaagcagcggaacttatgtttgagaactacaaagtgccagcgctgtttctagccaaaaatgcagtgctcacatcttttgcgtctggacgagctacatctttggtggttgacagtggtggtgggtctactgtggtttctgctgtacacgatggttttgttttacagaagtctgtgtcgacttctccagttggcggtgaatttttaactgactgtatgatgaaaagcttggagagcaagggcatcgtcattaggcccagatattcatttaagaagaaggaaatcagtcctggagaatataagattgtagatcttgatcttccaaacacaactgagagttacaggttgtactgcatgagagctattgctagtgacgtcaaggagtctgtttgcagagttccagacactgcttttgatgaagtggcatatgcaaatgttcctacaacttcatatgagcttcctgatggacaaactattgaagttggtgctgatagattcaaggttcctgatattctatttaatccatctctatcccagactattcctgggattgatggatttgcagattcaataccagtccgtggccttcaacgaatggtcattgatagcgtaaataagtgcgacgttgacatacgaaaagagctattcagtaacatcttgctctctggtgggtcatcatcaattctgcagttaaaggagcgcctggagaaagaagtattggaggagtctcctcaagctgctcgtgtcaaggttatggcaagcggaaactcagtagagagacgtttcagtgtttggattggagggagcattctagcatctcttgggtcgttccagcagatgtggttctccaaagcagagtatgaagagcatggggtttcctatattcagagaaagtgcccttgaagcaggggaaggaatatgtacaaccaatattatgctttacgagccttattgttgccaaagggttccttgtgtacaacagcctggtgccttgccatgttggccaatgaatactcgagactcttttcaagtgacgtttgttgtcttcatggctagttaattttaggtgatgtaaggtgaacgtaagaactaggtcaactaaaatatttatcattgacagtatgctgaatctgtctccccttctgtagaatgagacgggaccccatcttgttctgtaccggggctaattctttgccagcacacaaagagccaagacgattgttgtaactcgggttatttaaatcccagctgcagagcaaatacacaactttaaacgtgaaaaaaaaaaaactcgagggggggcccggtacccaatcg

SEQ ID NO: 6449 - DNA, 1157 bp, Zea mays
  misc_feature (967)..(967): n is a, c, g, or t
gcacgacggtggtaaggtgcatggcccgaccccagaccccctctcgcttcgcccctcctcatcctctctcctctctcccccgccccgttcgtctccggcgagctagggtttgcccccccgccttgccaccccacggttcccgccatccttggatctccagccatgtacggcggagacgaggtttcggcaatcgtcatagatgtgggctcttacagctgcaaggcgggctacgcaggcgacgacacccccaaggccgtcttcccatcggttgttggttcaattgaacaaactgaagacacagatgaccccaagccagagaaggaagctgactctgcatcagattctaagaacggtgccaagcccatggatgtggacaaagccaagacaaaacgcagactttatgtaggccaagagttagagttcaggagggatcacatggaggtgatttcatctatgaaagatggaacggtaactgactgggatattgttgataatatatggaatcatgctttcagacggaggttgttgatcaatcctgaagagcatcctatgctcattgctgaaccatctacaaacactgcacagcaaagagagaaagcagcggaacttatgtttgagaactacaaagtgccagcgctgtttctagccaaaaatgcagtgctcacatcttttgcgtctggacgagctacatctttggtggttgacagtggtggtgggtctactgtggtttctgctgtacacgatggttttgttttacagaagtctgtgtcgacttctccagttggcggtgaatttttaactgactgtatgatgaaaagcttggagagcaagggcattgtcattaggcccagatattgatttaagaagacggcaatcagtcctggagaatataagattgtagatcttgatcttgcaaacacaactgagagttacaggttgtactgtatgagagctattgctagtgacntcatggagtctgtttgcagagctgcagacactgcttttgatgaagcggcatatgcaaatgttcctacagcttcatatgagcttcctgatggacaaacttttgaagctggtgctactagattcaagggtactgatattgtatttaatccatctctatcaaagctatttcctgggattgatggatttgcaga

SEQ ID NO: 6450 - DNA, 910 bp, Zea mays
tgtcgatgtgccaatcaggttcgagttgccgaccgaaagatgtgcgcccgttatctgtactacagaagagagccttatcttttatcaagccgccaccagcaaaaaggccagcctcactcagggccgataaaacctttccctcgctttcgtcatcaaggacgcactccatcaaatacacatcacaaatttttgcaatttctaggagaacctccaccacggaaggcttcactgtgacatggttctgaagctcctctggagctgtttcttccaaaatcacaccaagcaagcggcatgtgaaccttcgtcctccacttagcttatgcttgacaagctgctcaagagtcagatttactggttggaacagctggttgactgcttcgtgtgctcttgaatctgctgatgaacaagcatctgttgtggttaaagcacctggtcgcgatctagtgctggtgttgcttgacgatggggcaaccctcctacgaggcctcggaggttgctcttgaggacctctcaacattttccaggcaaacagaagtgtgatcgagattgcagcaagtgtagtaagtgaacggagcttctggcgatcgaggtcgaagggcaggcgatcagcgtagcgagcgagggcgtccacgaggcgcctcaccagatcggcgagctcgtcatcattcccggccactgcccctgccaccggggccgacgccgacgccatcgccgctgacgagaggagaacagggtgggcggcgggggcagcggaaaccctaggaaagcgcgcacaccggtgagcgggaggacagggggtggggtgcgagatgccccgcaccacgacgagggtcgaggaagaagaggagagagagtttttgctgtgggggaacttttttttcgtcgttctcgcccggcctcgaaagcggcc

SEQ ID NO: 6451 - DNA, 1298 bp, Zea mays
  misc_feature (31)..(31): n is a, c, g, or t
  misc_feature (300)..(300): n is a, c, g, or t
tccccgcgtccggaattactgtcacctaagntaggaatgtccgtccaatgatggaagttgtccgaggagcagcctttgacattttacagtcagctggtggttctcctgcttcactcagaccgggtcggtggctagacttgtatagtggtactggatccgttggaattgaagctatgagccgaggatgttcacaggcacatttcgttgagatggatccttgggtcatctctgaggtcctcaaaccaaatctggagtgtactggatttattgacgtgtcacacatacatatgctccgcgttngaaaaattcttggcccaatgccgaaaaatctcaaggtaaatatccttcattcgattatatcagtgtaacaccaccatatctggaggtcaactatagcacactgctcgcccaacttgcaaggtcaccattggttggaaaagactgcttcatcctagttgagtacccgctgaaaacagacatggctgaatcatgcggaaaccttgtacagatagctgacaggaggtttggtaggaccaacttgctgatatatgggccaacttggtcagagaaaaagaagaaaagatgatttctgaagggggggttcaggcaaggtttgcatgcacagggtgtaatgataacgatgctttgtaaatcacggtagtgcacggttaagtattcaagatttgcacaggggatacttggcctagtgtaaggcataagaaggtggttgatcttggttcactgggcctatccctgaataacttgcacagacagagagctcgcatttcgctttcctttgtggtcagagatccacatccgagaagaggggggaaacagaggtcctctaccttccaaacatcagtatcgaatccacagctcatgcacaccttgggaaaaaaaaaagaaaagagatccgtgctctacgttgcaattctaattgatatcctgccaagtattcttcgagaggtccattcaaaaaaaagtattcttctaggcttgtgcacttctgtcactgttttgtaccccgtgtttaatttctgggcggtatgatatcaagagtacccagatgtatccgtcgttgctggtctaaacactaatagggtgtttggtctgaggaatgggctagtccattctcttctcgctcttttttttatttggtttattaaatagaatgagttgatctatcaccaccttattacttatagttagttagtactaatatgaggaataaagtcattctaccaatttaaaaaatggatttatgatataccactttattttggatcgagtgattcctt

SEQ ID NO: 6452 - DNA, 1204 bp, Zea mays
cattgggtacctcgaggccggcaggcaaggaaccctcttatcccttctcgtctcctgtcccggactcccgggaccggggaggccgggatcgagaaggggaacgagcgcgtcccgtgctcgccactcctcgccgatggcgtcctccactctgccagcctcccccttccgtatgtctcttcccggactacgagccccggaccctgctaaggttaagcacgtatccgttcgagcccccgctcgccgtcttcccgttgcagcctccgcggcaccatcaggcgccgcggcggcggcggcggcggcgagggagcgcaggcgtttcctggagcgctacgggctcaacccaaacgacttcgaggaagatgcagaggagaatccgagggaagagagaaaggacaggcggaggcggcggcagtcggggagaggggagcaaactgcggaagcggcagtgactccagcgaaggtggaggagcctcgggagactcacaaaatgctccaggtgctaggtggaaaagtccgcagaaggaaattactgtcacccaaagataggaatgtccgtccaatgatggaagttgtccgaggagcagcctttgacattttacagtcagctggtggttctcctgcttcactcagaccgggtcggtggctagacttgtatagtggtactggatccgttggaattgaagctatgagccgaggatgttcagaggcacatttcgttgagatggatccttgggtcatctctgaggtcctcaaaccaaatctggagtgtactggatttattgacgtgtcacacatacatatgcctccgcgttgaaaaattcttggccaatgccgaaaaatctcatggtaaatatccttcattcgattatatcagtgtaacaccaccatatctggaggtcaactatagcacactgctcgcccaacttgcaaggtcaccattggttggaaaagactgcctcatcgtgggtttgccttctgccttggtacgatgtaatgctaagcatggatcctgtggtgcttagccctcccctcttgatgattgttgcagtcgtcgctcacttattaccaaatgctgcagatagctgacaggaggttttggtaggaccaacttgctgatatatgggccaacttggtcagagaaaaagaagaaagatgatttctgaagggggggttcaggcaaggtttgcatgcagggtgtcatgat

SEQ ID NO: 6453 - DNA, 982 bp, Zea mays
  misc_feature (147)..(147): n is a, c, g, or t
gttgatatttaatagaccaagctaattagtgatcaacttcaggactagtgtcaatatgccaatcaggctcgagttgacgaacaaaagatgtacggccattcaccgtgctacagaagagaaccttatcctttatcaagccaccaccanccaaaaagcccagcttcactcagggccgataaaacctttccctcactctcatcatcaagaatacgctccatcaaatacacatcacagaattttgcaatctcaaggagaacctccaccacggaaggcttcactgtgacatggttctgaagctcctctggagctgtttcttctaaaatcacaccaagcaagcggcatgtgaaccttcgcccttcgcttagcttatgcctgacaagctgctcaagagtcagatttactggctggaaaagctggttgactgcttcgtgtgctcttgaatctgctgatgaacaagcatctgctgcggttaaagcacctggtcgcgatctagtgctggtgttgctagatgatggggcagctctcctacgaggcctccgaggttgctcttgaggtgctctcaacattttccaggcaaacagaagtgtgatcgagatcgcagcaagtgtagtaagtgaacgaagtttctggcgatcaaggtcgaagggcaggcgatcagcgtagcgagcgagggcgtccatgaggcgccgcaccagatcggcgagctcctcgtccttcccgcccccggcccctgcccctgccaccggggccgacaccgacgccgacgccatcgccggtgacgagaggtgagcggggttggcggctggggcagcggaaaccctagaaaagcgcgcgcaccggcgagcggggggacagggatggggtgcgagatgccccacaccacgagtccacgacggaggaagaagaggagagaggagggagggagctctgcttcgcgtttttccttttgtcaggattaagggcggaggagacgcgcaatttt

SEQ ID NO: 6454 - DNA, 1463 bp, Zea mays
tttttttttttttttttttttttttttcggcaaactcgtgtgacaacacaagagcgaatcttgatgtgacaaacttttttttttgtcctttcggcaatagcagggaggttggcacttgcaactatgctattttggttgtagttgtacattaacacaactgattcgacaagtatgctactacatatgttttcccttgaatagattctgaggcactacatatcgcacaacaatggattactggtacatagcacaggcttttacacatgatacaggaaaaaaaacgagttccatcattcgagcagagaaaagaaaaaacaatgacgtcctcccttctcactaatccgccgccgccgccaatttcctggatggagtttgacctctttatctctggtctaggcctccaaaatactgttccaagcttggagcggtgaaaacattggttgctattctttcaggtcgctgcggggagatgtgcagttgatatttgataaacctagctaattggtgaacaacttcaggacttgtgtcgatatgccaatcaggctcgagttgccgaacaaaagatgtacggccattctccgtgctacagaagagaaccttatcttttatcaagccaccaccaccaaaaagcccagcttcactcagggccgataaaacctttccctcactctcatcatcaagaatgcgctccatcaaatacacatcacagaattttgcaatctcaaggagaacctccaccacggaaggcttcactgtgacatggttctgaagctcctctggagctgtttcttctaaaatcacaccaagcaagcggcatgtgaaccttcgcccttcgcttagcttatgcctgacaagctgctcaagagtcagatttactggctggaaaagctggttgactgcttcgtgtgctcttgaatctgctgatgaacaagcatctgctacggttaaagcacctggtcgcgatctagtgctggtgttgctagatgatggggcagctctcctacgaggcctccgaggttgctcttgaggagctctcaacattttccaggcaaacagaagtgtgatcgagatcgcagcaagtgtagtaagtgaacgaagtttctggcgatcaaggtcgaagggcaggcgatcagcgtagcgagcgagggcgtccatgaggcgccgcaccagatcggcgagctcctcgtccttcccgcccccggcccctgcccctgccaccggggccgacaccgacgccgacgccatcgccggtgacgagaggtgagcgggattggcggctggggcagcggaaaccctagaaaagcgcgcgcaccggcgagcgggaggacagggatgggtggggtgcgagatgccccacaccaacaccacgacgaagaagaagaggagagaggagggagggagctctgcttcgcgtttttccttttgtcaggattaagggcggaggagacgcgcaatttgccgtc

SEQ ID NO: 6455 - DNA, 1635 bp, Zea mays
gaacggtgatagttctgattcccaggcaaggaaccctcttatcccttctcgtctcctgtcccgggaccggggaggccgggatcgagaaggggaacgagcgcgtcccgtgctcgccactcctcgccgatggcgtcctccactctgccagcctcccccttccgtatgtctcttcccggactacgagccccggaccctgctaaggttaagcacgtatccgttcgaacccccgctcgccgtcttcccgttgcagcctccgcggcaccatcaggcgccgcggcggcggcggcgagggagcgcaggcgtttcctggagcgctacgggctcaacccaaacgacttcgaggaagatgcagaggataatccgagggaggagagaaaggacaggcggaggcggaggcagtcggggagaggggagcaaactgcggaagcggcagtgactccagcgaaggtggaggagcctcgggagactcacaaaatgctccaggtgctaggtggaaaagtccgcagaaggaaattactgtcacctaaagataggaatgtccgtccaatgatggaagttgtccgaggagcagcctttgacattttacagtcagctggtggttctcctgcttcactcagaccgggtcggtggctagacttgtatagtggtactggatccgttggaattgaagctatgagccgaggatgttcagaggcacatttcgttgagatggatccttgggtcatctctgaggtcctcaaaccaaatttggagtgtactggatttcttgacgtgtcacacatacatatgctccgcgttgaaaatttcttggccaatgccgaaaaatctcaaggtagatatccttcctttgattacattagtgtaacaccaccatatctggaggtcaactatagcacgctactcggccaacttgcaaggtcaccattggttggaaaagactgcttcatcctagtcgagtacccgctgaaaacagacatggctgaatcctgcggaaaccttgtaaaggtagctgacaggaggtttggtaggaccaacttgctgatatatgggccaacttggtcagagaaaaagaagaaaagatgatttctgaagggggggttcaggcaaggttgtaatgataatcacggttgggaacggttaaggtttcaagatttgcacaggggatacttggcctagtgtaaggcataagaaggtggttgatcttggttcactgggcctatccctgattaacttgcacagcacagagagctcgcatttcgctttcctttgtggtcagagatccacatccgagaagaggggggaaacaaaaggtcctctaccttccaagaatcaatatcgaatccacagttcatggcttcatgcacaccttgggaaaaaaaagaaaagagatccgtgctctacgttgcaattctaattgatatcctgccaagtattcttcgagaggtccattaaaaaaaagtattcttcgaggcttgtgcacttctgtaactcttttgtaccccgtgtttaatttctgggcggcatgatatcaagagtacccagatgtatccgtcgctggtctgaacactaatttaacgcactcattcgcagtatggcaatgatgtggccaactaacggtccctttcaccttttggt

SEQ ID NO: 6456 - DNA, 2426 bp, Zea mays
atatatatatatatatatatatatatatatatatatatatatatatatatatacaaacaaatgatttttttacaacacaaaccaacatgagctatcatggttgttagaggcgagatatcatggttcgaatccggtagctgcgctacacgcgcgtgtgtgtgtggtggggggggggatgacgcatgaccgcgcgtgggggacgatgacgcatgacaaaactcctgctcatatcagcaaggatgtacgtccaaccatggtaaaagagtcaaattcaagatatattgaaacatatgatatagattgtatgttatgttgcaatatatgtgcatgtttagtaaaagatgtgatggagatcatataaggcattatctaacattcaatgacacaaaggcataagactatcttctagaactacatatacatgtaatctctcgtaaaaatgaagaggcacgggattagaacgattgcaatctaacaaaacaaatgaatggtttacttttatcattctccacctttttgacctaatatctcttcctcacaaatgttgttattcatcttttgatcatatgacaagagatggcacagttcatttactagcaaatctaggtaacctactaacatttatgctcagactagggggtaatggctctaaactttacaaaatttattggatcgaatcagaatcacgctctatttctattcaattttgaactaaaattaatcaagggtccaaataaattatgaagaaacatttggatcgttttccattaccacacttagctacctgatccatcctggacaaagaacttcagtggaccatttgctagagcttgaaactatctatccatcatcatgtaatgtgatgggtgataggtattcttcggtggtttggtcatacataggtctagatattcttcactattgtgcgcacggtaattatatttttgggcaaaaaatccagtttccgcaggttcaagcccaatcattttattcgtgatctgtatattctagcactttgatctaagtacggagtatggcgtggcacgtgggaacaaatttgattccacaattgtctgtatgtgagctgtagtacctcggcattgtagatagcagttaacttattggatttttcctaattgcatctccaaagtcagcgcctctgatgcagtcgtcatcatagttcgatgcacttgattaaataagaaattaacacacgcaccaactagatcgatcttgggtttggaagccagatcatcgccaccagcatcttccatgatgatgctataaatatgcatgcagtcctttgctgccgggtaacccagtcatatcgctcgtctgcaaatctgcaaatggctagcatcagcagtcttgcagcacttagcctcttccttctcgtgagcgttggattaagcgacgccatccgggtggccagatactccagctctcaaggagcgggacagggaggggggaatggtggggcggatcagaacggctcaggttcaggggttgggctcggttcgggatccggtgagagcggtgcggacggcgtctacgtgagtgccggaggcggtggtgagggcggtggctggtcacagtacggtggtactgcttttggtggcgggtctggtacggggtccagttccagccagtatagctcgggatcatctttcggtaatggcgggtctactcttgccgggggcatcggtggcggcggcggcggtggacagggctcggagaaccaaggctccggtggctacggtaccggcggtggcaccggatccggctctagtgaggctagctccggcgacccgccctcggccacaccaccgtacgcaagcgcagatgcttctggcaatggtggtggcatgggcggtggtcgcgacggtgggactggtggcggtaaaggccacggatctggattcggcgaaggacagccttaagagtttcctatcagattttcaaagctggaggccaaaagatgctatttcattttcatttgctttgcgtacgttgatttttttatagttttacttgtggcccttttttgtacttctagttctagacaggaactaataatggcttccagcaaccctagctagccatgacctagcaatgcgagttcaacagatcagatgtttgaagattattgtgtggtcattattatagtaactcattgtgttctatgtgttctcatgtggcgcggcccctccagtgggtatccctttgatattgtttgcaaattgcaacaccgttttgtgcaaccttgagttgattgcagacttgtagtgacctcacagaaaggaaagagtgccggacaacacaggactgcaaactatattgtttattacactagtgcatgcataagctggtcagccggtgacttctccatttacgtgcatggggttaatggtcgcacgcactatcgg

SEQ ID NO: 6457 - DNA, 1904 bp, Zea mays
cttgtcccgattgatccacaccttttccgccgctccaactcccaccaaacaatccgctagattacatacgctatgctgtagcgacgagatattgctacagtgattaggtagaagagaggggaggagacgccattgtaacatggatggacgaggacgacaggaagctagctggctggctacgtacacgtaggtatacgtatgtatgtacgtacgtgagacagcaaggctgcacctgtcccatgcccgcatcgatacggatagatgcgtatttattaccactacaacaaaaatacgacccgtatatgcatggcgcgcgcggaagccaacgcaggggtcaaaagcgcgacgccgccgacgcgcgctatatatccgtcgcattgcaacctaacgctacgtcgtgtgcgcgagtagtagtgctgtgctgtgtgcctgtgtggctgtgtgctcatctcgatctacatatcgtgtccacgcacgcaggaggagagcgggcggtccacgacgacgtgcagcgcgcggcggccatggagggccactactcgcccacggccgcccccgaggtgagcggcgagcggcggttccgcggcgtgcggcagcggccgtggggcaagtgggcggctgagatccgggacccgcacaaagcggcccgcgtctggctcggcacgttcgagaccgccgaggccgcggcgcgtgcctacgacgaggccgcgctccgcttccgcggcagccgcgccaagcttaacttccccgaggacgcgcgcctcaccacgccgtcgtccgccgcggccacggccgccaccgcggcggcgggatccacgaggacgatggccgtggcctccacgggagggtacccggccagcgccgcctctgctgactacctgcagtaccagatgtttctgcagggtccgcagggagccaccagcggcagtcatggaggggggtatcctctgtactacgactatggcggccacagcggggctggcgatggtgccctgagcagttcttcgggctcctactcttttccggcctccacggttaccgtggcttctgtgccctcctctgctccgagctacgacgaggcggcgcagtggacaagctggccggagagtagtgctagtgcgtggagctatccggcgaccacgggttcttggtctgcttcaagccagtatccaccgtcaactcgtccacctcagtagtccatgctcaatgttttatttcataacacgttcgtggcctccctaagaagacatatagattgatgattttgttcaagatgcatgcttccgtgcaagatccaatagaaggttgcaatattgtgtttcttcttcgcttggtggtgttgaatcctgtatttgatcatgggataatgattttggttgcaacttcatcgaagacgcgcgtgatggatggtaatatttcgttaagaagtacttaatttctcttaatgaacactaccgaaaacgagcgctttgtcgagtgcccgaagcactcggcaaagccttaaaaacactcggcaaagaaggctcgataaacagtgcatcggcaaagccttctttgtcgagtactttttctcgcgcactcggcaaagaaaagcagccattacggcgacggggtgacggagacggtgtctttaccgagtgtcacggatgacactcggcagagataacacctttgccgagtgtctgcccggcagcactcggcaaaggtaacttttttgccgagtgccacctaggacactcggcaaagaacccgccagggagggttccccatgtcaggttctttgccgagtgctatgtatggcactcggcaaagtgtgcctatttgtcgagtgtcagagacattacactcggcaaagaacctataccggtgcccaggtcttggttctttgccgagtgctatggtct

SEQ ID NO: 6458 - DNA, 1119 bp, Zea mays
gccgtgtccgtgtgcgcgacttgctagcgagtgctgtgcacagtgtactcagctcatctctatctatccgcgcacgcaggaggagagcaggcggcccacgacgtgcagggcgcggcggccatggagggccactactcgcccacggcctccgccgccgaggcgggcggcgagcggcggttccgcggcgtgcggcagcggccgtggggcaagtgggcggcggagatccgcgacccgcacaaggcggcccgcgtctggctcggcacgttcgacaccgcggaggccgcggcgcgcgcctacgacgaggccgcgctccgcttccgcggcagccgcgccaagctcaacttccccgaggacgcgcgcctcaccacggcgccatccgctgcggtcgctccggcggcggcggcgggatccacgacgacgatggccgtggcggcctcggcgggcgggtcgtaccagcaggaggccagcgccgccgtcgtctctgctgactacctgcagtaccagatgatgcttctgcagggggccgccaccagcggccaaggcagcagcagcagtcatggcgggtatcctctgtactacgactatggcggccacggcggggctggcgctggcgctggtggtggtgccatgagcagctcctactctttccccgcctccacggttaccgtggcttctgtgccgtcgtcctctgcctcctccgctcccagctatggcgaggcggcgcagtgggcaggcagctggccggagagtagtgcgtggagctatccggcgaccacggcttcttggtctggatcaagccagtatgagtatccaccgtcaactcgtccacctcaatagtccatgctccatgtttcatttcatataagacgtatacacggccttcctttttttcccccatctactccacaaagaacaaagcttttgtggttcagaagacacagatagatagatgattttgttcaagatgcatgcatccgtgcaagatccaagagaagaggttgcgagattgtgtttcttctttgcttgtggtggtgttgaatcctgtatcgatcatgtgataatgattctggttgcaactaaatcgaagacgcacgtgataataaataatatctcattaag

SEQ ID NO: 6459 - DNA, 470 bp, Zea mays
gcaccacaccgagggattagaagaaagaaagcaaaaaaaaactaggcattcagcttgcttgcttggggcgctctagtgctcgcttgctgcacctgcaccggtcgcgcacagcctgggaagaggcgagctgaggtctgaggaagccgagaagccggggctccgcgtgcgtacagggacagagacggcaagccggagtgtggatccgttggtgaccggaggaccatcacccagagcgagccatgctgcagcacggcgaggagaagaaggggaaggtgaagaaggggtggctggcggtgcgcgtcggggcggcggagggcgacggcggcggcggcggcggctcccagcagcgcttcgtcatccccatcgcgtacctgtaccacccgcagttccggcgcctgctggaggccgcgcgcgacgcctacggctacgactactccgcggggccgctgcgcctgccctgctccgccgac

SEQ ID NO: 6460 - DNA, 1903 bp, Zea mays
ctgcatgatcgatcaagctgatgtttcttgaaatttttcttcgtgttgctttcacacacaccgcaaactaatatagctggtcctccgagatatatatattaccacgtatgacgtatgcacatgtcggggaggggggtagaaagagagaaaatatatgcggatcagcagtcttcgccgtgcaaatatccgtgtagtactgatgtaggagtagtggagtagacgcacacacactcgtaattaagcatggcatgaaacaacttgaagagtacaccaacctcgtttgatcgatcggaaaaggatccaaatccagaggattactccagcctacatgtttggctagctaggaccgatccaccgtcatcgtcatctcatctggtttgccgggccccactcgatcgcgcggccagtgcagcctccagccatcgtggattcgtgggggcaggcaactgggcaagcgccaccagcagccatcgaccgcgcgcagcagccaactgaagcggctcgcacttgtcctgccgggatgtcgattccaccactctctccgtccgtggcccacggtccacagcaggacgcgccccccggacctgcctctgcctgcacggcgcgcaccatatcctcgcctccgatccatccacggccacccatccgccgcccgtccatgtcaggtcatcgatcgatcaggcctgggactgggcctggccgtcgtcagttcgcagctcgcggacggaacggagcttagtgcgatctgtctcacccggagctgaggaaggctgcctttcctttcctctcctttcctttccgtaacacaaaggacgtactagttcgtgcacccgcacgcgccccggccagccactaggcacactaccgcactttgcagtagctcccgggtcccggcccgcccagcagatggagagttccctataaaaaccagcacgagtggcacgaaacgcctcgcaccacaccgagggattagaagaaagaaagaaaaaaaaactaggcattctgcttgcttgcttggggcgctctagtgctcgcttgctgcacctgcaccggtcgcgcacagcctgggaagaggcgagctgaggtctgaggaagccgagaagccgggctcagcgtgcgtacagggacagagacggcaagccggagcatcgatccgttggtgcaaggaggaccggaggatcaccactcagagccatgctgcagcacggcgaggagaagaaggggaaggtgaagaaggggtggctggcggtgcgcgtcggggcggcggagggcgacggcggcggcggcggcggctcccagcagcgcttcgtcatccccatcgcgtacctgtaccacccgcagttccggcgcctgctggaggccgcgcgcgacgcctacggctacgactactccgcggggccgctgcgactgccctgctccgccgacgagttcctccgcctgcgcgcgctcgtcgagcgggaggtgcaggcgccctcgtcgtcgtcctcgcaccaccaccgcgtccacgccggcggggggtcccacggcggccactactccctctcctccccgtgcacccgcgcaagggtcacctcgtgatcgaccgacgacctcggctttcctacgcgtgtgtgctggatggtggtgtctggtggtgtgtgtagagcgagggacagtatagttgctcgtagattataggtctgggcattcgggttacccgataaattcgggtcgggtaattcgggttttctaaaattcgggttttaagaaccgttacccgaagtatacccgaaataagcgggtacccgaaactttggtacccgaaaattcgggtacgggttcgggtttccccgaaataaccgaattgcagaaaaatgcatgcaacaatataccaaataaccaatgtcgcatgataggtagcagt

SEQ ID NO: 6461 - DNA, 688 bp, Zea mays
gccggccgggtcgcggaccccccacgcccctccccctcttgataagcccacgtcggcggcagccggggcggccgccaggcttgctatagctggtccatggcaccatacatgtaagcacgcacacaggcgcacacacacgcacgcaatgatctacgtatctagcagcagcttatcatgtcgtcatcatgcatgcatggacgacggcggtcgtcatcttatctgggagcgtgtgtgtcttggcaatgggaagctgcatgcgcctctcggccggacggcgcgtagctgtagggcggcgtgccatagagctgcctcctgccgctcaccttgctgttgaggacgactgatggtggccatggccactcggcgtcggtggcggcggcgccgagttttacctctctactaaggtagggcaacttgtatcctttggcaattgttctcatctatctgggtctatctgttggctgcccggtgacggtatacggtgatgttctaatagtactcaattggtcttggagttcatgctacggctcctctgttatatattacacggctgacggctcctccttattaatgtgtactttgatgatgtcattaataatatgaatctgatgatattgaataaaaaaaaaaaaaaaaggccggcggccgctcgcgatctagaacctttttttttttttttacataacac

SEQ ID NO: 6462 - DNA, 5431 bp, Zea mays
tgtttatttatataaaatgctattacagatcaacgtggaaagaggttaaataattaaagtgcaaataatattattaattgagtagttacgtcattaaatatctaattaaggagatgtagggtaagtttgaatgcactagagataatagttagtggctaaaattgttgatacatccaaacactctaactatttttggtaaattagttaatagttaggtagctatttattagctatctaattctattaataatttttagtcaactaattattagttccagtgcattcaaacaccaccgtagtatgagagcccttgttgggatgccagacccgtttctctccgtcaagtagttgacaaggaccaacaggcttgtttggatcacatggattctcaaaatttagggtatgtttgatcgattaaagtttaatgtgtcacctcgagtctttgaatattaagtattaaatactccaactgtcttaatttataattcattttactggttcattttattcattttttgcgaaaaaatgaaaaattctaagtcatacttcaagtatattatatgttatatgatatcatagtaaaaattaacaataattatatttttttaaaagaagagtcagccaaatatgatgtaaaaagtcaaatgagttataaattggaatagagagagtacatgcttaattaaacttaataaatttgtctcatcgttttgtatttatgactatatttaatactctcaattgtcatttaagcattctatgtgacttagaatatactttagtttggtagaactaaacctccttagatactacataaaatccaatacaagtctgtttataagcctaagaaaagataccgaatgaaattatatgcacaaaatacaatgcaaaatacacaagttgtttggttaacattgagattctataataaatgagacctgtaccaaacatggccgtagtatcattgcaccactattttcctagaaaataaatgacatccatagcagatagcaccgatgttcgccacaaaatagacaaaaccatgtgatttgccaagatctgaggatgaagtcacttgtaatggctgtttaggagtgaattaacttaaggagtagtttggaaactccattttaccaagaattttctatgtttttaagaaaaaacgaattaatttatctttgaaagatgaaaatcatttgaaaaaatagggtttccaaactagggctaaagagagagaaaatatcaaactttaggaggaaactgtgaataggcgtactgctactgcagagacgaaactaccatgggccacagtatcatagtcgttcggcccgtcttgggaaccacagtgtatcggtcatacggccgaaaaatgggagagcccacaggagttacgaaacccattctataaagccagccgctcccatttcaccgccgagcagcttcgagcccactaagcctttggcaccccaagaccgccggtaccatgccggtcctccgctccccgttcgccgggggcgacctccccgccggcgacgccgacccggactacctctatttccttgaacacatccgcatcgacggtgactcctacaccctcgagctcccctcccacggcgactccccgccatcactcatcaagtacgagaccccgttcgccagcccctccgacggcgagtgcgtctccgatccctcccagggccgcctcagcggcaaccgcagcgcgcaagacgagagggaaccggtggagtcggcgtcattggagacgggacccgcgtggtacgattgtctccatgacgtcgacgaggactaccgcctcttcctgcagcacacgcgcgttgtggacggccaattggttctggagatcgggggcgtcgtcgtcaactacgataacccggttgctgtggaatctccgggggagaaggatacgcagcggggggaagaggcggtttttgcttcgccgggggaagggatcagtgttgcagcggggagcgatcaggtcgcctccggtgctccagcgacggctgtttcggagcagaacgcgtccgattggcgtgcggatccatcaccacggcgtgaggtgaacgatggcggagatgaggggctgtcggatgcaagcgcgctgaagggcgcgtattgggaggcgagctcaagcgatggccgtcgtgcaccccctactaattcggtgagaaattctgatactcacaactgcgtgtcactgtcagtttggcactagctcatgctgtccttcgggataaggaataacagtatacagtacctattagctctcagtccctaaagtattttcatttctgtacatccgtgcttggcagcttgggccaggagctgtatcagataagaataaaaattaaaaatatgccagtagcccagtacgtttcttttacataaggtgtgcctttctcaactttctttcagaacgtggatcgaaatgtcccattgaagttacttgaagaaatatatattttaatttctgtattcttctaaaacagatgatgtttgacataattgctgcatttgatttgctcttccttcctgttcatcttatataggggggaaaggtagaaaaggaactaggtattatatggcctacacatatcacaagaaggccagattcagatttcaagcgaaggttgatcaaggcccttacaaaaccagttgctcggaaggaatactatagattgtttgacacggttactatccgtactccgttaatgaagctgcggcaggtccgcaacgaaacaaaattctatcctaccgaagagatgggcagttcatatttggaccattacccaggtacaattttgcagcgatttgtacttcttgtttatgaacactgtctccatatttcttctcccttcacacacttatttacattcctgttaatgaaaatattccaataaatttctggtatgatgccctttatcggtcttatctgtatgactgtatcactgcaattactgtcaagttttttcatctcctcgagaaaactttgtttttgtcaatgacattcaaacatttttttgcccattcttttttggtgcatcatatatattatgatattgttgaatcactggtatatgattgtgtacataggccacaccttgatatcattggttattcctttagaacctgtaatgtcgatagtagtagttaaatggaaaaaggctcagttacagtaactgttatcgtttgggtactcattttcagtgtcaattactgaagccatcagtagtctatgcacaacatttctataggtgttgtggcaatttgattttcattatagaacactgcaaatgttagacttagtttgttgttgaaccctataactgattaatggctcatttcacctaagcaattgattctttggagctttgtgtttctatgctgagatcatagtcatgacagaatggtaaataaacacacgaactagattcattctattgaatagtatatttatttcccatcagaagattttcctttccttcacttttgtgactaaactatttttggggtgactgtgtagtaacacaagaagcacccataagggacttatgtagttggcgctgagaaacatattgttgagaaatagtgcttttattcttgaactgttcagattctcttgtaattctagtagtaactaatgcattttcttaattttatttacttcagatctggcggagcaaattatgaacaatggccgtcgtaatggcctagctctgatgcgcgggtttctcttctggttgcaggtagcctagtaattattttggcaccgcctgttgtctctatctttgcattttgtttgaaaaagttctcatatatcaaatccatatgcttccatatcttttgttcaagcgcaattgtacaagcgtaaacctgtcgttctctatattgaactacatattttttttgtttgggtacaactattcattttgttttgctgagataggcattttctttgcctgcgtggctccaagtcaatataggcgcccatcgggtctggttaagcagacctgatgtcaattatactggaaccagttttgtttgcagcatcagtacatactgtcttcttattgccaggcctaagcagcaatgtgaatctgctaactttgagcttcattcttctgcaggccgcagtacatgaagatcagttcaagccatgggtagatgattctaataaagaacatgaagttatttatttggtggattgagctcgcactgacttggtggctatatcattcgtttgcttgatttcgcccgatggtggtaataactctgcgcgcgtgacaaattgtcctcagcggagactgtacggatcccaacatgcgacggaaacctcgatcctgggacctggaataccatgttcacgagtatctattggatagcaatgcacatacattccagctgttgagtgaataaacggttcctcattgaaaataatacatgaacgctctatcttatgcattgtgtgattacgtctgggatgtgacccctgtagagttttcccaagactggagttagggtttggtcaatccgatgagttgttgcacttgatctccctatcatttaggatgctgcaaacaggatgcatagcagattggataaaaacttcgttagggcttctagaaagtgagctaagggcaactccatgagactctagatccttcctaattgctcgaaatcgagattttaattaaaaaaatcctgagtgacactttaattggttatcttaaaatagccacctttcattctagaattttcgctagccaaacataggaagcaagaatgactctctagagtacaaactagatataaaaaatattgtccagctgttagaaatattgatgtttatgcaaatggctctcctaatgatgatttagagtgagttttagaaagattcctgaagatgctctagggtcccttaaggagttctaccaaacaaagcttaatagaatttgtcaatgcctggaaaaggccatacccctcattcgtggccaagacacacttaggctccgttcggttgtgcccaaccagaccgggttcggtctggattggggggcaatccaggttgaaatccgaccccagtagaaatcccggtttctaattttttttatgttcgtttaagcccactagaattttagcccataggtttggattttttttggctagagaaggtactggattggagccacgacccgaagggcctggaaacaaatccgaagcgggcgacacgacgaagagcagcggcggcgcaagcgagagatgagatgctgctgagcggcggtggcgcaagcgagagacgaggtgctgctgagcgtcagcggcgacggcaacatcttccccgccgctagcaaactctactgcaccggcaagcttctctccggttggtccctctcactttagctagggttctgaa

SEQ ID NO: 6463 - DNA, 1560 bp, Zea mays
acgaaactaccatgggccacagtatcatagtcgttcggcccgtcttgggaaccacagtgtatcggtcatacggccgaaaaatgggagagcccacaggagttacgaaacccattctataaaccattacctagaacatcctaatccgagaagcttcgagcccactaagcctttggcaccccaagaccgccggtaccatgccggtcctccgctccccgttcgccgggggcgacctccccgccggcgacgccgacccggactacctctatttccttgaacacatccgcatcgacggtgactcctacaccctcgagctcccctcccacggcgactccccgccatcactcatcaagtacgagaccccgttcgccagcccctccgacggcgagtgcgtctccgatccctcccagggccgcctcagcggcaaccgcagcgcgcaagacgagagggaaccggtggagtcggcgtcattggagacgggacccgcgtggtacgattgtctccatgacgtcgacgaggactaccgcctcttcctgcagcacacgcgcgttgtggacggccaattggttctggagattgggggcgtcgtcgtcaactacgataacccggttgctgtggaatctccgggggagaaggatacgcagcggggggaagaggcggtttttgcttcgccgggggaagggatcagtgttgcagcggggagcgatcaggtcgcctccgctgctccagcgacggctgtttcggagcagaacgcgtccgattggcgtgcggatccatcaccacggcgtgaggtgaacgatggctgagatgaggggctgtcggatgcaagcgcgctgaagggcgcgtattgggaggcgagctcaagcgatggccgtcgtgcaccccctactaattcggggggaaaggtagaaaaggaactaggtattatatggcctacacatatcacaagaaggccagattcagatttcaagcgaaggttgatcaaggcccttacaaaaccagttgctcggaaggaatactatagattgtttgacacggttactatccgtactccgttaatgaagctgcggcaggtccgcaacgaaacaaaattctatcctaccgaagagatgggcagttcatatttggaccattacccagatctggcggagcaaattatgaacaatggccgtcgtaatggcctagctctgatgcgcgggtttctcttctggttgcagaacgcagtacatgaagatcagttcaagccatgggtagatgattctaataaagaacatgaagttatttatttggtggattgagctcgcactgacttggtggctatatcattcgtttgcttgatttcgcccgatggtggtaataactctgcgcgcgtgacaaattgtcctcagcggagactgtacggattccaacatgcgatggaaacctcgatcctgggacctggaataccatgttcacgagtatctattggatagcaatgcacatacattccagctgttgagtgaataaacggttcctcattgaaaataatacatgaacgctctatcttatgcattgtgtgattaa

SEQ ID NO: 6464 - DNA, 793 bp, Zea mays
  misc_feature (789)..(789): n is a, c, g, or t
gcacgagaccattacctagaacatcctcatccgaggagggagtggtgatatatgcactgctcagtacgcagccgctcccactactagattcaggtgagctcatcattagtgccccggcccttggtgcggtgcggccaacggccatggcgaagcttgccgcgcagctcaagagcaagttctttggcctcgtcggccgcatcaccagctgtggccgcgccggcgccacccacaaggatgccgctggtgcgacagaggccaagtcatcagtgggatcccagcctgttgagatcaggtcaaggggaggtgctcctcccgttgatggaggggccaagggtcacatcaacagtgacaccatctagaggagagggagaggagaagagaagagatcgaagagaagagaagaagctcaccgatagttaccatgtttgaaagaactgaagctgtaaatcacagtcgtcgttgcttgtgtgtgtgtgtttatagttcctccatggtttaccatcactttcagcttttctagtatatctagtgcttgctatgtttcataatttcgggctatgttgtttcagtgtacggtatttttgtttgtttccttccacgattatataatctagcttatggattatataagcaactattgacctgcttatggattaccataatctaggtgtctaggttatataatctatctaataatctgttttgtttgtttgcctctcaacttatttaagttggattactgtttgtttcctttcaaaattatacaatccaacttatagaatatggccnagaa

SEQ ID NO: 6465 - DNA, 1498 bp, Zea mays
ctgcgcattgcgccgcacgctccgagtggtgggcgccgactccgtccaaaaagaggagcgtctacggtccgccagcgagaacggggggagagaaaaaagactaaaaatatcgagcagcagggccaggccccagggacaggcagagcagctcaggcgccgctgcctcttcaaagtcctcccagatttcccctcgcatccgccccgatctcgcctccaatggacgcggtgccgcccgcgcgcgcggcgcggcccacgagcccgtcgcgagcgcccaaggcgatccgcagcaccaagccgcggggcctcgacgaggacaccgcggcgccgcccgcgttccccaaggccaagtccctcccctcctccgccgccggagccgaggcctcgctcctccaccacaaccaccacgcggacgtcccgatggacgcccgcgtctgggcggggctccccgacgacctcctcgtggaggtgctagcccgcgtgtcgcccttcctcctcttccgcctccgtaccgtttgccgtcgctgggagtccgtcctccacgacccggctttcctcgccgcgcacgccgcggttccctcccacgggccctgcctcctcaccgtctccaggggcggcaacggcacccactccccgccgcagtgcagcgtgctcagcgtccccctgcacgcccgctacaagctccccttcgccttcctccccgcctgggacctctggcttgtcggctcttcgggagggctcgtctgcttctccggcttcgacggcgccgccttccgcacggtcgtctgcaacccgctcacgcaggcctggcgggtgctccccgacatgcactgcaaccagcagcggcagctggtgctcactgtagacaagaaccgccgctccttcaaggtaatcgccgccagcgacgtgtatggggacaagactctccccactgaggtatacaactccaaggaggataaatggtcggtgcaccagatgatgcccacggcgaacctgtgctcgtcgaaaatggccttctgtgactctacgctgtacctggagacgctctctccgctggggctgatgatgtatagagtggacgcggggcgttgggagcatatacctgccaagttcccacggtccctgctagatggctatctggtggctggagctcgcacgaggctgttcttggttgggcggattgggctatacagcacactgcagagtatgaggatctgggagctagatcatggtagatcagtttgggtggagataagccgaatgccgcccaggtacttcagggctctgctgaggttgtcggcggagaggttcgagtgctttggacaggacaacttgatatgtttcacttcctggaaccagggcaaaggtcttctctatgatgttgataagaaggcttggtcatggattgctggctgcgctagccagctgtgcaatagtcaggtctgcttttacgagccaaggtttgatacatcaatctattgagtacggcaatatgagatta

SEQ ID NO: 6466 - DNA, 1824 bp, Zea mays
tgtcgccggccgacgcgtcagccacccaccctcgcgatcagacggccatggccataacgagctccaagatctgacggcgcagatccgtttctaaacccgtatatattcggccgggtacctcgggcccggccgctctcttttccgccctccacccctcgcgagctctccacccctccacacgaccctcctcggcggcggcggcggcgatgcagatggcggcgaccaccaccgagtcccaggcggccgtgccgcctcaacaccctcacgcccacccccacgcgcccccgcagcatgctcacccgcaccaccacatgccgcagccacggtgggtcgtcatcccgtacccgccgccgccgcccatggtggccgcgccaccaccgccgccgcagtttgccaagcacttcgctgctgggccgcccccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccggccatttaaattgaactgggcatcgtatagcatgggtgaaaagcgatctgaagtggcttctgatcactcgatatttgttggcgatctagctgctgatgtcactgatgaaatgctgctggagcttttctccagcaagtaccgctcggtgaaaggagctaaagttattattgatgcaaacacaggccgttccaggggctatggatttgtcaggtttggagacgacaacgacaaatctcatgccatgtctgaaatgaatggtgtatattgctctacgaggccaattcgtataggacctgcgactcccagaagatcttcaggtgattctggctcctcgactcctggtcattcagatggtgattcttctaacagaacggtatatgttggtgggcttgaccccaatgtcagtgaagatgaactgagaaaagcctttgccaaatatgatcttgcctctgtgaaaattcctctaggaaagcaatgtggctttgttcaatttgttagcagaactgatgctgaagaagcactacaaggattaaatggatcactcattggaaagcaggcagttcgcctttcatgggtccgcagcccatcgcataagcagtctaggggtgactccgtcaacaggaggaacaacatgtactatggcacaccattctacggcggatatggctatgcctccccggtgccacacccaaacatgtacgctgcagcgtatggcacgtacccgctatatggcaaccagcagctagtgagctagagagctcccctccgacgtgtcccctctgacgggaaacaaaggttttggtccggtgagcatagtagcgtcaggtgagaaggtgcctttataaggctgtcctaagaagtgggcgagatatgttgttgcatcgttatcgttatggtgcctgtaactgttgtgtgtgccgtgtgcgtccggaagaattggatggaatggaactcgtggcttgttgtagtacatcagagagtcatgttattctttcaagaaattttgacttggtaataaattaaactattgtttgtgcgtccaaaaaaaaaaaaaaaaaaaaaaaaaaaaaaaaaaaaaaaaaaaaaaccccaaaaaactcgagaggggg

SEQ ID NO: 6467 - DNA, 905 bp, Zea mays
  misc_feature (8)..(8): n is a, c, g, or t
tcgaggcnccggcggtattcgagacgtcacggccggattctgcagtatggctcgccgactctgccgtctccctcgcctctttcccctcgtctcgtctgcatccgcctccgccgccccaagacctcatcacctccccttcgccgtgaaccctaaccccgcgcccctcgccccctccttctcgtcgtcatcgccgcccgcttttccgggcccccatcgcctcttctcttccacgagtggttcaagcatggtggtcgtgggctccgcggactccttcaacagcatcttttccaaggtgcaagatgaaaagctaccagctgtcttttactacacggcggtgtggtgtggaccatgtagggcgatcgcacctttagtatcaaagctgagcagccagtatcccaagataccggtgtacaaagttgacattgaattggaaggactgggaaacaaactccgtgatctaaacatatgttcagtgccgacgttccacttctatcacaaggggcagagaattagtgaaatcgtgggtgctgatgcaaagaaaattgaagctaccatggaaagtctccacaagcagcagtagaagtttcagagcagagcctcaacctcacaccaatggaatggtttaatctacctcgcatgagaagtgttgcgcacttttggattcgtgtttttctttacgtgtcacaccgtgtgaacgccagcgtttcgtcatcagatgcttgtgattcgtgccggcttgtttcatgtgaagacatcagatgcttgtgtttcgtgccggcttgttttgagttttgggtcttgagcttcggcgactctgtccagagctgcggatgtttctcatgcttggaatgagtgagatgggttgaaaatggccacccataaacaaaaaaaaaaagagtcgagcg

SEQ ID NO: 6468 - DNA, 1978 bp, Zea mays
cagcaattgatagaaagacgggacatctagagagtgtcgtaaacaagctaaaagatatagataagaaaattacagatttagttaccaaacagcagcaaatggatgctgaacgtgatcatgcgaagtcagagttggaacaatttaaggctgacattgccagggctatgaagcaaagggggtcacttgagaaagcccttgtcaagaaggaaaaatcacttaacaacatctgcaaccaaattgagcaagtccagtctagcattgcaatgaagaatgatgaaatgggcacagagcttattgatcagctaacttcagaagaaagagatctcctttcacgattgaatcctgaaattactgatttgaaggagagatttctaatgtgtaaaaacagtcggattgagatcgaagcacgaaaggaagaattggagaccaatttatcaacaaatcttatcaggcgtcagaaagagctagaagcgataatttcatctgcagattctagaaccttgcctttggaagctgaggcaaaggagcaagaactgaaaagttccaagagaaaccttgatgaactaacttcattattaaaggctaatgtcgatgccataaataatttcaccagaaagatggatgatctgaaaagaaaaagggatgatctgaaggctcgtgaagctattttagagcagactgtacaagatggtgccaaagacttagaacagttgatgaacagcaggaacacttatctagccaagcaagaagagtgcacgaagaagatccgagatttgggcttgttgcctgctgatgcttttgaagcgtacaagaggaaaaacaagaaacagctacataagatactctatgactgtaatgagcagttgaagcagtttagtcatgtgaaccaaaaggctcttgaccaatatgtgaacttcacagaacaacgcgaacaactgcagagaaggcgagctgaacttgatgccggtgatgtgaaaatcatggaactcatatcggttttagaccaaaggaaggatgaatccattgagcgcacatttaaaggggttgcaaggcacttccgtgaagtgttttctgagctggtgcaaggtggtcatggatatttggttatgatgaagaaaaaggatggggatgcagttgatgatgatgaggaggaggatggacctcgtgatccaggccctgatgggagaatagaaaagtatatcggtgtgaaagtcaaggtatcatttactggcaagggagaaactcagtctatgaaacaattgtcaggcggacagaagacggtggtcgcactaacactgattttcgctatccaacgatgtgacccagctccattttatctgttcgacgagatcgatgctgctctggatccacaataccgaacagcagttggaaatatgatccgccgtctagctgacatggctgacactcagttcattgcgaccacattccggccagagattgctaaagtggctgataagatatatgccgtgagacacaagaatagggtgagcaacatcgacgtggtgtccaaggaggaggccctggacttcatcgagcgtgatcagacgtacaatgctagctgaggctgctgctgctgtgtattgattgatctgcaggcagatgctaacgcagacaggatagttcttgttgtgttatggatattctggcctattgttgtagctgtgtatatgtgtgatgcagttaggtagctattggaccagcttgtttggcgcatcaacgttgtgaatgtagcagctaccaccttggtttggtaccagctttaattaagtttgggaagcgctgattagactagacgtacgttacatgttgccccatgattgttgtatggcacgcccagcccaaaatggcagtaatcagttcatttcgacaattaacgtaagtgtaagtgtacgagtagtggtattcaaatgttttttaactgtatttttctagtacatttattttttgtacacataaa

SEQ ID NO: 6469 - DNA, 3816 bp, Zea mays
ggattaagaaactgaaaccgttagtgaaaacacatttgtaccggtggttcacttaaaaactgcaagtgaaattagtgcatttccacatgtggtttctttaggaaaacctttgcaaatctagttttcacagacggttccttacgctaaacgccagtggaaatgggatttgcactagtggttttattaagcaaactgccagtgcaaatatgtttccacttgtggttcttgaatcgggggccaccaattttatttcacttgcatgcgataactgaaatcacctgtaagaatttctgtgcaccgcatgcatagaaccattttgtactagttttagtgccggttcgagctgctaaagtggcaccttttagtatagttggaatcaagaacatatactaaacatacctcattggtttaggatcatgtaactaggaataactaaaggttgacatctttagtcatggttgtctagtgccggttgagaatccaatactggtttccaactggttctgatgaccttttattttgtagtgatcaacgcaccaattatggattcaaacatgagagtttagtttgctacatttgtctaatataaattgttaaaatgttgcagttgctaaataaggaaagatattttagtatgcatatgtatttcttcaatcgctgaaagaattacatgtaatgtgtgcattagacggccccgttcgatttatctggagttatgacctgaaacaatttctagttaaattgtttgtacaatttatataagttttgataagctagaaagattattggtgaaatcctggacaaacgaacagggtctaagttatagacaaaggctatgcaaactctaataaacagccacatgcaaggaacctttgcgtacttgcaagcagatggccagatgggtgaagcacctccaggaggaggggctccaaaactgagctttccccatcaaatcccccacatctccatcggatcataaccgaatgctagggacatggtactgatcgctatgcctggggctcctctcgttttcgatggacatggccgtccgccagccggcgtcaagtgctaaccaatttggcctgccctctaatgccgaaatgttgggaaacagttctgtccctgcgtccacgtcaacataaagagacagagagaaaggagccccaaacagagctcaggccggatggccggtgcaaccacgagccaaccaagtacccaactaaacccaacgaaccgcatcgcacaggaggccgctgcttcagtactggcacttgacacttatcacgcggccgtcgtcgccgtcgcgcgcgcgtcgtctcgtctcgtctccccaaccgcacccggctcgtgccactgacatccgccatttaacgcgctctgcctctgatcctgcttctagacttctagtagatatgagcgctgagcgagcgcgcggccatggtggctaggctgctagctggtgctggtgctgctggttttctccgagctcccattgaataacacgctggagcattgatggtccctttcagatggtagatggcgcgcatttacgccgccacggtacgagccgagctcccctcgctcctctgctatatagcgctagctccaccatccaggccactaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctccgggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcctcctcttcagcgtcggcaagtgcaccgtcaactcggcgccctacggccccctgtggcgtgctctgcgccgcaacttcgtcgccgagatcgtgtccccgcaccgcgtcaagggcttctcctggatccgggagtgggccgtggacgcgcacttgcgccgcctctgcgccgagctcgcggcggacggtgccgtgcgggtcatggccagctgccgcctcaccatctgcagcatcctcatctgcatctgcttcggcgccaagatccccgacgagctcatccgggagatcgaggaggtgctcaaggacgtgatgatgatgaccatgcccaagctcccggacttcctgcccctcctcacaccgctcttcaggaagcagctcaccgaggcccgcgccctgcgccgccgccagctcaactgcctcgtgccgctcgtccgcgcgcggagggacttcctccgcgacggcaccgcggcagcggcggacggcgtggagatgatgagcgggcctggggaagcgtacgtggactcgctcttcgacctggagccgcccggccgcgggaagcgcctcggcgaggaggagctcgtcacgctctgctccgaggtcatgagcgccggcacagacaccagcgccacagcgctggaatgggccatgatgcacctcgtcctcgaccccgccgcgcaggagcgcctctacgacgaggtcgtcgccaaggtgggcaagaccgcccggatcaccgaagccgacgtcgaggccatgccctacctccaggcggtggtgaaggagacgttccggcggcacccgccgagccacttcgtgctgtcgcacgcggcgacgcgggacacggagctgggcgggtaccgcgtgccggcggacgccagcgtggagttctacacggcgtgggtgacggagaacccggcgacgtggccggacccggacgcgtggcggccggagcgcttcctggaaggcggcgagggcttcgacaccgacatcaccggcacccgcgcgctgcgcatgatgcccttcggcgccggccgccgcatctgccccgccgccacgctcggcgtgctccacatccagctcatgctcgccaacatggtgcgcgagttccgctggctgccgcccgccggtgagggcccgccggaccccaccgagaccttcgcattcaccgtcgtcatgaagaacccgctccgggcagccttcgtcgagcgggccacgacggagacggcgacaaccgcgtgacgagtgacgacggaaagtaaaaaaaaagggagagagagagaagttactagtacaagttactctttcactgggctctggctgggtgggtaagttgctgcaacgtgcgtgtcgtgcggggttaattcggtcccgcactctgcggtataaattacagttattaattaattagtccacggggaaggtgcgtgatcatcatatactgtatggatggattgatcggttcatcctacctgttggttggtcgacggatggctggatggacacgtgccgccaggcggatggatggggttcatgggaatgcaacgcacgatgctgtcgtcatatcatattttttttctttagtgtttctatgtgctattaattttaatagtagaagtactgtttcttagctttcaatttctcttttctctgttcaatttcatccaaaagtgtacctacgtactagctattgcatgatcgatgtggtcaatatattggttgtcatctcatgtgcaaaaataacgatg

SEQ ID NO: 6470 - DNA, 3236 bp, Zea mays
tgcagcatcctcatctgcatctgcttcggcgccaagatccccgacgagctcatccgggagatcgaggaggtgctcaaggacgtgatgatgatgaccatgcccaagctcccggacttcctgcccctcctcacaccgctcttcaggaagcagctcaccgaggcccgcggcctgcgccgccgccagctcaactgcctcgtgccgctcgtccgcgcgcgaagggacttcctccgcgacggcaccgcggcagcggcggacggcgtggagatgatgagcgggcccggggaagcgtacgtggactcgctcttcgacctggagccgcccggccgcgggaagcgcctcggcgaggaggagctcgtcacgctctgctccgaggtcatgagcgccggcacagacaccagcgccacagcgctggaatgggccatgatgcacctcgtcctcgaccccgccgcgcaggagcgcctctacgacgaggtcgtcgccaaggtgggcaagaccgcccggatcaccgaagccgacgtcgaggccatgccctacctccaggcaaacactcttttctccattcatttcggtcctgtttttttgtcgaaagttacaacacgatcgagaatgtgataggagttcggcacaaatctggcaattattatatactatactactatgaatgagacacggtgctaatagaatactatatactactaatattaaaagaagacgaaattctgcctgctttattccaagaaactattttatttgactcagcgcacgaatttgctagttgcattggaaataattgcataccctgaattggttgcatgctcacgaccaatctcgcaaatggatgcaaatgattaaacaagcctttgaccatggatacagaacaaaagttaaactgatgtatcgtggacatgatatgatatatcactaattggtactatcatctagtgattattagtttattactatgcttttggttcatccgtcagcaactaaaaactgagtctcttcttaattatatataagatgttccttttcccacgaaccaagtacgtgctacttgaccaactaccggaccgaattgcagcagctaatttgggacagctcacgccgaaattaaaaccttgtccaagcaataatcagtgcttctagacgtagaagcgatataatcattgtgttcgttcatcgatctgtcatgaaaacgacgcacgtacgtactcctacgacgtgcttcaaagattcctgggtttaataccacagctgtagccgagaaccgaaagcgatggtcgcacgtacgtttccagagggtatgttggtctctctcgccgcagtcgatgatgatgatgatgacgacgacgaccgtgcattttccttctgcaggcggtggtgaaggagacgttccggcggcacccgccgagccacttcgtgctgtcgcacgcggcgacgcgggacacggagctgggcgggtaccgcgtgccggcggacgccagcgtggagttctacacggcgtgggtgacggagaacccggcgacgtggccggacccggacgcgtggcggccggagcgcttcctggagggcggcgagggcttcgacaccgacatcaccggcacccgcgcgctgcgcatgatgcccttcggcgccggccgccgcatctgccccgccgccacgctcggcgtgctccacatccagctcatgctcgccaacatggtgcgcgagttccgctggctgccgcccgccggtgagggcccgccggaccccaccgagaccttcgcattcaccgtcgtcatgaagaacccgctccgggcagccttcgtcgagcgggccacgacggagacggcgacaaccgcgtgatgagcgacaacgaaaagtaaaaaaaaacagagagaagttactagtacaagttactctttcactgggctctggcagggtgggtaagttgctgcaacgtgcgtgtcgtgcggggttaattcggtcccgcactctgcggtataaattacagttattaattaattagtccacggggaaggtgcgtgatcatcatatactgtatggatggattgatcggttcatcctacctgttggctggtcgacggatggctggatggacacgtgccgccaggcggatggatggggttcatgggaatgcaacgcacgatgctgtcctcatatcataattttttttttctttagtgtttctatgtgctattaattttaatagtagaagtactgtttcttagctttctatttctcttttctctgttcaatttcatccaaaagtgtacctacgtacgtactagctattgcatgatcgatgtggtcaatatattggttgtcatctcatgtgcaaaaataacgatgttaaatgattttctcttgagaccaagctacgactcatgctggtgcaaacagtgcatgcaaaacattgttctttgtttggattggatcactcaacggtccgatttgaataatgcccgattctacaagagcagtgcgtacgtgttgatgatagatggtactgtggtgtaccgtgtacgtatgctttggtgttcaaggcagaggcaaaagggcactgaatggccgaatgcgcaaattgtccaaaacgggaccggccggccaccttctcccgttcttctgttcctcatctcgccagcacagctgcatgcacggcggcaacagcagctgccatacgcgcccgcctggccggctgtgcctaaactctccgcccggcccgccggccgccgctgattattttttttccattcatttttgtttgtttaagcgacagagcacaatgcactaggcgccaccagttgatctgctgatgtgtcgccgcagatcgaatctcctcatgcgttggtttaggatgaaatagatgccaaaaatgtgtattcactgtcccccaaaaattgtcgttagatatggaaatttaacaagctgttgatggagtttaacaagctggtttgttgaaaaaggatcgatggggaaaaaaaagaaaaggaaggttccttgggccgaatcaccttctttctcctatgtcgcctctcacgtcgcccatggcgcatgtcgagatggcacacgcttggagggggctgggtcgtggtctacagtgcaccggttggcccagggagctatcgcgccccgcttgcgtcgcacctctgggttcgtgtcgctcgcacctccagcccaagcccacgacaccccgcacagaccagctcccacatctaacacaacaacaactacag

SEQ ID NO: 6471 - DNA, 2103 bp, Zea mays
aagtagaatactcgtggaaaacatgaacgcgagtgcagcaagcctgcaacaggagaaatcagtcgaacaaaactagaaatcaaaagttagaaaatactgaggacaatgagcttacactgtagagagaaacatcagcagtacgtgagcagcagcatccagcacagcggcacggagggcaagcagacaagtaacagataaacagaatcagtaaaaggaactcctgaagctatttgaagaagaaagaaatcggattcacaaactgctgcaaagtggcaacacaagctccgcctctgatccaatttgaagtggctttcggttaaggaaaacaagcttgtgagcttaaaaggtgttgaggggctctcaaagctgcaggtactgaatgctggcaagaacgaacttacaaaaatggacgaggtcacatctttaacaagcctgggagcattgattcttaatgataacaatatttcttccatctgcaagcttgatcagttgcaacagttgaatacacttgtcctctctaagaatcctgtttttactattggcaatgctttggtcaaggctaagtctatgaaaaagctatccttgtctcactgccaaatagaaaatattggatcttctcttgttaagtgtgtggaactgaaggaacttaggctttctcacaacaagatcagtacaatcccttcagatttggccaaaaatgtgaagatcttgaaccttgatttggggaataactttattgagaggagttcagatttgaaggtactttctgaattgcgctacttgaggaaccttaatttgcagggaaatcctgtttccaagaaagacagtcttgtcaaaaaggttaagaaatctgtgccaaccttgcgcatactgaacgcaaagcccctagaggccacctccaagagtgatacgaggtctacaaaagagaatcctcctagcaaagatgaagaccccattgggattgatgcaaagaaggataaaaggaagggatctaaacaagaggtaaagggccttgaagagcttgaagtccagagtgtttctacaggtatcaccacttcgaaccctggtaaacttgaagtgccagacggtaaggaaaagaaaaaggtcaaggaagctaagacgaagaaatctgaagagccgtaccatgccaataacagtagcttaaagaacaaagaagttcaatcttttgtctatgataccagcacgaaggacaagaaggaagccaagaggaagaaatttgttgacgaagaagatgtagatgctgaaggaattgacaatacagaaatctcgtttgcagatttaatgttttccaatgtgggcaatccagagactaagctaaagaacatctcaaccctggaagcagctcctgatggaaaatctgttggaggtctggtaattgatcacacaaagaagagaaagaaaccaaaaggtgttgtcaccatcactgactcctcagctcttaagatgttttcctcaatgccagaggtaggagcaggagggcttggcctgtcaggatgggatgagtagcgtctagctctctagtaccataagtttgctgcctgatgaatatcgttttttggtgaaaacctcaattttatgtgaactgagcagcattttcttctcttcccatcaagtgcatttatgatgtgtgatttgaggaaccaagcccctctagatgagtggtgcatcttcggttcaaccaataatttagtggaataactacttttctcacgcttgcatgaattataaactactccgtccattctaaattataaaatattttacttttcttgatccataggttttattattcacttagatatgcactatatctagatatatagtagagaacaaatgtttttaattcaaaatggagtgagttaattttatcagaaataagaacgatggacactttgttccattctaaaacggacagacccaattacaaatagcaatgggtcctgatccatgatgtggctgtttggttcagcttttgctcggcttctggccgccagaagccgaggctggaaccaaacgctcagcttttggcgtggattctggccgacacgcttcggtaagaagccacccgcgcacgctccgctg

SEQ ID NO: 6472 - DNA, 1744 bp, Zea mays
ctgtagtctctctcctgttccaaaagtccaaaccaaacaaactcacgcccatcagcagtcagcccatgtcctccaacgacctcttcgacggcctgcctccgcccgccgccgccaccgccccggccggaggcggagctggcgcggcctccctcttgcagcccccgccgccaccacctcctccttctctggcgcaagcaacggcacccaagcccgcgctgaagagctccctcaagcggagcaagccctccccctcctcagacgctactccctcttccactcctgcccccgcggctgccgcgcccgaagcccatgttcctgagaaacgtcttcggttcagaacaaccgttgatgcttcagaaacacaagtgattgaggctatgcagaagatagcttcacacatagggaacgcttcaaaattcagcaaggcatcaaaactagctttgcaactcatcgaggctggaagcgtcaagcctggaacaatcggtcatttctttgctatactagaagctgcgatgtcttcaccgggagtgtgcaacgagccttctgtacgagcagactaccacaaattgttcgatgctgctcagggtgtaacagagttactcaaccaagagcagaaaaatcgattcaacatatgggtgctgcatgcagtggtggctaacgatcttttcactgatgacagctttgtgttctcaaaggctgtaggaaagatcaaagatgccatctcagccctgccagtggcaacggtggatgacgacaacgacgaagctgcggcccttgctgctgcgagcaaaactgatgtggcgacggacaacgaagcaggtcatggcgtcccagccgcagcttctgactctgtggtggatgatggcgcgcatgccgcggccttggagccggaagaagaatcctccgaccctttcggtttagatggtcttcttgagcacaggcctaagaagacgtctgggagagctcgagagaaggcagtcgcggctctgaacagaaagacggtcgaggaggaagcaaagagggttctcaagtcgcagcgggaggcccttctgaaatgcctggaaatagccgctcggcgctacagaatcccgtggacacagaccgccattgacattttggcgaagcaggcgtacgacgacgcggcccggttcacacggcggcagcgggacgcgatcgctaagctgtggaactcgatcaaggagcagcagatccggcggaagcaaggcaagtcggtgagcgggaagctggacgtgaacgccttcgagtacctccaggagaagtactcccgcgagaagatgagcatccggcacagcgtgggcggcggcggcgatcgtcgcgcgacgcagtggctgggctaggccgtgcgtgtgtgtgatggtttgtgcctttggcttcatcagcgacacggcgtgggagttgtttgtggttggtttttcgtagaggagaggagagagttgacatgatcttccccgtagcatgtgatgggtggctcttggtgtaacgttacgtactagctgcactgaactcgttgcatgtctttatcagtactggaactggaagcagcagctgaaactgctgacaacgacatggcagtgcagcacagtgcggctgttgggggcaaaatgctttgtttatgccggcacccggcagcacatactactagagtagcagcagtctatcaccacccttgtttgaatgagtctggtcatttgttcacttaagattaaaactaactgtttagact

SEQ ID NO: 6473 - DNA, 2241 bp, Zea mays
  misc_feature (2203)..(2203): n is a, c, g, or t
atccctaccactgacaccatgtccgcccgcatcgacctcaacaacaacgccggatccgcctcccaaaccaaagctggagctccccgcggtggcggccgcccccgcaagaaccccccgccccccgctcacccgcgccctccgcatcccgacacccccatggtcagcggcttcgctccgggcgacatggtctggggaaagaagctgaaccacgccgcctggccgggcctcatctactccgccggagggaacggcaccggccacgagggccagcttctcgtatcctactttggcgacaaggccttcgcctggtgcgacacagccgagctcaggccctatgaaccctacttccctgtcgccgagctctatgacgacggcggcgaggatttcgacgccgccgtcgaggcctccctcgacgagttctccagccgcgtcgagtccgccctcgcctccgccgcccgccctttcgcccccgccgatttccttgcctcgctccatgatctcgccgcggatcgcatgggcttcaccaatagggtgcaggccgccgtcgtcaaggcgcatctcagagccttcgacgccttcagggctctgccggacccacctcagtacaccttgggagctcggtctactcccagacgtcccgctcccgctgcccaatcctaaagctgccacggatgccgccttcagctcctacaccacccccgcttccagtttcaggaggggcaggaagaggaaggaggaactcatcaaggacgatgactccgatgaggactgggaccctagcaagaggggtgccaccgacttggattctgatgtggactttgactgcaggagaggatccagaggcaggggcaggggcggcggcggcactggtgcgtcgcgtggcaggcctcgagggaggcccaggaaagcagatgcctgcatggacgaagatgagattcaagacaaactggagtatccgtcggctgctgagatgttgctgcagcttctgtccatcgccacggatcctgtaaatggcaattatgactctgctcctgtgattgttagcttcttctcaaagcacaaggactccgatgtgcctagtttatatgaagacaaagaactgattgagaattttggtggcaagaagggtaagaaaaagtccatcggaagcttgggcccagctacaaagccagaagccagcgatgatactgtggatggtcagaggggccgtaggaagtctgctgggagcttgtactcagctagaaaggccgaagattcatattggtgtgatattatcatcagcgatttcgatgacggagacagtgactatgacagtcacaagaggaagcggccctgtaacaggagcaccaataagaagatgaagcaggaggagccacctcaaggagccccatcatcgaatgcaaaacctgcagatggtccagccgcccttattctacatttcagcagtccagaagctattccttctgttgatgacatcaatagcatattccgtattcatggacctattgtggagcgtgagactgtgatcactaagaagtcaaagattgcaaaagtagttttctctaagagtgttgatgcagagcaggcacatcacagttccggaaagcgtaatgcatttggtccatcgcttctcacatctgaaattaagtacttgccatcggcacctcaggtttcttaaatgccgcagtctggactggtggatacgccgtggaaatgcgccatgaagcttggagcaacggagcataagttggtgtcactgactttactgaccaggtcacagtagtcactgagttgagtgagcaaattttaggctttctgtggttacatgcatccatttgactgattgtcgacccggagtttgttgtttatgttgatagtagattagattatgtagcatgatgtgcttcctcttatgctagcaacttttttttggtattgcctagtaattgcacagctgtggatctctctattatgtttttttatttgattgtcacgaggctagtgaagccgctttagtgcaaaaaattgtgtagtgtgctgtggcctgtgctctacaaaatacggtatccatgcatatattgctaaaagatgttgtgtatgtgctccaataaatgtgatctgggcgatttcttgctatccattttgtgacgtcccgaacctgtttctacgctagggggtgttacgctttccagtcgtttattantttgccgcaggtttatatgctccacatgtctacgcatg

SEQ ID NO: 6474 - DNA, 995 bp, Zea mays
  misc_feature (916)..(916): n is a, c, g, or t
atatacgtggtgcgtgcgacggcgacacgtaccgggaacgaattactctctccccgcctcaattcaatgccgtcatccaactctcaccggccccggcttcaatgcgcgcccgcctcccgccgccccgccccgcccagcctatcctcggcgccccccccgccggccgggccctcctcctctatcttcgcatctggcacgagcagccaagcaaataaaagtagagcggcgagcgacgaccggcctgggccaccctttcggccgagcgtagccgagcaggtcgtcgtcgtcgtcgcagcaccccgccggctagcatggccacgaggaggcagtggtggtggtggtgcctgctgctgctggcggcgtggtgctgcgccgcggccgcgcagtcgccgccggcggcggacccgctgcagagcaagtgccagggggacttcgggaagctgacggactgcatggactacgcgacggggcacgcggcgtcgccctcgtccacctgctgcggcgacgccggcgacacggagaaggcgcgccccgagtgcctctgctacatcatccagcaggtgcacacggggcgcaaccaggtgcagtcgctcggcctgcgcttcgaccgactcatggcgctccccgccgcctgcaacctccccaactccaacgtctcgctctgcatcaccctgctgaacctgaagccgggctctgcggactacgccctcttcgccaacgcctccaagatcacgccgtcagccggcggcaaccctgcgagcgacagcgccgcgggcagcggcgtcaagctccgggctggggtcagcggcggcgtcgcgctcgccgtggtctccgcgatcgcctcgtcactcttctgatggaccgacctcctctcaagaagcagcggcgggttttttttaccctcctgtggattcgntctcgtgctgcgttccgctagcccatgtctactctgtactatctcataaaaaaaataagatcagctgagacgttgttac

SEQ ID NO: 6475 - DNA, 1309 bp, Zea mays
tcggtacccctgtacgtacgtgacgcacggcgacacgtaatcgataagggtcagtttggagtctaaaaactcgaaaagattagagatcgaagagactagagagactaaaatctatttttttatttaattttaaataaaaaaaaaattttagcccctttaattctttcggttttgtagcttcccaaagtagcaaggaatctcatcactctgcccgcggcgcctccaattcaatgcgtcatccaactcacaccgccccccggcttcaatgcgcgcccgccgcacgccgcccccggccagcctataaccgccggctgggctgggcacgccgccctcgtttccattttccctcctgcagtcctgctgctcctactgacctccacctcctcatcatctggcacgagcatccaagtaaatataaattcagcggcgaccgacgaccggccggccgtgcacccttcgcactactactgcgcccgcggacggcgtcagaggagcagcacccagccagcagcatggcctgcaccaggaggcagttgtggtgggcatgcctgctggcggcgtggtgctgcgccggcgccgccgcggccgcccagccgccggcggcggacgcggacccgctgcagagcaggtgccagggggactttgggaagctgacggactgcatggactacgcgacggggcacgcggcgtcgccctcgtccacctgctgcggcgacgccggcggcacgcagaaggcgcgcccggagtgcctctgctacatcatccagcaggtgcacgcggggcgcgaccaggtgcagtcgctcggcctgcgcttcgaccgcctcctggcgctccccgccgcctgcagcctccccaacgccaacgtctcgctctgcatcaacctgctgaacctgaaaccgggctcgccagactacgcgctcttcgccaacgcctccaagatcacgccatcagccggaggcagcccggcgagcgacagcgccgttatcaggctccaggctggggtccgaggcagcgtcgcgctcgccgtggtctctgcgatcgtctcgtcagtcttctgatccgaccgatctcctcagaggactagaggagaagaagcggttcttacctccgtgtggattcgtcgttctcatgttgcgttccactcgtcgatgtctattttgtatttgtaccccacataaaaaaaatagatccagatgatacttgtttcccccgtccctgtggctttaactgtaacctcggatgtttgaattagctaattatgtataactctcatcgcgtcaaaaaaaaaaaaaaaaaacccacgcggccg

SEQ ID NO: 6476 - DNA, 1029 bp, Zea mays
cccggcttcaatgcgcgcccgccgccccgcccagcctataaacgccgcccgccccgctgcgaggctcctcctcctctatcttcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagcatggccacgaggaggcagtggtggtggtggtgcctgctgctgctggcggcgtggtgctgcgccgcggccgcgcagtcgccgccggcggcggacccgctgcagagcaagtgccagggggacttcgggaagctgacggactgcatggactacgcgacggggcacgcggcgtcgccctcgtccacctgctgcggcgacgccggcgacacggagaaggcgcgccccgagtgcctctgctacatcatccagcagacgcacacggggcgcaaccaggtgcagtcgctcggactgcgcttcgaccgactcatggcgctccccgccgcctgcaacctccccaactccaacgtctcgctctgcatcaccctgctgaacctgaagccgggctctgcggactacgccctcttcgccaacgcctccaagatcacgccgtcagccggcggcaaccctgcgagcgacagcgccgcgggcagcggcgtcaagctccgggctggggtcagcggcggcgtcgcgctcgccgtggtctccgcgatcgcctcgtcactcttctgatggaccgacctcctctcaaaggagcagcggcggtttttttttaccctcctgtggattcgttctcgtgctgcgttccgctagcccatgtctactctgtactatctcataaaaaaaaatagatccagctgagacgttgttccctccctctttccctgtaccgtgtttcatggtgacttgtgacaatggatggtttctccttgtgcgtcgccatttacaaaaaaatttgtttgtttgttcgaaaaaaaacccacgcgtccgcccacgcggccg

SEQ ID NO: 6477 - DNA, 1944 bp, Zea mays
  misc_feature (11)..(11): n is a, c, g, or t
ttccacgcgtncgcactgatccacctcgccttctgcttccttcagcggttccgcccatcgactcgacagatccttgttcacgacctcaccctattcagatcccaagcggccacgcccaagcccaaaccctacccacccatctcaagttctcaaccagcgatgatggcagcggagccctcgccgtcggttccctccaccgccgctgaagacatggaaaccctcgccctcgactcatcctcgtcgtccgccgccgctacggcctccgcctccgaccccctccttcggccacctacctccccgaccgccgccgcgagcgacgaccccttcgtcatcgacgacttcctcgacgaggacgacttcaccgccccgccgcccagcgtcgccggcccgccgcccgccgtgcttggcgatgcggcgtccccagtgttccccaagatcaccgtatccgatcccaagaagcacgccgagcctagcggcgggggtgctgccggtgtgatcccagggtccggcagctacttttcttacctcatcaccacacgttttgcgggcggcggtggggaagtccgcgtgcggcggcgcttccgcgacgtggtggccctcgcggacggccttgccgcagctcaccgcggcctatttgtcccggcccggcccgacaaaagcgtcctcgaggggcaggtcttgcaacgccacaacttcgtgagccagcggtgcgctgcgctccagcgttacctctgccgccttgccgcgcaccccatcgtcggccagagccctggtctccgcacgttcctcacggagcctggtgccatccccgccttccagagtgaggcaccgcggtactggacaaccacggtgaatgctgctgctccgatggttcagatgaaagctgggagggacttgtttgggatgtttaagggtctcaagcagacgatggtgaatgggatggttgcaacaaagcctccacctgtggagcaggagacagatacagagttcctggcgcacaaggccaggttcgaggacttacaacagcagcttaccacaacatcacagcaggctgaagcgctcgttaaagcccaagatggttatagagaaactacaggtcacttgggaatgacattgattaagctggcaaaatttgaaagagagcaggcaacatgtaactccctaagaagacggtctggtgaaatccataactttgcaaattctgttttgaagatgagcaggtcacagataaaattgaactctgaaattgtgaaacacctgggtagtatccatgaatatttggagatgatgatatcagttcatcatgcatttacagatcgctctaatgctttacattacgtgcaaattctgtcagcagatttgttttccttgcatatcagggcaaggagacttgaatcgtcgtcagcaagagatatggggcacgagtggtcaacatatcagaaagtagaggggttgaaagaaacaataagatcagcggaagcagccaaaagtgatgcagttagagaatatgaaagtattaaggaaaacaacaagattgaaataaaaagatttgacaaggaaagacgccacgatttcatcgagatgctgaaaggttttgtgataactcaggtgtcttattcagaccattttgctaacatgtggacaaaggtaacggaggaaacagaagtatatgcaaacaggagcagctgatgtacgtatagggagtgtagaatagttgattttgatctatttaatttgctccaacatccaacgacaacaatcattcttattgttccccagttttgccaccttgagttggttgtaaacttgtaatgcaacatgagtcatgtgcagtcgggaaaaaaaaaaaaaaaagatgagcttctgtgctacccgagaactggcatgtgtatgtgagaaccatacgcaaacgtggtttaggttgaaaaataatggcgatactag

SEQ ID NO: 6478 - DNA, 1797 bp, Zea mays
cccacgcgcccgccatccactgatcctgatccacctcgccttctccttccttccgcggttccgcccatcgactcgacagatccattgttcacgacctcaccctattcagatcccaagcggccacgcccaagcccaaaccctacccacccatctcaaccagcgatgatggcagcggagccctcgccgtcggttccctccaccgccgctgaagacatggaaaccctcgccctcgactcatcctcttcgtccgccgccgctacggcctccgcctccgaccccctccttcggccacctacctccccgaccgccgccgcgagcgacgaccccttcgtcatcgacgacttcctcgacgaggacgacttcaccgccccggcgcccagcgtcgccggcccgccgcccgccgggcttggcgatgcggcgtccccagtgttccccaagatcaccgtatccgatcccaagaagcacgccgagcctagcggcgggggtgctgccggtgtgatcccggggatccggcagctacttttcttacctcatcaccacccgttttgcgggcggcggtggggaagtccgcgtgcggcggcgcttccgcgacgtggtggccctcgcggacggccttgccgcagctcaccgcggcctatttgtcccggcccggcccgacaaaagcgtcctcgaggggcaggtcttgcaacgccacaacttcgtgagccagcggtgcgctgcgctccagcgttacctctgccgccttgccgcgcaccccatcgtcggccagagccctggtctccgcacgttcctcacggagcctggtgccatccccgccttccagagtgaggcaccgcggtactggacaaccacggtgaatgctgctgctccgatggttcagatgaaagctgggagggacttgtttgggatgtttaagggtctcaagcagacgatggtgaatgggatggttgcaacaaagcctccacctgtggagcaggagacagatacagagttcctggcgcacaaggccaggttcgaggacttacaacagcagcttaccacaacatcacagcaggtattggtccactcacagatcttgtgaaatagctcagttgcatgtattggccctcacgatgcttcatcttttacaaacattattatgcgaagaaaacaaaattgctctggctggtccttataactttgtattctatatatatatgcaggctgaagcgctcgttaaagcccaagatggttatagagaaactacaggtcacttgggaatgacattgattaagctggcaaaatttgaaagagagcaggcaacatgtaactccctaagaagacggtctggtgaaatccataactttgcaaattctgttttgaagatgagcaggtcacagataaaattgaactctgaaattgtgaaacacctggtatgttgatatattgtggactccgtactgggaaaatgtttgtatattttactagaattatctgactcattaaccttatggctttgcagggtagtatccatgaatatttggagatgatgatatcagttcatcatgcatttacagatcgctctaatgctttacattacgtgcaaattctgtcagcagatttgttttccttgcatatcagggcaaggagacttgaatcgtcgtcagcaagagatatggggcacgagtggtcaacatatcagaaagtagaggggttgaaagaaacaataagatcagcggaagcagccaaaagtgatgcagttagagaatatgaaagtattaaggttagttgcctgaaacaatgtaataataatgttcc

SEQ ID NO: 6479 - DNA, 1240 bp, Zea mays
cccacgcgtccgcatttattgatctacttacagatcttgtgaaatggctcagttgcatgtgttggcccatgcttcctcttttacatacatattattatgcgaagaatacaaaattgctctggccaatcctttaaactttgtattttatatatatgcaggcggaagcgcttgttaaagcccaagatgatcttagagaaactacaggtcacttgggaatgacattgattaagctggcaaaatttgaaagagagcaggcaacatgtaattccctaagaagacgtgctggtgaaatccataattttgcaaattctgttttaaagatgagcaggtcacagataaaattaaactctgaaatggtgaaacacctgggcaggatccatgaatacttggagatgatgatatcagttcatcatgcattcacagatcgctctaatgctttatattacgtgcaaagtctgtcagcagatttgttttccttgcacaccagggcagggggacttgaatcttcatcagcaagagatatggggcatgagtggtcaacatatcagaaggtagaggggttgaaagaagcaataagatctgcggaagcagccaaaagtgatgccgttagagaatatgaaagcattaaggaaaacaacatgattgaaataaaaagatttgacaaggaaagacgtcatgatttcattgagatgctgaaaggttttgtggtaactcaggtgtcttattcagaccattttgctaatatgtggacaaaggtaacagaggaaacagaagtatatgccaacaggagcaactgatgtacgtataaagagtgtagagttgttggttttgatcgatttaaattgctgcaacatcgagcgacaacacccattcttatccttctccagtttttccacttttgggttggttgtaatgcatgagttatgtgcagttgtgaaattgggtcccggcagatgagcaaattggctccacgagaactggcatatgtgagaaccatacgcaagatttttctcggtgataactactactaacaactgtctctgttccaattacaaatttaaagaaattaaagatgttttggttttaaagctaagagaacattataaatttatttagatatagtgtatatctaagtgcttaagttagctttaatgatgacttatgggttacattaaagtatattattttatattttaatagaggagagagaagctagctcttaatcaagagctaagtttat

SEQ ID NO: 6480 - DNA, 2611 bp, Zea mays
cattgccgcccgcggcgccggccgcgactttcgcaagcccccttccgaccttgcccctgcggtctcccgagtcccgaagcatccccttccaaaaccctcgccgcgccgcagccacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagtgcaaaagctgctggaaatgaggttattgggattgatttggggacaacgaactcatgtgtttctgttatggagggaaagaacccaaaagttattgagaatgctgaaggtgcgagaacaacaccatctgttgtcgcatttactcagaagggtgaaagacttgttggaactccagccaagcgccaggcagtaaccaacccccagaatactttctttggaacaaagaggttaattgggcgacgctttgatgatccacagacacagaaagagatgaagatggtgccatacacaatcgtgaaggctccaaatggtgatgcttgggttcaaacaacagatggcaagcagtactcaccaagtcaggtcggtgcatttgtgctgaccaagatgaaggagacagctgaatcttaccttggcaagtctatctcaaaggcagtgattactgttccagcttatttcaatgacgctcagcgtcaggccacaaaggatgcaggccgcattgctggccttgatgttgaaaggatcatcaatgaacctacagcagccgctctgtcttatggaatgaacaacaaggaaggcttgatagcggtatttgatcttggaggaggaacttttgatatctctattctggagatctcaaatggagtttttgaggtcaaagcaacaaatggtgatactttcttgggtggtgaagattttgataatacactattggagttcttggtgagtgatttcaagaaaactgagggcatagatctgtcgaaagatagattggccctgcaaaggcttcgtgaagctgctgagaaggcaaaggttgaactttcgtcgacttctcagacagaaatcaatctgccattcataacagctgatgcttcaggggcaaaacatttgaacatcacactgacaaggtcaaaatttgaatctcttgtacacgatctgattgagagaactagagatccatgcaagaactgtttgaaggatgccggaatatctactaaagaggtggatgaagtacttcttgttggtggaatgactagggttccaaaggtgcaggaggtagtctctgaaatctttgggaagaacccaagcaaaggagtcaatccagatgaagctgtggccatgggtgctgcacttcagggtggcattctccgtggagatgttaaggagcttcttcttcttgatgttactcccctgtcactaggtattgagacgctcggtggtatcttcaccagattgatcaacagaaacactacaatccccacaaagaaaagtcaggtgttctcaactgctgctgacaaccagacccaagtgggtatccgggtgttgcaaggtgagcgtgaaatggctacagacaacaagctccttggtgaatttgacctcgtgggcattccacctgccccaagaggcttgcctcagattgaggttacattcgacatcgatgccaatggaattgtgaccgtctcagccaaagataaggctaccgggaaggagcagaacatcaccatacgatcctcgggtgggctgtcagaggctgacatccagaagatggtgcaagaagctgagctgcatgcccagaaggaccaggagcggaaagccctcattgacatcaggaacaatgccgacaccactatctacagcatcgagaagagtcttggagagtacagggacaagatcccggcagaggttgcatctgagatcgaggcagccatcgctgacctccgccaggagatggcctcggatgacattgagaagatcaaggccaagcttgaggctgccaacaaggctgtctcgaagattggacagcacatgtctggtggtggctctggcggctcgcagtcaggatctggacctcagggtggcggcgaccaggcgccggaggcagagtatgaggaggttaagaagtgaggctgcgggagttcaagggaattgtagcggcttgtttagaagtagctcgtttttttttgggaacgcagatagtcagatgtctcagatgaggtgtaacctgtgttgcaataatctatgaacttacccctcttgttttctcctgcagtgaaacaggtcacacgacattgtcatggcttttattgcatatgaagccttgttctgcccgatgtactcgcacagcgaaaaccatcggcgagttctgttaatggattgaagtatatttgttcctgtgttttgactaaaaaaaaaaaaaaaagtggcaacaactgtgactttggcaatgttctgagaacgctaggtcagatcaaagagattgtatggtacttttgtgaagagccgtctcttatatctctaaagtatttaaatagttagcttcaaaaaa

SEQ ID NO: 6481 - DNA, 1899 bp, Zea mays
gtttttttttgttttttgttactttgatttgatattttgatctgatctggtttatgtagaactagcagttttccctttatttctgtggtgttacttgatctgatccggcccggcagttttgcaggtgttctcaactgctgctgacaatcagacccaagtgggtatccgtgtgttgcaaggtgagcgtgaaatggcagcagacaacaagcttcttggtgaatttgaccttgtgggcattccacctgccccaagaggcttgcctcagattgaggttgcattcgacatcgatgccaatggaatcgtgactgttgctgccaaagacaaggctaccgggaaggagcagaacatcaccatccgatcctcgggtgggctgtctgaggctgacatccagaagatggtgcaagaagccgagctgcatgcccagaaggatcaggaacggaaagccctcattgacatcaggaacactgcggacaccactatctacagcatcgagaagagtctgggagagtacagggacaagatcccggcagaggttgcatccgagatcgaggcagccatcgctgacctccgccaggagatggcctcggatgacatcgagaagatcaaggccaagcttgaggctgccaacaaggctgtctcgaagattggtcagcacatgtcaggtggtggctctggcgactcgcagtcgggatctggacctcagggtggcggtgaccaggcgccggaggcagagtatgaagaggttaaaaagtgaggctgcgggaagttgaggcgaaattgtagtgacctgtttagaagtagctactcttttttgggaacacagatagtcagatgagaaatgtaaaacctgtgttgtaataatcgttggatttgcccccacttagtttccttctgcggcgatggaggtaacacgacatttcattgcttttgttgcatatgatgtcttgatctggcatggatgcatgctcacagcgaaaaccattggcgagttctgctattgaatgaaagtacatttgtttctatgttctgactgttgatgatatttaagggtggtaactcaactgtgacttttagcaacgttttgaggcatgctgtcagctcattgatgttacgtaatgtgttcgccacgctctgatctctattcacatacaatgaaagtttatgaaaataattgttgaagtgttcaacacgtttagcgaagcaatgaaaataggtatctaagtgtttaacacgtttggcgtatctccgagaaatgcaatgaaaatttatgaaagtaggtatgttctctgtagttgcagttgccatggatgtccaggcagaagtcaattcctttttgtccaccggtcttcttatgctcatagttggcgtgcacaaatattccgaaatcgttttggcatgaccaaaattacggcaacttgggataaaacctcgacccaaaagacaggaacacatcaaggatatgtcacaacaatggcggtcgccaaatgctttggtgctccgtgtgcgcccacttctggatttcacctcagaaatcctccatccagtgcttgagcatcatcccagagccatttttgcagctttgagaaagcacaatgtacggtctgacacagttccggtcggaatctcgagtgatgatgagggcacgacgttcatacatgtttggaatcgcatggagactacgaatctcagtcgatggtaggtgctgtatcatcatcgatttggtatcatttgttcctagcttgctaagaatcacatggcggtgcacgtccttcacatggaatatatttactactcctttcatccgaaaaaacactactaaaattatattttcatcaactatggatatttattataccaaaattatattcatcataaaatatactttcacactataattat

SEQ ID NO: 6482 - DNA, 1814 bp, Zea mays
aaaaccaacgaaccaaacataaattcagcccaccgctcctgctgctgctgcttcgaggacaggacggagggagctcacgcgcgagcaaagcaaagcacaagcagcaatggggatctgctgcggcaaggccaaggcggcggcaggggagcccgacgacgacgagggcctgggcttcccatggatgcacgacgacctgttccacagccacctgtgggccagcgccggcgtctccgtgcacaccaagcagggatggaagggcgccaaccaggacgccatgaccgtctgccaggacttcgccggccagaaaggccacatcctctgcggagtgttcgatggccacggccctcgtggccgggaagtcgctcgccacgtccgcgacaccctcccggtggaactagccgccgctctgaagccgagaaccggggacgaagatccctccgcctcgagcgacgcttcgaagcctaaacctgacgaagatggctcaggcgagaatggagaagatggctcaggcaagaatggagatgcttcgagcaacgccgatttggattccttcgacaagtcaggaggtagcggctcgtccagcgacgttacgagcgacgagagccagcagcagcagctgctgctgtccacttggaagaacgtgttcgtgagggcttttgagcaggtggacgaggagctgaggcggctttcaggaatcgactgcatctgtagcggcacaactgcagtcgctgctgttaggcagggcgatcacttgatcgttgccaatctgggcgattcacgcgccgtcctctgcacccgggacagcaaggaccgtctgatccctgtccagctcaccactgacctgaagccggatctgccaagtgagctcgcgaggattctgagctgcaaggggagagtgttcgccatggacgacgagccggacgtgccccggatgtggctgccggaccaggacgcgccgggcctcgccatggcgagggcgttcggtgacttctgcctcaagagccatggccttatctgcgaacctcaagtctactgcaggaaactgtccgagaaagacgagttcttggtgcttgctactgacgggatttgggacgtgctgtcgaacaaggaggtggtgaagctcgtgtcatcggcgcctgacccgtccaaggcggcgaggcagctgatcgaccgggcggtccgagcgtggcggcgcaagtacccgacgtccatggtggacgactgcgccgtcgtgtgcctgtacctgaaccggcgggcctcacctgctcccgtcgagagcagcagcggcctgctcccagttcccgacgacgtgaggccggccgcgcctttcacaggcagcagcttccgcagggctctgacgagcaacggccaggcggtgtcggaggaggggacgacggcggtgtggagagcgctggagggggtggcgcgggccaactccgtgatcaggctgccgcgcgtgggccgcgtgctgagctggcggaggcggtcgacctcgctggacgaagacgacggcggcgagcgggattgatggactcgggcggggagggcatcggaggtcgtcgttttcatggccggtacacgtagacgtagctagattcgttcgtgcatgggccgatggacgcgaggtgtaggatttgattggcctgtcgcattctggtgtggctgttgcaatggatgatgcgacatggacaggagtagcatttctttatccctggctgatgaatcagtgagtgcttttcatcctgctcgtctatgtactgctactgcacttgctgtaactgaaatttgtgggtgagattagcatctgacaacat

SEQ ID NO: 6483 - DNA, 1431 bp, Zea mays
tgattaaaattaaaaatgtggaaccatacaaatactctgtttgggagagcttcgctccattctataaaataaatctgcagaatagtgccaaacaacattttttttctgagaatcacttattctttaaaatgaaccgtaggctggaaactaaaaaaaagttgctttttctgattcacttccaccgtatagttagacttttcatatatttatcatatggttttatttgagaattattttcagccataaattcattgatctccaagaataattctaacgccgctcgaggcgccggcccgggtacacaaacagcaagaaccaccaagcgaccaagcctgcaagtcaccaagggagcccgatctgagtcaagcgagtcttcccgtttcatcgcctggaaaaaggcgagaaaccccaaagcgaaggaacagcagcgcgagtgctagcagcagcagcgattccttcgccataccgttcgctgcgctcgctcactcggatcgaaaccccctagggttcgcatcgtcctcccgccaactcctatccctcccctctccctccgccgcgcgcgcgcgtggagctaccaaaccctaggacggcaaatccggtgcgatcgcccacggtggaggcctctcggccgccgagaggagccgctcggggctcggatcagggttccggtacttcgccggtgccgcctctgggtggtgggaccggtggatggtcatgggagccagcggctccaagcttgagaaggccctcggagaccagttcccggaaggccagcgctacttcggcctcgagaacttcggcaacacctgctactgcaacagtgtccttcaggtatgggtacatgcctctgaaactaacagctaatagatttgatgcttggttatgcttggcttgatactggtaagtgcggcagtgtagtgaaacggcctggttcggtttttttaggtagtaggtgtgtatatgctagatattataatgttctagcacttgttcgccagtttcgagatatgccacctattggtatgggctattcatatcgagcacaagtctttaggagtttggacctttttttcgaaaactctaatttgtttttttaattcctaatctgatctcgaagttttgaccttttggagtttaagttttgggaatagtcttgaatcctccctatgtaactatggtcaatgtttatctcaatctctagaaatctggccaaacagcaatatcgtgcatagggagcagcactgctagaccacaacactatcgggatgagaagttgcactgtcaggctgagaagtggcaccgtcgtgctgctccgagagatttcagatttggcttccttcagatatttgggtatctttttggtctgattgcttcctctagagactcttttagagaattcaatcaagagttgattgaggtgttcttaatttt

SEQ ID NO: 6484 - DNA, 1919 bp, Zea mays
ttgggtacctcgaggccggccgggtcccaggtccagtgaaatgcttgcccacgaacagaaacagcaagaaccaccacaaggcgagtccgattctagatcaagcgagtcctcccgtttcatcgcctcggaaaaaggcgagaaatctgcaacagaagaagcagcagcgacagcgattccttcctcgtacctttcgttgcgctcgcgcactcggatcgacccctctagggttttgcatcggcctcccgccagctcctatccctcccctctccctccgccgcgcgcccgcgcggggagccaccaaaccctaggacggcaaatccggtgcgatcacccacggtggaggcctcgtcggcggccgagaggagccgctcagggctcgggtcagggttccggtacctcgccggcgccgcctctggctggtgggaccggtggatggtcatgggagccagcggctccaagcttgagaaggccctcggagaccagttcccggaaggcgagcgctacttcggcctcgagaacttcggcaacacctgctactgcaacagtgtccttcaggcactttatttttgcattccattcagggagcagttactggaatattatgcaaataacaaaactccaggagacgctgaggaaaatcttctgacttgtttggccgacctttttatgcagataagccaagcaaagaaaaagaccggtgttattgctccaaaacgttttgttcagagagtgaagaaacagaatgagttgtttcgcagctacatgcaccaggatgcacatgagttcttaaatttccttttgaatgaacttgttgatattctggaaaaagagtcaagtgctgctaaggactcaccccaatcgtcgtctcctgaaaaagctccaaatggcccagttcaacctttagccaatggagttaaaaaagaaccaccagttaccctggtccataaaagttttcagggcatattgaccaacgaaacaagatgcttaagatgtgaaacagtaactgcaagggatgaaacatttcttgatcttagtgttgacattgaacaaaatagttcaatcacaagctgcctgaaaaatttctgttctacagagactttaaatgcagaggataaattcttctgtgacaaatgctgcagtttgcaagaagcacagaagagaatgaagattaagaagactccccacatattggtgatccatctaaagcgtttcaagtacattgagcagcttggccggtataagaagctttcatacagggttgtattccccatggaactgaagctcagtaattcatccgacgatgtagacactgagtactccctctttgctgtcgtggtccatgtcggaagtggcccgaaccatgggcattatgtaagccttgtcaaaagccacaaccactggttgttcttcgacgatgaaaatgtcgagatggttgaagagcagaccctacaaacattcttcggtacttcacatgaatactcaggcaacacggaccatgggtatatcttgttttacgaggggcttggtgggaagagttagattggtctattaacctttcctgttcctttttttccttctctttggagcttgcaagttccactcttgtacctacacagctactatatcattacctccatggaaaacggtcaatccaagaggttgtatgaggcgacgatgccagattttgggtggtttcagtgtacaggggataatggaatctagctcccaacgatgaaataaggtgtaattttgaagttcgcctgaccagttccttctcagggctaacatcttctgttaaagtgtgggactttactattgggcacactgtacatcaattctcgttcaaaactttgtacgcattttccagttctatccatgtacgtgctaaacttgtagcattggcaaaaaaaaaaaaaaaa

SEQ ID NO: 6485 - DNA, 1800 bp, Zea mays
cacattcagccggccccgcccagcgaccaagcccccaagggaccccgatctgagtcaagcgtcttcccatttcatcgcctggaaaaaggcgagaaaccccgaagtgaaggaacagcagcacgagtgctagcagcagcagcgattccttcgccataccgttcgccgcgctcgctcactcggatcgaaccctccctagggtttcgcatcgtcctcccgccaactcctatccctcccccctccctccgccgcgcgcgcgcggggagctaccaaaccctaggacggcaaatccggtgcgatcgcccacggtggaggcctcgtcggccgccgagaggagccgctcggggctcgggtcagggttccggtacttcgccggcgccgcctctgggtggtgggaccggtggatggtcatgggagccagcggctccaagcttgagaaggccctcggagaccagttcccggaaggcgagcgctacttcggcctcgagaacttcggcaacacttgctactgcaacagtgtccttcaggcactttatttttgcattccattcagggagcagttactggaatattatgcaaataacaaaactccaggtgacgttgaggaaaatcttttgacttgtttggccgacctttttatgcagataagccaagcaaagaaaaagaccggtgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgctaaggactcaccccaatcatcatctccagaaaaagctccaaatggcccagttcaacctttagccaatggagttaaaaaagaaccaccagttactctggtccataaaaatttccagggcatattgaccaatgaaacaagatgcctaagatgtgaaacagtaactgcaagggatgaaacgtttcttgatcttagtgttgacattgaacaaaatagttctatcacaagctgcctgaaaaatttctgttctacagagactttaaacgcagaggataaattcttctgtgacaaatgctgcagtttgcaagaagcacagaagagaatgaagatcaagaaggctccccacatactggtgatccatctaaagcgtttcaagtacattgagcagcttggccggtataagaagctttcataccgggttgtattccccatggaactgaagctcagtaatacatctgacgatgtagacactgagtattccctctttgctgtcgtggtccatgttggaagtggccccaaccatgggcactatgtaagccttgtcaaaagccacaaccactggttgttcttcgatgacgaaaacgtcgagatggttgaagagcagaccctacaaacattcttcggttcctcacatgaatactcaggcaacacagaccatgggtatatcttgttttatgaggggcttggtgggaagagttagatgggtttattcatcttccttgtttcttttctccttctctctttggagcttgcaaattcactcttgtgcctacacagctactatttcattacctccatgggaaacgggtcaatcgaaggggtgttgtatgaggtgaggacgccagattttgggtggtttcagtgtacaggggataatggaatctagctccaacgatgaaataaggtgtattttttttaacttctcagggctaaagagttggactttactattgagcacaacgtacatattttccaaaaaaaaaaaaaaaaaa

SEQ ID NO: 6486 - DNA, 2892 bp, Zea mays
  misc_feature (12)..(12): n is a, c, g, or t
cggccacgtggngctgaaagctgctaaggttggagatatgaatgttataaagatgctcctgatgggtaatgttgatgtcaatgaagccgactctgaaggaaacacagcacttcactggtgccttagtggtgcttcatgtaccaaggaaccaaggattgtgtggcttctgctcaagaatggcgcaagagttttccaggggaacaaattagggctcacaccagtacacagcgctgcagctaagggcaattacaaagctcttcagtcacttctgcttcatgcccaagattgtgttgatatacctaccaagaccaaagaaacgccattattttttgcagtgaagaatggttctgtggattgtgcaaaacttcttttgcgtttcggggctgataccaaagcccggaacctgagaaagcaaagacctattgatgtggcaacatcccaggacatgcgtttcatccttagctctgcaaatgtgttactattttcagggaaccataactcacctcaaaagaatcgtgtgatgagaaaggaaatttacaaagagcttggtgatgaatttgacgattttgacaaggattcctgtgatgaaagctacactgggcttaagacatcagtagggcaacgtgatttctgctccagtaatctttctgcacaagggcctaagagtaagagccaatatgttccaaaacaagcacaaggttcaaagtttgtgcctcggaataatcattggccgaagcatgattacactcgcaaaatttttgttggaggactcccaccttcagtagactcagaataccttattgaattcttcaatgctgagtttggtcctgtggaggaagcagtagtcatcggcataccaattggcaaccgagttcagtcccgaggttttggctttgtaaaatttgagagagaagaggatatgataagtgcaaaggaagctcatcatgtttacatgcttgggaagagagtggaggtaaaggatgctgttgctagagcatacttgcctttagaagaccaaagatatacttctttgaggcaattcatcaaggagcggccaaagatccacagggtgctggatggtgaactgactgaggaacacaacatccagaagcggcgaccattgccagaaaagtgtcttccatcctggcccgccgggttcaggaagtggttacctggatttcttgaagatgaaacagcacgacttagaggagagaggtatccgttgagctccctgaagggtgatttcagagcgacttgcaggatggagcttgatcacaccgcacttggttatcctaagctaagtgactttatccgctccctccctggcatctgcagaatgtgtgtagttcctgttggaagtggacctgcaacgcacatggtcctccttccaccgctctcacgaccgaagtatgtacccctgctagagccttgttcctttgatcatgacgagcttgcagaatcagtatcagatcagcactccccacgatcaccacttaacactaacatcgcggatgactccccacgtaacactgacagccagcagggtgatgatgcatgcagtgagaccaatgttcagatccagcaagttgatgatgcatgcagtgagacttgtgttcagagtcagcatgactatgggaaaagccagcaggatggaagttcctccgacaatggtagcttactggacgatattcctgccagtactacaaagcttgatctgattgagtctgtaacttcagtaaagcctgctttgattgaacctgtacttccaagaaagcctgatctaattgactctgtacctccaagcaagcctgatttggttgagtgtgtacctccaaggcccaaattgattgagtccgggtttcttcctcaaaagaatgaatccgggcctgtacagaagcctaatttgcttggttttggaccttcaagaaatcttgagttgattgagtccaggccttcagcatgcttcattgatagtccttttgaaaggacagcagttactcctagcagctgcgaaggtgaaatgagattctctttcttccagtctcagtgggacaagtacctggcaccatatcccaggagtgactcctgcatcatatgtcgatcttgtgaagctgggatgcaacttgttccctgctttcataagatatgtgttgcgtgcatgatgaggtgcaatgtcagagcatgtatggtttgtggcacttctgtaagtggagttaagtcatcccctgcagtggatgcgacatacagatacatgggactcaccgagcgtgttttagatctgagatgccagttgatggtggtctgccgtggagctgaggcaatagtcagatgctcaccatgtatgcacaccatcgcttgccggggttgcttccttgcctcagtgacactactgaaatcctgcaccacctgtggctgcatggttgaacacttcaagatcgtttgacaagacttatctcccaatacacagtagtattactaagcaatctaaggtatagaataaagcaagcagtcctacgacctgaaggggagatctgattactctcgttcggttttgccacacttgtgggatgcgctaacaggctattttggtagtggtataggcaccctcgctcttgtgagcctgaggtgctctcttttgctccctttctgttcttccgtagaaacactttttcagtatcagacatgctcgatttatatgctattgctatttctgcttctatgagcttgttatggtatggcactagcaagttctcggtaatcttccatgtaaaacccctcatctctgttatatggcactttttctatgtaaacctgtgtaagtactactagtatcaaaaatggatcttttatgcatcaaaaaaaaaaaaaaaaaaactcgagagtacttctaga

SEQ ID NO: 6487 - DNA, 1462 bp, Zea mays
gccggccgggtcccactccccagtccccatagactccagcctgagctgcaccgtgagcgctcgccgctccgcatcgccgtcccagtcccacaccccgcatccagcctgccccagcgtaatggcgcttcgccaggccgtcctcctggccgtggtcctcgccgcgctgctcccgctcgccctctctcgcgggttgggcttggtgcacgggcatgtgcggccgcacacgcacgggctggggctcggccaccaccacgcccagccgcacccgcacccgcacgggcacgcaccgctcgtaggtggcgcgtggtcctctgctcacgccaccttctacggcggcggcgacgcgtccggcaccatgggcggtgcgtgcgggtacggcaacctctacagccaggggtacggcaccaacacggcggcgctgagcacggcgctcttcaacaacgggctcagctgcggcgcctgcttcgaggtgcgctgcgacgcggcggggggcgggagccactcgtgcctgccgggctccgtcgtggtgacggccaccaacttctgcccgcccaacaacgcgctcccctccgacgacggcggctggtgcaacccgccgcgcgcccacttcgacatgtcgcagcccgtgttccagcgcatcgcgctatacagggccggcattgttcccgtctcctaccgcagggttgcgtgcaacaagaagggcggcatacgtttcaccatcaacggccactcctacttcaaccttgtgctggtgaccaacgtgggaggcgccggcgacgtgcacgctgttgccgtgaaggccgagcgctcccccgggtggcaggccctgtcgcgcaactggggccagaactggcagagcaacacgctccttgacgggcaggccctgtccttccgcgtcaccaccagcgacggccgctccgtgctctccaacaacgccgccccccgcggctggtctttcggccagactttcagcggtgcccagttcaactgaacacacccccaccgttcatgcagcgtcgacgcagtggcactagtactagttgttccgtccaccccgattggagcctgccgagaggcgccatggttttatgaatggtctgcacctcgcatttgctcctgggaattaccagtagtttaggcctagtaatagcgcgggttttatcgtgcttgcgttagcatggtgttttagtgttccttggttgtatccggcttggaaattggaggtggtggtaaggctggtctgcagataaacggaggcaggctgccttgtatcacccgccaattatgcgtttagggcctcatggtgatggctccttcgagatgagatgttttctgagttattcaagtgtgttagttgtaatgaatcttatcaagttactatttcctaatatattatccttcggaaaaaaaaaaaaaaaaaaaaaaaaaaaaaaaagtactctgcgttgttaccactgctaag

SEQ ID NO: 6488 - DNA, 1403 bp, Zea mays
ccaacatctcctcacttcacaccactcccgccattgtcctgcgcctttctgcaccgccacacacaccccgctccaatccaatggcgcctcgccaagccgtcctcgcggtcgtggtcctcgccgcgctgctcccgttcgccctctctcgcgggctgcggcttggccaccaccgcgcccagccgcacccgaggccgcacggccacgcaccgctcggaggtggcgcgtggtcctcggctcacgccaccttctacggcggcggcgatgcgtccggcaccatgggcggggcgtgtgggtacggcaacctctacagccaggggtacggcaccaacacggcggcgctgagcacggcgctcttcaacaacggcctcagctgcggcgcctgcttcgaggtgcggtgcgacgcggcggggggcggcggccgctcgtgcctgccgggctccgtcgtggtgacggccaccaacttctgcccgcccaacaacgcgctcccgtccgacgacggcggctggtgcaacccgccgcgcgcccacttcgacatgtcgcagcccgtgttccagcgcatcgcgctctacagggctggcattgtccccgtctcctaccgcagggtcgcgtgcaacaagaagggcggcatccggttcaccatcaacggccactcctacttcaacctggtgctggtgaccaacgtgggcggcgccggcgacgtgcacgcggtggccgtgaagggcgaccgttccgcggggtggcaggccctgtcgcgcaactggggccagaactggcagagcaacacgctcctggacgggcaggccctctccttccgcgtcaccaccagcgacggccgctccgtggtctccagcaacgctgccccgcgcggctggggcttcggccagaccttcagcggggcccagttcaactgaacaccctccatcgttcccgcagcgtcgtctcgtccgtcgtcgacgcggtgccacaagtagtagttttccgttggtcgtggtagagtcgtccaccctcactcggagcttgccgagaggcgccatggttttatgaatggtgcatctcgctttggatctggggaattaccagtagtttaggcctagtattagcgcgggttttgtcgtgctggtgttagcctggttggtgtggtagcgttttgcttggttgttttggaattggaagtggtggtaaggctggcttgcagattaacggaggtaggccgccttttatcacccgccaattaagcatttgtggggtctcatggtgatggcctctttcggatgagatgttttgcgtgttacccaagtgtgttggttgtaatgaaccctattaagtttgtgctggaacttcagtatgcatagtcatttggttcgctaaaaaaaaaaaaaaaaaactcgagagtacgtctagaa

SEQ ID NO: 6489 - DNA, 1447 bp, Zea mays
  misc_feature (815)..(815): n is a, c, g, or t
accctggcaggcctgccggcactccccagtccccatagactccagcctgagctgcgacgtgagcgctcgccgctccgcatcgccgtcccagtcccacaccccgcctccagcctgccccagcgtaatggcgcatcgccaggccgtcctcgcggccgttgtcctcgccgcgctgttcccgctcgccctctctcgcgggctgggcttggtgcacgggcatgtgcggccgcacacgcacgggctggggctcggccaccaccactcccagccgcacccgcacgggcgcgcaccgctcgcaggtggcgcgtggtcctctgctcacgccaccttctacggcggcggcgacgcgtccggcaccatgggcggtgcgtgcgggtacggcaacctctacagccaggggtacggcaccaacacggcggcgctgagcacggcactcttcaacaacgggctcagctgcggcgcctgcttcgaggtgcgctgcgacgcggcggggggcgggagccactcgtgcctgccgggctccgtcgtggtgacggccaccaacttctgcccgcccaacaacgcgctcccctccgacgacggcggctggtgcaacccgccgcgcgcccacttcgacatgtcgcagcccgtgttccagcgcatcgcgctatacagggccggcattgttcccgtctcctaccgcagggttgcgtgcaacaagaagggcggcatacgtttcaccatcaacggccactcctacttcaaccttgtgctggtgaccaacgtgggaggcgccggcgacgtgcacgctgttgccgtgaaggccgagcgctcccccngggtggcaggccctgtcgcgcaactggggccagaactggcagagcaacacgctccttgacgggcaggccctgtccttccgcgtcaccaccagcgacggccgctccgtgctctccaacaacgccgccccccgcggctggtctttcggccagactttcagcggtgcccagttcaactgaacacacccccaccgttcatgcagcgtcgacgcagtggcactagtactagttgttccgtccaccccgattggagcctgccgagaggcgccatggttttatgaatggtctgcacctcgcatttgctcctgggaattaccagtagtttaggcctagtaatagcgcgggttttatcgtgcttgcgttagcatggtgttttagtgttccttggttgtatccggcttggaaattggaggtggtggtaaggctggtctgcagataaacggaggcaggctgccttgtatcacccgccaattatgcgtttagggcctcatggtgatggctccttcgagatgagatgttttctgagttattcaagtgtgttagttgtaatgaatcttatcaagttactatttcctaatgaaaaaaaaaaaaaaaaaagcggccaaaaaaaaaaaaaagcaaaaaaaaaaaaaaaa

SEQ ID NO: 6490 - DNA, 874 bp, Zea mays
accacgctccggtcagcctcgcctcccttctccgtctcattcccccaatcccacgccactcccgcaggaatccccacccaaattcccgtctccccgatcgccgcccttctcggtgcccgtaaaccctacccccggagtcgcccgtgcgctgtcgtgcccgcgttgccaccgtcggtggtccgcggcgcccgtaaccaaaacctaaccgcagcctgcagatcccgattccgcagggaggcgggagaggtgaaggccgcctcgccgcagatggagcccgcgggcgcgcgcaaggagtggcgcgccgtccccggctcctcgctccgctccaatggcgccgaggatgccgcggagcacgggaaactggggcagtcggaggaccgagctatctacgaggaaggggcgggtggactggaggacttctgcgccatcaccattgatgggagcggagggctcagcgaggacatcctgcagcagcgcctgcagagcgttgtgcggcaaagggagcagctgcagcaggtcgagatggagctgcgtgcgcaggccattgcacacccgcagatcattcaggcgcaacaaagcttccaggctacttccaaggaacatgccgcagctgtggccaagatcaaggagcaactgcatgagcgggagcaatacattcttgaactagaaatgaaactcaatgacaaggatagagaactaaatgctctgaagattgatcatcaaacggtgtgggcaaatcaagatcttattagagaacagaccaaagagctggcaactgtcagaagggaacgcgacaactctgaagctgaaagagcccaacatcttacacaaattcatgagctccaagaacatctgcgaaaaaaaaaaaaaaaaa

SEQ ID NO: 6491 - DNA, 2548 bp, Zea mays
  misc_feature (2515)..(2522): n is a, c, g, or t
gatgctcagcacacttatatgatgcattgttctctcagttttttccagcctgtataatgataagacacagggagcaactgcatgagcgggagcaatacattcttgaactagaaatgaaactcaatgacaaggatagagaactaaatgctctgaagattgatcatcaaacggtgtgggcaaatcaagatcttattagagaacagaccaaagagctggcaactgtcagaagggaacgcgacaactctgaagctgaaagagcccaacatcttacacaaattcatgagctccaagaacatctgcgagaaaaagaaagccagttcattgcattagaggaacagcatagggctgctcaagacaacattctttacaaagatgagcagttgagggaagcccatgcttgggtatctcaagttcgagaaatggatgctttcagtctcaatccctacaagttgagttacgtgagcgcatggagcaatttaatcaatattggattagctcccagcagcagtatgctgaaatgcagcggagtcttctccatacaatacaacaactccagcaagaattaactgaggcaagggaacagtctggtgcacaaaaagatggtccacaagtttctcgggaagggtcagctgaatcatcactagttcaaagcatgggaaacagcgtggcttcaaatggtagtgcaactgcagatgggaaccagcaattgttgaaaaataatggaagcgtggatgtctctgttcaggccaatagtgcctcagctgtacctgttccttcttccctactgggaatcggtggtccggctgcgcatatcgctgcgatgcatgcttttatgattcatcctcaaggcattcctcaacccttagtagcatcacccaactctggtgttcctcaatttggcagttttcagtctcagtctacaattcaaccaaattcacaatggccaaatcagcaggaagtacaaaatgtctcacaaccacaagatgaaacaaactatcagacatcccaatcagaccggactgttttacaacaaggcgctattaatactgatgagttgtcctcaaagccaagccaggatagtcagccagaccatcttaatgcccatgtgaaacaacagcaaagccctgcaagtgcacctactgaatcaactcatgaacttactgttgttgaagcgaatgtagctgaacatgtatcttgtgacgaacaacaaaaaatcttaaacgaacaggattcactgtcaaatatgaacaaccatattggaatagttgagcatctagagcaaaataccgaatccaaggatgaaagagctgcatctgataagcaacctgaacctgtatctaggcagcataaacatttgaactttcctccgttcactacccagattcacttgaaaaagagtgcaacagagaatcctaatgttgtaaatcaggttgatataatgaaatcagttgcaggtggttttagttcgcagttacctcgtgcaccaaaggaaccttctctcctagatgagagatctctattggcttgcattgtacgtgcagttcctgctgggactgagggtggaatcaggataagttcaactctgccaaataggcttgggaaaatgttggctccccttcactggcatgactataagaagcaatacgggaagctcgacgattttgtggctagtcatccagagctgtttgtgattgagggagacttcattcaccttcgtgatggagcacagcagattatttctgccactacagctgctgcaaaaatagctgctgcgacagcatcttctgcctcttactcatccttactgccttctgttgccgttactcctgtggcacaaaatactcggcaaaagaggaggcccgcagttgattccagatcatcaaatgcaattccctctggaaacggcttcacagatcaatttaacatcattcagggtgtcagcgacgtaacaatttcaggcaaagtaagaaatatccaagataatggcttcatagatgaagttcgcactgggcagccatccgtgctcacagctgctactgccaacggagcaagacatgacaaatgtgcaaataataccagacatggttatggtggaaaacaacaggggaggaccactgggacgacatacctttccagaagatgaaccaactttcactgggcgatgatgctgttggaattggaaaccatgcgagtggcgatgatgcggttggggaaaccatacgagtgacgatgctttggcttcgaaatgatggtgaagatgacctggattaaagttattctagattcattttttattttgcactattggtcttcacagagcctgtatggttgggggccttgttttggcaaagctgtactgatatatccctaccccaagaatcagaagcctgccaaagttttgcgactatgtacctcgtctgcgcttgtgtattgtggtgcacttgaatgatgcgaatgttatatcgaatccccgtccttgatcgtgatgaaaaaaaaaaaaaaaaaaaagcggccnnnnnnnnaaaaaaaaaaaaaaaaagggccccta

SEQ ID NO: 6492 - DNA, 3690 bp, Zea mays
aacgacccacacgcacgcacatccactatccccggaccccgggccagtctcacctccttccctcgatcgcacgccactcccgtaggaatcccgaatccccccacccaaattcccgtctagccgtctacccgatcgccgtccttctcgctgcccgtaaaccctagcccagccctctacccccgccgtcgttgcccgtgcgctgtcgtgctcgggctgcccccgcggcgccgcgagccaaaccctagctgcctcctccagatcccgattccgcagggaagccggagaggtgagggccgccccgccgcagatggagcccgcgggggcgcgcaaggagtggcgcgccgtccccgactcctcgctccgctccaatggcgccgaggatgccgcggagcatgggaagctggggcagtcggaggaacgagctatctacgaggaaggggcgggtggactgggcgacttctgtaccatcactattgatgggagcggagggctcagcgaggacatcctgcagcagcgcctgcaaagtgtcgcacggcagcgggaggagctgcagcaagtcgagatcgagttgcgtgcgcaggccattgcacacccgcagatcatcgaggcgcaacaaagcttccaggctgctgccaaggagcatgctgcagctgtggcaaagatcaaggagcaattgcatgagcgggagcagtacattcttgaattagaaatgaaactcaatgacaaggatagagaactaaatgctctgaagattgatcatcaaacggtgtgggcaaatcaagatcttctcagagaacagaccaaagagctggcaagtgtcagaagggaacgtgacaactctgaagctgaaagagcccaacatcttaaacaaatccacgatctccaggaacttttgcgagaaaaagaaagccagttcattgcaatagaggaacagcatagggctgctcaagagaacattctttacaaagatgagcagttgagggaagcccatgcttgggtttctcaagttcgagaaatggatgcattgcagtctcagtccctacaagttgagttacgtgagcgcatggagcaatttaatcaatattggattagttctcaacaacagtatgctgaaatgcagcggagccttctccatacaatacaacaactccagcaagaattagctgaggcaagggaacggtctggtgcacaaaaggatggcccacatgtttctagggagggatcagctgaatcatcacttgttcaaagcatagcgaacagcgtgacttcaaatggtagtgcaactgcagatgggagccagcaactgttgaaaaacaatggaagtgtggatgtctctcttaagggcaataatgcctcagctgtacctgttccatctttattgggaataggtggtccggctgcgcatattgctgcaatgcattcttttatgattcatcctcaaggcattcctcaacctttagcatcacccaactctggcattcctcagtttggcagttttcagacacagcctatgattcaaccaaactcacattggccaaatcagcaggaagtacaaattgtctcacaaccacaagatgaaacaaactatcagacatcccaatcaggtcagactgcattgcaacaagacactattaatactgatgagctgtcccccaaggcaagtgagggtggccatccagaccatcttaatgcccaggggaaacaacagcagagccctgcaagtgcacctactgaatcaactcatgaacttactgttgttgaaacaaacatagctgaacatgtaccttatgatgaacaacaaaaaaccttaaaagaacaggattcactatcaaatataaaaagccatgttggaagagttgagcctcaagagcaaaatgctgaatccaaggttgaaagagctgcatctgacaagcaacctgaacctcaatctagacagcataaaccttcaaacttccctccaactacccagcttaacttgaaaaacagtgcaacagagaatcctaatgttgtaaatcaggttgatacaatgaaatcagttacaggtggttttggttcacagttacctcgtgtacctaaggaacctgctctcctagatgagagatctctattggcttgtattgtacgtgcagttcctgctggacctgagggtggaatcaggattagctcaactctgccaaataggcttgggaaaatgttggctcctcttcactggcatgattataagaagcaatatgggaagcttgatgattttgtggctagtcgtccagagctgtttgtgattgagggagacttcattcaccttcgtgaaggagcacagcagatcatttctgctactacagctgctgcaaaaatagctgctgctacagcatcttctgccccttactcatccttactgccttctgttgctgttactcctgtggcacaaagcactcggcaaaagaggggccctgcagttgattccagatcatcaaatgcaattctttctggaaatggcttcacagatcaatttaacatcattcagggggttagtgacgtacctgtttcaggcaaagtaagaaacaccctagataatggcttcttaggtgaagttcgaactgggcagccatctgtgctcacagctgctgcgaatggagcaagacatgacaaaggtacaaataatgtcatacagggttatggtggaaagcaacaagggaggtcaactgggatggcttacctttccagaagatgaagtagttttcactcgacgcaattggttttgagggtggtgaagctgttggaaaccatacaagtggcattgttttggcctccaaacggccgatgctgaagatgacctggattaaagttattctagattttttttgttgcaccattgctattcacagcgcctgtatgagggccttgttgtggcgaagcctgctgaaattttgcgactatgtaactcgtctgtgcttgtattgtggtgcacttggaatgatgtgaatgttatagcaaatctgggaaatgtggtcacattttgagctggcgagctgtggcatggtcaatccgaagctgggtatcagcattggcgtttttcccgcatggctgagaataaccaaaactggctctatcgtccagtcgaacatacgcctggcccttctaggtcatatctgttgtcacatcagtttaccgatcatcattaacttttatctaccgtaatatttcagtgtataatctttatcgttagcttatagcatctttcacatcatctttatactcttacttaaaataaaatatggtgtttttatctaaataaaaatttatcggagtaaaattaagcaaacaaaaaccatatagtttataaaaacaagcataaactacatagtttatgaactataaataaaatttacataatttatgaacatatttttaattgttttggattgtttttgaattctttagttttttaatttttttggacatcaaaatgatgtggaccaatgaagagacgacatatggcagtaaacggttggtactggcaagttcactagcgcacctgtctactgattcagccccaacgctatcgatatcaatagattcggatggtcgacaatgtcaccaactaatattgcgatcagactcacgatgtattgtcgtagtccatagtgttcgtgtcttctggggtgaaaggtaaatggtctcaatatttcctat

SEQ ID NO: 6493 - DNA, 784 bp, Zea mays
  misc_feature (13)..(13): n is a, c, g, or t
  misc_feature (628)..(628): n is a, c, g, or t
ggccgcagcaggnacgacagcccgaaaccagtgggcaaacaattcggcgcgcgtgatcctgtcgggcgggcagcaggaccgtggcgccgcggacgagcccgacggcgaggaggacgacgactacaagcacatgacggacgcgatgtgccgtgtgtacagcaacgcgcccagggaattcaccatcatcgacaggggcaggaggaactccgtttgcttgcacaggaaggggttcgaggagctgtacgtcttcagccccggatcccagtaccagtggtacggcaagtatgcctacgtggtcgtagggcctgccatgctggagcctgtgatgctgaagcccggagacacgtggcggggggctcagtacctgcgcaaccccaatctttaggcatgctagcagctgggagaattgatgaccctggacacatcaaatgttcccgtacgtgtatccagatcatcagatgaggtcaggcgagatgcaaaattggcaaccacaatggtctacagatgttggaaatgctgtccatatatagcgaattgctgatgacaaggttcaatattagaatgatgagatttactatatctcaaatatcttaaatatacttctgttcagatgatccgcgctgggcancccccaaaaaatatcggaaaagaaagcgatgacacacaagctacaaacaaactcccgtgaactatagaaaaaaaaaaaaaaggttgctcctcggccgggccctcgctaatcaattccccgggccccccttggggcccgggagcatgccacttcggc

SEQ ID NO: 6494 - DNA, 962 bp, Zea mays
ctcgaggccggccgggaaagaatatagaaacacgacacgggcgcaacctccaaagtctggcccgctcgcgccgccgccgccttttcccggctcccaaggcgaagtggacggccgcgtcgggcgtcggcggcactgtacgtggtccgcagctgagcaattggcagatgtagtgataagctgatccgtcgtctcccgtcttcccgacccgggtcccgcctcgcccgtcgccgccagatccgacgcgctggatcgccagcggccggctgctgtcgatccgacgtgcggcagtctgctcttcctgccgtttccctgcgcttggggtccataatagcacgcatctggccggctcaagagcatagttgatctgaccggaggaggccgctgctgctgcttctccctcaccgatggcgagggttcgggacaggacggaggacttcaaagaggctgtccgagtcgccgcactctcccatggatacacggaggcccaattggccgcgctcatgtcttctttcatcatccggaagccgtcgcccaagtcaccgttcactaatgccgcaatcaagacgcttcagagcatcagggaactcgagaggttcatagtgaagcataggagggattatgtggatctgcatcgctctaccgagcaagagagggataacattgagcatgaagttggtgtttttgtaaaagcatgcaaggaacagattgatatcttaaagaacaggatccacaaagaagagaagaatggaagtggaaagacatggcttggcactagggatgagagttcacgggtggacttgatagctcatcagcatggtgtgatcaggaggtccccacagcacctatgagagttcaagaacaactactggatgatgaaacaaaagccctgcaggtggagttgacaagtcttcttgatgctgtccaagaaacggagacaaagatgatagaaatgtcagcactta

SEQ ID NO: 6495 - DNA, 1424 bp, Zea mays
ctcctgtagtaggccgcgatgtggcgcctctgtacacgcctacacagaaaagcgtctcccatcttgacgacccgtcttcgacctcgctcccacctcgccgcccgatccgacgggctggatcgccggcgaccgaccgttgtcgatacgaagtgcagctgtaggctcttcctgccgatcccctgcgtttgcgttccataatagcacgaccagcgcatctcaccggctcaagagcatccgtggatctgaccggaggaggccgcggctgctactgctactgctctctcggcgatgtcgagggttcgggacaggacggaggacttcaaggaggccgtccgagttgccgcgctctcccatggatacacggaggcccaactggctgcgctgatgtcgtctttcatcatccggaagccgtcgcccaaatcgccgttcactaatgccgccatcaagacgcttgagagcatcagggagctcgagaggttcatagtgaagcataggagggattatgtggacctgcatcgcattaccgagcaagagagggataacattgagcatgaaattggtgtttttgtaaaagcatgcaaggaacagattgatatcctaaagaacaggatccaagaagaagagaagaatggaagtggaaagacatggcttggcactagggatgggagttcccggttggacttgatagctcatcagcatggtgtggttctaattttaagtgagcgtctccactcggtaactgctcaattcgatcgtcttcggtccatgcgttttcaagatgctattaacagagctatgccaaggaagaatcagaagagaccagaaaaaaaacctgctgaaccgtccaagtccagtcttgttctaaaatctgatgtatcaaagattgtagatcaggaagcgtccacagcacctatgagagttcaagaacaactactggatgatgaaacaaaagccctccaggtggagttgacaagtcttcttgatgctgtccaagaaacggagacaaagatgatagaaatgtcagcacttaaccatcttatgtcaacacatgttctacaacaagctcaacaaatccagtatttgtatgaccaggctgttgaagctacgaataacgtggagcgtgggaacaaggagctatcccaggcgatccagcgcaacagcagcagtagaacctttctcctcctcttcttctttgttctcactttctcggttctttttcttgactggtacaacaactgagttagcatatgaagacattgtatgctgttcatgggaaatggttaaattatgaaagctggtctgtcttgaagtccaaaccttttaggtagtctgttactttctaagagtagtgatcaagctgctgttcatctgaatacgccgggatttgtcatttcatttctgacgtgctaaaaaaaaaaaaaaaa

SEQ ID NO: 6496 - DNA, 2035 bp, Zea mays
gcacgagaccattacctagaacatcctaatcgaaaaagatttcgtctccatttcctcctttctttccactaaaactccgcccccgtgtgccgtgttatctatccacccatcggttcgccttcctctcgccgctcgccgcatcgctttttagggttttctcgctcctgctcccccatcctccgcaccctcgctcctcccaacgcacgcgcgtcgacgacgaccggcagccgcgcatctgtccgccgccgccactcactacaaggagaaatgggcaacagcgacgctgcatcgcccgcatcggcggccgccgcgcgcgactccaagaagaagagggggagccgctcggcggcgaagctgaagcagagcaagcgcgacacacgccgtgagcagtttctgtctagggggcaaggtctgatctcatgtctggtctgtgcgatacattagtcttaatccgtgtttgtgattttggggatttctggttttcgattgacgattcggcagtggtgtgcatgacggatttgagctctccatgcgttggatcgcggtttttatatacaaagttatgatattttttgtgagacgttttgaccttcttctggatttaagctctccatgcgtcggatcaaggttatcttctctgagacgtacttctgaaatttatgtttttcaggtgctgcttctgaatgctacgtctgttcgttgattggggattgtggttatatagctgtaaagtttgtgttcttttttatggattcgttttaaatctgatataccatttcgttttggattggttcaggcaataaggatgccaaatctgcagcttcgccaacaggagcagtttctgggtcgcccatactcgcttccccgcaccctccacttcctcgtcgccgtgctgattccagatcaaggggcagtgatccggaggatagggatgaggctattgctgctggccttgaggcagatggcagtggccttgactccccaggctcagacaagcgccaaagtggtgactgccctcagaggaaggggttccctggcaatggcggtggtcccagcctcagcagtggaagcagtgtatggtccagctcaaggagtgtgagtgatgctgaggaggatacaggcggccctgaggatgagagtgaagtcttcgatgattgggaaatggctgctgatgcgctttatgtcgatgacagttcttgtaaccagagttcaggtcccacaccgacactcccacaagctccgaccactgcagaaccttctcatgcagcgaaaccagaaccgattcaaagcaagacaagggcttgggcaccggatgacatatttcgaccacagagcttacccagcatctccaagcagaccagcttcccagcaagcattggtaaccgctggcaggatatgggaatgagtgctgcgcagcagggaattctttcattgccgctgtcgtgccccatttgctgtgacgatcttgacctgacagattcgagcttctgtccctgtccttgtgggtttcacatgtgcctcttctgccacaacaggatcttggtggaagatgggcgctgcccaggttgcaggaagcaatacaacacagtttctgcagcagaaggcggcggtggaggtggctcaagagcaacagttgggactggacgagagatggaaaagcgactgtcccgttcttgtagcatgggtccaagttactaaactgccagggttatgctagatctatgttgtagcgctacccgttgcatgttactgtcagatatgctcgttttttgcgtatcgtctgcttttggtataaagaaatgtgaatattcgaaataggtgctgaatccatatagacttgtccagaaactcagttccataccgttctcgttgcatgtgatgcatatgttgctggagaggactgtttgttgcttacagtttgtgagataatatatatgccatataaggtgactgttttgtcctaaaaaaaaaaaaaaaaagcggccgctttttttttttttttttttctcataacaagttccaaacatgttgcaat

SEQ ID NO: 6497 - DNA, 1414 bp, Zea mays
acaacagatttcgtctccatttcctcctttctttccactaaaactccgcccccgtgtgccgtgttatctatccacccatcggttcgccttcctctcgccgctcgccgcatcgctttttagggttttctcgctcctgctcccccatcctccgcaccctcgctcctcccaacgcacgcgcgtcgacgacgaccggcagccgcgcatctgtccgccgccgccactcactacaaggagaaatgggcaacagcgacgctgcatcgcccgcatcggcggccgccgcgcgcgactccaagaagaagagggggagccgctcggcggcgaagctgaagcagagcaagcgcgacacacgccgtgagcagtttctgtctagggggcaaggcaataaggatgccaaatctgcagcttcgccaacaggagcagtttctgggtcgcccatactcgcttccccgcaccctccacttcctcgtcgccgtgctgattccagatcaaggggcagtgatccggaggatagggatgaggctattgctgctggccttgaggcagatggcagtggccttgactccccaggctcagacaagcgccaaagtggtgactgccctcagaggaaggggttctctggcaatggcggtggtcccagcctcagcagtggaagcagtgtatggtccagctcaaggagtgtgagtgatgctgaggaggatacaggcggccctgaggatgagagtgaagtcttcgatgattgggaaatggctgctgatgcgctttatgtcgatgacagttcttgtaaccagagttcaggtcccacaccgacactcccacaagctccgaccactgcagaaccttctcatgcagcgaaaccagaaccgattcaaagcaagacaagggcttgggcaccggatgacatatttcgaccacagagcttacccagcatctccaagcagaccagcttcccaacaagcattggtaaccgctggcaggatatgggaatgagtgctgcgcagcagggaattctttcattgccgctgtcgtgccccatttgctgtgacgatcttgacctgacagattcgagcttctgtccctgtccttgtgggtttcacatgtgcctcttctgccacaacaggatcttggtggaagatgggcgctgcccaggttgcaggaagcaatacaacacagtttctgcagcagaaggcggcggtggaggtggctcaagagcaacagttgggactggacgagagatggaaaagcgactgtcccgttcttgtagcatgggtccaagttactaaactgccagggttatgctagatctatgttgtagcgctacccgttgcatgttactgtcagatatgctcgttttttgcgtatcgtctgcttttggtataaagaaatgtgaatattcgaaataaaaaaaaaaaaaaaa

SEQ ID NO: 6498 - DNA, 2645 bp, Zea mays
gtatgagattcatgaccccttgccagatgggtaacatgacttgtgagtaaagatgtgcaacctctgcagagtgtaaaaactggcatatcagccgtgctcacggtcatgagcagctcaggccatcacatgattaatttatggaattaaattcaatttatcatttgcatcgcattgagattatttattattactttgatttattattactaaggtttggtatttatttatatttagtaagtgataataaaattttgaccaacttataaaaagcaatgctctgcttcaatctttattttgttgattagccttacacttcgcatgaactctcacctttagtgagttcatgcacattatttctcacaacttgttgagatatgatcttttgtgagttcactcttgcgatatataaaccctctacaggtgaagagcatgtggtcgaaaaggagccgcacaacgagaagttcgacttgatctaggtggcgtcttccggtcagctctgtggcgccagagaaataatatttagttcgttttatatttatcatttattttgtaaaacttacgctatgtaacaagtgaatttatgatatttatgatatttatctctatacgctcttttattatatgtgttgttcttacttggcgcatatataagacgtaccaggctttattccttaaattcgggtgtgacaggagattaagagaagatcgcgagggcgatttctgaagactcgtgggggcgacaaaggagatgaaatggagatctctgttgtgacgagatgacgaggttttccattttgatcagggcgaagaggacgacgcggtttggggtccaacgcggcctccatggctccaactccaacacgacatgtctgcagaacgatattaaaattattcatagtattaaaattatcacatatacaacgtccatttgtaaagcaattactcataatattaaaattaccacctgtacaatttttttaagaaagatgtcgcagctgctgtctgcaagctgaagggaacatatgccacgtttgacatttttagttgcaaacttacgaacatatgtaccacgtagttaggtagatatgaaaactccaatcaaattttaaggttgaactttgtgagacgataagttagcactacagtcctgaggttgcacatcggacctatgtatttcagcttgtggccgcttttagagtttaaaccactggtttttgaactttctaaaatccaaacaacttctataaactaaaagtctaaaagtttatcctaacgagcttttaattcttggttttcgaaagcctttttacttttgaatagtctaaaaactgacgtacaaaatgtacaataaactgaaacaaaccgccccataaaaagcccgttcgtttaaagatgaattatatgaattagagaagattaaattactttctagttaacattaaataggaagggtttagatataaattaatgaggattagagggcctccaatttccctcgtgcgcccgcggaccaaagagaccctcattttgttcgacgcagaaccaaacaagccgggactggacgcggctccggcgtggcatcgctggaccttcttgctcaccaagaagcccaacccggcctccatcaaagcccacaaccgtcgtagtcgctacttcccctccgatcgtcgacgacgacgcatccacccgagcccttctccgcgaaatagccgtcgccgcactgccgcagctccggctatgtcaatcttcgagtacaatgggtccgccgtggtggcgatggtggggaagaactgcttcgcgattgccagcgaccggcggctcggcgtgcagcttcagaccatcgcgacagacttccagagggtgttcaagatccacgacaagctctacatcggcctctcagggctcgccaccgacgcccagacgctgtaccagcggttggtcttcaggcacaagctgtatcagctgcgcgaggagagggacatgaagcctgagacctttgccagccttgtctctgcgctcctctacgagaagagatttgggccatatttctgccagccagtcattgctggacttggagatgacaacgtaccattcatttgtaccatggactgcctcggtgcaaaggagctggccaaggattttgttgtttctggaacagcatcagaatctttgtatggtgcttgtgaatccatgtacaagccggacatgcaacctgatgaactcttcgagactatatcccaagccctgaattcatcagtagaccgtgactgccttagcggatggggtggctatgtgttgattgtgacaccgactgaagtgagggagcatgtgattaagagcaggatggactaaataatggccactagaattattagctggtttccaatgcttaagaccaatgttgtgtttgtattctggagtaacattgtatcatcacagttggtatgagaaggaacgtttgttttctttatctctgttttacaacacttctgtttggtggaatactgagttggtaatatcctagattgcctgttttacaacacttctgcttggatttcaactgaatggtggaataatgagttggtaatattctagattgaggaaaaaaaaaaaaaaaaaaaaaaaaaaaaaaaaaaaaaaaaaaa

SEQ ID NO: 6499 - DNA, 1085 bp, Zea mays
tgcgacccttccgcggccctccgtgcactccacggggacctcgaggccggccgggatgataagcccaccaggccaccgccgtcgccagtcgctacttcccctccgatcctcgtcgccgacgcatccacccgaaccctcctccgcgacctcgccgtcgccgcagccttggccatgtcgatcttcgagtataatgggtccgccgtggtggcgatggtggggaagaactgtttcgcgatcgccagcgaccggcggctgggcgtgcagcttcagaccatcgcgacagacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagacctttgccagccttgtctctgcgctcctctacgagaagagattcgggccatatttctgccagccagtcattgctggacttggagatgacaacgtaccatttatttgtactatggactgcttaggtgcaaaggagctggccaaggattttgttgtatctgggacagcatcagaatctttgtatggtgcttgtgagtccatgtacaagccgaacatggaacctgatgaactcttcgaaactgtatcccaagctctgaattcatcaatagaccgtgactgccttagcgggtggggtggctatgttctgattgtgacaccgactgaagtgagggagcatgtgattaagagcaggatggactaaatcatggccactatcactataattcttagctggtttccaatgcttagaccaatgttgtgtttggattctgaagtaacattgtatcatcacagctggtatgagaatgaacggttgttttatttacccctatcttgcaagacttatgcctggatttcagctgaatcgtggaatactgaattgataatagcctagatctgttgttctcttacagaaacgtgaatgaggttaacatgtgctgtatcgcattctatggttgcctatcgaagagagccttggtccccctgtgcgctaatactctg

SEQ ID NO: 6500 - DNA, 1059 bp, Zea mays
cggagccggccgggtaccctcggcccctcagcgggacgcggctccggcgtggcatcgctggaccttcttgctcaccaagaagcccaacccggcctccatcaaagcccacaaccgtcgtaatcgctacttcccctccgatcgtcgtcgacgacgcatccaccccaacccttctccgcgaaatagccgtcgccgcagctccggctatgtcaatcttcgagtacaacgggtccgccgtggtggcgatggtggggaagaactgcttcgcgattgccagcgaccggcggctcggcgtgcagcttcagaccatcgcaacagacttccagcgggtgttcaagatccacgacaagctctacatcggcctctcagggctcgccaccgacgcccagacgctgtaccagcggttggtcttcaggcacaagctgtatcagctgcgcgaggagagggacatgaagcccgagacatttgccagccttgtctctgcgctcctctacgagaagagattcgggccatatttctgccagccagtcattgctggacttggagatgacaacgtaccattcatttgtaccatggactgcctcggtgcaaaggagctggccaaggattttgttgtttctggaacagcatcagaatctttgtatggtgcttgtgaatccatgtacaagccggacatgcaacctgatgaactcttcgagactatatcccaagctctgaattcatcagtagatcgtgactgccttagcggatggggtggctatgtgctgattgtgacaccgactgaagtgagggagcatgtgattaagagcaggatggactaaataatggccactagaattattagctggtttccaatgcttaagaccaatgttgtgtttgtattctggagtaacattgtatcatcacagttggtatgagaaggaacgtttgatttctttatctctgttttacaacacttctgtttggtggaatactgagttggtaatatcctagattgcctgttttacaacacttccgcttggatttcaactgaatggtggaataatgagttggtaatattct

SEQ ID NO: 6501 - DNA, 1606 bp, Zea mays
ttgggtacctcgccgcccgccgcgcctctccgggcagaccggcccggcggcccccatgggttccgtgcaggtgagcgtgtcgccactgactccggagcgtccgtccgtcccccatacggccacgcctctgggtctcccgcgctgccatggacgggggaagagagcagcaggcgccgccggagtcgcagcccggtaagaacctcatcaagatcccgtcctatcaggaggtcttcggcaccggcgcctccacctcttcctcgaagccgccatcctacaaccctcctgtagccacctccgccgccgccgccgcttcatcctcctcgtcgtcctcgggatcattctcgcaggctttttctttcctcaagtcctccgagttctactcacctccgccgccgcctccccagcccaccaccaccccgaggccgactcaagctagcccctcagcgccgactccccaaagcaagaactccattctcgtcagtcataggcagagagggaaccctctgctgaagcacattaggaatgctagatggacgttcgccgatgtcgtgccggactatgtgcttgggcaatcgtcatgtgccttgtacttaagtatcaggtaccatcttctacatccagactacttgtactatcggataagagagctgcagaagaatttcaggctgcgtgtcatcttgtgccatgttgatgttgaagatgtaatcaagcctttgcatgaaattacaagaacagcgctgcttcatgactgcacccttttgtgtgcctggagcctggaggaacgcggccgcgccttgccgactattaaagtatatgaaccccgcccagctgacagcatccccgaccacatggataacggctatctatcacggttgacgcacgggcttacatccattcggcatgttaataaaacggacgttgtcacactcggttcatgtatttgcagtcgctctcacagatcatgaatggttctatggacgagctggctcgatgcccaggaatcggtgagcggaaggtaaggcggctctatgataccttccatgagccgttcaaacgggttcctgcccgaccacgaccaaacctcgtagtacccgataccccggaccgggagaaagcaaaaggccaaccttcgtctacagatggcagcagtttgcaagatgcggtagagaagccagatgcgtcgaagaagacgaagaaaggctctgatgtaagatcagccctcaccgttgcctttgccaagtattcggagaagatccgcagtcagggccgcgatgcgccaaacgaggccggtgagagtactggcggctcgaccgtggaagctgagagggcgggagactagatttagctgtaggatggttaacggtgctggagtaatgctagtttgttccttcctgttgggtgcttgttgttgtgactcggccgccgatgtgcgcgtgcggcaccagtatttcccgcggcgtcctaggcatatgtgttttttttaggctaaagaggggccagagaatcttcaacgatatcgaaacatttaagtgagcttcctagacggtggcagccattccatcaccaaaaaaaaaaaaaaaaaaaaaaaaaaaaaaaaaaaaaaaag

SEQ ID NO: 6502 - DNA, 2187 bp, Zea mays
agtctttatttcagacctttaatccataaatagtgaaaaagatctatacgcagattctgctggagatgagcttattcactcattcggaccaagacgacgaacttcgaatttcctcaattttcacgcgagcacctcggccgcctgcgccatccatgtcgtcgcccttctccgccgcttccgtggccgcggggtcagaggcggcagccggcaccaggaagctgcctgtgctgctggtcgacgtcatggacaccctcgtccgggacccgttctaccaccacatccccggcttctttcaaatgtccatgaaggaactactacaaagcaagcatccaacggcttggccacaatttgagaaaggactgattgatgagaatgagatggccaaaaagttcttcaaggatggcagatcgtttgatttgcaaggtctaaaagagtgcatggtgagagcatatgaatacattgatggcgtcgaagatattctttgctgcttgaagaaaaataattatgaaatgcatgcttttacaaattatccagtatggtaccaattaattgaggataagctaaagctctcaaagtattctatcttgcgacatgtttgttcgttggagaactggtaaagcgcaaactcttcgcccgagttttatcttcaagctgcagatcaactcaacgttgatccagcaagctgcgtttttattgatgacaggatgataaacattgaagcagctcttagtgtaggaatggttgggttgcagtttaaaagtgctgaggcactacagaaggacttgtgtgctctgggagttgaattatctcctcttgtttgtgaaggtgaagcacaagtacaataaggttgtgtgtgccctatcttatcttatgctcaaccaaactacaatacgaatgtacataatgtatggtgccctttctttgtgagctatgtcaataaattattgtgctaatctgaatcctctatcaaatataactgatatgttaactgcacatattctctcctatgaagagttttttgttgtcagttagtagaggtgaatttttttttatcacaaacatatgctgtcaaacctcagccaataggctctgtaacttcaattcaggttaatgttcatcaagtttgaggagttttcaaaaaaaaaaataaaaacctatctattttttgcggggagcttaggaaaaactcaacctttgttttgaaagaaacggcaaagcaattttaaaacttaaaatcaaagtgtatgtatgatttagaaatcagagctgctattctgattaagcaaacacatttacttgattctattgatctggctttgatccttatataatacatatacgtggtgacattaaaagatgtctagtcatctagtgtatttacgggcttgattctgtttcttacatccctttcctctgttcctatatctaaaccctgctgtatcgaactcttttgttaccattgttgacatagaaattggaaaggcatcctgatttttttttgggtaaagaagatatagttggaggcacaacaaaatagaagctgaagttttattttaaattagtgtcatgtacggtcaaccatatatccgtaaggggaggcgcgcgcgggacattcgccacgtcgaggaacgcgctgaccgcgcagcaagggatcaggcagaacaggggcacgcagcaagggatcgcgcagatcagggggatcacgcagagcaggaaggggcgccagtgattgacagctagaaggaaattgctagaaaggaaagggcgaagaaggaaactagcagctaggaaagaaagggctaggaaggaaagagctaggaaggaaactaataatcagggagttgtttctccttttgatctggcggctggcttataaattgattgtaaccggaccctttgaagacaagcaataatcagttgtctctctcctttctacctctgtaagcctgcggttgggaggcatactccccaccagagaagacgaccggcggctacgagctgcgtagccacggtcctgcgagtcaagggtactcagtccttgacagcttggtatcccgagtcaggcgctcctcgcccgaccactcccggcccgccgtgccctccaccaccaccaccgctcacccgccagcagccgctccaccatcgcccactttgctacccgctgccaccaccatgtccgagcccacc

SEQ ID NO: 6503 - DNA, 1171 bp, Zea mays
tctattctatctagatctcactctttatttcaaacctttaagccataaatagtgaaaaacatctatacgcagattctcctggagatgagcttattcactcattcggaccaagacgacgaacttcgaatttcctcaattttcacgcgagcacctgtttgtatcgccggcggatcggatatattttctcggttcctgctactcctttctttctcgcctgcatccatggtctcgctgctccctcgcgctccctcactcgccttcctcgctaagtccgcctcttcgcagcggccgcctgcgccatccatgtcgtcgcccttctccgccgcttccgtggccgcggggtcagaggcggcagccggcacgaggaagctgcctgtgctgctgttcgacgtcatggacaccctcgtccgggacccgttctaccaccacatccccggcttctttcaaatgtccatgaaggaactactagaagccaagcatccaacggcttggtcagaatttgagaaaggactgattgatgagaatgagctggccaaaaagttcttcaaggatggcagatcgtttgatttgcaaggtctaaaagagtgcatggtgagagcatatgaatacattgatggcgtcgaagatattctttgctgtttgaagaaaaataattatgaaatgcatgcttttacaaattatccagtatggtaccaattaattgaggataagctaaagctctcaaagtatttatcttggacattttgttcttgtagaactggaaagcgcaaaccttcgcccgagttttatcttcaagctgcagatcaactcaacgttgatccagcaagctgcgtttttattgatgataggatgataaacattgaagcagctcttagtgtaggaatggttgggttgcagtttaaaagtgctgaggcactacagaaggacttgtgtgctctgggagttgaattatctcctcttgtttgtgaaggtgaagcacaagtacaataaggtcgtgtgtgccctatcttatcttatgctcaaccaaactacaatacgaatgtacataatgtatggtgcccttgctttgtgagctatgtcaataaattattgtgcaaaaaaaaaaaaaaaatcaaatataactgatatgttaactgcacatattctctcctatgaagagctttttgttgtc

SEQ ID NO: 6504 - DNA, 1385 bp, Zea mays
gccggccgggttaccatcaagctttcaggcagggcaagcaactcgagtagtagttgccagccacacctcctgtcttcctttttccttctcgcattgtggaggagaaggatcaagtgctcataagcaagctagcttgacgaagtataggaaattaggaatacaaataaactcatcctcctcatatataaacgctcgatctccagatatggccggcctgtccctgctgcatcccatggccttcgccttcggcctcctcggcaacatcatctccttcatgacctacctggccccactgccgacgttctaccggatctacaagaacaagtcgacggaggggttccagtcggtgccgtacgtggtggccctcttcagcgccatgctgtggatctactacgcgctgctcaagtccaacgagctcctgctcatcaccatcaactccgccggctgcgtcatcgagaccctctacatcgccatgtacctcctctacgcgcccaagaaggcaaagctgttcacggccaagatcctcctcctcctcaacgtgggcgtgttcgggctcatcctcctcctcacgctgctgctctccgccggacagcgccgcgtcgtcgtcctcggctgggtctgcgtcgccttctccgttagcgtcttcgtcgcgccgctcagcatcatccgccaggtggtgaggacaaggagcgtcgagttcatgcccttctcgctctccctctccctcaccgtcagcgccgtcgtctggttcctctacggcctcctcatcaaggacaaatacgtcgctctgccaaacgtcatcggcttcagcttcggcgtggtccagatgggtctctacgcgctctaccgcaacgcgacgcccagggtgcctgccaaggacgtggccgacgacgccagcaaggacaaggcgcccggcgaacatgtggtggtcaccattgccaagctgaccgcggcgacgacggcacctgcagctgccgtggcggaggatcttgtcaaggtccacgacggccacccggaggaagcagccaagggcgccgccaagccggcggagaacggcgcgggacgcagcgacgccgagcaagtctagattcctcgctcgatcagatcagaattcatgaagaagaacatgcgtatgtatgtgtatccggtaggtcgtaacataacataaattaagtgcgcatgcagtttggcaactcatgttgtttcatttcgttctcgcgcaatatgcgcatgtattaattttagattgtcattgttgtagttcttgcctccgattattattagtgtgtccgtcaccttccatgtaataacaaaaaaaatatatataaatggtcctattaaagcaaaagctaaagttcgtttttatgccaaaaaaaaaaaaaaaa

SEQ ID NO: 6505 - DNA, 1026 bp, Zea mays
cccgggccttctgtgatccaaactaataaacaccacgcgagtacgccgcgtgcgacctcgagcggacgcgtgggcgcccgcgtgccatggctcccacggcgccgacgcagcggccgacgatgcgccactcctccgcgttcctcctcccttcaaccgcaccgtcatcgcccgcgcctggtcccgatgacgccgccgtcgcgctcgtcgtcctcaaccagccgctgccccgcttcgcgcccctcctctggtccagagcggcggtgcgggtgtgcgcggacggtggcgccaaccgcgtcttcgacggcatgccggccctgctccccggccaggaccccgacgaggttcgcgcgagttacaagccagatgtaatcaaaggggatatggactcagtaagaccagaagtgaaggagcattattccaacttgggcaccagaattgttgacgagtcacatgaccaggacacgaccgatttacacaaatgcatagcttttatagctgagaattattctgccactaacaaatctaaccagctcagcatcttggtccttggagcacttgggggaaggtttgatcacgagatgggaaacatcaatgtgcttcatctcttcccaagcatcaatatcgtcctcctatcagatgattgtctgatctttctgctctcgaaaattgcatacccacgagattcacgttgaaaagtcgatcgagggaccccactgtggattgatcccgattggcatgccgtcgactagcaccacgaccaccgggcttcgatggaatctaggttatcctcgtccttatccttcgtaatgcaggcttataataccagtatgagcttcggaggattgatcagcacgtcaaatatcgtggaagaggacaaggtaacggtcacctcggattcagaccttatgtggacaacatcgctccggaagtgaatctacactggagtatagggtaccattatactgttgtaatattagagaaataagtgacatgcttttaatatatttatatatatatatattaaat

SEQ ID NO: 6506 - DNA, 2451 bp, Zea mays
aatttaatctctgttaatccctctaatcaaacacatgcaaccgaacaaggactaaagattttatttctagctaatgacttaatacaaagcatacaaagacgagctacacatctatatatatatccttgtacttttgtgattaatatatggtttcaaatgcaaaccatatatatacatgcagcagcgaatctattaatattttttcttaattaatgagcatcactgcgtcagacaccaggtgtatacatatggctgtttcaacggagcgagctagcgagcgagtggtggtccgccgcaacgaacggcgacgacgaacgaagctctccggcgttgaaccaatatgggtctcggataatccggccggtttgacacttgggacagcataaaatatagcaggcagtgtcgcgtgcgtgtgtcacatacacacatgctggtgaagtggttgtgtgctactagctgttgtatcgcacgtacgtggccatatcgtcgtcgtcgtcgtcaccatcatcagcggcatcgatccgcagcgccagaacaagcgagcgaagccggccggacacggacgtacgccgcccgcctcggtacccctgggtgtgtggtgaagtggttggttttgcattgctatgtatgatgccgtgaccatagattagaatataataatacgcccaggcaggcaggtctcgtttggctttgcagtttgcacgatgctagctagctcccctccttcgtccctagcgagagctagctctcctccatggctcgatctccagcaggtcggccgacatggactgatgggagacatacagattattatacttattttatattagaaaaaaaagaagagcttaattgcttctgcgagctgtgctggctgcctggctctacacaccgccgctgagcgctgatctacacagcgcgcggcacacagatggatgcgatgcatgcaattgcagttgcagttgcaattgcaattgctcttgctcatcaggtaatatatactgtaaggtagtagctgctagcagtcatggatcatcgatcatgtgaaattagagtaaaaggaaatttagcagcagactgacatgcagttccaagcacactgcgagctactagggggaagggaaattaaattacactgctacggtacgagccgggggtgtctatgactaattaagcatcgatccatgacatgagaattcgtcgatacacgccacagcagcaagtagaaggggaagaagaagaaggcaagcgaaaggggaaggaggagggattgagtcttagcagcagctgcatcgttacttgtcgtcgtcgatccgccgatggcgatgaagcagcaagcgttggttccccttccatgtccggatcgaccgagtccggtacggcgacggattcgatcgatcagtacggggcgacgcggccggcgccgcctcctgggttggcccagccgtaggcgtcaagcggggagagggaggcccgtgatgaggccgtgggggagccggtccgcgagcgggtgttgtccgggcaatggcagcggcgggggcggcggggacgaggactgcccgccggcgccggcagctccgggcatgccctgcggaataggaggaggagggggcaggtgctgctgctgctgcggcaggtcgtcgtcgtcgagcgggaggcgctcgtaggcggcgttgccgaagcaggcggcgacgatgacgacggggccggacgcgaggagcggcccggccacggacccgcccaccacctggccctgcccgccggagaggtagacggtgaggcccgtggcggcgggcggcgccggcggcgggaggaaggagccgcagagggagaggatctcgaagcggcccggcagcgtgacggccccggcgccggcgccgggctggcggacgcacacgttggccacgctgccggcgccgctgagcacgcacacgcccacctggcggcgccgcgcgaagccggccacgctgtccaccacgtcgcagccggcggccacctccagcacgtgcgcgcgcagcgcgctggcgctgtcccgcgtgatgatcacgggcggcttcggcttgttcttggaccccgcggggcgaccccgcgggcggcgcatcaccgcggcctgctggtggtggtggtgctggtggtggttgtcgacgtcgcccccggcctgctgctgctgctgctgctggtcgccgtcgccgctcccgttgctccccgcgctgttgatggtgttgttgctgtcgtcgccgagctcctgcttcgcgccggcggggaccccgcccatgagctccagctggtgctcctggaaatgctggaacgccgggtgctgctgtcccgggaacaggtggtggccgccgccgaacgcgtggtggaacggcgccactggcggcgcgaagtggtggccgccgccgtgcgccgccgccacgggatccatcgccgcccggccggccacgggcgagcgag

SEQ ID NO: 6507 - DNA, 1840 bp, Zea mays
gattgcagctatggagctggtaaaagtacttgcccacatatggggacctggagagctgaatccgtcaagtgcatcactcatttctgctctacgttcagagcttgatgttgcccgttctcatgttagaaagctaatcaaagaacagaaatctgatgcctttgaaattgaggacttaaagttgcaacttacagaagaattggaatcgtggaaggtcaaacaaaaggagaaggttggaaatgctctccgatttgtagtttcagagctagacactgagaagaagtcaaggaaaagagcagagaagacaaataagaagttgagcattgccttagcaaacactgaagcctctttgcaggcagtgacgaaagaacttgaaagggagaggaagtataaaagaagagttgagaagatctgcaacgagcttatcagaggcattgatgaggacaaagctgaggtgcaggcactgaagagggaaaccgagaaggcacaagaagagctccagaaagagcgtgaaatgcttcaacttgcagatgagtggcgtgaacaaagggttcagatgaagcttttagaagcacgggttcaatttgaggagaaaaatgcagctgttaatcagctgcgcgatgaactccaagcttatctcgatactaagaaagagcaggaaccgttgaatgatccaatggaactgtcccatgcatctgaaattggcaacactgcagctgatttagttcctgacagaaatggtggaaacatcagcgaagacgcctcagaaggcagtgatatacactccattgagctaaacgtcgatggcatcaacaggacctacacctggagctacactccttcctcaaaaggcaggcagaggagcccatcaaggcatgaaccgttttcggatagagggatggatggcgtgaactcgtggcgtttagagcaaagttttcgggacatggatgaagaactggagggagactgggcagaagggtgcagcaacggaatgctgaacttggatcatgatgaggagaggtatctggctatcaagaatctcagagagcagatgttggccgggtcggggttcatcctgtcacaaggtagagaaaatgctaaaagagagtattgtggcttgtaagataaactgaacaagaaaatttaaaagtaatgtgccgtatgaatcgctgcttgatgctagatccaactgttcaaggatatatatagtgatggttctctgtggattactttccccttgtaaatatcttgagctcttgaaaggttaggttacagggctggtgtgttcatgttcatgattctgatgtcttgtatgtgtgttaatgtccatttaagtgtctggaaatagtttataaaacgtgattggaaatataacacaaaaagaaaacattggtatgaccttctactactatatatatgtgagtgtaatttacctcattcaattggaaaataggattttttagactccacaactgtttgaattattcgattagaaaattggttgtgtagcatggaaagatcacgatctctgtaaaataccaccaaaaatttgtgcccccctaaataccacagaaagattgggctatgaactgaaaggatcactttaataaaatgaggtgacagagccgttaattaggacaaaaatacccccaagagttcaccaaacataaacaacaacgtgtccctaatattcaaatatatataaacccatactccctctgtcctaagataagtacacatcttacttatcgagaagtaaatttttttctaaatttgatcgaatacatatataacaatattaatatttataatgtatttataatgttttgaaggcacaagagcg

SEQ ID NO: 6508 - DNA, 3967 bp, Zea mays
  misc_feature (3416)..(3416): n is a, c, g, or t
  misc_feature (3429)..(3429): n is a, c, g, or t
  misc_feature (3959)..(3959): n is a, c, g, or t
cggtagcatttctcacttgatgtcactaaagctttgttaatcaattccaggttggtaaattctcccaagacgatgtttcaagatgtcctgagaaaacagtgaacctacaggatctgcagaacagcttgattgcatctaaggagcttgtaaaagtacttgcccacatatggggacctggagaactgaatccgtctagtgtatcactcatttctgctctacgttcagagcttgatgttgcccgttctcatgttagaaagctaatcaaagaaaagaagtctaatccctatgaaattgaggacttaaagaagcaacttgcagaagaaatggaatcgtggaaggtcaaacaaaaggagaaggttgcaaacgctctccaatttatagtttcagagctagacactgagaagaagtcaaggaaaagagcagagaagacaaataagaagttgagtgttgccttagccaacactgaagcctcactgcaggcagtgacgaaagaacttgaaagagagaggaaatctaaaggaagagttgagaagatctgcaacgagctcatcagaggcattgacgaggacaaagctgaggtggaggcactgaagagagaaaccgagaaggcacaagaagagctccagaaagagcgtgaaatgcttcaacttgcagacgagtggcgtgaacaaagggttcagatgaagctgctagaagcacggcttcagtttgaggagaaaaatgcagctgttaatcagctgcgcgatgaactccaagcttatctggatactaagaaagagcaggaaccaatgaacgatccaatgcaactatcccacgcgtctgaaaatggcgccaccgcagctgatgatgtagtccctgacagaaatggtggaaacttcagcgaagacgactcatcggaaggcagtgacatacactcgattgagctgaacgtcgatggcgtcaacaggacctacacctggagctacactccttcctcgaaaggcaggcagaggagcgcttcgaggcatgaatcgttttcggatagagggatggacggcgtgaactcgtggcgtttagagcaaagctttcggggcatggatgaggagctggagggagactgggcggaagggtgtagcaacggaatactgaccatggatcacgacgaggagaggtacctggcaatcaagaatctcagagagcagatgctggccgggtcagggttcatcctatcacaaggtagagaaaatgctgaaagagagtgttgtggcttgtaagataaactgcatatgaagagaattttaaagtaatgtgtcatatgggtcgctgtttgatgctaagatccagctgttcgagaattttaaagttatgttccatgattctgaggtcttgtatgtgtgttgctgtccatttaagtggccggaaatagtttataaaaaaaagcgcccggaaatataaaaacaaaaggaaaacgttcatctaatgtcctttaaccattgtgtgagtccaccaacttaacctgtctgatttagcttcttgagcagttttgactaatgtagtgttacatcaactgtcctccgtggcgccgtcgaccacaagtaaactgaacttttataatagttgaagggggtgaaataatcgttctaaaagtcattcaaatatatatattttagaataaatatatatttaaaactactaaatctgattcaatattagaaaatttattaaaaaaaattagcttggagaaatatggtagtagtttaagagagaaaaatcagagtcactcaatagttaaggaggtcagttacaccccttccaacaaattttttttttgaaattcttccaataaaatattgaaatatatctaactttgaaacatttagaactagaactggaccacaggccaaaacctgttgaatctttacagagaaggaatctttataggtttagactattcttttttaactagagatgataatagataggtgtaatgctggtagagcaaacacccatctatattgacacacatcaagccacaactgcatttaaaatgtcaaacaagtagatttttacgttcggacttgtaccggtatggatgatcgacaattacaaataattaaaacaaaagtgtcacaaatagcaaggtaaataaatataattatttataatcatacgatatataatgcatacgatatataatgtgatataaattacatttcaaagaagtgaagatgagtagatgatctagagtttcattagattagttcaaaagactcagctagtattctacggctcattgggtactcatggttgaaaagtcgcccccagttctaaaccttcattttacaggtcgagtcaaatgtagacccatgaatggaatttaataactagaaccacatctaatatatatgaaactctgggcgttggcgtcgattcggtgccaaacactagaatgaaccacatggcagtgctcttctaaaccttcattttacaggtcgagtcaaatgtagacccatgaatggaatttaataactagaaccacatctaatatatatgaaactctgggcgttggcgtcgattcggtgccaaacactagaatgaaccacatggcagtgctctttatggaaacgcggacagtttgcaatgtagagtcggacggtccgcgacctcgctgcaggatctgctccttctctgcatgctttcggatggtccgcgcttgtagcccggacggttcgcaatgacgcagagtattcttcttcgcatgaaccaagatctcgcctcccgggagggacctattggggaggagagattgtagggtagacttggggtcggcagaccacacaagacgcatttagacgacgtcgagccgaagagaagtgaataaataggttgatggaagactaatactaaggctagattactcctacttctaatgtatggaaagaataaggcaaatgttggaatcagaccactgaaacgtggcgtgtccgtcgggccgcccgcacacacggcgcgccctatccaggccgtcgggccacgacacacacgcccacacatataacagcgggctttaagtctgttgggcttacactcccccaaaaagctagcccatcagaggctgcaccatcaaccatataaatcatgcttgctcacccataatacacaatgtgagactattcccaacaatctctccctcacacatagttagccgagatttgtctaaaataacactgggccaaactggctctgataccaattgttggaaccagactaccgacacatgacatgtctgtcgggccgcccgcacacatggcgcgtcctacccaggctgtcgggccatgacacacgcacacacgtatagcggcaagctttagatctattgggccaatactcctccaaaaagttagctcatcaggggttacaccctcaaacatataaancatacttgatcanccacaatacacaatgtgggactattcccaacagcaaataagataaatgtaataaattagtttgattggattgcgtcctgcagtgttaatcacccatacccctttatttatataggaggggtttgcaactgtttcaagttggttaccaaacaaatcttgttgagtttgctgacaaataccgcaaaaaatcagaaactcgaactaattctgtttccgtgcagaccgttcgcgccgccacgacagaccatgcgggccacccgtcttaacgtgaacagtgggcacctaaacttatgcctgtaattgttatccctattccaaacaatctaaaatctatttttttcaaaccaacgtaattttatcttgaagtaatctcttttcacttggcctcaatcggtggttgagtccttggggcccttctccacacatagcgtctcaccctcggcatactatagatgtccaggtgggtcgggcttgccgagtggcccaaaacccggcatgggtttggcccagcccaatcccggcacaacacanagcgaaga

SEQ ID NO: 6509 - DNA, 2343 bp, Zea mays
  misc_feature (2324)..(2324): n is a, c, g, or t
actcagttcgttcaaaccagatgacagaagaaaataaccgttcagctgttagtggtcattgtggcagtagcccatcatctcatcaagaatgctgtaggtcagaagacttgaatagatatgtgtgctctgatgagggcaaggaggttgggcacctaaagaagagtcagtcgcttgtaaacatgcttcaaaaggatcatggtcgtaattctagcgaaggctctgaggttgatgttacaaaccatgaacacaaatatgatccctctaatttgaagagatctgaagttgttggagaatctagtaagctgtacagactgaaaaatgaggatccctcgcgtgcctcatctgacctaatcagccatgacttttgtgaacctttaggtgatcacactgttgattctgatagccatcatgacatgccttattcccaaagcaatctcccaagatcacaatctgcaatatttcagaatgattgcaccagtgatccagaaggttctgtcgattctgagatactagggtgcagatctgttgacggtttatgttcactgactgatgagaaatttgactacctgagaggtggtgaaatgtatcactgtaaatcaaatttggatgtttattgtgcaccttctccaaatatgcaccgggcatcaaacattgacgaccatggttcagtaggttgctctgatgttgctgcagagggtcaacggtccactggaagcacagaagaattttttgtcagggatgggatcctagtaggtcacgaatactgggatggcaaatacatttgtggcgatcactcgctgggtccagttgcccttttctgtgcagattattaccattctgggaatgatgtcgacctcagtgaagctacaggtcaagagagagagctgtcgaacagagatagcacactccaccagtcgcttgtagtggaagtacctgagtcggtgagcatttctgatacaaacgacattagtggggaacctgaacacagtagaactgacattgatgaggacccaagtgaacttactccaagaacctacaatattaaaagaatcgaggattggatcaatcagattgatatcaatgatatcgctttggatgggcaaggagagaattcagtttctgctttagccaaatctcgtgaaccgatggctggcgttcctgctgtgcggcctgatgctaaaagcccgcttggtatggagatagcttacacttatatttcgaagttaactcctgcttcatcatcggcacagttggcaaaccttggtttggttgcgatcccaagactgagcgcattctcaggtttgcgcgtattaaacttatcagggaactcaattgtgcgagtaacagcaggagctcttccaaaaggccttcacatgttaagcctgtcaaagaataacatatcaacaattgaaggccttagagagttgacacgattgcgcttgttggatatcagctataatagaatatctagaattggccatggattggcctcctgttcctcgttgaaggagttatatctggccggtaacaagatcagtgaggtagatggtcttcaccggcttctgaagctcaagattctggacttgcgccacaacaagatttctacatcaaagggcctcgggcagctagctgcgaattacaactctctagaagccattaaccttgccggcaaccctgcacagaagaatgtaggcgatgagcacctgaagaagtacctgcttggtctcctgccaaacctcgctgtgtacaacaagcagcctattagggcgactggatcaaaagacgtctcggaccgccatacccgcaagatctcttcttcgcaccattctgaccgtggtggcagacccgaccgcagatcttccaggttggtgggtgccccgtctgctcacaagccacagagctcgcggcatggacgctctggatatgtgtcaagctcagcgctcaagtacacgagagcccgcaacacgcacaagacctcgctggggtcaaggccccttgaacatgcgagtgccatagatctggcgaagcaaacccagacagagggaaggacacagtaagatcagtcaagcacgaccatcgatatactaccatggtattgttgtgaagtaaagcgaggcaccagttttgctggtggattttttttctctctcacgtgaataaagctcaaaacagtaaacagagcagtgctttcatatcagcccatatttttttttctaatattgttgagtggtattgatggcaattgggaattgtatgatttacttgccttatgaataaagcttgaaagaaacaaaataaagattagtattttttttcaagatgtnttcaaaaaaaaaaaaaaaa

SEQ ID NO: 6510 - DNA, 1324 bp, Zea mays
ctgctacaggaacctacactcctcattttcatagaatgttattttatcttttaatcacaatgatcaagttatttagctgcactactgggaaatggccaattagggcttgttcggttagctcgcaattcatgtgtattggacggaattggatgagtttaaatcacaaacaagtcaaactttttttaaattttttccaatctcatccaatccatgggtaacggaattaaccgaacaatgccttaaggaaaactttctaaaacctgtgttttttctgtgtttttgaattaatttctataaaatttctatgtattttgcaaagagctattgtagtaaaaatccttaaactgaatagaaaattatcgtttttatacctgctaaaacctgtatagaatttggagtcgaaaagcaggaatggacaggcagagacggttagggaaaggtgcaacagcccacatgtaaaaggctgcgtgccacgtcaccctctctcatcacatcccagtactgtactgtacgtacactgcagtcactcagccacgcccccggattcccatcctccatccgctagctagctagctaggcaagacagtcgagagtcgacaccatggccatggcgacgcaggggcaggccgaccagcagcagcagcagcacgggcggtctgagcccaccaccagcgtcgccgccaaccgctgggggccctactccggcgccggcgacttcgccagcaacatggccgtcatcctggccgccctgctggccgcgctcgcgctcggcctggcgctcaacgccgccgtgcgctacctgctccgccgccgccgccgcgccggctctggtggtggccagggcaacggcagcggcgtgctgccgtcggacgacccggctgagaagccctctgtggaggtggagctgcaggcgccgccgcccgccctgctggtgtactccgccgccgggacgaagctggcgggcgccgcggcggagtgcgccatctgcctcgccgagttcgcagacggggacgccgtgcgcgtcatgccggcctgcggccacggcttccacgcgcgctgcatcgagcgctggctcgcggagggccgccgctcctcctgcccgacctgccgcgcgccggccgtgcagcgcagcctgcacgcaagtgaattactctaaataaataattgccgttttagtgttgctatttaccattgcttgtactgcctctgtaaatcaagaagaagaaataaaattataactcttaggtttgggctcaaaaaaaaaaaaaaaaaaaaaaaaaaaaaaaaaaaaaaaaaaaaaaaaaaaaaaaaaaaaaaaaaaaag

SEQ ID NO: 6511 - DNA, 402 bp, Zea mays
gtgtctacgttggtgtggactttttttcgacgttgagtcccgcacgagtgcacgacggcagctcacggagactgagaacggcgggcggcgggaggttgaaccgaaccggtggcgacgacgtcgaccaggccgcactccgtccggcatccgtatcctcctgtttccttctctccggtaatcttatttcctttctttggttatcgcgttctagggttctgcttcttggatccagcgattggggacttgggggtaggtttctggacatctatactgcaaagttcttcatatctagtgctaatctgatttatcgtattgaggtttgagataagagaatgcctatgctttttcttttttgcgatcgaaatgcctacgcttttgtagaatctatcatggcataatatg

SEQ ID NO: 6512 - DNA, 1257 bp, Zea mays
tacctccgagccccgcgcggccgaaacgcggacaagtctctacagcctcagcacggacccggcctgcctcctcttctctctcacggcgacgactgggcgaccgaccaaccgtcgctgcgctacgccaggtgccaaggtcttcttcgggtccttcgccggcgaccagcagcaccaggcaattgcacttgtgtaagaaatggatgctactgccggttaattgcgacacagatttatatggacatagatattggggccatgtgtaagggcggaagctgttcctaccgcgtcaataaggggagtcctgctggttctaccaggaagatccgttccacagcctctcaaggtcggatggcatctgacacagcgagggtaacgaaaacagaggcatcaaagctgaagaacctgatctcggcatcattcaaacccttgtctctgaccattcccatcggcgacggattccacgaatcgctccctttcagccattgtcatttatagtagagaaagacctacaagaacgtcgaggtgctttctgcaggatctcataatacttgcacgagctaggatgcagctcaagcctcctgcaagacccaagctctattcagggctcatgccccaagaagatttggatccgtaccgtgatctaataccaggcttgcctgaagacttggcgaagatatgtcttgcccttgtccctcgtgctcattttcctgccatgggcgcagtttccaagaggtggatgtcgttcctcgaaagcaaggagctcgtagctgtgaggaaggaggttgggaaacttgaggagtgggtgtatgtcctggttccagatgctggggcgaaggggtcgcactgggagattttagagtgttcggggcaaaagcagagccctcttccacgcatgcctggactaaccaaagcggggtttggtgtggttgttattggtggtaagctctttgttattgcgggctatgccgctgaccatgggaaagactgtgcttcagatgaggtttatcagtatgattcttgcctcaacaggtggactgtgcttgctaagatgaatgtagctcggtgcgacttcgcctgtgcagaggtcaatggggtgatatatgttgctggtggatttggtccaaacggcgagagtttatctagcgtcgaagtgtatgacccagaacagaataagtggacactgatcgagggcctgcgcagaccaaggtggggctgcttcgggtgcagcttcgaagggaagctgtatgtcatgggcgg

SEQ ID NO: 6513 - DNA, 1758 bp, Zea mays
agtccgacacctccgtctgcgcacacatttcacctactctccacacagggcacacccaacacttgagctcacacaatcacgctacagagcgcagagctgcacgctccaccggcgaactcacctcggccgccctcctctgccagatagcctccctctactattcaagcccaaaccctaaatcctcggttcccaaatggcgacgccgccgactgcgctgctgttgctcctcgcggcggcagcggcattccacggcgcgacggcgaagacgacgatcgagccgtgctctggcgcggacgcgtgcccggctcttctgggctacaagctctacgcggacatgaaggtgtccgaggtggcggcgctcttcggcgccgacccggcagcggtactggctgccaacgcgctcgacttcgcctctccaggcgccgccaaccgcatcctccccgcgggaacacccctccgcgtgcccacccgctgcgcctgcgccgacggcgtccgcaagtccgtcgccatccgctacgccgcccggccttccgacacgctcggctccatctccgaggtcgtcttcgccggcctcccctcggccgaccagatccgcaccgccaacgggctcgccgccgaggaccccgacgcgccgctcaacccgggccaggagctcgtcatcccgctcccctgcgtctgcttcaactccaccgacaacaacctccccgctgtgtacctctcctatgtcgtgcaggtcggggacaccgtggaatccatcgccgccagccacacaaccaccgtcactgatatcagcaatgtgaacgccatggggagccccattgtcgcaccaggcgacatccttgccataccattgtctgcttgcgcctcagcatttcctaactctgcttcggactatggattgcttgtggcaaatggaacctatgcactgactgctggtaactgtgtggagtgcagttgtgggccagcgaatctcaatttgtattgcacaccgtcttcactatcagcatcatgttcaagtatgcaatgctctaatagcagcctaattcttggtaatgtgactgcacaacccaccactggtggctgcagtgtctcatcttgcaactatggtggctatgtcaatggaaccattgcaacatcgctatcctcaggtcttcaacccatgtgtccaggaccgcatcaatttcccccactcacggcggtgccaactgcggcaaaccatgggtcttattccccatcacctgcaccaggacctggagatgctggtggtgccaccccaggaggttccagcctttctccatcaaatgagcctgctgggaacagctcacaagcggctgcgataaatcaaccatgccgtttcctcctcattttcattctttctgtgacattgtccttgcgggtgtggattcctgtgtagagtattgttttttttaaaaaaataactatgtagagtatttgttggctgtatttgtattgagcgtggaaggccttatttggggccaggtggaacctgaatgaagaatgcagtagcctgtcttcgttagtgtccggtgaaactttggtatgattttggtttctccagaatttgtatatgaaaaaaaaaaaaaaaagaatctatccatcaaggcagtagcacgagatagagatggtaaggttcatggtccccatgggggcaccaagcttattgcctagagcttattgcctagtgcggctgctagtatgcatctcccattagtcctgcaaaaacgaaaaaaaaatcag

SEQ ID NO: 6514 - DNA, 3036 bp, Zea mays
  misc_feature (70)..(70): n is a, c, g, or t
tcaccgtgacgcccgctcgacgcccccctcgtccacgctcgcgatgtccccgacgtgatgccccctcccnccgtgcgcgtacacctctagtgcgtgtagcagtacgtcgcctataatgtcgtcctccagtccgtccacgctgaatccatcagtgtctgctcctgctaggagaacgttgctggggccaagatccccaagttcacccgcttcgttgacccgccgcgaccttcatcaggtagctactcatcacctcggcccaccagccgcatcaaacagggaaatcaaacagatatgttccttggagttttgtttcctgtgtagcgtgccatattagcatttttgtcgttgcgctcttgttgattcagattttgtagttcgagagatgaacaatgcaatttaagcgtcatcagaaacatgttctggttccccccaatatgcaagtaatatgtacgccaggtgtgttcaaattctctttgcaactaacccatcgaccgagctctttttttctacttatgttgttgaagtagtgttttcttgcagatgttcgcctttgggacattgctccgagggactatgtaatgcaatgcaacttatgttcatattctgtttcatttctcccccattagaaacagtagcctattcttatataataacactggacatttcgttgctgtcggatgaactaaattttcctgtatgtgctgcagcacaatttgtgccacagattcagctcaaaagtcgatacgataacaaaattggtgtttttatatgttcttcaacatttcttttctgtacgttgaatttagataattgcagtggttgattctccctccttttttatctttgttatttcttgggccgtggtggaggaggttacagcggcagcggtggacaatttggctggttggatcttatttgtgcgctcgtattgtatgttttatgcagagtcggaaggacgtggagggtcgctcttagtcatcaagaggtccgtctctttctgacgtgtttgcatacaaacagaaaatcttatagtttgccaatgtcgtttgttctagcaattttctatctactaaatcataaacatattagttgtttggcatagtagatcaaatgcataatctaattactggactagaaaaaatatgatccgttgtgctttgaatggtttctctctgtttcctagatgcagagcatggctcttattctttgcatgtttaaatcgattgtagtgatttgtttagttctgctctgcaaccctttgagagatacatacctgggtttgtatatttgtccatttcagaggtcaatgtattaccttgtcaggcagcttcaagatttctaaaattgacaaaaatggttggaagatcaaacatcgagaattcactttctacaagtggaacaattgcatatcagggcattgatctattgacatgtgcccatatttctatttatttgtcttcaagttctagatatctctcttattctgatttctataggcacattttgctgcagatttctgttttcaaattgttcctgtaccatgttccattagcactaatattttagtttaattaaaaaggatctggcttagcatgagtgaaaagatatttaagtttgttaaaaacaatctgacttacgccccgtttggttggaggtagtcacgtttagtccctaaattgccaaatggtgggactaaactgttttagtctttagtccctcaagggatgactcgaagagactaaaccatataaattccactttttcccctcctttatttcagttgcactaatggcgggagaatgctaaggggtattttagtcctattatgattcatttaatgtgttttaaatagttttagtctctagaactaaacatgatagagactaaattttagtctcctaactaaactttagttcctggactaaaggaaccaaacgaggccttagcatgagttgaaaagacatgtgagtcatttttatgacttctacatttgcaacatgtggtatgtagcatgtctaaaatagcaatacgcaactttcatgaattatgcaatttttaagcagcatgacatgtgaggactgatttttctgtttcaatgcaagggggcaccacgacaggtggtggcgggcgcgtgggtggacacgaaggcaactgggtttgccctgacgtcaggttcgtttccattatcgtgttcatggattttctattggactagattaaagattcgttgaatcgtgttattctgtactggcatgtgaattctgtcatgtagactcgactcaagtaaaactgtttcaagatgttctttgcagtgtttgggtgattgaatcattatgctttcaggcatgtggcacacatgctgttactattctaggttgaccactatcattcacattcctttttttcctgcatcttttacatcatgggcttcgatgccgccgtgtatgggtggggcaggggtttgggggttttctcgacctatgtgagaaggtctttcttaatacaatgctcggggatgtcttacccccactggtcgagtttttttacatcatgtagttacacaagaacaacttgatcatgctaaagaagcaaccaaatctgcagttttgatgaacttggaatcaagggtacaatgttcttgctcctgatcaaatcctaattgtataacatgtttccctaaagtgttctttacagtacatacttttcctcttttgtaatctatagcatttaaagataaagacaagtttaaaataggagacgtgactaggtttattattattgaaacaatgttcactctccactattatgttgaattgttaaatgtatttacatgtagttggagcgtcacaatgttcagttgtactacatatttgggtacatatttgggtgtgactaactttcagtgttgttatgtacataatattgtgtggctaaacttttaaattaccatttgtattttattgtgttaccatttgggatgcatctacatgcttgttgttttggtgtcacctcgcctaaatatatattgctcggcac

SEQ ID NO: 6515 - DNA, 1231 bp, Zea mays
ggaaagccttaaccgacaggcgatacccacggcacgggcccacttggccgcgcgtccgggccccgcgccaatccaacgccattacgcaacgattagccaaacagatcaatcatcttctacttcttcgtataggccgcgggatcccgaatcccaatccatagtcgccaccgtcgccggctacagggttcggtccccgtgatggagccctcgtcaacctcctcctcgccggctgtggagcgccggttgtcgccggaggtaaggagggtgcggaagcgggagctgaaggaggcactggagcaggtccagcgggcggttgagatgctgcgcgatgccgacgccgatctcggcgtctctctctcggaggagaccacagcagctccgccggagggcgaggaccgcgaggccgatgtcggtgccaatggatatggggcggagacgtcgtcggttgcgagtgactccgattacgagacggcccagatgtgtgatcttcttaaatctaaggttggatcgctcgagttccttcaaaagctcaatggtattcagaagtcagtaggtcagaatggtgcagttgaacctgatacatcatgggatataataacgtcagtggatttatgggaagatggtggctcagatgatggatatgtacttgttaagcaggaggatgtggttgatgggatgacttcctttatggctgcatgcttggtgtcaattaaaaagaccaaggatctgccccctgatcaacttcagaaagcgcttaggaagacgttttcagctgaaaagaagaaaggtaaaatccggaaggcatgggatggaactaaagtcatttataatgttgcttcatggggcgccactgccgttggggtctacaataatccagcattacttacggtcgcaactacagcgtttcagacttcttgtcgtgtgatatccaagttcctttgaatatcgtgtcaactactagggtgtgttagaattgcttgcgtatgtgcttttccattgttcaggcagcataagcttgagaccatttgtttagtctatgctgatgagttcgactgctaattatcagcacctcagtccaaagcagcatttgtattgtacaactgtaaatattgccttggtttgaacaaactgtcttttgtgccagaactttattttggtcatccgaaatgatgattagtctgtactagtttccgtatcaaacaaaacgaaaacccttgatattctaaatatt

SEQ ID NO: 6516 - DNA, 1315 bp, Zea mays
atgacacggggcccacttagttgcttatgtgagccgcccctcccgccgatcccgcgacgataacccaaacaaaccaatcatcctctccgtgtaggccgcgggattccgtgtccctctccaatccggcgtagccatcgtcgccggatacaggatccggtccccgcgatggagccctcaccaacctcctcctcgccggctgtggcgcgccggttgtcgccggaggtaaggagggtgccgaagcgggcgctggaggagttgttggagcaggtccagcgggctgttgagatgctgcgcgatgccgacgctgatctcgccatctctctctcggaggagaccgcagcagcctcgccggaggccgaggaccgcaaggacgatgttggtgtcgatggagatggcatggcgacgtcgtcggttgcgagtgactccgattacgagacgacgcagatgtgtgaccttcttaaatctaaggttggatcactcgagttccttcaaaagctcaatggtattcagaagtcagtagatcagaattgtgcagttgaacctgatacatcatgggatataataaagtcggatttgtgggaagatggtgacccagatgatggatatgttcttgttaagcaggaagatgtggttgatgggatcacttcctttatggctgcatgcttgttatcacttaaaagaaccaaggacctgcctcctgatcaacttcagaaagcacttaggaagatgttttcagctgaaaagaagaaaagtaaaatcagaaaggcttgggatggaactaaactcatttataatgttacttcatggggcgccactgctgttgggttctacaataatcgagcattacttacggtcgcaagtacaacatttcggacttcctgccgtgtgatatccaagttcctttgaatattgtgtagggtatgttagaactgcttgcgtctgcttttccgttcttcagctaataaaaaggtagcataaagtcggaatccatttacttaaatctgtcctgtttgccagcgacatcaagatttcgcagtcgagttcgactgctaattacgtattctcttcattttttttatttgtcgcggtttagttcaaaaatgaacaaatattagcatttagcagcgcctctagtccaaagcagcgttggtattgcacaactgtaaatgttgccttgcattgaacaaacttgcttccgtgccagaattttattttggtcacctgaaattattactttgtactattttccgtatcaaacaaaactaaaatccttgatattgaaaaaaaaaaaaagggcggccgccaccgcggtgga

SEQ ID NO: 6517 - DNA, 3294 bp, Zea mays
ctatcatatcatcagtgtggttcagtccgtgactcgcgctgcacaccacggccggccagcccgccaccgccggaggcaggtaggctatccgtgccccgttgattcccctctccattgcggccagccgtctccccctacctcccactgcgtcgacccgctccgctccactcccgcttttcaatcgaatccgatacgcgccccccttccatcccgttcctatccccccgaccccggcccaccaatcctcaggccactcgcgccgcatcgccaccccattcctcctcacatcacatcgatggaggccaaaaccttaacccctgaggcggacgccgccgccgcgccccaacccctagccgccggggagctcgtctgggccaagccctccaagccccgccggcactgctggtggcccgcgcgcatgctcgccgcgtgccccgcctccgccacccgcggcgcccaagtctcctacttcagtgaccccgccgcccccggcgcgccgtccgcccctcccgcgcaggtccggcgcttcgccgacgccgacgccggcgccgacatgatggcccgcggcagcaccgcgcgcggattctccggggccgtcgcggaggcagaggcgcgcgccgtcgcggcgctgcgcgcccagctcgcctgcgcttgcgtcccgcccacgccgccgcccggagaggatagcagcgtcaccggcgtcgccaacctggcgcccgcggagttcctggccgcgctccgtgaggccgcattggacgtcttctctgccggcctgttggaccgcgccaggctcaagagctgggtccgggcggtcggggaggggtggggtccacatggcgcccggcactacccgcggcgcccgctgcacgaccttgtggacaagatcgatcttgatgtgcctgctggcgaagacagagatgctgatggttggcttgccgaggaccagcacaaggcattggagaggccggaggagacaccattgaggcacaagaagcgtggtgtcaccaaagtgctggatgcaggggaggatgagggcaagatggatagccctgagcatgtaacctcaggaaagcgacagcggaagaggagtaagtacctgttgccaccatacaccagcttggttgtggttgacaagattgccctcaaaccggttgatctgccaagggcattggtgaccgaagctgctgaagatggcagcgatatgtcgccattgccagacagcattgttgtggaagatgtcttgctgctggtgcgaagattaggggaggttcccaggcataaggacgactttccaaaggacgctgagggatttctctgtttgtttagaagcacaacatttgttcacggtgctgactatgagtcttgtaaggcatatgaatgtccactcgtgcgtggctctggaaaagttggcatggaaattgttgtcgctctagcctctgattcacatgcttttctgaatcaaggcagttgtgtgttgaagaggaccaggaaaaaagatgaagctgtgagtggtagcccttccatcaagaagaagcgggagaagacctctcttgccagcgctgatataccaatcgctcctgctattcctattaggcagttgaaagcagaagatatgagaaccctcatgaaggctgaaagtggtctaaggggtataggattaggagttaagaataataagggcaaaccttcacctttgaaagttcctatttcagctgcggatcctggagcagtggaattaggacacgaacatgcccaagcaaatgttctggctgtgtgcaatacgttccctgaacagcccgcaaaagaaaacgatgctactaacttggaagcaacaaggtcagaaatgaatatgcaaaatggtactgtagatgtgcctatcagaagtgttcagacagaagcaatgaaattgcaagctaataatcccatagatgtgaatgcacaaagcgttgctgtagatgtccctgtaggaagtgtttctaaggaagcaacagagccagaaactagtgtacacaaggacaagaatgtgcaaagcgatgtttcaggtgtatctgacagaattgtttctaaggaaccaacagagttggaaactgatgatcacataaacgagaatgtgcagagtgtcgctgcagatgtgtctgccagaagtgtttcaaaggaagcagcaatgaccgatgctgatattggcatacatgaaaatacgcaaagtgctgcagatttgcctgacagcagtgggccgtctcctatgcatgaagacatgtctcagcctgtggatggacataaggagcctgggagtgtagaagtctgcatagtccagcaatcttacgcttctctggaagctatggtgccagaaatgattaagaaagttaacgctaatggcgcaggcacaatcggtgtgaattatacactcaaagacgagtttcaaaaggatggacaacctgtcgagaaagtgaagctaccagcaggagtggcgaaccattcctgtggtggcggtaccaatggcacttggctggaccctgctaaccttacacctaagaaaaggaagaaagtcgcgcagcacttcagcaatccagcagccgtcatagtggaattcgcacccggtgccactgttccgtccagacaggagctgctctccacattcggcaagtacggcgacttgatcgagtctcagaccgatatttcggaaactacccgcagcgcctctgtcgtgtatgggaaaagcgttgaggccgaggaggcgtacaggaacggttgccagtaccttcttggtcagtttgggcctccgttcgctacgctaaggcttgatttctccccaatcgtgccttcaccgtctcctcccgcttcgaaacctccgctccgagatattcggaagaacctcgaggacatgatttcgtcccggcgctcggctttgaacaaggcgacctcgtcggcagacgcccagctggaccctgttccagataagcttctgggggagatgcaggggctgttggcaaaagtcgacaggatgcttaccaggcctcatgctaatgctccttagccctgccaatctggagggttgtggctgtaacctattcggtagttaggcaactttggtgtctgctctgttagctgtgaatggcggggcttgttttgtggctgcttcgtgtactatatatatgccaataaggtcgcagcttcttttcgtgcccctgattttgatgttatgttagtagtatggcattgccattttgtcagagctgttggagtttgcaccggaaccctaaagtgcacttgtgctgtagtgcttaaaaaaaaaaa

SEQ ID NO: 6518 - DNA, 3577 bp, Zea mays
actttccatcgaatccggtccgctctcttccatcacgttccctatctccccgaccccggcccaccgaacttcacgccactcgcgccgccccatcgccacccccattcctcatcgcagcgatggagggcaaaacactaacccctgaggcggacacggcctccgcgccccaaaccctagccgccggggagctcgtctgggcgaagccctcccagccccgccagcactgctggtggcccgcgcgcatgctctccgcgtgccccgcctccgccgtccgcgacgcccaagtctcctacttcagcgaccccgccgcctccggcgcgccgtccgcccctcctgcgcaagtccggcgcttcgccgatgccgacgctgacatgatggcttgcggcagcaccgcgcgcggattcttcggggccgtcgcggaggcccaggcgcgtgccgtcgcggccctgcgcctccagctcacctgcgcctgcgtcccgcccccgccgcccggagaggatagcagcgtcaccggagtcgccaacctggcgcccgccgagttcctggcggcgctccgtgaggccgcattggacatctcctctgtcggcctattggaccgcgccaggctcaagagctgggtcttcgcggtcggggaggggtggggtccacatggcgcccagcactacctgcggcgcccgctggacgaccttgtggacaagatcgatcttgatgtgcctgctggcgaagacatagatgctgatgattggcttgccgaggaccagcacaaagcattggagaggctggaggagacacccatgcagaagaagcgctgtgtcaccaaagtgatggacaaactggatacaagcaagaatgagggcaagattggcagccctgaacatgtaacctcaggaaagcgagtgcggaagaggagtaagtacctgtcgccaccatacactaacttgggtgtggttgacaagattatcaaacaggctgatctgccaaaggcattggttcccaaagctgctgctgatggcagcaacgtgtcaccattgccaggcagcattgttgtggaagatgtcttgctgctggtgcgaggcttagggaaggttcccaagcatagggacgattttccaaaggatgctgaggaatttctccgtttgtttagaagcacaacatttgttcacggtgctgactataagtcttgtaaggcacatgaatgtccactcatgcatggctctagaaatgttgacatggacattgctgtgggtctaatctctgattcacatgctgttctgaaacaagccagttgtgtgtcaaagaggggcaggaaaaaggatgaaactgggagtggtggctcttccatcaagaggaagaagcgagagaatacctcttctgctgctacaattagcactagtataccaatcactcctgctattcctatcaggcaagtgaaagaagaagatatgagaaccctaatgaaggcgggaagtggtccaaggggcatagaagtagatgttcagaacgagaagggcaaaccatcacctttggaagttcctatttcagctgcagatcctgaagtagtggaatcaggacatgaagaggcccaagcaaatgttctggctgtgggcaatatgtttcctgaacaatccgcagaagaaaatgatgcggctaacttggaagcaacaaggtcagaaacgaatgtgcagaatgttactgtagatgtgtctatcagaagtgttcagacagaagcaatggaattgcaatctaataatcccatagatgtgagtgcgcaaagtgttgttgtggatgttcctattggaagtgtttctaaggaagcaacagagccagaaactagtgtacacaaggataagaatgtgcaaagtgatgtttcagatgtgcctgacagaattgtttctaaggaaccaacagagttggaaactgataatcgcataaatgagaatgtacagagtgttgctgatatgtctgacagaagtgttttaaaggaagcaacaatgcctgatgctgacattcgcatatatgaaaatctgcaaagtgctgcaaatttgcctgccagcagtgggctctctcctatgcgtgaagacatgtctcagcctgtagatggaaatgaagagcctggggatgtagaagtttgcacagtccagcgatcttatgcgtctctgcaagctaacctgccagaaatgcttaagaaagttaaaactaatggaacagatataatcggtgtgaatcatacactcaacgatgagtgtcaaaagaatggacaacctgtcaagaaagtgaagctacctgcagaagtggcaaatcattcctgtggtgaaggtaccaatggcacttggctggaccctgctaaccttactcctacgaaaaagaagaaacctgcacagcacttcagcaatccggcagccgttattgtggaatttgtacctggtgccactgttccttccagagaggagctactctccacatttggcaagcacggctacttgatcgagtctcagactgatatttcagaagctacccgcagtgcttgtgttgtgtttgggaaaagcattgaagccgaggaggcgtacaagaacggttgtcagtaccttcttggtcagtttgggcctccgtttgctacgctaaggcttgatttctctcccgtcaagttgactgtgccttcaccgtctcttgcttcaaagcctccactccgagatattaggaagaaccttgaggatatgatttcagcccgtcgttcggctctggcaacctcatcagatgggcagctgaatcctgttccagataagcttctgggggagatgcagggccttttggcaaacgttgacaggatgcttactaggccgcctgagaatgctccttagctctgccaatctgaaggattatggctgtaacctattggtagttagacaactttggtggttctgttagttgtagcttttgcatctaactttatgatgaactacatcgtttacccagttcagcagctgcgatttggaattcctgtgaatggtaggggcttattgtgtcactgcttcgtgtactatatatgccaataaggtcgcagcttcttttagtgccttgattttgtgttatgttaatagtatgtcattgccttgattttgtgttatgttaatagtatgtcattgccattatcagaggtattggagtttgcatcggaataaaaaaatgtttgaagcattgctgtcgttggtcttggtgaattgttcgaatgtgacgctagtatccattgaagtactagcatctgatatgaacaaaaaaacgacccttttcgtcaatgcttgtgttgagtagtactccacgtaacagtttgagcacttcagtagtattttcatcgtttcggacagtaatttgcactgtgtagatttagagggtgtgtctggttttatggactaatttttaatcccttcattttattctattttagtctttaaattatcaaatacaaaattaaaatagtgttttagtttttatatttaataatttatggactaaaatagaataaaataaaataactaaaaattagtccctagaaaccaaacgtacctacagttttggtgtc

SEQ ID NO: 6519 - DNA, 7464 bp, Zea mays
  misc_feature (6622)..(6622): n is a, c, g, or t
ggactctgtgggacaatatgaggagtgagtgaacttgttgtaaaaggagtgattttcattaaaactcacatctctaggaatataaatacggcgagtagatggatcataacaacagtctttgtgtttaggattgtattcaagaaaaacacacttaacagactgagcagtcaatttaatccgctcatatggtggtaacaagacataacacacacatccaaacactcgaaggtgatcatatcgtgaaggtatccaaaaagaacttcactaggcgttttgctagaaagtttggatgatggctgtttattagtgagatataccgcagtagaaacaacttcaccccaaaagcgtgaaggaacaaaagaagatatcaaaagagtgcgtgcactctcaatactatgacgatgtttgcgttcggtaacgccattttgggcatgagcaccacaaagaaagttgatgtagagtaccctctaaggacaataactctcgaaaattatcagatagaaattcaacaccagaataaaaaaaaaatataatagaagcagaaaactagatgtgaaccatgcgcgtgaaggacatataaacagaaaccaatttagagtgttgtttcataaagtaaatataagtataacaataatggttataaataaaaacgacataatatttatgaccctaattcaaaataaaaagagtaagatcctacatgagagtaaataagatcagaagatctagtagaataagaatcactagtaaaatatgaaaatatgaaagttatatttgttttgaaaggtgacaatcttgctttgtcacaaaccatatcaaaacactccccagctcatagttatccagttctatcctatacgaacaggagtacgctacaaaatacaaatggtagccccttcccttcgtttctcatagctgaaaagactgagagcctgagagacggtttagatcgacccccacgggcccacccgaccatctcgctggggccagccaaacccaaatcaccgccgctatgtcacggtcgatccctcgtaaaccccgcgcccggatgttccgcggcatataccgctttgtccatcccacctcggcacctctaccgacacgtgggtctacccgccaacctgtccgtttccgccgcctctgacacgcgggcacaggcacgggcctcctccttgggtaccccccccctccccagctcgtctgcccctctctccatttcgcggaggaagaaaaaggggaccaaaaaacggaaaaggggataggaggaacggatcagcggtggaagcttccagccctagcgcagcaatggcgggttggtgcgagcaggcggtggcgctgctacagcgccccgcggtggcggagatggccgtcgacgtgctgctctgcgcggtgccgatctgggccgccgtcatgatcggcctcgtcgtcggctggtcctggcgcccgcgctggacgggactgctcttcctcggcctccggagccgcctccgcatcctctgggtgccgccaggcctcggggcccggcggctctggttcgcctgcaccgcgctctccgcctgctccgtcgcgaccaagctcatctcctccgcattccgccgctgcagaggcaagcaccaggacagggcctcccccgacgatgatgccgctgcgaccagagacggcggatgtcgcgccgacggcagaacaaattttgagggtgagcatgatacagtcactgagaaggacggctggggaccgaggttggtggcggaaatgcagcggctgtcagtctcgtcaattgcctctcttgaagactaggtgtctttcagtttggtattgaatggaatgaccttgcggttcattcaggggcgaccctgtccctgtgctagaaggcaatttaggacctgtttgattgaggccttgagaggtggctttttaaaaagctattggtacctatgccctgtggaaaaaactgctgggggagggagggcgatgaggaagtcgaaaggcgtttagttgaggaaaaactgccgtcacctacaggctgtgtttggaatgtgggtagtgaggaaatcgaaagccgtttagttaagtagatgtgccttccacaagaatgtatccaccctcaacttcctcttcgtcctctcgaagccagggaagctggcctgggggtgggggtcagagacatgtcattgctggagctgcgtgcctgcgctagagacacgccgttgccagggtagtgtgccctcacaccgggagggagagtgcctcgctgaatctgcaacactttttttacgcgtaaagagacgagtcagggcaaatcaaaccggtacgcacgtaacggatgataggtgggtaatttcatgggctttgtattagcccagagtaggtggaagtagggaaggctgcagtgaaatttgtactaggcaaaagctgcttttggctgtggctttaggtgggaaccaacccctttggttgatttttggctttttagaagccatagcaggttgaaaagcccaacctaagaaggccttaggagttttgatcttttttccctcatgaaaattactctctttaagctgacttgatgaactgacacatgtcgatagagttggagcagaatgcacgattgtattttgaattggtgacatagggatgttggaaacttgtggctttgctggtagaagagtatgtacttttgtccggtccgtgaaaacttcctatttatgtaggctatataggttttgatgattgattagctccgttcgcattgcaccatggaaggattcgcaacataaacttgcctgctgctggggtttcatcgtggctgtggtttatttcttcctcttttgatggttttagtatgtgtccttgcagtgaacttgttcttgttgacataagaaagcaccacaatttcattttttttctgcagtgaaaacttagttcaatttttaatattttctgatcggcagaacaaattttgagggtgagcatgatacagtcactgagaaggacctagaacatctcctgcaacttttagataataaggaaagcggggatacagcttggcagaatttgatggagcgtagaacctccaacatgacatacaatgcctggcggcgtgagcctgaggttcgtctttccaattggttgtggaaaaataggatattataaaaagtacttcactactaccatgattctgaggtggcgtataacatattagtgtctgaaatctgaacgcaaagaataattctgcgtgttaaattaaaatgacgaagggctatgattttaatttttggaagtttcttttcggcacatattgtcatttcattggccagtggcattactaacaccacgagtccctttaagtttctgttagtgtactctttgttagattctagcattttctttattgaaagtgttatcctaaacggtaaacagaaacagtcagccatttaccgtttagccattatttggcgtaaatggccatataaagttaggtggtttgagtagtacttatccggtcctgagttcaattcaccatggaagcgaattttcacgctggggttaaggaaaccctcccgtatatccacgccgaagcacaggtgtaactgtctaaggccaagccctggaccccggtcttggttaggctacaatgccgccatgtatgagggggacaggaattcgacgttttttcgaccttagggaggtcttcttaatacaatgcatggaggctgtcttatcccctgcaggtcaagtattttatatattagccttttcaactgaaacaggaattctgagacgagattgtttgatcaccttcttttgttacttgatcggcataaattggcatgaacagttagaagattgcagtaaaatctgtgtcatgactaaatgttttaccataatatatttgtatacatatcctgagtttattttaaatacatttattaggagggacctataatgtactgcagccgcactatttttgaggatgctactcctgaactggttagagatttcttctgggatggtgattttcgtctaaagtgggatcccatgcttgcatattgcaaatctttggatgagttccctcagaatggagcaacaattgtccactggataaaaaaggtttgtccagcttctgttgttccctgtgtatgttcatgttaaactctcaattccaacatgttgtttgttttccagttcccgttcttttgcagtgaccgtgaatacatctttggaggacgcatatgggaatctgggaagacttactattgtgttactaaggtacatgtacatagtgttttattaaccgatacttctactcatgtaatgttaatgctccctccattatctgaaaaaagaattcatataattttataactgacaaaggtgaaatgttttgtcccctttccatttcctgctcaatggctatgctttacttttggctttacacctactgtgtgaaatttatgttccgttttttctccaagaaattgcttactctttatttaacaaaacattcttgttctgcacttctctgctgtttgatggtagtctgcagaaattttctcaggattgcttactctttatttaacaaaacattcttgttctgcacttctctgctgtttgatggtagtctgcagaaattttctcaggagtggccttgtaattgatccggacctaatgtaaatgcttaagagtgataattttcgtgagttttttcccgtcacccataaaagagtaacccaaaactatcaactactcagatagcaaactgcttattatcttcctgcatgatgtgttgaatttacctatcagtgtcttttaaagttgaactgcttgcataatttcatcagcacctttaagttttatgggatatcaggttattagatttcttggtttaggagatgaacatacattaaccgctatgttccttttctgactaatatgtgctagactttttggaaaacaaacaatggacctgtattacatgaagagaacattacactgggtcatttactattgatagtggctggttggagcacatcttagtatttaaagatggatttaactgatgacagtcaagactgaatcaatgcattaaaacatcttatttttaggcattaaattctcacacacatcttgctgagaaaccaaactctgctctccgtagattagagcgacacgcctaccttgtctggcatgtttgtgaaatatggattagattcacaaggatttcaatatattaaaatcgctgcctgtagaaaatgtttgctaacatcctatgtaagtgcatatatgtgagcgctcagcagcctccgttccgcagggtgttccatatccatcattgcccaagaaagaaaaaccgaggcgtgtggagctgtacttctcaagttggcgtattagagctggtaacttttttcttagtagttagtatcattatggtgtctagagctgtgtttgttctgaacatgaaaggtatccagtcaggcttgaacacaaatgcttaggccttaacgctataatcatattctttgtctctgaaatgcagttcaatcgcctaaacatgtgggtcagcaatctgcgtgtgaagtaactttggttcactatgaggacatgggtataccaaaagatgtagcccgggttgctgttcgtcatggcatgtggggtgctgttaagaaacttcagtctggattcagagcataccagcaaatgagacacacagaaactaccctgtcacacagcgtcatcatggctcgaatgaccaccaagatatccatcacagcttcaaatgatcccttggaccatgacctctcggttgccgataaaatcagtgacgagaatgacagctccaatgcagttcaacatggttttgattggaagtggttggtggttgggggtgcagtggctgcggtttgtgtgctcaacaccggtctggtaggcaaggccgtcttgcttggagcagcgagaaggcaagcaaagaagtgatatgaggagcagccttccagccagacattcatcagattgtagctacgatcgtacaggcaaaaaaatgttgagaaaataggtggggttcaacagagataactgctgtttgaggcgtatgcaatgggtctatcggatctagtttcacagtatagtctattttatttagagataaaaatcgcttgtttaagaataagtaaagctctttatttaagaagaggtgtttgagaattaagacggaatgaccgttttcttcctcgccccctcaacctctcaaccttagcaactccaagagattagctacaaagactaaccaaatttactgatttagctactctctaaaatagattttagagaaaaaattaggccaatccaactctaaaatagattttagagaaaaaattaggctaatccaacagactcggtaaacctacagactgaatagagagtgaagcagtgaagcaggctatctaaaattagagagcgaagatggataaatagagagccactaaatttaaagagtcgtttatagagtctattggatacaattttctttataaaaccatataactagtctcttggagttcctcttgaccgctagctttacagctataatgtgtaattctagattgtgcacttatgcattatactntccccgtagtggataccaaaagggacaaaatgagtttgacactttaggcgtagtgtggcctatggttttttaagtatagccatgatagaatgtgccatttgaaaggagggctctatgtttgtctgttattgaaacttcgctaacttattagacaaacttttaaaagacttcgtagtgtaactctgccatacacattgaactaatttccgaagtcaatctcgaggggtttagggtttcaaactagccataaaagtttatatatacctaaaatggtaaaacatcaataaagtatgtttcactataaaccaattcatgaggaattttcaagcatttataataattaattggaaaaaacgtgtgatgaaaattgcttacaatattgcagggacaagttattagactttaggtctagtttagtggaaggagaattagagagatctatggaggggaattttctcgcaatttaaaattgaatagctagagaatttctcctcgatctccaatttccattccacaaatcagcccttagtgatgtgtttctgatagaaccccacgtcacatagggtcagaaaaagttcagggaatattgttactcagtggcccaacatattttgtctgatacgcatagagcacaaaaaagtttttttattgaaaagggagttctaggaaactctacacacagagtgaacaacagtaatggatagcataaagaaataaggccgttttggcctcatcatcttcgtttgtgcaatactgcaactgcaatgaagccactgctactcataagagctctgtcatcaccttgcatcgcaactggcagttttcaattgctgtaccggcgc

SEQ ID NO: 6520 - DNA, 2304 bp, Zea mays
ccctcgacgcattcgggccctcgagcccgcccggccccggctccccacatcttgtctgccacagttccacctctccatttcgccgaggaagaaaaaggaaaaaaacacagaaggggttggagagaaacggatcaggggcggaaggttccagccctagcacagcaatggcgggttggtgcgaggaggcggtggcgttgctgcagcgccccgcggcggcggagatggccgtcgacgtgctgctctgcgcggtgccgatctgggccgctgtcatgatcggcctcgtcgtcggctggtcctggcgcccgcgctggacggggctgctcttcctcggcctccgcacccgcctccgcatcatctggctgccgcccggcctcggggcccggcggctctggttcgcctgcactgcgctctccgcctgctccgtcgcgcccaggctcctctcctccgcattccgccgctgcagaggtaagcaacaggacaaggcctcccctgaggatactgctgctgtggctcgggacggcggaggttgcgccgatggcaggacaaattttgagggtgaacatgatactgtcactgagaaggacctagaacttctccttcaacttttagataataaggaaagcggggatacagcttggcagaatttgatggagcgtacaacctccaacatgacctacaaggcctggcggcgtgagcctgaggagggacctataatgtactgcagccgcactatttttgaggatgctacacctgaactggttagagatttcttctgggatggtgattttcgtctaaagtgggatcccatgcttgcatactccaaatctttggatgagttccctcagaatggagcaacaattgtccactggataaaaaagttcccattcttttgcagtgaccgtgaatacatctttggaggacgcatatgggaatctgggaagacttactattgtgttacaaagggtgttccatatccatcattgcccaagaaagaaaaaccaaggcgtgtggagttgtacttctcaagttggcgtattagagctgttcaatcgcctaaacatgtgggtcagcaatctgcgtgcgaagtaactttggttcactatgaggacatgggcataccaaaagatgtagccagggttgctgttcgccacggcatgtggggtgctgtgaagaaacttcagtctgggttcagagcgtaccagcaaatgagagacacagaaaataccctgtcacacagcgccattatggctcgaatgaccaccagggtatccatcacggcttcgaatggtggcttagaccatgacctctccatcgccgataaaatcagtggcgagaatgacagctcccatgcagttcagcatggttttgactggaagtgggtggtttttggtggtgcggtggctgcggtttgtgtgctcaacaccggactggtaggcaaggtcctgttgcttggagcagcgagacggcaggcaaagaagtgatgtgaggagcaaccttccagcctctgcagaaaggcattcgtcaggctgtagctacaaccgtacaggcaaaaagtattgaggaaataggtggggttcgacagatataattgcaatgtgtaattttggattgtgcacttgtgcagtagatgtagcatgcttgctaccataacagattccgctgtatcaggaatcgctggctaatactccgtatatctgaagatctaagaggtcactgcatgtttgcagctttctatgttcgatatacgtataacggcactgcatgttataagagaaatccattccctgacactgaacagccttttaacatttcggtctgaggctgtccgtaggtcctggtgccatgtcatatgaaacggtggcgacagaaggaaccgcccccgctatttttttgcgtaatgctaagtccctgctacgcaggtgacaaacatatttcacgtaaatcgatccatgaagaacttgcaagcatttataatatttcacaggaaaaaggcgcgtgatcaaaattgcttacattattgcagcgtgacgaatcatcagaaaatagtatttatgataaaaccccaggtcggatcagagaaagtttagggaatattcccactgatcagtggcccaaaacgtattgtcacccacgcaagcgacgcataagtcttttttagtattattgaaaagtgagttgtaggaaactctaaacagatatatagactgaacaaccataaaggatagcataaagaaataaggccctttaggcgtcatcgtcgtttgtgcaatgaagccactgcttctcatgagagcactgtcatca

SEQ ID NO: 6521 - DNA, 1804 bp, Zea mays
  misc_feature (1154)..(1154): n is a, c, g, or t
ctcgaggccggccggggacacgtgggcacaggcacgggccccctccaaaaaaaaccccctccccagctccgccccccctctctccatttcgcggaggaagaaaaaggggaccaaaaaaacggaaaaggggataggaggaacggatcagcggtggaagcttccagccctagcgcagcaatggcgggttggtgcgagcaggcggtggcgctgctacagcgccccgcggtggcggagatggccgtcgacgtgctgctctgcgcggtgccgatctgggccgccgtcatgatcggcctcgtcgtcggctggtcctggcgcccgcgctggacgggactgctcttcctcggcctccggagccgcctccgcatcctctgggtgccgccaggcctcggggcccggcggctctggttcgcctgcaccgcgctctccgcctgctccgtcgcgaccaagctcatctcctccgcattccgccgctgcagaggcaagcaccaggacagggcctcccccgacgatgatgccgctgcgaccagagacggcggatgtcgcgccgacggcagaacaaattttgagggtgagcatgatacagtcactgagaaggacctagaacatctcctgcaacttttagataataaggaaagcggggatacagcttggcagaatttgatggagcgtagaacctccaacatgacatacaatgcctggcggcgtgagcctgaggagggacctataatgtactgcagccgcactatttttgaggatgctactcctgaactggttagagatttcttctgggatggtgattttcgtctaaagtgggatcccatgcttgcatattgcaaatcttttggatgagttccctcagaatggagcaacaattgtccactggataaaaaagttcccgttcttttgcagtgaccgtgaatacatctttggaggacgcatatgggaatctgggaagacttactattgtgttactaagcctccgttccgcagggtgttccatatccatcattgcccaagaaagaaaaaccgaggcgtgtggagctgtacttctcaagttggcgtattagagctgttcaatcgcctaaacatgtgggtcagcaatctgcgtgtgaagtaactttggttcactatgaggacatgggtataccaaaagnatgtagcccgggttgctgttcgtcatggcatgtggggtgctgttaagaaacttcagtctggattcagagcataccagcaaatgagacacacagaaactaccctgtcacacagcgtcatcatggctcgaatgaccaccaagatatccatcacagcttcaaatggtcccctggaccatgacctctcggttgccgataaaatcagtgacgagaatgacagctccaatgcagttcagcatggttttgactggaagtggttggtggttggtggtgcagtggctgcggtttgtgtgctcaacaccggactggtaggcaaggccgtcttgcttggagcagcgagaaggcaagcaaagaagtgatatgaggagcagccttccagccagacattcatcagattgtagctgcgatcgtacaggcaaaaaaaatgttgagaaaataggtggggatcaacagagataactgctgttagaggcgtatgcaatgggtctatcggttctagtttcacagtatagtctattttatttagagataaaaatcgcttgtttaagaataagtaaagctctttatttaagatgaggtgtattaatcgaattgagaattaagacggaatggccgtcgttcctcgccccctcaaccttagccgctggctttac

SEQ ID NO: 6522 - DNA, 1352 bp, Zea mays
ggacaggtcgcctgggatgagccggacctgttacagaacgtgaagagggaagaagctgtgcgtcccactgtacccggagcttccgctggagggccagttcccggcgccgatgttccacggaagccccctcctcggccgtggcggcgccggtggcccgatgtgctacttccccgtcggctcccccgcggccggccggggagccaggcatgctcaattcggcatatccttatcagatctccacctgaacaagctgcagccgggcctgtcaccgcacgggctccaccgccagctcgaccacggcgtgcaggtgcaggtgcagcagccgaggatcgccgccgggctcatcgtcggcggccacccggcggcccgagacgacgtctcgtgtctgctcaccatcggcaccccaaagagcaagaagccaccgtcagacgtcaagaaggcgtccacggcggcggcaccgcagctgatgctcttcgggaaagcgatcctcaccgagcagcagatatcgctaggcggcggcaatgtcgtgccggcgctgctggcgaagaagagcccctccgacgacgacgacgacgtggccgagaggacggtgagcaactcggacgtgtcgagccctgggaggagcaaccaggacggcacgtccagtggcggaggcccggcggcgcgggcgtgctggcaggaggaggagtgcaacaacagggcggcaggttctgaggacgacctcctcgggcactgcaaggtgttcatgcagtcggaggacgtcgggcgcacgctggacctctccgccgtcgcgtcgtacgaggagctctaccagaggctcgccgacatgttcggcgtcgacaaggccgagctgaccagccacgtgttctaccgcgacgacgcttccggagcgctcaagcaccctggcgacgagcctttcagtgagttcaccaagaccgcccggaggctgaccatactgacggacgagagcagcgacagcttagcgaggtagagtccagtctcaaggagacggcggttcggcagtttcggttgggagtgggaggcgccccggaacgggagcgcgtgcgtgcgtctgatccaggaccaaagatttgtcggactagtagctctacagtagtggagtacgtacgtacaccttgatgctgctgcttctgctgtcagttcaagtggccataaccataatgcagctgcctttggtcacagtgactgatcggatgtgttgtgtacatcggaccgttgatttgcgaacgcgattactgaaagattattattatttttttgtatttttgatataaaaaaaaaaaaaaaattcttatcgatcccgtcgacccttcgaggggggggcccggtac

SEQ ID NO: 6523 - DNA, 2591 bp, Zea mays
ctgctcaccaccgggtggagcgccttcgtgaaccagaagaggctcgtcgcgggggactccatcgtgttcatgaggacggggaacggggacctctgcgtcggcatccggcgcgccaaaaagggcggcatcggaggagggccggagttcccgcaccaccagccgccagacggcggcgggtacgggtacgggtacgccggcttctccacgttcctgagaggagaagaggacgacgcggccgcgaggggcaaggtcagggtgctggtgcggccggaggaggtcgtcgaggccgccaacctcgcggcgagcgggcagccgttcgaggtggtctactacccgagggcgagcacgccggagttctgcgtcaaggcgggggcggtccgcgcggccatgcgcacccagtggtgcgccgggatgaggttcaagatggccttcgagacggaggactcgtccaggatcagctggttcatgggcactgtcgccgccgtgcaggtcgctgaccccatccgatggcccaattcaccctggaggcttcttcaggtagatgaaaccaacctccataactgtccgtccatgcgtactctcatctcaaggacggcatctcaaagctccttttttttttgtggccaggtcgcttgggatgaaccggacttgttacagaacgtgaagagagtgagcccatggctggtcgagcttgtctcaagcacgccggccatccaccacctcacgccgttctcgccgccaagcaggaagaagctgtgtatcccattgtacccggagggccaccagctcccggcgccgatgttccacggaagccctctggtgggccgtggtgttggcccgatgcgctacttcccggacggcggcactcctcctgcaggcatacagggagccaggcatgcgcaattcggcatatctttaccagatctccaccacctcaccaggctgcagtcgagtctatcgccgcacgcgcacgggcttcgccaccagctcgaccacggcgcgcggccgaggatcgccggcggcctcatcgtcggccacccggcagctcgggacgacatctcgtgcttgctcaccattggcaccgccccgcacaagaaaccatcagacgtcaagtcggccgcggcggcgccggcgccgcagctgatgctgtttgggaaaccgattctcaccgagcagcagatatctctaggcttccggccgctgccggcgccgaagaagagcccgtccggcgacgctgctgagactgagaggacggtgagcaacaactcggatgcctcgagcccagctgggactgcgagtgggagcacgccgtccatcagtggaggcgccccgtcgtcgtgccaggacaacaaggcggcggcgacggcgacggcgactgatgacgacgatctcctcgggcactgcaaggtgttcatgcagtcggaggacgtcgggcgcacgctcgacctctcggctgtcgcgtcgtacgaggagctctaccagaggctggccgacatgttcggcgtcgacagggccgagctgacgagccatgtcttctaccgcgacggcgcttctggagcgctcaagcacgccggcgacgagcctttcaggtccgtacggtggttttcgtcagtctgaagcggcgttcggttcctgtgtcgcttacttgctagtgttcctggccgtggtgctaagcattccaacctaactactagacacggttatcttcaagcatcaaactcatctaggtgttctttccttggaagcatccgatcctcatggtactttgacttggatcgcttcaagctaggactaggacatctccatgtggtttcctatcgtactgatgtacgattacttctgaatttgcagtgagttcaccaagaccgctcggaggctgaccatacaaacggacgcgaggtagaagaaggcggcagacaatgaagctctcgtcgcctgtacaaccggggggagctagcgagccgcggcggcgatctcgaaggacgatcgccacttgcagagtgctggtgcagactgcagagagggcggtgctgctgtcgtgtcggtcgtttcttatcagctcttttgttgcctgcaaaatgaatttaaagaatgtgctctgtcacgctgccacgtcagtcagtcagcacgcagtcgacaccgcccaccggtactgttccactgctatgtggccgtgttgcgtccatgccctgtcgttgttcctgttgccgggtataagtgtacattcgggccgcccggctcggcccggcccaagcctgaaaaggctcgtattatttgaatttcgggccggtccggtccgtttgaatttcgggccgtgccgggccggcccatgggcctagctctcggcccacggcccggcccgtaattgcttaaacgtgccaggctcatttcgggcggcccgaaattataaaagcccgaaattcacattacggcccgaaatttaattttagacccgaaattcagtttttggcccaaaattcacattagagccttaaattcaaaaaaataataaaacaaataaaagataagacaaataaatttgaacaaaatcaaacttagtatttgtattaaagttaccacaactatgcaag

SEQ ID NO: 6524 - DNA, 816 bp, Zea mays
gggtacctcgaggccggccgggccgggactcatcaataatgccccttcatccatccatttcatatccttagcttccattccatcatcatatcgcgcccatggatcatcgtcagccgccgccgccgccgaataagacggcggagcttgaccccgtgctgcactccatcggcttccagatcgaggaggtgtcgccgtcgcaggtcaccggccggctccccgtcacacccaggtgctgccaggtacgccgttccaggtgctccacggcggcgtgtcggcgctggtggcggagggcctggccagcatgggcgcgcacatggcgtcgggcttccgccgggttgccggcgtcagcctcaccatcaaccacttccgcagcgccaaggtgggagacgtcgtcctcgtccgcgccgccccgctccacgtcggccgttcgacgcaggtgtgggacgtgaagctatggaaggaggatcagcaggggaagaaggggagtcagatatccgagtcaagggtgacgctgctatgcaacctgcccgtgccggacatcctcaagcacgctggcgatgcactcaagaagtatgccgacgcccccgccgcccaaaaacccaccgccaccagcagattgtagatatatagttaagttattagtagagtgatatgcagagatttatttattttaatacataacgatatatacactcattactcatacatgtatatctagtatacaattgtacacctacatgaactattacttgtgtgttggtgtgctcttcaaaaaaaaaaaaaaaattcggctagcttaattagcttttgtattgt

SEQ ID NO: 6525 - DNA, 960 bp, Zea mays
cattgggtacctcgaggccggccgggaaagaattaagctgactagtgtctagtaacaaacggaagacgacaggtagtggtagtggactggtggttaattgcttctttgtttgcccactattatagcaggcacacagcccgcacgtcattaataggctacatacaatacgtcacccaacctctcgtcttctcccgcgcaataatataatccccttcatccatccattccatatccttagcttccattccatccatcatatcgcgcccatggatcatcgtcagccgccgccgaataagacggcggagcttgaccccgtgctgcactccatcggcttccagatcgaggaggtgtcgccgtcgcaggtcaccggccggctccccgtcacacccaggtgctgccagccgttccaggtgctccacggcggcgtgtcggcgctggtggcggagggcctggccagcatgggcgcgcacatggcgtcgggcttccgccgggttgccggcgtcagcctcaccatcaaccacttccgcagcgccaaggtgggagacgtcgtcctcgtccgcgccgccccgctccacgtcggccgttcgacgcaggtgtgggacgtgaagctatggaaggaggatcagcaggggaagaaggggagtcagatatccgagtcaagggtgacgctgctatgcaacctgcccgtgccggacatcctcaagcacgctggcgatgcactcaagaagtatgccgacgcccccgccgcccaaaaacccaccgccaccagcagattgtagatatatagttaagttattagtagagtgatatgcagagatttatttattttaatacataacgatataaacactcattactcatacatgtatatctagtatacaattgtacacctacatgaacaaaaaaaaaaaaaaaaaaaaaaaaatcaaaaaaaaaaaaaaaaaaaaaaaaaaaaaaaaa

SEQ ID NO: 6526 - DNA, 5240 bp, Zea mays
  misc_feature (724)..(724): n is a, c, g, or t
  misc_feature (4293)..(4293): n is a, c, g, or t
gacaaactttttaactagtcttttgtagatgttcttacattacatactaacttcatcattattccatcgcaattataaaacccaatttaataactcagaaaacacttcatctaaacgcaagggtaacggtaaacccacctgcgaggccgcgactgtgacacacggcgttaagtaaccgccacgtcagcagcaacgcactggcaaagtggcaatggttattgctaaccatcaacccaacccgtcactttcccttctgtctggctccgcatcccagtcccagacccggcaagcgccggccatcgccatttcggatccgggcccgctcagcgcgcgggttcccgaacccggccggccggccgcgctcctcgccaccgccgccgccggccatgaagcgcgcgcgcagctccgaggtattcatcggcgtaggccggctgcgcgcacgcaggggcctggcgccgcttctcgcagcggcggctttcgcctacctactgttcgtgtccgtcaagctcacttacctcggcagcgctgggcccgcgcctgccgtcggccgcctggccaccaccggcgcgggcgagccagctgcgcgcgcgcgctcgagcggcggcggggccgtgtccgggtacggccgcatcaccggcgagatcctccggcggcacgaacccttcgaggtgcggcggaagcggtgccggccagctgcggaacttcacggagctcgagcgcgtgngcggccgaagcgtgggcgctcggggccgccgcgtgggaggaggcctctgcgttcgacggcgacgtcgactacatcgcctcccgcgacgtcgccggggagggcacggccaagtgcccaggctcgctcgcgctcggcgccggggagaccacggcgttcctgccgtgcgggctggccgccgggtcggcagttaccgtggttgggacagcgcggacggcgcggccggagtacgtcgaggcgctggagcggagcggcacgggcaacgggacggtgctggtggcgcagttcgcggtggagctgcgcggcctgcgcgctaccgacggcgaggagccgcctaggatactgcacctcaacccgcgcctgcgcggcgactggagcagccgccccgtgctagagatgaacacctgcttccgaatgcagtggggcagggcacagcgctgcgacagtaccccttccggagacgatgacctgggtaagaggcgcgctccaacaatcttttgtttcgaaatttgaacaaaaatgcatgtagcaagcttattaattggacaatgcaagcttccttttcttgggaaacggtagaaaacacagtagtcactagtcagtatggagcattatgctctcatgacacatcccttgtgcagaacctgttaaattttcaccagtttagatatttgtatttgttcttgtgcatccagtattgtttgtggcggttggttgaagtataaggtattgggtggatgaacactgaggctaaaacaaaatggattgcctacaaaggtgctaaatctatatgcagagtggccatgcatcctaatttgttcatttttataagttgtattgtaatgtattgcttgcattgctgctcatgtctgttgctacagttatgatggcctcctttagacctttgtacttattcttgcagcttgttgaccttgcagtcgatggactaagaaaatgtgagaaatgggactggcaggacgtagttgaatcgaaagaaacaaagacaagctcatggttcaacagattcatcgggcgagcaaagaaaccagaaatgagatggccattcccattttcagaggggaagatgtttgttctcactatccaagctggagtcgaaggataccatatcaatgtgggaggccgccacgttgcctcatttcctcataggatggtaaatttcagttctattgccaaagaatatattccattgtagagatattttgaagccctggcagaagaaatcactgggctcttcttctcaattgccaatatttgcagggattcgccctcgaagacgcaacaggtttagccgtgacagggggcatagatgttcactctgtgtacgcaacagcgcttccaaaggcacatcctagcttttctctccagcaagtcttggaaatgtctgaaaggtggaaggctcgccctgtgccagacgaaccaatccatcttttcatcggcatcctctccgccacaaaccatttcgccgagcgcatggctattaggaaaacttggatgcagtttccggctatccaatcggggaatgcggttgctcggttctttgttgcgctggtacgttgagttcccatgatttcacaatggttcgatccatgactgtatcgttacgagtttgtggcgtgcttcactctgtagagccacagaaaggagataaatgcagcactgaagaaggaagcagagtattttggagacatagtcattctgccgttcatcgaccggtatgagctagtggttctgaaaacggttgcgatatgtcaatacggggttagtcattgcacattcgcgttaaatacttaaatgtctatttccaatgtattattggacaaatgctgactggtgggagagccatttgtttgtgtgtaggtgcacaatgtcactgcagattacatcatgaagtgcgacgatgacacctttgtgcggctggatatagtactgcaccaaatcagtacctacaacaaaacctcacctctgtatctgggcaacctgaatctcttgcacaggcctctaagaaggggcaaatgggccgtcacctacgaggtacctcagcgccccactgcaaccgccatagatttgcaacttcaacactcatatgtgatacgtttgcttacccaaagcgtgcctgcaggaatggccagaagcggtgtatcccccgtacgccaatggacctgggtacgttatctcggccggcattgcgagagacgtagcatcccggcatacaaaccactccctacgggtaaggctgctcgctcttctaaccgcggtgcatgcatccgtcgtttaccttctgccccaccgtcggcggaaagccaaccccccctctcctgatggccgcctcctgcgctgcttgcagctgttcaagatggaggacgtgagcatgggcatgtccctcgcggccgcccacgcctccgcccccgtgcagtatgtccacagctggaggttctgccagttcggctgcgtggacaactacttcacggcgcactaccagtcccccaggcagatgctgtgcctctgggagaagctgtcagcggggagagcgcactgctgtaactacagataacacgaggcccccagcccccaggggggaaatggtgacctagccgcctaggtgcatcaaggctcatgaccttcgttccattcgcctggcttcggtggttcggttccatacgaccatctgctcagatgactaatgccagaaaccatgatctcgacaccgcatgttctttggttcttagattgaaggtatacgggataagggtgttaccaactgctgcttcatcttcaattcttcactgaggtgaatgctggcatgaggatagaaggggagggggcgtgaattcacattggctgtttgtacaggccgccggcctatttgtagaactgcaaatccgtacccactggaacgggaaattgtctcccctgtgtggctgtgtatgcagatctgtgtgtactattcgtgcgaatcggtggtgtatgtgtatttgacatccaacaaagttaacttagacggcacggattccttgttggagtcggcgcacagcgcacagcggctggaccagtggaccggcgggacaaggaaacccgcgcggtatccggtggttttgccaagaccctcccccgtttacaagccagaaggcaagctataggcgaaacttcgggggtcgtcgagggttctcgaccctcccttcccctctctcgcccgctcgctccctcaccgccggcgttctcgccgccagctacggacggggcacactgcgcagggtcccagccccgcctctcacccgaacgtcttcgctcccctcaccgggtaggcgtcgcgctctactggcaccaccccggccctcgcgctctactggcaccggaccggcgcggggtggcgcggagacctgtcccggccaggagaccgttccgtgctataccggtgagttccccgagcttaccctggtgtcggtgcctcctcgctccagcggcagcgaggaattgaattgaaccctaatcttcgctcactcaggcgctgatccgcacctgcttcgtggcgctgctgcccgactagcgcgctncacctgcgtctggttcgattatagtcgtagtgtccagcgcggacgctcaatttagctgccttcggttcatcctggctggctgcacgggtgtaattatagaatcagtgccccgtctcaatccccttgtcctaactgcatcctggatgggtgtttcagcctttcagggggctgtttctggactgattgacttcatgtgctgcaactgagagcttgttgcaatgcttcctgcctgtcaccattggttacaatgctaggttctgctgataacagttacgattgctgtgtttagagtgttggtatcctgaataggccgcttgttgctgcctgaccagtgctctttatgtacacgcgttggcctggtatcctacttacatatattgtcagaagcatcttgtatggaattagtgcggtggcatgctggccagatctctctcgtgctctgttttgtcagttctagattttgtggtactctggtggttttacgcatgacaattggcatgcaattccatagtatttttctgaataagagagggaaaacctgttcattatttctgatggtgacaccatatgtggttatgcactgtctatagctgtttgcatggtcatgggatttaacatgtctgtgtggtatgtagatatgtggtagtgtatatcatgtttgttcattgcacaaccagttcactttacctttacaaatttgttgttacattctttcctaattggatttcaggtgaagatgctctttgcatagctcaagctccaaactgatggattctgatgacaagaagtttggaaatggtagggttcgggttaagactcacataaaagaattaaatgcaccacaggtccttaaattatttctccattctcatctaagcccatgaactctcaaattgatcatctggatccttcaacttttcaagcggttcattgcatgttcactctag

SEQ ID NO: 6527 - DNA, 2260 bp, Zea mays
  misc_feature (8)..(9): n is a, c, g, or t
  misc_feature (17)..(17): n is a, c, g, or t
  misc_feature (19)..(19): n is a, c, g, or t
tcgaggcnncggccggnanaaaaatacaaaaaaaaaacattggggacccccaggcccgccgggacggcgaaatcaccgctcgctacctagtactcgtcactcgtgtacacgtgtagcaagcacgaagcagcaaaggcgggatcggcagccatggcgatgatggacaagtggacaggcctgggctcggcgctggcaagcatgctcttcctctggtccatggtgcagaaccacctccccgccgccttcggctaccgcctcagcacctgggggaacaagctcgcctctctcttcagcccttacctggagatcaccatctccgagtacggcgccgagcgcttccgccgcagcgacttcttcctcgccgccgaggcctacctctccgacgcctgctcccgccgcgcgcgcaagctccgggccgacctcggcaaggacagcaagaacctccaggtctccgtcgacgacaacgacgaggtcaccgacgccttctccggggccaccatctggtggtacgcgtccaagcagctggccaggtcacaggtcatcagcttctacccgggcgaggacgagcgccgcttctaccgggtcgtcttccacaggcgccaccgcgacctcgtcgtcggcgagtacctgccccgcgtcctcgaggaaggccgcgccgtgaccgtccgcaaccgccagcgccgcctcttcaccaacaaccccagcggcagctggaactcctaccgcggcaagagcgtctggagccacgtccccttcgagcacccggccacgttcgacacgctcgccatggacccggacgacaaggaggacatcctcgacgagctccgcgcgttccgggacgctaaggcctactacaccaaggtcggcaagccgtggaagcgagggtacctgctctacgggccccccggcaccggcaagtccaccatgatcgccgccatggccaacttcctcgactacgacgtctacgacctcgagctcacggcggtcaagaacaacaccgagctgcggaagctcttcatcgagaccaccggcaagtccatcatcgtcatcgaggacatcgactgctccatcgacctcaccggcaagcgcaaggacgacaagaagcgggcgtcggccgaggcagacgacaagcccaaaaccccaacggatcccgacaaggacgagggaagcaaggtcacgctctcagggctgctcaacttcatcgacgggctgtggtcggcgtgcggcggcgagcgcatcatcatcttcacaaccaaccacaaggacaagctggacccggcgctgatccggcggggcaggatggacaggcacatcgagatgtcctactgccgcttccggaccttcaaggtgctcgccaagaactacctggatgtcgaggagccgcacgagctgttcggccagatagaaaagctgctcgaggagacggacatgtcgccggcagacgtggccgagaacctgatgcccatgtccaagaagaagaagcggagggacgccaacgcgtgtctggagagtcttgtggaggctctgaagcaggccaaggaggatgctgctgctgctgctgctgctaaggcactagctgacgctagggcggccaaggaggaagcggaggaggcgaaggagaaagaggccaaagagaaagacgaggcaacaaatagcaaaggagcagcagacccagcagggaaggacactaagatgagcaatggagatgttactgccaataaggaaggtgatgacgagtgacaagtatagaatggagacgagctcgcttgctagtgaagtaatggagaaacatggctataaataatgacagtggcctatgtaaaatagtgcagtctctagtgaagattacagtcacacgtcgtcatcttccatgttaaaaagataaaaagatagacttgatttggattagttaaaaatagaaagatgtaatgtaacaaccaaatcgagccttctttgcctttcaacttgtaaaccaaggcgacagtgaatgttgcctcatatatactagtaactgtcgcgcgcctttgagcacgctacatatatatatatatataaacacgtagatatgatgatgtgcttgcgcataatatgccgagattgcttaatacaataatcagtgggcttaaagcctgctgcattcagcgtgggtgggccaaaggcaaagaaggccttcttccttctgttccgttccgttctgttccgttccgttccaccaggtgaaggaactactgaacgttaggtgtgggccggaccgggccgg

SEQ ID NO: 6528 - DNA, 1900 bp, Zea mays
cattgggtccctcgaggccggccgggtaacagtacgtgctgtctagagtacaagtgagtagttaagcaagtgcctgtaaaccaagcttgcttgcgacttgcgagacaacacacaacacaacagccatggcagtggtagacaggtgggcgggcctgggttcggcgctcgcgagcttcctcttcctctggtccatggtgcagagacacgtgcccgtcaccatcagccaccgcgtcgccacctgggccaacaagctcgtctcctacttcaacccctacgtcgagatcaccatctccgagtacggcgccgagcgcttccgccgcagcgacttcttcctcgccgccgaggcctacctgtccgatgcctgcgcgccccgcgcccgcaagctcaaggccgagctcggcagggacagcagcaacctccaggtctccgtcggcgacaacgacgaggtcaccgacgccttccagggagccacggtctggtggtacgtcgtcaagaaggtgcccaggtccaacgtcatcagcttgtacgccaaccaagacgacccgcgcacctaccgggtcgtcttccacaggcgccaccgcgacctcgtcgtcggcaagtacctgccccacgtcctcaaggaaggacgcgccgtcaccgtccgcaaccgccagcgccgcctcttcaccaacaaccccagcggcggcggccgtgggaggggcgacgtctggagccacgtcccgttcgagcacccgtctacgttcgacacgctcgccatggatcccgacgacaaggaggctgtcgtcgacgacctggaggcgttccgggagggcaaggactactacaccaaggtcggcaaggcgtggaagcgagggtacctgctctatggtcccccgggcaccggcaagtccacatgatcgcggccatggctaacttgctcgactacgacgtctacgacctcgaactcacggcggtcaacaacaacaccgacctgcggaagctattcatcgagaccaccgggaaatccatcgtcgtcgtcgaggacatcgactgctccgtcgacctcaccggcaagcgcaaggacaagaaatccgaacgcgaggccgacgacaagcccaagctgccgatggagcctgacaaggacgaaggcagcaagattacgctttcagggatgctcaacttcatcgacggcctgtggtcggcatgcggcggcgagcgcatcatcatcttcaccaccaaccataaggacaagctggaaccggcgctgatacggcgaggcaggatggacaggcacatcgagatgtcctactgccgcttcccggccttcaaggtgctcgccaagaactacctggacgtcgaggagcacgagctattcgaccagatagggcagctgctcgaggagaccgacatgtcgccggcagatgtggcagagaacctgatgtccatgtccaagaagaagaagagggacgccaacgcgtgcttggagagtcttgcgaaggctctgaagcaggccaaggaggaggcggccaaggcgaaggtggaagcagaggcaaagaagaaggtagaggcggcggccgaggcagcaaagtccaaagaggaagacgaggcaaaggaaggcagcggataagacgaaggcgacaaaacttcagaatcgatgagcaacgtacgaacacacatcaaaagagatgacaaatgacaagtctaggctcgtgattctaataggagtcatcattaaaaaaaggcttaaattgtagaatcgttgaaattagggaacaatgtacactgtctctggaaatttgttgcaactcttccacttgcctatagattggtaatggatatataaatgtttattcacgagtcgtttgatctcttaattaattttagtttaaaataaatacaaatagagcatttgcgcccaaaa

SEQ ID NO: 6529 - DNA, 1931 bp, Zea mays
atccttgcgcacctcgaggccggccgggaccacccaccaacccaccatccccgatcgcccttggagatggagatggtcggcggcagcgccgacgccatccccggcctcttgtcatacggctgggccgggctctggtccacgctggcgagcctcctgttcctgtggtccatggtgcaggaccacctccctttccagctcgaggagcagctgtccgcactggcgcgccgcgccctcgccgccgtcaccccctacgtcaccatcaccatcgacgagcacgacgccgactccttcggccgcagcgaggcctacctcgccgcggaggcctacctgggcgccaccttcgccggccgcgccagcaggctccgcgccgagctcccgggcggcagcgaccgcgtcagcctcgccgtcgacgaccacgtcgaggtcaccgacgccttccgcggcgcccggatgcggtggcgcaagacgcggacgctccgccgcggcaacgtgatcgcctggaacccgcgtgaggaggagcgccgcgcctactgcctcaccttccaccgccgccaccgcgcgctcgtcgaggccgcctacctgccgcacgtcctcgccgagggccgcgccgccaccgtccggaaccgccagcgccgcctctacaccaacaacgccagcggggactggggcggcggcgacgacgggccccgcgcctggacgcacgtcaagctggagcacccgtccacgttcgccacgctcgccatggacccggacaggaagcgggaggtcgtcgacgacctcgacatgttccgcgacggcagggactactacgcgtccgtgggcaaggcgtggaagcgcggctacctgctgttcggcccgcccggcaccggcaagtccaccatgatcgccgccatggccaactacctgggctacgacatctacgacctggagctcacggcggtgaagagcaacactgagctcaggaagctcttcatcgagaccaagagcaagtccatcatcgtcatcgaggacatcgactgctccatcgacctcaccggcaagcgaaacccgcgcgtccgggacaagaacgatactaggaagaagaagaagaaggcgccgtgggaagaagaagacaaggacgaaggcagcaaggtgactctttcagggctcctcaacttcatcgacgggctgtggtcggcttgcggcggcgagcgcatcatcgtgttcaccaccaaccacaaggacaagctggacccggcgctgatccggcggggcaggatggacatgcacatcgagatgtcctactgctgcttccagggcttcaaggtgctcgccaagaactacctgggcgtgcaggagcatgacggcgagctgttcggcgacatccgtcggctgctggaggaggtggacatgactccggcggacgtggcagagaacttgatgcctaggtccaagaccaaggacgccgatgcctgtctccggaggctcgtcaaagcgctcgaggaggccaaggaggcggcgttgttggcggccaaagccaaacaactggacgggatcaaggacgatgagggaaccgacgatgaagacgacagcgatgacgatggcagcgttaccagcagaggtcacccctccgacggtgacgaaaagagtgccaaaaaagaggaaatgtaataaaaaagtttaaaacctataaaagcctgaaagctaggtgaggatacttgacttgagcattcctttccaaagctggtggtacctagaattacttttcttacttgtatgctaactatcttgtcgtttttctgttgtccctccctctgattctaaaaccaaaggggcaactgcgtcattaaaacaatgcaggcgggcatgcatccgtccaatcagaccaggttccgtggtctgcactgaattaaaggggcaactgcaaaactgccatcgttttcaggctttgc

SEQ ID NO: 6530 - DNA, 2129 bp, Zea mays
cattgggtacctcgaggccggccggggacacccatactgcgctcaccgagacaccgacccgcgatcccgacggcagctcccctccccctctccaggtctccactgtacgtctgaactgcatatcgcgcacgccgctccggtgctctgcaaccggctccaccccgcgctgctactcctcatcggcgccggcgcgtgcctgctcgggtacggcaccgcgtggctcctcgtctccggcgtcgcgcccgcgctgccttactggctgatttggtttgcgttatgtcttgctacaaatggtggtgcatggttggcgactgccgttctagtgaccaacatgaggaacttcccgctcagcagaggtgccgttgctggcattctgaaagggtactcgggtttatgggcccctcgtggcccgccgggatacaccggagtgctccgtgattcacccatcaacctcttgctctctctcgctctgggaattcctgccgtgtgcctcctgggaatgtactttgttcagccctgtgaaccctctctggtggagacgaacgcagagcaagtccattttatgtttgcacaagtggcaagcgttcttcttggggtttatctggttggggctacaatattggatcacgtcgtggctgtcaatgacattatgaactattctctgcttgtcgttatggttcttctcattttcgctcccctggcaataccattgaagatgacgctattcccgaagaaaaaaaccccatcggattcacactctccaacagttgataatgatcacacacagccgcttttgccttcttcctccgaatcaaacctcggtaatcttgaagaagatgattccacagacatcgatgtcctcttagcagagggtgaaggggccataaagccgaagagaagaagaccaagaaggggagaggatttcaggtttcgcgaagcgatactgaaggccgatttctggcttctctttgccatctgctggccggccaggggatctggaatcaccgttcttaataatctggcacagataggaatcgccgcaggtgctgtcgacacaaccatctcactctctgtcttcagtttctgcaacttctttggacggctgggaggtggtgctgtttccgagtatcttgtcaggtcaaggacactcccacgaagcgtcctggtcatatgcacccaggtagtgatgataatcacgtacctgctcttcgcgttgggccggctcgccacgctctacgtctccgtcgccttactcggcttatgctacggggtcctgctctccgtggtgatctcgacctcgtcggagctcttcgggctgaagcacttcggaaagatatacaacttcatcacgctggcgaacccggtcggcgcgtacctgttcaacaccctcgcggggtacgtctacgacctcgaggtggagaggcagcacgccgccgcggcggcggcagggtcggacgtcgtcgcgtgccacggccctagctgcttcaggctcacgttctgcgtcctcgccggcgcggcctgcctgggcacgctgctgagcacggtcctcaccgtgagggtccggcccgtgtaccagatgctctacgcaggggggtccttcagccagcccaggaactctgcgcattgaccggcggtgatacaaagccttgttgttttctgctgctagaataaaaatccggtatggcctctctgaatagcttcgttaatggcctgctgtagttcatgagcatgcacgctagtcttgtgctctgtggctgtattttttgggtccttcttggcctaataggaggagggagcgatggcctcgtgcagcagcagatgcttgctcccggtttagccgccgacgccgaggcccgagttttagggggtgtataattgaaatccctacttattatgtagaacaatgttgcttgtatacgacacgggtttaccggacattttggcagatcgcatatggtaccggagaccaatttgcattttttttctcgtaaaaaaaaaaagcaaggggacatggatgtatattcacttgcagttaaagctgaaacaacattgtctgttgatcacccaccagaaggggatgaccaaaagaatgataacttctaactcacagaatcaaccaaggcgttttt

SEQ ID NO: 6531 - DNA, 1954 bp, Zea mays
cggccgggccgggaagtcgcgtgaccacttccttatcgtctcctcctttcctcccctcaactccaatcgaatcgctcgaaccattcccaggtttgtgcgtcgatctaggcttgcgcgaggatccaattgcatcccgctcccctttgagcttgtgatcttcggagccggagttcttcgcgagcctcccccaacccccacccccaccccccgatttcttttggtttatttgtgcgagttttctcaagagcagaaaaggctgtttgcaattccggtgcactcaggcctcaagatccaactctgaggcctttcccgcgctatccgcgtcgatctacgcaagaggatgggcaacgcgggtagcaacggtggaggcgctgccgctggtcaccgccgtcggagctccagccacggccaccaccaccaggcgccgccgcctcaccagccgcaggagactgcggccaaccgctacgtgttcgcggccgccacgccgtacccgccccagtaccctaaccccaacccgccgcagtactacccgcagtacgggaactactacccaccaccaccaccatccgtgccggtgccccttccggcgccgtacgaccaccaccacaggccacccaccgccgcccccggcgagttcccgcccccgcccctcacccacccccaccactaccctggctgggctgggcggtatccctcctacggacaacatctgcctatgcccacgccctacgttgagcaccagaaggccgtcactatccgcaacgacgtcaaccttaagaaggagacgcttaggatcgagcctgatgaagagtgccctggccacttcctcgttgccttcacctttgacgccacggtcgctggcagcatgactgtttacttgtttgcaaaggaagagctcaactgcaatctaacagcagtgaaagaagacctaatgaagcccgttactgttagcttcaaagagggtcttggtcaaaaattcaggcaaccttcaggaacaggaattgacttttcagtgtttgaagaatcagatttattaaagcagggggacatggatgtatatccacttgcagttaaagctgaaacagcattgcctgttgatcagccaccagaaggggatgaccaaaagatgaaaactcctaactcacagatcacccaagccgtgtttgaaaagaaagaaaatggggattatcatgtaagagttgtttgccagatcctttgggtcaatggaactaggtatgaactgcaagaaatatatggcatagggaactccgtggaaggtgatgctgatgcaaatgatccagggaaagaatgtgttatttgcctctcagaaccaagggatactactgtcctcccatgtaggcatatgtgcatgtgcagtgagtgcgccaaggtcctgaggtaccaaaccactcggtgccccatctgcaggcagcctgttgagcgtctcctcgagatcaaagtgaacaacaaatctgaagatcagcaacagatgccccaatcgccaccgctcccagcactggatccgcagcaggaagaggtgtagccatgatcaaagtcagttctgaaacattatatggctctcgtttgcggaccttcaggccttccctaaaggtttgttctctcatttgagcaatggggaatgtaactggtactttacctttacgtatgtaaggttctggcatggctttgccgacctctgctgtatctgcctatctggaggtgggagaccaagatgccaagaagagtgtgtaccatatatacaccatgcatgcgtgtgccatggctaccttaagaagcgtagcgaggaggattcatcattcctggttgacttcctccaggaaaaccaggtgaagagaaggttgtctcataaatttgtacaaaaaatgactatttccagggaaaccaggccttctctgttatgccataaaaaaaaaaaaaaaagcggccctctgcc

SEQ ID NO: 6532 - DNA, 4300 bp, Zea mays
  misc_feature (20)..(20): n is a, c, g, or t
  misc_feature (587)..(587): n is a, c, g, or t
taccctcgggctttccgggnaacccactttccccgcaccttttcccaccgccagtcctccacccacgcgtccgcgcgcacacggaccccaacccaaaccggcaaaccccagctccacgttcgcgctctactcgcacgcgctcaaggtcgccctcggcgccgaccagagccgcctggcgctgctcggggtcgcctgcgacgtcggcgagaacctcggcctgctcccgggggtgctctgcaaccggctccaccccgcgctgctactcctcatcggcgccggcgcgtgccttctcgggtacggcaccgcgtggctcctcgtctccggcgtcgcgcccgcgctgccttactggctgatttggtttgcgttatgtcttgctacaaatggtggtgcatggttggcgactgccgttctagtgaccaacatgaggaacttcccgctcagcagaggtgccgttgctggcattctgaaagggtactcgggtttaagtgttgctgtttacactgaaatatacaccggagtgctccgtgattcacccatcaaccttttgctctctctcgctctgggaattcctgccgtgtgcctcctgngaatgtactttgttcagccctgtgaaccctctctggtggagacgaacgcagagcaagtccattttatgtttgcgcaagtggcaagcgttcttcttggggtttatctggttggggctacaatattggatcacgtcgtggctctcatgacattatgaactattctctgcttgtcatcatggttcttctcatttttgctcccctggcaataccattgaagatgacgttattcctgaagaaaaaaagtcgatcagattcacactccccaacaactgataatggtcacacagaaccacttttgccttcttcctccgaatcaaaccttggtaatcttgaagatgataccacagacatcgatattctcttagctgagggtgaaggggctataaagccaaagagaagaagaccaagaaggggagaagatttccggtttcgtgaagcaatactgaacgccgatttctggcttctctttgcaatatgctttgttgggtttggatctggaatcactgttcttaataatctagcacaaataggaattgctgcaggtgctgtcgacacaaccatctcactctctgtcttcagtttctgcaatttctttggccggctgggaggtggtgttgtttctgagtatcttgtcaggtacagtatatattatatttactcatttatttaatctatgaaataaccgtttccatatgatgggccattcttggctttaatggctctgccagttttacattgtttttggcctagtgggcactgagtactgagagagatctggtagcgaaccaatatgtctttatagctcctaactgactaaatttatgaaccatgttaacaccctccgcggaccctgagaaagccgccctgcagtctcaagttctgagtttctctcttgtcagtcaatggcttgggtaaaaattgtgaacagagaatatgaaagcctgacaaactagcaatgagtccattttctgaagataaacagcaaggaaaattctgaatcccatgtgtagaaacatgtaggaaacacctttcttgtttatgagtgataggcaaaattttggtcattgcatcctagggttaacttacagtcttcttttgcaggtcaaggacactcccacgaagtgttctgatcatagggacccaagcggtgatgataattacttacctgctctttgcattgggccggctcgccacactttacgtctctgtcgccttactcgggatatgttttggtatctcgctctccgtgataatctcaacctcctcagagctcttcggactaaagcactttggaaagatattcaacttcatcgcattggcgaatccggtaggcgcgttcctgtttaacaccctcgcgggatatgtctacgatctcgaggtggaaaagcagcacgccacagcatcagggtcggacgttgcatgtcatggccctaattgcttcagactaacattctttgtcctctccggcgtggcatgcttgggcacactgctgagcacggttctcacggtgagggtccggccagtgtatcagatgctctatgcaggcgggtccttcagccagcccaggaaccctgcacattgacccatggcgataaagctgttttctgcatctattctcttacaataaatccagtatgacgtcggtctgaatagcctcacaaatggtttattgtaattcatgagcacgcaccttattttgtgtgctctgtgttgtaatttttggtctaatatgaggagagagcgacggtctcgtgctgctacttgtaccagatgctcgtgatgttgctccaggttaaccagctgatgcccgagttttaggggcgtataactgaaatatcaacttatgtaaaacaatggtgcttgtacacgacacatgtttatcggacaatttggcagattccgtggtatattgagaagaatgtgcttctttttttttcccccctaaaacgtgaaagaaactgcgtctcaggtcttgatcatgtcgtcttaaaatttggtttactcatggcctagaactagggcagtggtcggcaggttaacaggtcaggtcctcttcaaggccagtgcagcattgaaattttttaatcatgcagtggttgagatctgaccagggttggccagctaaactttgctgaagccgacagatctacatccagacgccgtgaccccacagttttgaatcgttgagtgaagcggcgactgtcagttcagatctggatacctcggctcgtaatggacacggccctctatctattccatccctttgtcagggatctacactaacgacagacgcgcccttaaaatatttcacagcaggaacgaaaatgtcgcaggtattttttttatcatcacgaacctggatcggctcccagctcaaaatttcagagaatgacacatgggcattatttttcacactcatttacacggttgcaaattgcaattacagtaacaggcagcaggtagagaggtaggtagctagtgagtactgaccactccactggcaatcgggcacgttgtcttcgctcgctgtacgcaccggccggcaggtcacaggtgcagtgcagggcgcatttggcacgcgagcgcgcgcgtctcggctagttgggcttgagatcctggaacatggactcccaccgcatctcctcgccgtcgccgctgtgcttcacaaccacctcctcctcgtcgcttacttccccatcctcgtattcgtcgcagctgcagacgtccgtgctctcgaggcaggcggctatggacccagcgggcgcgggcagcgtcttgaccgccgcgccgtcgcccctccacttatcggcgcagctgttggtgagcacgacgggcttgctgatgcgcgtcaacatcggcagcgctcgcggcttcccgccacggatcgccacgggcgacgcgatcttgctccagctgtgcgcgaccctcccgccacggtgccgcagcagaggcaggcgcggcgtggcgaggacggccgccgccgccctggcccggtcccggtcccggtcctggccgcgtgacaccgaggcgcggaggcggccgagcgccgagcttgcggaccggtgcacggccgcggcgagcagcctggtggcacgccacggcaggacggtgatggcggcggccctgccgtgggaggacgtctccttccttgcgagcttgaggatctcgaggcggtgcttggcgacggcaacgcccatgctgaggaggaagtcgtggtccaggtggcgcacgtctgtggcgccgagctcgttgcgcgcgaagagcagcgcgtactcgaacgccacgtccgggtgcagccccgccctgcagagccacgcgtaccagtccattcgctcgtccgcctcgtcggagcgtgcgcggcgagcggcgacgacggcggcggcagtaagtgaggctgccctcggtgtggttagccgtgtctcgtgctcccgtggcgctggacgtgcgggcgcgcgcgtgctctggtgtgtagcggcactggccgtggccgatgggcgggtagcgtcacgtgaacccgattataaaaaacgggcgagagaggggcggtggcgtctgttggctggatggtggtggtcgtgccactggtgctggtgcgccgtgcacggatcggtgggccgcccacccacatacggagtaacagtgctgtttcatgcgcaaacgatttgtccagagaaacggtcgttattcttgttcctcaactttcaggttctgca

SEQ ID NO: 6533 - DNA, 2105 bp, Zea mays
cactcctaagggcgattgggatcctcgaggcacgagaccattacctacaacatcctaaacgaaaaaaatacagggggaaaagcaagacgcgtgagcacttccttatcgtctcttcctttcaccccctcgaccccgatcgaatcgctcgaacaattccctgtgcatcgatcgatctaggcttgcgcgaggatccaattccatccggctctcctttgagctcgtgatcctcggagttggaggagttcttcgcgagtctctttttgccccgatttctttttggcttatttgtgcgagctttctcaggagcagaagggaagaggcagtttgcaattccgatgcacccaggcctcaagattcaactctgaggccttatccgaggcatccgcatcgatctccgcaagaggatgggtaacgtgggaagcaacggtggaggcgccgccactggtcaccgccgtcggagctccggccacggccatcaccagcaggcgccgccgcctccccagccgcaggagactgcgcccaaccgctacgtgttcgcggccgccacgccgtacccgccccagtaccctaaccccaatccgccgcagtactacccgcagtacgggaactactacccgccgccaccatcatccgtgccggtgccccttccggcgccgtacgaccaccaccacaggccacccaccgccgcccctggcgagttcccgcccccaccccccgtccacccccacaactaccccggctgggccgggcggtatccctcctacggaccgcatctgtctatgccgacgccctacgttgagcaccagaaggccgtcactatccgcaacgacatcaaccttaagaaggagacgcttcggatcgagcctgatgaagaatgccctggccgcttcctcgtcgccttcacctttgacgccacggtcgctggcagcatgactgtttacttctttgcaaaggaagagctcaactgcaatctaacaacagtgaaagaagacctaattaagcccattactgttagcttcaaagagggtcttggtcaaaaattcaggcaaccttcaggaacaggaattgacttttcagtgtttgaagaatcagatttattaaagcagggggacatggatgtatatccacttgcagttaaagctgaaacaacattgtctgttgatcacccaccagaaggggatgaccaaaagatgataactcctaactcacagatcacccaggccgtgtttgaaaagaaagaaaatggggattatcaagtaagagttgtttgccagatcctctgggtcaatggaactaggtatgaactgcaagaaatatatggcatagggaactccatggaaggtgatgctgatgcaaatgatccagggaaagaatgtgttatttgcctctcagaaccaagggatactactgtcctgccatgtaggcatatgtgcatgtgcagtgagtgcgccaaggtcctgaggtaccaaaccactcggtgccccatctgcaggcagcctgtggagcgtctcctggagatcaaagtgaacaacaaatctgaagatcagcagcagacgccccaatcgccaccgcgcccagacctggctccgcagcaggaaggggtgtagccgtgatcaaagtcagttctgaggtattatatggctcgaatttgcggaccttcctgaaggtttgttctctcatttgagcaacgggggatgcaactggtacttttacctttagcatatgtaagcttctggcatcgcatggctttgccgacctctgctgtatctgcctatctggaggtcggagagcaggatgtcaaggagagtgtgtatcatatatacatcatgcatgcgtgtgccatggctaccttaagaagcgtatcgaggaggattcctgatgcctggttgacttcctccagggaaaaaggggaagagaactagagaagaggtggtctcttaaatctgtacaaaaatgactatttcaccttgattccataccttctctgttatggcctgaaaaggtcgatgagtattttacttggagttataaaacaatcagtgcataggtcgcctctcggccaattatttattccccccaaaaaaaaaagcggacgctgggtcgac

SEQ ID NO: 6534 - DNA, 3818 bp, Zea mays
  misc_feature (3366)..(3366): n is a, c, g, or t
gtcgaaccacgctgacgacgtcccctgccgccgcccaactgagcggtacaagtacaccgtacaccaatccattcgatctctgggtctaataccttggaacaagcaaaggggccagacccctaaggcgccagtgctccactccatcaagcaatgcacggcgtcaatggaagacttcgccggccaggacgtttgcgtcgttctcggcattggggacaacatcaagggcctcttggccacgctgtcgcgcatcgacgccatcatctcctatgattcatcccctcgctcaacttgcatcctatcattccctatcccgtgccgagtccctgattcacggttgttgtgtggtagtcggtaacgctgaatatggacctgggcgacatcaagtgcgaggtgttctgcaaccaggtgctccgcacgctggagaacttcttggccctctgcgctagcggctactacgtcgacactgtgttccaccgcaacatcaagggcttcatggtataaggcggtgaccccatcggctccggcaatgcagggcgctccatctgggcaccaagttcgccgacgagttcagggagtctctcaaggttggttggttgcttggttcctttttagattgcttgtttgcttgctttgtgtgtcgtttgatatttatcctctgataagaacacgaacgaaccctcgcttgctgattactgctgaattattactagaattggttggtaggtagcacactatgcaggggccaacagcggacccaacgccaacggcagccggttcttcatcacctacgccaagcagccgttctgaaaaaataaattgaacagggtcacccaaaaaatgtgcatgtctggaacgacagcttcagattaacgacaaccatgattttccaattgtgtggttttgatggagtcatgtatgggtaaccaggaggccatctaaataaatctgtatgcacttcaatcatgtgctaatattgattgtgcagtacatacatattaatatagtgatccatgatgtctcaacatttttagatggtaaaatcggtgcctgtaagtgtgagagtaaacttagcttataatactattactgtcgtactacggtatcatgatttatggttattctgtctagaatatctgacatagatataagttttttctctaaaaacgtaggagaacattatattaagaattaagaagatatgaaaaaaggcatgagaactacacctcatgattcatcacattttcctcggtcgttgttgcttacttgcttcaaggataacaggtatatttactgcaattactcagcatgttaggtaatatcgattttttaagttgttgcatcatcatatctcattttaagttgttgtctcatcacatgtactactttataacatgattactaagttgagtgcataattattttgtgaccactaaaaccaatattttgtacgttcagtacatgtatatatatccatttagcaatctaatagctagactgctcatgagtctagtatttgtacaccgaactgttccacttcaaacgattttttgtttacgtaattctgttatttctatgtgtatgtgtatgtatctatatatactcttttaacaccataaacacaacgatcaaattaacactcgcgggaggcgcgagtaagttactagtctccaattagttctgataatgagtcgaaatataccctaaaccatcgcaaaagagtcatttccctcaacctagcccaataattaaactaaataatctaccctaacccgctccatagctagtgggttaaacccatagctagtggattcgttagcgtgttcagattaaaatatttcactagagagcagcggagctgatttgtgatgagctcagcatgataatctgccaaattttatagatatctaaagttagatccacatgggcccatctcaaaagtcagaccctaaaattagtctcacatacacaccttaatttttttcacgatattaattgaattttgttgaaaacagttaagaataatactatgctagcttatcaactgtttctctattaaagactatgctttgcatgatctcttgagcggttgagtccgatgatcaaagaatcactcatacgtcaattccaccggtgtcacttttcaccgctctagtgagacaagcacaagcctctcacaatcaccaccatgacctctcacaatcataccttcaaaagtaacaagtcgatgacgattgcttgatgaactttctagtgcctcaagaatcaacaatgtgatgcaatgcactagagctctctccaactcactagaatgcaatctctagcaatgtgtgtgagtgggatagattggaaggcttgaatgtgctcaatacatggttcaaatagccaagagggatgttcaacacacacacaccaactatttatagcacatctccaaccaactagtcgttatgggccacatgtcccttttctgcccatacatataactactttttatttagaaacttgtcaaagttgttagataaagtgacgcgcggacggtccaccaaccacgaccttgaggcacatagaaacctagaaccctggctttgcatactcatgaacagtccggcacctaggcacggacgatccatcacctaggaaagtggattgactttgacctaggcacgagctgtcatcaaaccaccacccaaaagtcacatagtccctacgcaaatccatcaaaggtattgcagaccgtctgcgtcccccggccggacggtccacaataggcatataaaacctaccagggacatagccaaactcggaggctcctttgacctctactgtagatggtccgcccgaaatcacgaacgatctgtactacaaagactacgcaccacacaaaaactcaacatttttgcacacatctccgttagccccgcagatggtccgaccacctggaacggacgatccacaatacccaatttagctcccttttcagaatccgcttttgaataggtttttctttcacaattgaaagcaccgtcggcccttatgcaaatgcataaactatatgagcttatgaggcacttaagaacctgtcaagaaaacatcattgacccctcttgatagtatgactatttagcctactaacttggtcaataagcttctttaatcccatcttgatcggcaaagcgaaaaatctatcgtttacctttgcattgagttatccaacggtttccatcaaagtccttcaagactttatgttgctcacatgtgcatggatcaacttgcattcttattttctctaagaaatagttagtccacacataattgtcattaattaccaaaacactacttagaggcctagatactcacaacaacccnacgtggctggcccttgctattgaggacgtcaccagttcatgaccttgttgtccccatagccacaatgtgatgcttgatctacaccttagggagacttggttggtcgtcaatgctcgctctgtgatggtcgccagatatccgtgctacactagagtcgggcccaagatcctgactatcctattcctatgcgactgagaccacacaaaggacagaggagtacgtggttggagaaggaagaccgttggagaaaaaggaaaggaaaaatattaatatctaataagagggttctatatatcgaggatgtttttggagtattgttgtaacatctttcccaatatttaggcggtcttcagcagcttgctcatcttacattccatcacatatcctattccaaacttaattatgtgaacaatatattctacaatgcaaaccgatgttttacacgacaaagg

SEQ ID NO: 6535 - DNA, 1786 bp, Zea mays
cgcacatcgtatcatggctataggttctgtggccgcggctggtggccaacaagctcttccggaagacctcgggcagccacgctttcgtcgccgacttcccggccgccgatgacgatgacgatatcgtctttggaacggaggccgacggcggcggcgggtgcagccccgacgcggacgccagccgctgcgtgaagcgggcgcggccccacgagcgcaacaagatcctaaagtacaggctgttcgcgagcacgtggaacgtgggcggcgtggcgccaccggacgggctggacctgtcggactggctggacggcggcgacgacgggccctacgacatgtacgtgctggggttccaggaggtggtgccgctgcgcgcgcgcaacgtgctgggcgccgacaagaagcgggtagggatgcggtgggtcgagctcatccgcgccgcgctgaaccggtcgcattcgcagcgcagcaggggcggcggctcaggcgacggcggcggcggcggcaagcagaaggtgcacccggtgcgggacggctgtggcggcgagctgggcagggagtaccggtgcgtggtgagcaagcagatggtgggcatcctgctcacggtgtgggtgcgctccgacctccgccgcttcgtccgccgccccagcgtctcctgcgtcggatgcggcgtcatgggctgcctcggcaacaaggtgagtatatatagtcctgtacttggttactcccgaatatggtggccgccccggcatctagctaagctaagctaagcaaacgatcgagaaacgaatggcagggtggcgtgtccgtccggttctggctgcacgacacgagcttctgcttcgtctgctgccacctcgcgtcgggcgggcgcgagggcgacgaggcgcaccgcaacgccgacgccatggagatcctttcccggacgacattcccgcgggggcacgcgctcaacttgccgttgccgcagaatattctagaccacgaccgggtgatcctgctcggggacctcaactacaggatctccctgccggaggccaagacgaggctgctggtggagcgccaggactggaagacgctgctggagaacgaccagctgcgcgccgaggtgtgccgcggcggcgcgttccagggctggagcgaggggcccatcggcttctccccgacgtacaagtaccaccccaactccgacgcctactacggctgcgccaccgccgcccgcggccggaacaagcggcgcgcgccggcgtggtgcgaccgcgtcctgtggcgcggcgcgggcctcgcgcagacccgctacgaccgctgcgagtcccggctgtcggaccaccgccccgtccgcgccgtcttcgcggtggaggtggatgcgcccggggacctcaactcgctcaggagcttcttcatgtccgagaggttcgacagggaccagatgctgctccgcaaggatgacgtcaacagcgccagattcggcgacactctttgagacacgcgtgttgagagggtgaagttgtcagtccagttctccgactgcaattgtactacgcaggcaaaagtgtgatgcagagcagagtacatatatggatgtttttcatttctgagtcagtcagtgttcatacggtcgtatctactgcaggcagctaggaaggatacagagatggggttttatttgtctgtctgtttccaccctgttccctacgttctgtaactacgtgtgtactcttcttgatccagttagggcttgttcggttagctctcaatccatatggattgagtgagattgggtgggttt

SEQ ID NO: 6536 - DNA, 7201 bp, Zea mays
cttttctcaacacagattctgcattgtcctaatatggcgcccgtaagggcgcttcgagttctagtacatttataataggtaccattcgaattgagataactttttcgcgatttttttttaaaaaaatccatgggtttcagatgtaaatgtaccggacgtacacattagcacttgcgaattgtgattgcaggcgctgacttggagtggagctgtcgccgaccggctgctggtggaagaggcaaagattcccattccaacaatctctctctatcgtgccctccagacaggtcactccacgctttatttgaccatctatatatggcgtccaaaagccgacgtcatccccctttcctccactttcactgccatccatccttcgtagtagctagtactccctttttcccccttggccaggcaccatgcagcgcacgcgcccgaccgacctctagtgactagtcctacccaagttaacatccggcggttagctctggctgtgagctgtgcctgtgagagtgcgtgaacatgggcgggcgggcgcgagctgctccatagatttttgtctccgcgcggcgcgcgccttgtcatgtagcccccgcggcgcctatttaagccgctgttctcttccctttccgtcctctaggcggcctctcagtttcatctcgtcttcgtcctccggcgttcttctgctcttctccgcagtcgtcgtcacgtcatcgccctatagctagcttagctagacgaccgctcgcgagggcatacgcgaggctacgactccatcgtgctggtggtgctacaagctcatcatcagttcatcatgctagagaaccaaaagcaagcggaggtaggccagcccggccgagcgcactcatcatcacgctctgttgccgccttcttgtagatctatctcctctccacttgatgtccgatcccgctactcgctcatcttccgagctagccccagctccgacacggccggcgccctctgcgacatggttttgtgtgtattgtaatatactaacgctagctgtgtgcgcacatggggctaggttctctggccgcggctggtggccaacaagctcttccggaagacctcgggcagccacgccttcgtcgccgatttcccggccaccgatggcgacggcgatgtcgtctttggtggaacggagttcgacggcggcgggtgcagccccgaccccgacgacgcggacgccagccgctgcgtgaagcgggcgcggccgcagccgcagccgcaggagcgcaacaagaagaccctcaagtacaagtacgtgcttctcctattggccatgtgcactcgagcagtagccaaccatgtattcctcagggagaggagagagccgtgagtgactactggctgctgcctgctgctgctgtggaagaaagtcaaaatcgccgctaagtaagctaaactggcgtctcgctatcgtctgctggcatatggcatatcaggctgttcgcgagcacgtggaacgtcggcggcgtggcgccaccggacgagctggacctgtcggactggctggacggcggcggcggcgacgacgacgacgggccctacgacatgtacgtgctggggttccaggaggtggtgccgctgcgcgcgcgcaacgtgctgggtgccgacaagaagcgcgtcgggatgcggtggatcgagctcacccgcgccgcgctcaaccggtcgtcgtcatcgcacgcgcagcgcgggggagggagcggcggcggatcaggctcaggcgacggcggcggcggcggcaggcagaaggtgcacccggtgcgggacggcggcggccccggcgggccggcctgcagggactaccggtgcgtggtgagcaagcagatggtgggcgtcctgctcacggtgtgggtgcgctccgacctccgccgcttcgtccgccgcgccagcgtctcctgcgtcggctgcggcgtcatgggctgccttggcaacaaggtgaggagtaataatacttggtcctccgaaatggtggtggccgccgccggctgcgcaggcaaaaagcaactgacgaagcgatggaataatggcagggtgccgtgtccgtccggttctggctgcatgaaacgagcttctgcttcgtgtgctgtcacctcgcgtcgggcgggcgcgacggcgacgaggcgcaccgcaacgccgacgccacggagatcctctcccggacggccttcccgcggggccaagcgctcaacttgcccttgccgcacaagattctagaccacgagtaagccacacgctactgctactacctgctccgatccatcgatctatccacttccactaccacttcatcccatgccagccaggaacagaaaacagatgcacagggaaaacgaaaaaaaataataataaagaaagcgagatgctgacgcggagacgcaccgcatgcatacgtatgtacatgcatgaacgcaacaacaagtacacggcctctcatttttattttactccatcgacgaatcgtattattgaataatccggtagctgaaccgtccacggtaccggtaaatcaagggcaggtgtagatatttccgtcacgatatataaatatactaccaatactttcacacacaaaaaaggaccacttaaacatatcatttgaacgtgtcatatgttgatttccatacggcatatccatagaataaaaggaaaccgcagctagagaaggcaaattcaaaagtatttaggcggcgatcgtggcaggtcgtgtaccgacgctggtgctgtacatatacgaggtataaaatacttacataacatcagcttaattaattgttactattgtaacaatgcgatcggttgcatgcacgcacgtagtcaaaacaaatacacgtacacacccaggccccagtcccaccgccccagcgaagacggaccagcgttgaggcaaaggcaaggctttggctttgacgaccatttttttttttttaaaactgcaataaaaacatattaaaattataaaactaattacaaaaaaactataatatcaaatatatatcctatcaaaacataattactgaaaaatagtgctatttatttaataccataaatgttattgttttatcatataaactccgttaaagttaaaactatttaagtccttaatctgatgacgagctccgttttttttgtgtgtgtgtgcagccgggtgatccttctcggggacctcaactacaggatctcgctgccggaggccaagacgaggctgctggtggagcggcaggactggaagacgctgctggagaacgaccagctgcgcgccgaggtgcgccgcggcggcgcgttccagggctggagcgaggggcccatcgccttctccccgacctacaagtactgccccaactccgacgcctactacggctgcgccaccgccagcgccaccgccgacgcccgccggcacaagcggcgcgcgccggcgtggtgcgaccgcatcctgtggcgcggcgaggggatccggcaggcccggtacggccgctgcgagtcccggctgtcggaccaccgccccgtgcgcgccgtcttcacggtggaggtgggcgcgcccgcgcccgggagtaacctcaactcgctcaggagcttcttcatgtccgagaggttcgacggggctggcagcaggagccccgccgccgaccagctactccgcagggacgacgacgtcaacagcgccagattcagcgacgcgctttgagacacgcatgggatgggagggtggagatggaattgtcactccacttctccggttgcggattgtacttgcgcacagacagaagatcgtatctacaacatgctgctaagatacagagatggtttttttctttttttttaaaaaaaaatccaccctgttcccaacgttctgtaactactatacatttgtactcttgttgatccagtgagtatgattgggcctcaagtcaagtttgttgccatgggcaaccatgaatgacaacagaaatcacagagaaaactatatatattcagagacagcagaattcatttagtcgttagctgccggttaactgagctgtgttcagacttcagaaatcagaaccatatatatatagccgattttgcgtacgtcagcagtgcccattcacacagaaaactattgtgggaactgtgtagaggtgttatccaacaaaacaatttgttacagaaaacaaatcgtggtgtcgtcatgagccacatagcagtcgggcagttaatacgaaggctgccagtggtttcgagctctcaatctcaatccatccccctagattcaagggctctgtttttttttttagataaatgattcaagggctatgatgtgaacgttaagattgcctccttgtttcctgcagaacaaatgtcttgatccaagacaagggttgctgccttgctcttgcatcgcatgtgatgcgagacaggcgttttgtctctagtctctgctcatcatttaaacacgctactgatgtaattgcagatgtatacgaatggctggttcaaatcatccttgaaaaaaaaatttggtagtatcgattcatttcactctccttaaaacagagctcaaaatccatcctaggtctattcagaagaaggttttatgcacgttaatcatgtgagtcctgaatctgtactaggatcggaggcacatacattgcgtgaaaccctgaaccatatcaggagtcccgttccatacgtttcacagtctgaaattaacgtacgaagctggtcctaaacaagtgatccctgaagattccctccagtgcccagagtaatttctatattatgaaagcagaacgaaaacggcgtcggctaggccatccacgtcgtctgaaattcaggtggccgtcggatttttcgtggacgctccctagcggctcggtgtctccatgtgccgtgaaggttcgagaaccatcgtatgttcacgaatcgatttcctgtcacacacaggctctctacgatacgggaagtcgggaaccttccggatggactccttcctcagccatcgtagcttgcctcgcggcactggcggcggctccgcccggccagcacaaccgcagtcccagtcttctagacgaagcgaacgtgcgacgggaaaaacacggcccccgttggtcgaatccacgccggcgacgtcccctgccaccgcccaactgagtggtacaggtacaccgtacaccaatccatccgatctttgggcctaataccttggaacaagcaaaggggtcggacccctaaggcggcagtgctccactccatcaagcgatgcacgacgtcaatggaagactccgccggccagggaggtctgcgccgttcttggcattggggacaacatcaagggcctcttggccacgctgtcgcgcgttgacaccatcatctcctatgattcgtcccctcgctcaacctgcatcctatcataccctatcccgtgccaagtccctgattcacggtggctgtgtggtagtcggtaacgctgcatatgaacctgggcgacatcaagtgcgaggtgttctgcaaccaggtgccccgcacggcagagaacttcttggccctctacgctagcggctactacgacagcactgtgttccaccgcaacatcaaggcttcatggtataaggcggcgaccccatcggttccggcaatgcagggcctccatctgggcaccaagttcgccgacgagttcagggagtcccaaggttggttgcttgcttagttcctttctagattgcttgcttgctttgtctgttgtttgatatttatcctctgataagagcacgaacgaaccctcgcttgctgattactgctgatttattactggaattggttggtaggtagcacactatgcagtgcagggcctaacagcggacccaacgtcaacggcagccggttcttcatcacctacgccaagcagccgttctgaaaaaaaaattgaacagagtcacccaagaatgtgcatgtctggaatgacagcttcagattaacgacaaccacaattttccaattgtgtggttttgatggagtcatgtatgggtaaccaggagaccatctgaataaatccgtatgcacttcaatcatgtgctaatgttgattgtacaatacatacatattaatatagtgattcatgatgtctcaacatttttagatggtaatcggtgcctgcaagtgtgagaataaacttagcttataatactattactatcgtactatggtatcatgatttatgtttattctgtctagaatatctgacatagatataagttttttctctcgaaaacgcaggagaactacgactcattatattaagaagataggaaaaaaaggcttgagaattacgcctcatgattcatcgcatttttcttgatcgttgttgcttcaaggataacaggtatatttactgcaactactcagcatgttaggtaatatcaattttttaagttgttgcatcatcatatctcattttaagttgttgtctcaccacatgtactactttataacatgaatactaagttgagtgcataattattttgtgaccactaaaaccaatattttgtatgttcagtacatgtatatatatatccatttaggaatctaatagctagactgctcatgagtctgcatttgtacaccgaactgttccacttcaaacgattttctatttaggtaattctgttatttctatgtgtatgtatctatatatattattgttactataagtttaaagcaatactcttattttaacaccataaacacaacgattaaattaacactcgcgcgaggcgcgagtaagttactagttatatatatacgccaagggatttgtttaagctgcagctaactcatttgtgttgcactgttacgccctttccacttgataactccatgactgtcttagcgagcgggcaaaaagaaatgaatttgatcaatcatattgaatcatggaatggatcacctaacacctgctgcaccatgttcgcatgggtccagtcatactcgagagaaatggtgaaatgaaatcattggacggctaagaacagcgcgccgatcggtggtgtgtatacatgagaacaagataaggtttccaaattacgttcgtcaatgataataacaagttgaagttctttcagtgcaagaaaggctttctcaatgatgaaaactgcgtctgtaaacccctctatcaatcgcatcagcgcaccagctcac

SEQ ID NO: 6537 - DNA, 1763 bp, Zea mays
aaaagacaaggcctgatgttcggccgccagagaccactgtaccagagccgctcaccgtaggttgcccatgcatagacaactcaccatccatggtgcataagatcccttctgccatcaccagctcttcgtgcatgcacccaccacttgctctgcccatcacagtaccatgtgccatggcaatgactccggcacattaggcagataagcaacagctgtgcctgtgcccgcgttgaggcgacaagtcaagaggtgtgacaaactattccaaattgccgaagcaaagttggcaatttcaacagtttcacactgagtgtttataattaatgtgcattcacatagcttattatccatctcctaatctttacaagttgcagacagcataatgggcacttgagcagctgccaccctacaacatgaaacatctcacccatctaatgggatgatacaaacaaaaaacagatccgtacccctgaactgactactatggtaaacttcgctatggaagtaaggagaaaaacctagtcaccaaaattcatgaatggtgaagctctgattcttgaccaactatcgaggtgaagctctaaccctcgaccatcttacagtgcccaagtcatctgcaagcaagaaaagaaccatacacatacacatacacaatgtagtttacaactgatgcagatgtcgaatgatgcagcgatcagcatgccatacccctaatcgatctcaatcaccactttcttgttcttgctgccttcaggcagtcagggcatcctcgcttctttgccccaactttcacatgtgtcattccatagccctaatttatctcaaccacagcttttttgttcttgctgcctttgggccgccctcgcttctttgccccaaccttcacatgtaagaactccactggtgttgccgctgttggcgctggcgatgatgctggtgctggtgctgccactgttgggatgacaggaatgccagtgccagcatcaactgccttattgccttccccttccacaatgccacttaggctcggtaatggcaagtatggccccattggataaaatcctagagcagcaggtgcctgctgctgcggggaattgagtggttcagcgaatgcaggaccaccagggaaacccattgggaagaacccccaggagcagtaatacatgtctgtgcctggcacgatgggcggctgcgtggacattgcagtggcaacaaacggccggcggcagctagggcaaagcagcgtttgcgactcgtaggagtggtcgtactggtgtaaatggcagcaggagggacaagctgtccagaagactggcgcctgttgagcttccccctcctggttccgttcaacctcaggcgattgtttggcagcccgcggcggccggccgcgcggtgctggcgacgtgcccgaaacggtctgcggagcaggcggcgtcgccggcgttttggcagcccgcggcggccgcccgcgctttggtggcggcgtgcctgacacagtctgcattggctgcggagcaagtggcggcggcggaggaggctgtgactgcagctcgacaaagaggatcctgcttctctggatggggatcgatgggtacacgagcggcggcggcggcggcggcggctgccgctgcgttagttgcagcggcggcggcgtcgaggtcggagtcgagggaggctttgcggaggggatctgacaggaaggcccaagcgtcggcgacgaggcgggcggcttcggcgaaggcgagggagcagggacggtcggg

SEQ ID NO: 6538 - DNA, 1096 bp, Zea mays
cattgggacctcgagccggccaaagcacgaggcaaatatcttcgcagtggtgacacccccatcccggggcacgaaaccctaactgaacccatggcgctctccgccgctcgccggctctccaccaccgcgtcctcctcctccgtcgccgaagcgccgccaaagctctcttcgctgttccagaacccgaagcctcgaccgctgcctgtccgcggcgtcgaggagccgcggcggggggccaggcccaggccgaggcagccctgggaggaggaggcgggggcgctgctgctgcggctccacaaggggaggtacctcccgggccccgacctctcgtcggcgccgcacgctgtctcacccgacgccgtcaagaccgccgccgagtggttcgggcatgaccaccagcccgtcgccaaatggctgtcagggagtgatttgaagaagcttgccttgtttgggtgtcccactgttgagcgaagaacggtttttgcatcaaaaagattaagagccttcttcaacatccaggaagacaaaatatgcggttcctgtaaactgagaagttcgtgcaagtttgtgaaccaggaagtggccaggcataatagagtgattctatcagatacgatgagaattatctccttgtttgtactggacgcttgcccacaagagctcgagattaccgctgagttaaaagccagtgtctgcaagctgctaaaggacgccataaatctcagcagttaactgctgagcattacggagcagaagtttgctagttttcttgtccttgtagttctaatagcgtgctgtcagcatttatctggacttatggaggaaattgccgaggcccatgtttgacgttgcgctcgcaatcgctccctgtgaaggttggagtggtgaaccccagcgacttccttctgatccgtgttttcttttgtgcaactaatatgaagatgaagtacagagtatgtaaaaacttaagatgcatatcgctctgtagctccttttcaactaatatgaagatgaagtacagagtatgtaaaaacttaagatgcatatcgctctgtagctccttttctttttgacgtaaaaaaaaaaaaaaaaaaaa

SEQ ID NO: 6539 - DNA, 4143 bp, Zea mays
  misc_feature (3455)..(3455): n is a, c, g, or t
gtgaaaaaaaaattcaaaaattttgaaaattggcaaactctgtaaacttaaaagtgaaaaggaaattgaagaagtgaaattaaatctagttcatcgcaacgaaggctcgttagcttgtcgtgctagtccatctcaccgcactagccgccgctgtccgccagtgtacagtggacagggggtgatgactggatgcgggcgacgcgataaacatgcacgtcgactgctcggctgcattttccacaccgcgaaaggagcccatcactcggaaaccgtaagccgtgcaaacaacaggcgacgcaccggcgccgcgcgcgcacgcctatttctagctcgatcgtgtcctctcgccgctccggagtcctcaatccacacgcttgggcgagcaagccttgttccggaagcgcgcggacgacatgctgatgctgcacccgaggttggtgtcgtcgagcgccgtggacgacgaggaccactgcgagagctgcgcctgctactgcgccatggtgtcctgcgtctcgctgctgctcttcatcgtgctggctgccgcggtcagcatcccgagggcctgcgccatcgccggcgtcatgctgctcctgctggggctcgtcggctggctcgtgcccacggggaatggagccggtccggcggcgcagcagcagcagcagcagggccaggctgctgccgatcctggggcgcggcggctggtggtgcaccaccggtgcgcgtgcgggctaacggacgccgctatcgccgcgctgccggcggcgttcacgtactacgaggcgcccgcggtgaagaatggagtggggagcgaggacgacaagcagccgcgcggcagctccttgctgtgcgcggtttgcctggacgacgtgcggggcggcgagatggtgcggcagctgccggcgtgccgccacctgtttcacgtcgactgcgtcgacgcctggttgcgcgctcaccggacgtgcccgctctgccgctgccagctctccccgaggaacgacgtcagcacaaagcgggccgccgcggtcgtcggggagtcatccatcgacgcgttgccgccggtgtgagtgttactcactcatcaatcctccgaagctggccggcgcattggtaaactgtattggaccagattcttcatttcttaacaccacataataaagaaaacttcggcccaatttcgagggcgcgcagcagacgtgtgtctctactctctagtctctaggcatgagcatgagcctcaacatcgatcgagtggttccaaccacatcgccagacccgacgcttccagcagtcgcgaaagaagtagcatctcgccgatggggacgggtaccagaccgtacggaccagggagtctacaacttgacacgcttcagttctgccgctaccagacaggcaatcgagtctatcatgtcagtgccagcttttgtactgtatgctccgttgcaccacgagggtctgatgaatgttgctgccagttacattttcgtgagttgtaaaaccagaacaaatacccgtgtttcttaggaaactgtagcttttgggctcttggatctatttggatggaattctaaaacccgcactcgtctagataaaaataagctgacgatgtttgtgggttagaataattatctagaatgaatcctaaggcacctcagaataaaaatctcataatcctagattctcacccaaacgagctagattgttggcattattctttttatccgggttctttcttgaaatcccctggcacatttggatggaatcctcggattctaaagtttctttctgtatctgaactattgaaattcctatggatgcaaacgatccatacgtttagctgagctgaaacgacatccgttgatggcaatctgtgctgctgttgatctgttggactacctgaccagatgagtggactagcttggtgagaattggaccggttattttacttgcttttgtgtggtagaggaggatggcaaacctagattgaaaacgatgacatgtgaaaaatccaaacatttggggtttgtcgctttccccctaaaacgcttggagtgagttgttcgagttgttgcaattttggtggtggtcgattgagttggctgagttgactcagtccgtcgtgagtgcttcggttgttggtctgcacgccgtagttgcagtgatgtgcagcacatcaccctaattttgtgggttctatgttcagattcagctcaaaagaccgggttgcattttttttttgtttttttgtcccaataataaaatttacggcaaatattttgtggctatttcaaaaagaactctgaatatgctcattctgttggttcggtttgattattttaatctcaagagacggcaacataaaagagcgagaaataaaaaggctgcttggctctagctgcaacaactagccaatccaacaacatttactgcatgactatagaaaatcagtactctctggagtagagctgtaggcctttgggttttgaaggttagtttggaaactcaaattccctttgggattgaaggtaatgagagagaaaattagtttattttcaccttaatcccctctaatctcgaaggggatttgagattcccaaattagcccttaggatgtgacctttcagccgagtgatatccagtccgataaaccagcagaagcgacagggccaaagtagagtgaaaacataaaacaaatagcaagcggaattgcttaaaactcgaacacacaatacacaatgcttaccgtagagagaacaaggccacaactagaagtacagcactggaaaaaaaaacaagacaagacaacaacgagccaacgatatagacccgtcctgcaaacagcactgattctcaatttatccaaaaaatacaatttaatcaaattcattttggattgaaaatatatttgtgattgatggccttcatgccgttgatatatatatatatatatatatgtgtgtgggtgcgcgcgcatgtcaattatcgtgtgtaatacccaaaagttggagaaatacaataatccttgagaccaagtgtctaagtgagttttgtttattttctttagcatctcaacaatatacaagggtttgatgtaaaagaaattatcaaataaaaataactaaaacaactatgcactcatgctgatatgctttgatttctgcacttaatttagtgatcagacttcattggaatttaaaataaaaagggaaaagaaataataaaggaagaatagaaaacaaaaaaggggaaagcttccctcgatcgcatgggccgaattccccagcccacaggagcatcccgcacgcggctcaggtggctcacacgggatcattgtgccgatagggaggcacatcctgtcagtcgttatccctccgcacggaccagccttctatgctttcttttaccttccaccgacgggtgggccctttggcttagcccctcacgcaccttgctagcantcgtgtgtcacgacgctctctgccacgtgggccccagagttcaggcgtcgtgctttcccccctctgtgcgcatagcgggcatggccgttacaaacactgtgccccctcctgcttatccctcatgcaagggctgggtggcagtcccctcgacctgggagataagacccagggcacctacgcccctccttcttatccttcgtgcaagactcatcgaaaccgccacaagagagagagtcgggagagctgtcgccgccgcatagcccgtgcggcttgagagagaggcgtcgtgctgggcgaaccgccactgttaggctcgaccaattgggtcagtgggattcggcaacgctcgagaagaccggttgtcgcatcgacggacgaagtggtgatcggagcgcgtgacgatttcacgccggagtcggagctccatcgtcgattccattgcgtcctgcgagcgggctacttcacagctatcactggtgagaaaaccctttcaagttgtttgtcgcgtcttcctctacgtgtagctcgttcatatcgggattggagcttcgggaaagtatcggggaacttcggtcgtcctcctctaggtttggaagggcggcgccgctgagtcttgtggtcgggtggggaagagggtccccaaccattgatcaggtgacagtcgacttagattagatgaagggaagcg

SEQ ID NO: 6540 - DNA, 810 bp, Zea mays
gggtacctcgaggccggccgggacctcggagcccaggatttctaatctaatctaatccaaaacccttccggtctttgctgcggctgcccgaagccctgctccatttgcagctagcttagctttggtttcctctgcttctcattctcccgtgcacttccagttcctgcccagcttgcagggctgctccaatggccaccttgtccgccatctctgccaacgtcggctactgcaaggcaccaaccctgagctggaagggaagcggagtaccaggccggattgtggtctccatgtccaccacccgaagaggcctcgtctccctaagacgacgatcccctcggtttcgcgtctacgcggcgaaggcggagacggtgagcaaggtgatggacatcgtgaagcagcagctggcgctggcggcggacgtggggctgacggcggagaccaagttcacggacctcggcgccgactcgctggacacggtggagatcgtcatgacgctggaggaggagttcaagatcaccgtcgaggaggacaatgcccagagcatcgccaccatccaggacgccgccgacctcatcgacaagctcgtcgaccagaagccacgagacagcgactgattgtcgacgcgacgacacccaaatccaatccatcgatcaccgctcgtacgtgcatgtgaatgctccgttattgtactgtaattgagttttttttatctctagctagagatatttatgaacacagatggaagagaagagttgatgatacctaccatcgtcataaaaaaaaaaaaaaaagaggcccctcccctgtttc

SEQ ID NO: 6541 - DNA, 828 bp, Zea mays
tcggtgagcaaagtgatggacatcgtctccgccttcgccgcgtagacgcgaaaccgagacggtgagcaaagtgatggacatcgtgaagcagcagctggcgctggcggcggacgtggggctgacggcggagaccaagttcacggacctcggcgccgactcgctggacacggtggagatcgtcatgacgctggaggaggagttcaagatcaccgtcgaggaggacaatgcccagagcatcgccaccatccaggacgccgccgacctcatcgacaagctcgtcgaccagaagccacgagacagcgactgattgtcgacgcgacgacacccaaatcctatccatcgatcgccgctcgtgcatgtgaatgctccgttattgtactgtaattgagtattttttttttttatctctagctagagatatttatggacacagatggaagagaagagttgatgatacctaccatcgtcatcgatcgttgccaagggtttccatctgttctgttttcatctttcccagccgagctagctagcgtcgtcgtcgtcgttcgacgacagagtgacggacatcggcttagctctccttttaatttccctcgagtttttagctgtgtctgatgggcctggttgtgtcgtttcaaggctttgttttttgttaggagaagatggttggtgaacatgtttttgcttccagcttttgtgcccagagagctacgacattgtttgaatatttatgtacctatctatattggagtgagttagtctagagtttagttcagattctatattatccactccaacactttggattaagatagtagtgattttaag

SEQ ID NO: 6542 - DNA, 1962 bp, Zea mays
ggtaccctcccgccccggccgggggccggcggaacagaggagaggagaggagagactagacccgctagctgaggccgggcggcgcgctggacacgaacatgatggggagaaaggcgctcggctgtgctcctcttctcctcctcttggccgccgccgtcgctccggccgagctcagcgtcggggcggcggctgcctcgggcgcggtcacccgggccgacttccccgcggggttcgtcttcggcgtcggctcctccgcgtaccaggtcgaaggtgcagttgcagaggacggaaggaagcctagcatctgggacacattcacacatgaaggctattcccttgacaacgccacaggcgatgtaactgcggatcagtatcataagtacaaggacgacgtaaagcttctgcatgagatgggtgtcgatgcctaccggatgtcgattgcctggcctcgacttatcccagatggtcggggagccgtgaatccgaaggggctggagtactacaacaatctcatagatgagctccttagctacggaatacagcctcacgtgacgatataccatttcgatttcccacaggctcttcaggacgagtacagcgggctgatcagtcccagattcatagaggacttcacggcgtacgcagacgtgtgcttcagcaacttcggcgacagggtcaagtactggagcaccgtcaacgagcccaacgtcgagacgatcggcgggtacgaccagggaatcctgccgccgcggcggtgctccttccccttcggcttcggctgcgaggaaggcaactccaccacggagccatacgtagcggcgcaccacctcctgcttgcgcacgcgtctgcggtgtccctgtacagagacaggtaccaggctgcgcaaggaggacggatcggactcaccttgcttggttggtggtacgagcctgggacgcagactcccgacgatgtcgcggcagccgcacggatgaacgacttccacatcggatggttcatgcatcctatggtgttcggggactaccctccggtgatgaggaggaacgtcgggtccaggctgccgaccttcacggacgaggaggcggcgcgagtgagggggtctttcgacttcgtcggattcaaccactacatcgtcgtctacgtcaaggctgaccttggccgcctagacgaccaagtgcgagactacatgggcgatgcagccgtgaagtatgacatgccgtttctcaagtcacgcaaccagttcccgttcggcgccttgacgagcgacttcatgacgtccaccccctgggctctcaagaaaatgctgaggcatctccgggtgacatacaagaaccctgcagtcatgatccatgaaaacggagctgccggacagcctgatccatccggcgtgaacagctacgacgacgagttcaggtcacagttcctgcaggactacatcgaggccacgcttcagtccatcaggaacggatcgaacgtgcaaggctacttcgtgtggtcgttcctggacgtgttcgagtacctgttcggctaccgcctccggttcggcgtctacggcgtcgagttcaactcgacggcaaggacaaggtaccagaggcactcggccaagtggtacgccagcttcctccggggcggcgagctgaggccagtcgctctgcctgacggagcatattcacagtgaccagttacacgtgtacgctccggctccaggggaatatctggcgatcagcgctctcggtgaggtggagagaaaatagagagtttgtaagcaaggatagtcggggtggtatatatagcagtgcttagatacggttttcttgggtaaatgtggtacgagttgaataagttgtggcatgtttggttagaggttagaggattggctctacccgaaaccagctgattcagatggtcgtttctatatatttggttagggggatggagtggatccattttttgtttaaaaa

SEQ ID NO: 6543 - DNA, 1598 bp, Zea mays
  misc_feature (1386)..(1386): n is a, c, g, or t
cacaacatgtatttacgaaaatgcggttcagaaagtgggggggcctgtcgtttctttcgcgcgtgcgtcgtgccctcttatttctgacttgtctgcatatataacctcaatataagatggtcggggagccgtgaatccgaaggggctggagtactacaacaatctcatagatgagctccttagctacggaatacagcctcacgtgacgatataccatttcgatttcccacaggctcttcaggacgagtacagcgggctgatcagtcccagattcatagaggacttcacggcgtacgcagacgtgtgcttcagcaacttcggcgacagggtcaagtactggagcaccgtcaacgagcccaacgtcgagacgatcggcgggtacgaccagggaatcctgccgccgcggcggtgctccttccccttcggcttcggctgcgaggaaggcaactccaccacggagccatacgtagcggcgcaccacctcctgcttgcgcacgcgtctgcggtgtccctgtacagagacaggtaccaggctgcgcaaggaggacggatcggactcaccttgcttggttggtggtacgagcctgggacgcagactcccgacgatgtcgcggcagccgcacggatgaacgacttccacatcggatggttcatgcatcctatggtgttcggggactaccctccggtgatgaggaggaacgtcgggtccaggctgccgaccttcacggacgaggaggcggcgcgagtgagggggtctttcgacttcgtcggattcaaccactacatcgtcgtctacgtcaaggctgatcttggccgcctagacgaccaagtgcgagactacatgggcgatgcagccgtgaagtatgacatgccgtttctcaagtcacgcaaccagttcccgttcggcgccttgacgagcgacttcatgacgtccaccccctgggctctcaagaaaatgctcaggcatctccgggtgacatacaagaaccctgcagtgatgatccatgaaaacggagctgccggacagcctgatccatccggcgtgaacagctacgacgacgagttcaggtcacagttcctgcaggactacatcgaagccacgcttcagtccatcaggaacggatcgaacgtgcaaggctacttcgtgtggtcgttcctggacgtgttcgagtacctgttcggctaccgcctccggttcggcgtctacggcgtcgagttcaactcgacggcacggacaaggtaccagaggcactcggccaagtggtacgccagcttcctccggggcggcgagctgaggccagtcgctctgcctgacggagcatattcgcagtgagcagttacactgtacgctccggctccaggggagggggatatctggcgatcagncgctcttgacgaggtggagagaaaatagagagtttgtaagcgcggatagtcgggtggtatatagcagtgcttagatacggttttcttgggtcaatcaggtccgagttcaataagctgcggcgtgttggttacaggataggctcgtattcccaaccaggctgatttagggcttgttcgggtattcccaatacatatcgactggatgggattgg

SEQ ID NO: 6544 - DNA, 1140 bp, Zea mays
actctgcggctgtgcctccggccggcgactttttagtctccgttccctcccgcggggccggccgggatactcctacaatcgctcctccatccagtcccgcatcgggacctgcacgcgcacgagcacacgacggcggacggtcgcacctcctccgctcggccgctccacagcttggcgctccggcgggcgctggcacctccggctacgtcctgctgcctgcgcgcggtagccacctgttgtacccgtgctggcctgctctctctgacctgatactctgactctgcaatcggcttgctctctccaggctttctggaatcacatttcttgagaactatctgttggagagctaaactaggctcttgttcatattatggatcagcaagctaagattgatgctgattttcttgaaccaactgtactcttagatgagacacattaccaggaggggtacagaaatggctataatgatggtttggcatctggaaaggaagaggggaggcaggttggtttaaagatgggtttccaggtcggtgaagaactgggtttctttcagggctgtctggatgtgtggacgtctgcaattctcattgatcagaatgccttcacagctcgggtcaggaagaatatcgagcaactggctgcactggtgggcagttatccgctgtccgatccggagaatgaacaaattcaagacgtgatggagaagataaggctgaaattcagggtcatcactgcaagcttaggggtgaagttagagtatgaagggcaccccaaatcatctaaacaggatgctgaggatctgtagcggtgattgaaattacattttagtttctccgcccttgctgtttaaagctcttcaactcattggcatcatgaggaactgcagtgagacatcaatggtcagagtccgaccataaccacatatatagttttaacaatgtctcaagttttgtgttattacctgctgtctgctgtctgccatatgtaatagtttcctttcaaaaggcaaatgcacttccttcccattttctttgaagtacttgtatcaaacactctgcgatgagaatcctgaatttcgttcttttctgaagaatatatgtactcctttctcataagaaaaaaaaaaaaaaaaaagcggcc

SEQ ID NO: 6545 - DNA, 1117 bp, Zea mays
acaccatctctaggccgcgtctcgccgcctcgcgtcgtccgatcattatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccaccgcttctatatcgccacctctctcgttgtagaagaagacactgaggatctggctttctggaatcacatttcttgagaactatctgttggagaactaaactaggctcttgttcatattatggatcagcaagctaagattgatgctgattttcttgaaccaactgtactcttagatgagacacattaccaggaggggtacaaaaatggctataatgatggtttggcatctggaaaggaagaggggaggcaggttggtttaaagatgggtttccaggtcggtgaagaactgggtttctttcagggctgtctggatgtgtggacgtctgcaattctcattgatcagaatgccttcacagctcgggtcaggaagaatatcgagcaactggctgcactggtgggcagctatccgctgtctgatccggagaatgaacaaattcaagacgtgatggagaagataaggctgaaatttagggtcatcactgcaagcttaggggtgaagttagagtatgaagggcaccccaaatcatctaaacaggatgctgaggatctatgagcagtgattgaaattacattttagtttctccgcccttgctgtttaaagctcttcaactcattggcatcacgaggaactgccgtgagacatcaatggccagagtccgaccaaaaccacatatatagttttaacaatggtctcagttttgtgttattacctgctatctgccatatgtaatagtttcctttcagaagcaaaagcacttccttcccattttctg

SEQ ID NO: 6546 - DNA, 1582 bp, Zea mays
gccggccggggagaggggtgcccgcgaggccgcgagggagagagtgagaccggccgagagagggagagaacctctctgcaggtgcagccatggcgaagcccgtctccatccaggtgtggaaccccagcggcaagtaccgcgtggtgagcaccaagtccatgccgggcacacgatggatccgcctgctcaccgacaacgactgccgccttgagatatgcaccgagcacaagaccatcctctccgtggacgacatcctggcgctcatcggcgatcgctgcgacggcgtcattggacagctcaccgaggactggggggacgtgctcttctctgcgctcaagcgcgccggaggcacggtcttcagcaacatggccgtcggctacaacaacgtcgatgtcgaggctgccaacaggaatggcatcgcaatcggcaacacgccgggcgttctgacggagacgacggctgagctcgccgcctccctctcgctggcggcagccaggaggatcgtcgaggctgaccagttcatgagggctggcctctatgacggatggctcccacacctgttcgttggcaacctgctcaagggccaaactgttggagtcattggagctggtcgcattggctccgcctatgcacgcatgatgattgagggtttcaagatgaacctcatctactacgacctgtatcaggccacacgtcttgagaatttcgtcacagcatatgggcagttcctcaaagcaaacggtgaggagcctgtcacctggaagagggccgccaccatggaggatgtcctcagggaggctgacgtgataagtctgcatccggtgctggacaagaccacctaccatctgataaaccccgagaggctggccatcatgaagaaggaggctgttcttgtgaacgcaagccgagggcccgtgatcgatgaggccgcgctggtggagcacctcaaggctaaccccatgttccgcgttggcctcgatgtctttgaggatgagccttacatgaaacctggactcgctgacatgaagaacgccgtcgtggtaccgcacatcgcatcagcctccaagtggacacgcgagggaatggcaaccctgtctgctctcaacgttcttggtaagatcaaggggtaccctgtgtgggggaaccccaatcaggtggagcccttcttgcaggagaatttgacgccaccgcctgcctgcccaagcatcgttaatgccaaacaaattggcctgccatcggcaaagctttaggagcgaacactgacaggctggtatctacatgttgaagatgtgtcgtcgtcgtctccaccacgcgcacatatatgtacatgcatgtggattgaggtcatgcatctgcagagcaggtagcacatattaatttggatcatatatattgaccaatacacactgtatgctagattgctaggttgctgtgcatggatcatattgatcaatgacgaccaggcctccctccgtttcccttctatatttaggacctatttggttccttaagtccaatttggttccttaagtccatggactaaactcccgtattcccaccagtcatttaataagttttgaac

SEQ ID NO: 6547 - DNA, 2722 bp, Zea mays
atgcaacggcagtaaagcatggcttagatgcaaatgtttttgtgggcagttcactcatcaacctgtatgtgaaacatggctgcatctctgatgcaaagaaggtgtttgacttctccactgaaaagaacattgtgatgtggaatgctatcctttatgggtttgttcaaaatgagctccaagaagagaccattcagatgtttcagtatatgaggagagctgatcttgaggctgatgattttacatttgtgagtgtccttggcgcgtgcattaacttgtattcacttgatttaggtaggcaggtacactgtataacaatcaagaacggcatggatgcagacttgtttgttgctaatgcaatgctagatatgtactcaaaacttggagcaattgacgttgcaaaagcactattcagtctcattccagttaaggatagcgtatcctggaatgctcttatagttggacttgcacataatgaagaggagggagaagctatcaatatgcttaaaaggatgaagttctatggtatagcactagatgaggtttcttttgcaactgcaattaatgcctgttccaacatttgggctattgagactggaaagcagattcattccgcatctatcaagtacaatgtctgctcaaaccatgctgttggcagctctctgattgacctgtattcaaagtttggagatgtagaatcttctaggaaggttttggcacatgtagacgcaagcagcatagttccaataaatgcgctaattacaggtcttgtcctcgacgccggccgggatgaagccatagagttatttcagcaagtgctaaaagatggtttcaagccgtctaacttcacatttacaagcattctttcggggtgtactagacctgtcagttcagtaattggtaaacaagtccattgttacacactgaaatctgctattttgaatcaggatacttcacttggcatctctctggttggaatatatttgaagtgcaaattgcttgaggatgcaaacaaactcttagaggaggtgccagatcacaaaaacctggttgagtggacagctactatttcagggtatgctcaaaatggttacagtgttcaatctttggtgatgttttggagaatgcgcagttatgatgttcgttcagatgaggccacattcactagtgttctgaaagcttgttctgagatggcagctcttacagatggaaaagagatacatggcctcattgtaaaatctggttttgtttcctatgaaactgcaaccagtgccctcatggacatgtactccaagtgtggggatgttatttcttcctttgaaatcttcaaggaattgaaaaacaggcaaaatataatgccatggaactccatgattgttggttttgcgaaaaatggttatgcaaatgaggcacttcttctcttccagaagatgcaagaatcacaaataaagcctgatgatgtcacactccttggtgttctgattgcttgtagccatgctggtttaatttccgaaggcttacatttcttcgattctatgagccaagtttatggtatagtacccagagtagatcactatgcatgtctcatcgatctacttgggcgtggtggtcaccttcaaaaggctcaagaagttattgaccagttaccattcagagctgatggtgtgatctgggctacataccttgcagcatgtcaaatgcacaaggatgaagagagagggaaagttgcagcaaagaaacttgttgagatggaaccacaaagctcatccacgtacgtgttcctttcaagcttacatgctgcggctggtaactgggttgaagccaaagtagccagagaagcaatgcgagaaaaaggggtgatgaaatttccagggtgtagttggatcacagtggggaacaaacaaagcgtatttgttgtacaggacacacatcatccggacgctctgagcatctacaaaatgcttgatgatctaactggaatgatgaataaagatggcagaatcaaggaatgcttacttgagggacaatgaccctgtttaactaatatatcatgctaaataatcaagggcctagattgatcttctactgtaatagaaagatgtctggttatttaggtgaggaatttggtacccttgcatagtataagtaatacaattactcataaattaaggatttaggcttttatcacatctcaccaaattggttgatgagttggttcatgtcttattgcacgaaaaattctctcgagaacgacaaggaaaactgggcacttcgctcatggcagtggcatcccgcttgaacgagatttacatcgcgcattcgcgcgtctcctcttgttcatcgtcagcttgtgatggcttcttgctcgaattgtgcagcttacatcatgctcctagtcactttttgtgcatttattcctgcaaaacttatacgtccgaccctatatagtcaaagcttctcgcaatagagtccacgtccttgaaatcatctttttattttttcataaaaagtagaagttgcaatatatactacaacaaacatcttagttcctaaactggatgcctttaatatacacaaactaacgacgagggcaaatccactttacgcatacacgaaactggatgcctcctcagcccatttctcttacctcttaccttgtgctcctcgactgtccagccgcctgtcacttgagattccagttaccaggatgattcttcaaatccac

SEQ ID NO: 6548 - DNA, 2005 bp, Zea mays
ccggccaaaaaaaaaaaaaaaaaaaaaaaaaaaaaaaaaaaaaaaaaaaaaaaattctcgcaggcctccacgcgaccacgccgcggttttgcacttctcgccttctctaatctctttgcctctttggctccctccaccaccagtccaccaccactgctacccaaccctcgcttccccaaaccctagccaagggacacggtggccggcgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctgttgcattctactttggagctcgttttggatttgacaaagatgccaggagaaggctcttcaccatgattaacaacctgcccactgtttatgaagttgtgacgggggttgctaagaagcaatcgaaagcccccaacggcagcagcaaaagcagcaaacctaactctaaaccatcaaaactgaccaattctaacagtaagcccgcgaagccagcccacccaaaagaagaggaggacagcggccgggaggacgcagaggaggaccaggcgtacctgtgtgggtcctgtggggagagctatgcgaacggggagttctggatctgctgcgatgtgtgcgagaagtggttccatggcaagtgtgtccgcatcacccctgccaaggcggagcacatcaagcagtacaagtgtcccagctgcagcaccaagcggagccgagaatgacggcaccctgggaacaggacctgctcccagttaacggaagcattttagaatcattaggagctatgaagcggtgtcattagaaccgcttcacctgtttagcgtaccggtgcgcgtgccggctgttgtatcttctctcgacgtgtgttgtaaactgggcagggacatggtagctagtggtgatgtgttgtgttagcaggctgactgctgtcatcgtagtgacggatgaactgctggcgtttggaaactcgtgttcggtaattaagtgctgcttagtgtgatagtttcctccggtttatcacctacccagagcgtgttagtggcgaacactgctgagaccatcatcaccgcggtcacatacacgttgctcatgggggcatagcacttcaatatggcaagttgacatgtaccacttgctactttgtcactaatcaagtagaaagtgctgctaatcatcatgctcccttgtacggcatcgtcacatgccaccatatctggctcccttagagcttgttcgttttgctcttaatccatatggattgggtggaattaagtgagtttaaattttaaataagtttaaatcttccacaattttttccgatttcatcaaatccacatgagatagaaataaccgaacaaggtctaacacttctgctagaccagaccatctagataaggcaaaacggaaagattggaacatatgcatctggctcccttagagcttgttcgttttgctcttaatccatatagattaggtggcattgagtgagtttaaattccaaacaagtcaaaatgtttcataagtttttctaattatatccaaaacacattggataggaataaccgaacaagtcctaacaaaaaactattacatcaagataggacaaacatagtaagcacgaaattgaaatgtgcacctttgtgtaggtatctgccacgaaaggttgtgaagtcctggaattgagttatattaacctaatacagaagtaaggaaatgcataactaagaaaaatgtgtctctcagggtgctgt

SEQ ID NO: 6549 - DNA, 1246 bp, Zea mays
gcttttccaaaattgcccctctgaaatcctcgcaggcctacggtctcgcggtattgcgcttctcgtcttctctaatcctcttctgctccctccactaccagtccaccaccaccactgctaccatcggttccccaaaccctagccaagggacacggtggccagcgatggacggcgacagagaaggcgctgcggcggtgcaccaccacgcgcgctcccccgaggacgtcttccgcgatttccgcgcgcgccgcgccggcatcgtcaaggcactcaccacggatgtggagaagttctatcagcagtgcgatccagagaaagagaacttgtgcctttatggtttgccaaatgagacttgggaggttactcttccagctgaggaagtacctcctgagcttccagaaccagcactgggcataaactttgcccgtgatggaatggttgaaaaagactggttgtctctagttgcagttcatagtgatgcgtggctcctgtctgttgcattctactttggagctcgctttggatttgataaagatgcaaggagaaggctcttcaccatgattaataacctgcccactgtttatgaagttgtgaccggggttgctaagaagcaatcaaaagcccccaacggcagcagcaaaagcagcaaatctaactctaaaccatcaaaacagatcaattctaacagtaagcctgtgaagccagcccacccaaacgaagaggaggatagcggccgtgaggacgcagaggaggaccaggcgtacctgtgtgggtcctgtggggaaagctatgcgaatggggagttctggatctgctgcgatatctgcgagaagtggttccatggcaagtgtgtccgcatcacccctgcaaaggcagagcacatcaagcagtacaagtgtcccagctgcagcaccaagcggagccgggaatgacaggcgccctggggcaggactcgctcccacttgacgaagcatttagaatcattaggagcagtgaaagtgtgaaactgtgtcattagaatcacttcctctgtttagtggaccagtgcgtgtgctggctgttgtatttttctcgtcgtgtgttgtacactggtagtaatggacatggtagctagtggtgacgtgttgtgttagcaagcaggctgactgttgtcatcgtagagtcggatgaactgctggagtttggaaacacatgttcagtaattcagtgatgtttagcgtgtatgataattttttcggcttgcaaa

SEQ ID NO: 6550 - DNA, 2674 bp, Zea mays
cacataattattattcaaacatgcgactgtgtaactgtaatttctattgtcctctctttctagtttttttttttttttttgctttcaccttttttgttgtaggatatgctatggcttggcttttgtgtcgctacccgcttaacgaaagacgtgctagttagcacggactgcacggtagtggaaaatagttttctgcggtacagtagggcacgaaggcgcgaggttctcgtggtttccttctttcagatacttcgcgtcgaagccacccctcagccgcgggccgcggcctcgacgcgaacaccagtccacgtccacttctcactggcccacaaggccacaactccacaagcataacgcaccgcataccgacgagaatcccgcgtgacgcacgcgcacccggtagtggtactgatctgtggccaccgctgcctgccagcccgccggctggccgcacgcaacactcgacacgcgatccgccacgggcccacggccattccacgccggatctcccgccgctcaggcgcatgctgcgcgcggctccgcagcaccccttacctttcgccgattccaccggccaccgtgccttcctccaccaccagccgcggcacacccgcggaaccgccgctcgagctcgcgcctgaaccccccaaactctgccaaatttcgccaaatccagccggtcggaccccgcaacacatcgttgggaccctcgaggccggccgacacaagccgcagcccgtggcgatggacctggcgtcgagcgaccttgcggcgctgggcgcggcggagctggtccgcgtctcggcgtcgatcccgcgcgcggctccccgcaccttcgcgctgctcaccgcctgcctcgtcttcccgctctccttcgccgtgctcgcgcactccctcttcacccaccccatcctgctccgcatccagcgcgccacccactccgagctagcgcagtggctcaggctcttcgcctaccagttcctctacctcatcgtcctcttcaccttctccctcctctccaccgccgccgccgtcttcaccgtcgcctccctctacgccaacaagcccgcgtccatctcctcctcgctcaccgcgctgccccccatcctgccccgcctcctccgcaccttcctctgggtctcccttctcatgctcgcctaccacctcgtcttcgcgctcaccgtcctcctgctcatcgtcgtcttcatccccaacgcgtccgagtccgagtccgcgccgccctccctcgccttcgtactcttcctcgtcgtcgtcgtcttcgtcttcctcgggatccacgtctacatctccgcgctgtggcacctcgccagcgtcatctccgtgctcgagccgctctgcggactcgccgccatggccaagagcaaggatctgctccagggccgcaccggcaccgcagccacgcttgtcgtctcctacttcgcggtctgcggcgtcacctccgtgctgttccgtgccgccgtcgttaaggggcgcgccgaggaggggagcttcggtctggccttgcccgggcggctgcttgtcggcgccgtgctgctgtgcgttcttgtctgtgtcaatttgctgggactgctcgtgcagagcgtcttctactacgcctgcaaggccttccacaaccagcagattgaccggactgcgttgtatgagcaccttggagggtaccttggggagtacgtgccactcaagagcaatatccagatggagaacctttgagattggagcataggacaagggtaagttactcacctcattgcttcatactagcagtttcatgtggatctttatcagaatatgagtatggcttacaaggggctatctggtcttgttgattctagtaccatgtagtagttcgtaatctgtataagtggtaatgcacagtatggaaccaatctgtggaatggaagtatggaacagagatgcatgaacaaggttgcctttcatctcgcaaaaaaaaaaaatgtatatccttgctttcatgcgggtcctgttattgttcgtgactatggttcatggtttagagattgggggttaacatgcactgatgcacaattagttctctctctgctcatgtgagactgtgagaggctgttcacatcagctggtgttgtcgattctgttgcgggatatccgtccctctcgcgttccataccgtttggtaagatattgcgttattagatgccattgttactctaactctgtacatcaagatcatgagtttatctttaggctttctatatataccacgtgtgctgaaatatttgaaacatgctagcagagtccatgctagttcattctactgggtaaagtcgtaaagattgtgctatcaactcgtaatctgtatcttaatgtctatgatcatcatgccctgcttaaacttctacgaaacgccatcatcatgattgatcacttggctactagttgttatccttgaaagaatttaagtcgggctaggttatgacttattttgtgttgattacttggtcgaactaatacaatttaacatcgtgaacataatcaattgctagttaatttcaaaccaatttaacaccagaaaagagcaataatgctcacatttttaaagaccacatcaattcaacactagattaacacagatcattacccatcagttcatccaaacacaattatacaacacaca

SEQ ID NO: 6551 - DNA, 2933 bp, Zea mays
cgacacgcggttcgccacggccattccactttccacggcggatccccaccgaaggcacccaacttctgtgcgcaaccccccgcgttgcgctcgcgcgtgacggcgacacggcgtgcccccacgaactccgccaaattcccccaaacccacctagcaggtcggaccccgcaaatcgccccccaaaccaaccgggccggccgacacaagcagcatcccgtcggcggcgatggacctggcgtcgagcgacctcgcggcgctgggcgcggcggagctggtccgcgtctcggcgtcgatcccgcgcgcggctccgcgcaccttcgcgctgctcaccgcctgcctcgtcttcccgctctccttcgccgtgctcgcgcactccctcttcacccaccccatcctgctccgcatccggggcgccgcccactcggggttcgcgccgtggctcggcctcttcgcgtaccagttcatctacctcatcgtcctcttcaccttctccctcctctccaccgccgccgccgtcttcaccgtcgcctccctctacgccgggaagcccgcgtccgtctcctcctcgctcagcgcgctgcgccccatcctgccccgcctcctccgcaccttcctctgggtctccctcctcatgctcgcctaccacctcgccttcgcgctcgccgtcctcctgctcatcgtcgtcttcgcccccaacgcgtccgagtccgcgccgccctccctcgccttcgtcctcttcctcctcctcgtcgtcctcgtcttcctcgggatccacgtctacatctccgcgctgtggcacctcgccagcgtcgtctccgtgctcgagccgctctgcgggctcgctgccatggccaagagcaggcagctgctccagggccgcaccggcaccgcagccacgcttgtcgtctcctacttcgcggtctgtggcgcgacctcgttgctgttccgtgccgctgtcgttaagggacgcaccgaggaggggagcttcggcctggccttgcctggccggctgcttgtcggcgccgtgctggtgtgcgttcttgtctctgtcaatctgctaggactgctcgtgcagagtgtcttctactacgcctgcaaggccttccacagccagcagattgaccgcactgcattgtatgagcaccttggaggctaccttggggagtacgtgccactcaagagcaatatccagatggagaacctttgagagttggagcataggacaagggtaatcttctcacctctcgttgctacatactagcagttttctatggatctttctcgaaagatgactatggtttacttggagctatatatctggtcttgttgattctaatatcctgtagtagtttagtttagaatctgtacaagtgaaaatgcgcagtatggaaccaatctacgaaatggaacgtagatgcatgaacaaggttgtctttcgtctcacaaacggtgttcttgtttatcattgctttcctgtgtgtcatgttattgttcttgactgtgattcgtcattttgagactgagggttaacatgcactgacgcacaattggtttcccctctgccaatgtgagattgagaggttgttcacatcgggtggtgctcttgattatgctctgtgggatgtctgtccctcactccctctcgcgttcatatggttagagcaactctggcaggagcccacaaatcagagcaactctagcacgagcacacaaaaaagtgatttgggtgctacccaagtatcgttggctccctatcttacacgtactcataatcatattcaagctataaccatattcaaactttattctacaaacaggaacgaaccgctgtagtagtatcgtttgctccctattttgcataatcaagttatttaggtgctcgatccaagatttaataaagcactaggctaggctaatttttaatatgacaaaattacaaaaaataattacaaaacatgatgtatcaaataaaataaaacagagcctaaaaagaggaacaaacggatcatcgagtaatatctttagggcttgactaatatctataaggatatctttagggcttgactaatatctataagggctggtttggggacataaaaatggagaagggcggacatggaaatcgagaaggtcaatgaggattcctctcttataggtcctctctatttcctagtcaccaaatcaaacctaagacttgtgacttgtttggcagcatgtggaatagagggaattaagggctgatttggtagacatggaaatgaagtggatctatggaggcgagatcgtctgttatttaaaattgaatagtaagggatccctcttctatggatcctctccatttccatatttaccaaactagccctagccctaaggaggctcgaatctctcactatttaaattttaatagtaaagaattctagcatccttaatcccctctattacccttacttctaaattagcccgtactctttatatattatagctctaattctagaggtagaactgagcaaattcaataaaaatgcgcaagagaaaagagcactaggtcagcaataaaaagaggacagctctgatatttttgcattgatggttagggatgtacaaaacaccgtcgaatatccacatcgctaatgcaatattcaagggtgatgttaaatggaaatgggtgacacttaaagaaatattcaaccaaatctcaagaaagaacaaaaggaggttgtacaaaatctcaagaaactactggaatgtaccagtttggaggtgtttgttcacttgactaaagtttagttcgtgtcaaatcagatgtttggatacaggtggctaacagcagctgtgtctgtgatgttaacaggaggctgacatcttgcatctcaaaagtaaagagcaataataacaaatgtataaaaatgtaatagatctaaacataagcatac

SEQ ID NO: 6552 - DNA, 939 bp, Zea mays
attccacgccggatctcccaccgctcaggcgcatgctgcgcgcggttccgcagcaccccttacctttcgccgattccaccggccaccgtgccttcctccaccaccagccgcggcacacccgcggaaccgccgctcgagctcgcgcctgaaccccccaaactctgccaaatttcgccaaatccagccggtcggaccccgcaacacatcgccaaaaccaaccgggccggccgacacaagccgcagcccgtggcgatggacctggcgtcgagcgaccttgcggcgctgggcgcggcggagctggtccgcgtctcggcgtcgatcccgcgcgcggctccccgcaccttcgcgctgctcaccgcctgcctcgtcttcccgctctccttcgccgtgctcgcgcactccctcttcacccaccccatcctgctccgcatccagcgcgccacccactccgagctagcgcagtggctcaggctcttcgcctaccagttcctctacctcatcgtcctcttcaccttctccctcctctccaccgccgccgccgtcttcaccgtcgcctccctctacgccaacaagcccgcgtccatctcctcctcgctaccgcgctgccccccatcctgccccgcctcctccgcaccttcctctgggtctcccttctcatgctcgcctaccacctcgtcttcgcgctcaccgtcctcctgctcatcgtcgtcttcatccccaacgcgtccgagtccgagtccgcgccgccctccctcgccttcgtactcttcctcgtcgtcgtcgtcttcgtcttcctcgggatccacgtctacatctccgcgctgtggcacctcgccagcgtcatctccgtgctcgagccgctctgcggactcgccgccatggccaagagcaaggatctggtccagggccgcaccggcaccgcagccacgcttgtcgtct

SEQ ID NO: 6553 - DNA, 1588 bp, Zea mays
tcccagttcaagtcccgcccaatggaggacccaccagcgcttcctctgcctgagccggagtccgagcccgatcccgatcccgaggcctcccctgcgcctccgcaaaggctgctgcgattgcgctgcgcggtgcagcactacgagtggggccagcgcggagccgcctccctcgtcgcgcgcctcgccgaccagaaccccgacccggcccgcccctatgccgagctctggatgggcactcacccgtctgccccctccacgctcctcgacgacggtacgctcctcagtgactggctcgcgcggaaccccgacgcgctcggccccgccgtcgctgcgcgctggggagtcgacctcccattcctcttcaaggtcctgtcggtggccaaggcgctctcgatccaggcgcacccggacaagaaactcgccgaggtgctgcacgcgctgcggccttccacctacaaggacgataatcacaagccggagatggccatcgccatcacggagttccgggcgctttgcggcttcgccggtattgaggagctcaaggatgtcctgaggacatttcctgaaattgaaggactagttgggcatgaagatactggcaagctgatgaacatgaaggaagatgatggggttagtgaagtaaaatccagtttgcaatcagcttttgctaagctaatgacagcaagtaaagacatggtttctgaagcagttgcaaaactgatcagtcgcctgaatactgagagcaagattaggaccttaacagacaaagaacagctgcttttgtccttggagagacaatatcaagacgatgttggtgttctagcagcacttttttttaactatgtcaagctcagtcctggcgaagcgctttatattggtgcaaatgaaccgcatgcatacctctcgggggaatgcattgaatgtatggccacctcagacaacgttgtacgcgctggtttgacacctaaatacagagacgtgcaaactctctgctcaatgctaacatacaaacaggctttcccagaaattttgcgcggagttcctgtgcagccacacgtaaggcgctacacccctccatttaacgagttcgaggtcgatcgctgcttggtgcctccaggtggatcgctggttgtcgtacccccggtaccaggtccatccatctttctcgtaatgaccggggcaggcgagattcagttggattctgcgtcagatggagaaaaggcagacgaaggtgatgttttcttcgtcccagcatacaccgaggttaagatatctgcgtgtggccccgagtctctgcagctgtacagggccggagtaaacagcaggttcttcagctaacaggcgcgtcgatctttggggctgtcgtaaagtgaccacactgtagttgtagggaagttgtcatatacgagaaatgaaacggttagttagcaaaaaggtctcatatatactaatgtatagggctgtaggctgatgaaagaataatctggttcctttcgtatcttcttgataattcactgtaaagatgccttgcagtgcaatccacgttggatgcgctagaaagaaataaagatgatgattagtatcaacc

SEQ ID NO: 6554 - DNA, 2936 bp, Zea mays
  misc_feature (667)..(667): n is a, c, g, or t
  misc_feature (1105)..(1105): n is a, c, g, or t
  misc_feature (1407)..(1407): n is a, c, g, or t
gtttcttgtcatcgatggcgatttgatgtgcaccgtggatgtcaaacttcctgaagaaggtttaggtggtcttgttacattgaagttttggaatcatgggtcaagagctggacattattttttgtccaccgtcatttatgagcctcacaggttggttcatgtttataaggctgctgagagatacaatacaaaaatgaaagtattatttgttctaacttttacatttaatctttcatacagtgatgatggggtttcttctgttgcattccgcccaggaagaaatatggccgttagctcttcttttggtggtaactttaaggtgtgcatggctgttgtgtttgagaggatgcactgtttcctcaattcataagttttgtctttcttttatgtaggtttgggtccagagtttgtcttcacaatcaaatgatgaaagaaattgttctggttggagatgccaatcagttggctcatacaagtgagttgtgaatctgtttacctttgaacaatacctattaatatttgatggtttaaaatactaaaatattcatacacatgtaacatgtttacctttgggcaatgcctattaatatttgatggtttaaaatactaaaatagtcatacacatatttattctaaatacttctatataaccacacatttaggcttncagcatttttttgtctttgattagtgagtcatatgatatttgagcgtttaaaattttgcaggaagaaacctatgacatcagcagccttctcagccgatggatctgttcttgcagttgcagctgagagtaccatcacattgtgggatcctgataataatgcgcttgttggtgtcattgcagaaacactatcggtatatgatcattcattgacatatttttatggtttatctctgtcttagaatagcagtttgatgtgtcatttattttatctgcagccagtgacaaatctttctttcgttgggacatcagtgtttttgatgtctctatgtcagagttcaagaccacagattgctctatggaatgtttcaaatctttccatgcagtggtcttacagcatttatgcagaaggtacaaactatgatagtagtataatttatnctatttagatttagggaagtcataatactttctggtcctacctcttacaaggcattttcatttgttgttttgagaaaacacaatttatagttctgatgcttggatacggatcatgttccttatttgtgcttgaagatgaacagggacacataagattagcctgacattcttactgttgaatgttctctgtagagctgatcctctgttttagtgttctaaagtgtttgacagttggggttgtgaaaaataatttgtggtcagtgaacaatcacgtttgatctcattctcatagttttattttntttttcacagctgcatgctgttcgccagatgggagtgaatttgcagttcttgctcttcttagttgtcctgatggagaagcatcaacacaacaagatggagtaattcttctttttgatgcagaaagctcaaaccccattgcctcctggtcggtaaagaaggtatatcccaactcccatctgagcaattggttgtcatctcaacttgttttggaaactgaatttgcccttggtccttctagtattctcaggtttatacttgtatattgttagataccacagtatgtctagttgcttagttctccaataaactttctgttggtttatttctttctgcatgtattgttagtcaacacaatggaccaggggccacaatgacacatagctttggttaatgccacttttttccaggcatcgggtggcagcatttcttttgtaaaaggtgacgtccctttggatgcaaatgctgatagttcgagagacaaagagccaatgttgcttgtttatgtaaatggttctcatgaatacgccatctttgatccccgggagagtgaggaggtggtcattagcaagaacaagcacaagaagattcaagctgaggaacctggtgagtattgtaggtttgttgcattgttcttgaatgcgttatttttatatttcactggctacatattcacctctcctgcgcaacccttgttacttgcaccagttagtcagatggtattttgtggtaaacaaacaaaatatagtagcaatgcagtaatcactatgccagcttcttatatgctgtgcagcctgtgcttccagatgctgtttgcaggatttttttatctgtaccttgtgcaaaaatgattgtcctattttttctactttgtaaaagcgctgtatctctttttcagcaccaatcggctacgcttctatttacggagagcttacagaactggagccaaagaaagaagtttcagatgttccattcgtcccttcggacaggccttgggaaaccatattcagcgggtcgtctcatgttctcccgcctctcacaaaactatgctctgcattcttgtcatcgctgctggagaaacggcctgttgcaaacgagtgagccgccctagaacattgtcctctcatacaacggtaggtatactcgccagttgcagaatggaaatgcggaaggaaatccgtccgtgacgatgcatatgcccacttgaagagttcagagatgctgggtgatgccatctgaggttggttatggttatacagatatcacacggcccacgaggatcattttgcagcgatactcgacggccaacctactgatcgcagcaattttgttttcttctccgcttgacatgtaatcctgacagtaaaactagaaaatcttagtgtgctttatctgatgcgatgacgcggtgctcgttgaggtgctgcgactgtttggctattgagctgtctacggcacaaccgcatttcttttgtactattttgtttttttttcaaagaaagctcacgcttggatatctgaacttgataag

SEQ ID NO: 6555 - DNA, 2735 bp, Zea mays
  misc_feature (2713)..(2719): n is a, c, g, or t
cgcccacggacgcaacctccctccctccccgtccccgttcatgtcgcccccgtccgtgatcccctccccgccctcctctccgcgaccccatccatcctgtcgccgtccacgcccagcagcgctcaaaagcaaaaaagggtacgaatacgaatcccaatccagggccggagggcgagcgaactcaaaagcaagctgttccagtccaatccgccccagtccaaatctaatcgccgggtttaggcagaaggggtgggacgcggcgaggtttaggcggggtttgttttgtccctttcgtgcgattctgctctccgcgcgggaggcaagtactgacggaagcgaagaccaaggcggaggagggggtccccggcggtggaagtggaacgcgccgatgcgcaagtttcaggactccatcaaggccctccaggccgacatcgatcatgccaatgcgatagcagggtgtcggaattcttgagggactacgatggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggacatggaggccagcatcagggagttttacggcgtcattttcccgtcgttgctgcagcttccgagtggcatcaccgagctggacgacaggaagcagaggaagctctgcctcaagaaattcaggagcagggatgagcagctctgggaggtggacacggagagggagcttgagtgtgggatctgcctcgaggaaatgacacctactctactccgcagcttaaaacctcaagatatgtcggtaatcaaacaagtacaagtttcaaggaaatgggaatttcatggaaatacagacattgggtccatattacacattgatatgattttggctgacaaagagcgctgtctgaggtgcgtggtcaagtcgaggcgaagatgagcaaggaggatgtgctcaaggtgcaggtgagttcgctccactcttcttcttcttcttcttgccgatcgacccaaccaccgcactccacctacacacaggcacatgttcattgtttttgctgatttcaacatagtactgctcagtggcggatccaggatgagatgcaaggaggggctactagcctactaaaataaagctaaaaatatttagatataactaaatgatctaattaatatagaccaaataagtatgaaaataactaataagttgtgttaaaaagtacaatactcaaaacatacccctaatgagttgtgttaaaagtatctttgttccggttcttgatgagaaatttatccattctatccctataaactaaaaaataattttatcaattaacctagcaaataattgaccaatccaaaataccaaagtataaaacctaatctcttggtgaaaggcaatctatgtttagcaagttaagaattatatagagtaaagtctagattctagagggaagataaatgacgtcgattgaaaataaaaagggcaaggcacagtcttgaaatgacactacacactacaccgatcctccagcccttgccacgctttttcttttgtatctcgtgggtcatggcttgcagtgcagcctatagcttgcactgcaggacagtgtgtctggcgtcttgacctgcttacaccaacacgtgactctctgttggctgctgcatactcgccttgttgccggcaccgcgaccggggctgcagcccaggcagtcccaggttcaaatccgcccctggtactgcttgtttagtagtgaagacagagactgcagtgaaaacagaccaccacctgtattctttcaggtgttagaaatgtaaaattttgctttctggttatgtgtgttcctcttgctgcatggttattaccccacccccatccatctcgcctgtgcagaaataataaacatcactagtgtgcgttaactattttcttgatactgttgtttctattgttctcaaggtcttggattcaacatagtactagcagtttggaatcacccgacggggatgctttccatgtaataaatatttttggaacgtttcggatttaacttatgttgtttctgttgcaatcaacatggtgtcactatttggattcaccagtaagaatatttgccatttgggcttgttaattagggtgcaattttatataaaacatgcctcgttcacttgctttccagttcttgatttcagatctctgaagccgattacgtacacatttcctaccacgacttttattctgctttccggttctcaacgtcttggacattgccggcgagcgcggtctcctcggcaacttctactgctaactcgggtgcaagatgcccagcaaacttcccaatccagctgccggcaaggagatgaggttcccgacggcgacaattttccactacacaaccggattcttcagcagcatatggatccgttgaagcgtcgtgtgacaatgccaccaaagagcagcaacaaacaagctcaaagtctccgctaaccactaatctcataaagcttgaattttctcattgctatgtttccttctcctagcaaagttaagatgtttgcacatttctagcttattaggtccttgtgtggaatgtgtttgaacaatgatctcatttaaacaaaaacaacaagagaggccgctcgnnnnnnnaaaaaaaaaaaaaaaa

SEQ ID NO: 6556 - DNA, 1104 bp, Zea mays
tgggtaccccctcggccgccccgcccggccgcccacgcgtccgagaacaatccagcgagctcgaaaaaaagggtacgaatacgaaccccaatccagggccggaggagggcgagcgaactcaaaagcaagccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggccaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgaggttagccccaaggtcgtgctgcccgactgtgcccacatgctctgcatgcggtgctttgaggattggaacgcgaaatcgaagtcctgccccttctgtcgcgcctgcctggaaggaggtgaagccgggcagcctgtggatatacaccgacggcagcgacgtggtggacacggataccttgactagggagaacatcaggcggctgttcatgtacataaataagctgccacttgtagtcctacatgtagttgaccttgacgtttacaagtaccgcatcaagtaaaatgcaactgatccttcctgggtgaaaaaaaaaaaaaaaaaaaaaaaaaaaaaaaaaaaaaaaaaaaaaa

SEQ ID NO: 6557 - DNA, 3744 bp, Zea mays
  misc_feature (53)..(53): n is a, c, g, or t
  misc_feature (1477)..(1477): n is a, c, g, or t
gcaataaaatctaaaaaaggaaaatgaatctctactattccttatatcttcantgtaggcgtccacaggcttggttctgccatcgcgctccgtccgcgatcccctccccgcgcccgatcctccacgctcgatcctcgaatcccgcggcttccttcgatggcacgaccccatccatctcgccagtgtccgtggtcccctccccgcgctccccaccacgacggcacgaccccatccatctcgctgctgtccacgcccagtcgcgcctcccacgatcacgcccacggacgcaacctccctccctccccgtccccgttcatgtcgcccccatccgtgatcccctccccgccctcctctccacgaccccatccatcctgtcgccgtccacgcccagcagcgctcaaaagcaaaaaaagggtacgaatacgaatcccaatccagggccggagggcgagcgaactcaaaagcaagctgttccagtccaatccgccccagtccaaatctaattgccgggtttaggcagaaggggtgggacgcggcgaggtttaggcggggtttgttttgtccctttcgtgcgattctgctctccgcgcgggaggcaagtactgacggaagcgaagaccaaggcggaggagggggtccccggcggtggaagtggaacgcgccgatgcgcaagtttcaggactccatcaaggccctccaggccgacatcgatcatgccaatgcgatgtgagtcctccactcctccagggagcagaatttcctgttcgccccctttccctttgcttgctcacgttaaaggcggaatcttttttactctttttcgacgttttggatgactgaatgactttttttattatgtgtgtgttccgcggttgtttgtttgtgcgatgcagagcagggtgtcggaattcttgagggactacgatggctcggtcatccagatgcgggtggcgtacagcgccgtcgcgcatttcctcctgcagtggaccgactgcaagctcgccggcgcgctcggcctcctcaaggttatgctatacaaggtatcgccgccttgcaccctgctagctcgtgcccgtgctcgattagggttttcactccacgagctggcttgctgagttgccgtttctccggcaggtgtgcgcggacggctcgtcggcgcttcctgattgggacatggaggccagcatcagggagttctacggtaattaacccacccccttcctctcttcctcgaacaactaactgtcggttctgacggcgttgcgcaatggcaggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgaggttagccccaaggtcgtgctgcccgactgtgcccacatgctctgnatgcggtgctttgaggattggtaatatctcttttctcctagcttaaaatctttggccgagtccataagcgtgcatgaagtttgatttttttatgttccacatttacacaaatttggtcatgttagcttatggatggcaaagtactatttctcacgggttctgaagcagaattacagtcaagtacttctcgtgggttctaaagcataatgttttctgaagcagaatgttgaaactctggattggggaacatgggaaatttgtttttagtggaattatatttctttatgaagtgctgttttctttttttcttttttgaaaattggtgtcaccgttttttttgaatgaggcaatttcagtgtaggtggtcggtttggagccttttgagtgtcagatggtctatctctacatctctagtcatttgacagaattttaagttcttgattcaggctgttcatcaaagcaacttgaactgaaaataccattattatgctaggaaagagtagggagctttctatcgaatcagtagtctgcttccgagttggtaacttggtaccacaaggagcagttatggctggagcatcactttcattttggttgcatgatgactctcgtcagaacagcaaacccctgcattttttgtgttatactgcctccatcctttcataattgacgccaaacagtacggaaatgaactacaaaacctcaaatagaaaaaaattatggagggagtaccatgggtgcagcggtaatatttatcttgaccttgtcgtttaagattcaagttgtagtttttttttcttcttcaaaagattcaatgtatatagtcggttagtagcagatgaagcggtctgatgaaatctggtttaatggcacttccattcagctcacctctttgttgggtcaggataagcttggctctctcttttccagtctttatcttccactggatattttgtgctttactagagataatcttccactcccttcagccaatatttgactacaccctagatattttgtgctttggatgcatcatcatcatcatcatcaagcctgacaaatctgacctttccattacccgtgctcccaacctatcatattcataccattcactcaaacaatctgtatcgaagctattataagtgatgatgatcctaatggtgggccggggtcgtcataacacaagttcgttcgctctttgcactacaggaacgagaaatcgaagtcctgccccttctgtcgcgcctgcctggaggaggtgaagccgggcagcctgtggatatacaccgacgacagcgacgtggtggacacggataccttgactagggagaacatcaggcggctgttcatgtacataaataagctgccacttgtagtcctacatgtagttgaccttgacgtttacaagtaccgcatcaagtaaaatgcaactgattcttggtaaaaaaaaaaaaatttaagttgtggttcatgtgatggtgttgtaggggtgtgttccttgcccagggccgtgtgagactgagcccgtggtgagcggggaagttgtgtgagcccatggatgccccagggccgcaaatagagcgcgttagtgatgtgaaggcacttcgggatcaaacagtggtggaggatgagtcaaaaacaaggtatggcgaagttaaaaatgtatatgacaatataaaaaaaatctaggtagaagcaaatgcgacaataaattactgtataaaataacggatagagcatcgcaaattgcaataggtgcctctcatccgtgcattggcattgctctttccgtttggatccattcttactcaactactttcactaaatcaccgagcctccttaatttactcaattactcaagctagcgtgatggatgacatctgctcgtgacctcgtgtttgcccctaggtcctagctgcatctcggctatgtctatacatgttgctcagctctgctcggcccctacacgtctacaacgtatgggattcagcctttggaagcccattagtagttagcgaatggaagcccatattgtggcctagctccactagtagataacagttcattctacgtttctatcccttctatcttctttctcacgagcctgcttgcattatttcacacgtttagagataacaatgggtaccaaaaacacgtatacccaacgagttttacccaatataagggcggtataggatacccgcgggtacgttaatgggtataattatgtacatattgggtagatgagtatgagtatgaatatgtac

SEQ ID NO: 6558 - DNA, 3231 bp, Zea mays
  misc_feature (951)..(951): n is a, c, g, or t
gattttgggagaggtaaccgttgaacttagccacagtttttttttgtctgtcgcttttacttatggtgagttgtggtaatacgtgactagcattcaagcatgcctttgaatctttgattaagatacgcacgaggacggccacatcgactggtaaatgaacacatgcagtcccttatgacctggtggatgtaacgatgactttgatctgtccctttactcgtaacaccaatactatacctatatggaattgtttttggataccaataccaggggcaagcttggacctacggcgcacaggtttgtatacctttgtttttttttcgtgaggtttttgtacttttgtgcttgagggtattgacaaggttgaaatatttcggaaattttatagtttagatttagactcgacgtatgtgtcacgtgcaacaaaaccagctctatcgcctctcacaaacaaacctactatgggcatatataatgtagatactatattgtagtactccaaatactagacatatttaagaagcttgttcatacaacctaatgtatttaagcattatattttattcatcaaaacctcttaagacacgacttatttacgtggattgccctgtgtatatataatccacataaatggttcgtatcttaaggagtatctaaggagtttagtgaaaaaacacaagatatatatctcagtgaagaaacgtatttagcacggttctaagtctaaaagatatggttttaccatacaatccacataaatgaattgtatctcgagggtatgaataagataaaagacttcgatacattaggttgtatgacgggcttttttttaggtatatacaatatagtatctaggttgtacatgtctaattattagctagccttattcgccgatttaaagtcgttacacaaagatactaatatttttatgtacctttaatttgttgtccnaccaactattagcaggtggatttaaatggcctttcggcctaaaaaaatactagtatgcattattatattagtaaccagttaatttttagtgctaattaatccaacaagacccgttcggtatttttttagaaacgtgcgtaacaataaatctattgatatggctatataattccatacaatagttttcgaacaccttcgatttacaggacgcagaagagttaagctaactaggggctagggcagtaccatgaaaaagaatcttggccaaaaaaaaaaatcgtttatcattggttcaagacagaggcctgaattataatacttccatctgacatctctatccggtaatgaaaacatgtgacatcgccattcatcaaccaggcttggtggatgggtcagcctcagccactgagccacagacgtcacgaaacctcaccaggaccaggccatcctgccaatcatggcctcggaatcttggataaggacacaacggtcccacaccggccctccccccaaacctcccccaaaccagggcgggccgcgggcgtcgtcggcgagcgcctcacggaaaccagagcccactggtttctttccgtccctttcctcctcccacggcgtcgaggacggctgggctgccataaatatccgggcagcgaacctgccatgttggcctggacaccggcgggccccgcgcgtcggtgacgtgggtggatggtctgtctgtccatcattccatctgcgcgtgccgaggaccgcgcgtgacagcgacccgccgaggatggatatttttgggattttttttcgtgggacccgcatgggcacgtcgcagcacgaagttatctgcgcaacctctatctaaagaatgacagatgggaccacgtggttatttgaccccacctttcagtggtaaaacgtggagcgtcaggtgtgccgagatgtgggtggggcccgtggaccactgccgtgcgggctcacccaaggacactgttcctcgtcgtcgctctcgcggtctcgcccccggcggccccccacgagtgtggcaacaaaagggtctcggttcggagttggactcggagtcggccagaacaatccagcgagctcgaaaaaaagggtacgaataggaaccccaatccagggccggagggcgaacgaactcaaaagcaagccgttccagtccaatccgccccagtccaaatctaatcgccgggtttaggcacaaggggcgggacgcggcgaggtttagtcggggtttgttttgtcccttccgtgcgattctgctctccgcgcgggaggcaagtactgacggaagcgaagaccaaggcggaggaggggggtccccggcggtggaagtggaacgcgccgatgcgcaagtttcaggactccatcaaggccctccaggccgacatcgatcacgccaatgcgatgtgagtcctccagggagcgggatttcctgttcgccccctttccctttgcttgctcacgttaaaggcggaatcttttactcttcttcgacgtttttggatgactgaatgacttttttttcgcgatggcgggggttgtttgtttgtgcgatgcgagcagggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgaggttagccccaaggtcgtgctgcccgactgtgcccacatgctctgcatgcggtgctttgaggattggaacgcgaaatcgaagtcctgccccttctgtcgcgcctgcctggaggaggtgaagccgggcagcctgtggatatacaccgacgacagcgacgtggtggacacggataccttgactagggagaacatcaggcggctgttcatgtacataaataagctgccacttgtagtcctacatgtagttgaccttgacgtttacaagtaccgcatcaagtaaaatgcaactgatccttgctgaatgaaaaaaaaaagaaaaaaaaaaaaaaagggtta

SEQ ID NO: 6559 - DNA, 1703 bp, Zea mays
gcacgagaccattacctagaacatcctaatcaaaaagtttccaattaagaaaggatcgcaggccattaaacaagcacgcacgggaggcctacaaagacgagagaggagaggagaacggtcaaggctgccgcgcgcatcgtcatcactagtcagtcgaggtcgaggggcggacgaggagctgaggagagagaagcttcacggagcttgcttgggagttggggacttggggacttgggggttgccgagctgtccgtctttcccagtttcccctcccctctacccaccagctacctcgggagggcaagtcaaacatctgcagcctcctttcccgaacccgggttggatggagcgggacttcctggccgcgatcggcaaggagcagcagcacccgcgcaaggagaaggcaggcggaggcgcggaggaatcagcttacttcggggcagcagccgtcccggcgatggactggtccttcgcgagcaagccctgcgccgccccggcgctgatgtcgttccggtcggcggcgagggaggagccttcgttcccgcagttctccgccttcgacggcaccaagaacacagcccctcgtatgctcacgcaccagagatcgttcggccccgacagcacgcagtacgccgcgctgcaccgcgcgcagaacggggctagagtcgttccggtctcgtcgccgttcagccagagcaacccgatgttcagggtccagagctcgcccagccttccgaacagtaccgcgttcaagcagccgcctttcgccatcagcaacgccgtggccagttcgactgtgggttcctatggcggaacaagggatgcggtgaggccaaggacggcacaactgacgatcttctacgccggttccgtcaatgtgttcaacaacgtctcagctgagaaggctcaggagctcatgttcttagccagcagaggatctgttccaagctcagcccccgtggcctgtaagccagaggctcctccagcgaaggtcacagcgcctgaggttcttctgcctgcgaagcaggatgctgtttcaaaaaccacagcatctctcgccgcctccatccagtgtccctggcatcttgcagtctgcagctctccccaggagcgcctcatctagctctaaccttgactccccagctccaaaatcttcggtcccgttagctgttcctcctgtaagccaggctccgccagcaacactcgccactacaactgcagcagcaataatgcctagagctgtccctcaagctaggaaggcgtcccttgctcgattcttggagaaaaggaaggaaagggtgacaactgccgcgccttacccatcagccaagagcccactggagagcagcgacacgttcggcagcgggagcgccagcgccaacgccaacgacaagtcctcgtgcacagacattgccctctccagcaaccatgaagagtccctgtgtttagggcagcagcccaggagcatcatcagcttcagcgaagagtcccccagcacgaagctacagatctgatcgtgcccagtgttcatagatttgtccaggctgaccgatgcagaaaaccataagaatacttttttcattcaagatgaagagattactatcgatgccgttgttgtttaccgtgatgctgccaggcgctgcgatccgctgcctgcgtttttgcacgctgcagcttgttcttcctgaaaaaaaaaaaaaaaa

SEQ ID NO: 6560 - DNA, 1890 bp, Zea mays
  misc_feature (1871)..(1871): n is a, c, g, or t
cgtcagctgggtaatctaataccctcgtttccaattaagaaaggatcgcaggccattaaacaagcacacacgggaggcctacaaagacgagagccgcgaggccggccggcaaggctgccgcgcgcatcgtcatcactagtcagtcgaggtcgaggggcggacgaggagctgaggagagagaagcttcacggagcttgcttgggagttggggacttgggggttgccgagctgtccgtctttcccctcctctctacccaccagctacctcgggagggcaaggcaaacatctgcggcctcctttcccgaacccgggttggatggagcgggacttcctggccgcgatcggcaaggagcagcagcacccgcgcaaggagaaggcaggcggaggcgcggaggaatcagcttacttcggggcagcagccgtcccggcgatggactggtccttcgcgagcaagccctgcgccgccccggcgctgatgtcgttccggtcggcggcgagggaggagccttcgttcccgcacttctccgccttcgacggcaccaagaacgcagcccctcgtatgctcacgcaccagagatcgttcggccccgacagcacgcagtacgccgcgctgcaccgcgcgcagaacggggctagagtcgttccggtctcgtcgccgttcagccagagcaacccgatgttcagggtccagagctcgcccagccttccgaacagtaccgcgttcaagcagccgcctttcgccatcagcaacgccgtggccagttcgactgtgggttcctatggcggaactggaacaagggatgcggtgaggccaaggacggcacaactgacgatcttctacgccggttccgtcaatgtgttcaacaacgtctcagctgagaaggctcaggagctcatgttcttagccagcagaggatctgttccaagctcagcccccgtggcctgtaagccagaggctcctcctactctcgctccagcgaaggtcacagcgcctgaggttcttctgcctgcgaagcagatgctgtttcaaaaaccacagcatctctcgccgcctccatccagtgtccctggcatcttgcagtctgcagctctccccaggagcgcctcgtctagctctaaccttgactccccagctccaaaatcttcggtcccgttagctgttcctcctgtaagccaggctccgccagcaacactcgccactacaactgcagcagcaataatgcctagagctgtccctcaagctaggaaggcgtcccttgctcgattcttggagaaaaggaaggaaagggtgacaactgccgcgccttacccatcagccaagagcccactggagagcagcgacacgttcggcagcgggagcgccagcgccaacgccaacgacaagtcctcgtgcacagacattgccctctccagcaaccatgaagagtccctgtgtttagggcagcagcccaggagcatcatcagcttcagcgaagagtcccccagcacgaagctacagatctgatcgtgcccagtgttcatagatttgtccaggctgaccgatgcagaaaaccataagaatacttttttcattcaagatgaagagattactatcgatgccgttgttgtttaccgtgatgctgttttgccgtgttaggttactgtactgctggtacagatggtagtgtcccccacccacctaactaacaagagagctgtcacttgcagactcttgatttttttttgccatttctcttggaaatgaactcagatgtgttattctagcagtaatcaaattatacaggcatacaaattctgcgccatttgtatggccaaagtgtaatacacttgttcttgaattatgaacctctctcaagctgcagaatgcaanttctcgatggtgttctcag

SEQ ID NO: 6561 - DNA, 3991 bp, Zea mays
  misc_feature (1566)..(1566): n is a, c, g, or t
  misc_feature (1796)..(1796): n is a, c, g, or t
  misc_feature (1805)..(1805): n is a, c, g, or t
acaaatgtcccatatttattttttacttgactcaaagaattttccaaaagaataacaatcgtttagtcaagaaaaaataaatatgggacatttgtacaagagcgccactgaaataatcagtaaattgttagtgttttaattgatgtttgtgtccattcaaggcacatattatggttaggggctggcagtactaattttaatgaaaagacaggagctctgccactcaactaaagaagttcatacaacaacacactgtactcttacaaccgcacaacagccgatccagtagcccttaagacacaaatcgttgccaagatttcgtgcaaaagcaacaaaacagagtgaacacaaaccgttgccaagactccgtgcaaaagaacaaaacagagtggattcttcatgacaaaccttagcccctgctaccaagacacagccacctgcacacaactggattcaccaaacacacctagaaagaggctaccacatgtcatcgtcaccaagcttcatcatgcccccaaccaaacaggccggactccatatcaacagggcgccaagagaaagaagcagcaccaagaaggcatacctgtccgctcggctttaatccgtaccggcttctgctgagtgtttttgtctctatagattaaagccgcagcagtccaaacagccggccggcttgaatccaaagcgaaccggcatgcacaccaagtttagcagggtcacactaacggagtccaccggtcgtcgttgccaagctccacacgtaagtgaagagcagctctgacttccaacgatgaacctcagctcaaaccaaggttgccgatccctcacccatagcaaccacattgtcactagcaagaacaggcatattgtgtcattgttgccgagccacatcacatcccaacgacgcaacaactctggctttacaaacacgcccaaaccatgaggaccaaatggatgagagtgaaccggcgctgagcacagtgaacgccaatggcgagctctggcaagacatgaacgtggagagtggaagtggattggtgctgcgaaagacagtgcagcttttctgtttttttattgcagtatttaaaggatgctaagtctaaacacgaccttctgaactcacgccactcaacaggtggtggcggactaaacgcgtgccatgcgcacggcgtgcgcagcgcgtagtccgctctgtatgaactgggcatgcatcgagctcaaacggatagcaaacagaatgacttaacaaactaactgacttaaaactaagtggatcacagggctttatctaacaatctcctcctaaaacctgtggcacttttactttatttcttgaaccccgatctttgatcgaagttcttcaaattttataaccgccagggacttggtgaaaatatccccaagctgctcctctgttcggatgtagtcgactctgatcaaaccatggtctgcacactcctggatgtaatggaatctaatctcaatgtgcttactcctgtcatgtaaaactggattcttgatcagatcgtagttttattatctaccaacagcagaggtggaacaccngctttcccaagcagctcctccatcagccttgctagccaaacaccttgagttgctgccatggaagcagcaatgtactctgctacacatgaagacagagccactaccctttgcttggttgactagtaaaccatgctgctggtgctcttgcggtcttcaacatctccagctatatcgctgtcaatgtatccaataacctccggcctctgttttcctctccctgcgccataccngacgtccanttcacagttccagccacatgccgcaagatgtgtttcactgcaactaagtgttcttctctgggtgcctccataaaatgactcacatataccagagtaagcaagatcaggccaggtgtttaccagatatctgagactcctgacgatgctgctgtagttggttgtgtcggctgccagagttgtaccagtctttctgagccgaagttaaacatcagtttaatacccaatatctaagttcatatttggtgccaaagtaggaatcaacaatgcttgttcctgaacccatttcataagtgctttactttagcttctcaaaactaaaccatggggaagattaatatttgttagattatgatatggcgccggggactcttcagaggtgagtagagaaggaggcgagcttgagggttggaacgcagtggatatgggggtagtgggcagctgatgtcgcggctggctggatgagccagggtgaccgaagagctgtccactaaggaataacttcttcgatagatccctagtacaaactatcggctggctttatagatgatgagccaccaaacctttcctattacttaacctagatatttggaaacagaaatatcaaatctaaacttcctaacaactcagcccttgattggaggatttgatttattcaatcaaaaccttcctactgacctcttcttcctttcctgcgctgactccttcctttcctatgcatgctgcccctttcctgcgcctgctgccagccttgggcgcctgtgatactggcggcccacaaactagtccacaacatttccctccacaccgacaaagaactcgtccgtgagctcgaactctggatacctctgcttgaattcttcgagtggttccctggaagcatctgtctcagcacgaccaaaccactgaatcaacaattcctaaacacctctgttgagcctggcacgtaccaccttggatagtgttggtaggacacgaccatgcaagatcacaggtaatggtaccacttgtgttggcgcctccccttcaaacttcctcagcaaggaaacatggaagacatcgtgtattcgagcacgaggtggtaactgcagcttgtatgagaccagccctacccgaaggaggacctggtatcgaccgtagtactttggcccaagtttggagggagcagcagaagtcaacctgactgctgtgcactgttgtaggcgaagccacacccaatcgccgacttggaactccacctggcgacgtttcttgtcctggtaagctttcatggttacttgggcctgaagaagacgctcccggatttccaccaagaacgtgacgcggtcctgcagcgggtggtacagtgctgccaccttagtggagcccggctgataggacagcagggttggcggctcccggccatagacgacacggaatggcgagcacttgatggctgtctggtatgaagtattgtagcaatactctgcccatggcaaccactgcagctaggacttcggtcgatctcctgcaagacacctcaaatacatggttatgacccgatttaccacttcggattgaccgtcgggctgtgggtggaatgttgagctcatgtttagtttgacaccagccaacttgaacaactcggtccagaaaaggctggtaaagattgtgtcgcggtcgctgacgattgagcagtggagcctatgtaagcagatgatgtcatcaaagaaggccttggccacggacgctgccgtgtaggggtgccgaatagcgatgaagtgtgcatacctcgagaatctgtccaccacagtaaggaccactgtcttgccaccagcacgtggaaatccttccacaaaatccatggaaatgtcgctccaaacctccaaaaggatggttaggggctgcgggagaccgctaggatgtagatgatccatcttgttcttctggcaagtggtacacccgcgcacataatcggcggtcctactgcaatgcgcctgggttgtggaaggaggcgcgccagcgattgaccgtcttctggatgtcgtcttggctgcagtcgtggacgtacgccagcaggtgtggccaaagggccaaagcatctggcacatagacgcgaccgccgaaggtgatgaggtcgtccaccttagtccagccttctggagcagagccatcggttatctgtcggtgtaaagtcgcagcctgcgggt

SEQ ID NO: 6562 - DNA, 864 bp, Zea mays
attggtacctcgagccggccgggaaaaaaaaaagacgcccaaaggttattccccaagcacaaacctctgagtctctgacacaccgccgccgcgccgcatccgctacaggctaccctcaccaccgcgcacaccgaagtagtagcaggcggtgccgcccccaatggcggcagactggttgtgggcgcgtagggtgtgggagaagtgggccgcgaagcacatcggcacctccgggaagccggtccaggctgcgctcctgctcaactacgacccctccgggccatctcgcctccttcccgtcgtagcagagcaagagggaacacaactttcagctcttgatatgcaaccactcctggactttgtcaagaggggtaatctgcagactgaattgttctctgttgggctgaaccaacatttggtcacctcaatccatgaaaactggttttgcgcccgctgcattaacagcacaaaaccagaaggtgaaggagtaatagttatgcagattggagcttgcttattagtcactatgtatgctggttctcttgctgcagcttcgcaagcaatggtggctgctgatcagtttgcaatacagtttaaccggaggagtcactaatttccagtatagtttcatgagtgatgttgatcgcaatttgttagtgtttgggatgatagtgctggaatgccgtagatgaccttatgtaacttgtaatgttacgatattctcggccgtagttatgctaatataatagcgaatattgacctaatactgatgttcctagtgtgaggttgaagaagctcatgttgaaatttgtggaacgtttcccaagcatccaaaagcttaaaagggacattagtttttcatcattt

SEQ ID NO: 6563 - DNA, 1995 bp, Zea mays
  misc_feature (1637)..(1637): n is a, c, g, or t
gtcgttctatctatatatttagagaccagtgggacaaaaaaaataaaccgaatgaaacttggccttctttatggttaatagataatattaatatagaagaaaaggaaataaactactgcaaaattgcaaaaacccaaagcatctgaaattctagatcttctacgctctaaacataaatcctcacttctatcaagcgttctgaaaaaggcgacacaaactgaaagcagccagccgtccacctccatcacctgctactgaagagctgcccggcgtcttctcctctgctgccgtgccttcgccggcggctgtccagtaccgcttgacagcgaagagcaccttctcaggcacgttggggccgtcctcatggtttgctagcagcgtcttccaccgcatccccttcaccgtcctctgcaccttgagcaggagtgcaggacagcggccgttgcaacaaaacaggcggccgttgcaacaaaacagactcccgttcccgtacattgtggacgggctaaacggcctttcgtccgttttcctcgttccaaatcatccaggattttttttataaaaaggagaggtcccgtcgtcagggccttgcctcgttccctcccaatcatcctgccgcgcgccgcacgtagacgtaggtagctacgattcgattcgtgctaggatttagtcgtcctgtcgtcgcaccagcattactagcattcagcaacaccaatggctgagaagaagatgcttacgctgaggagctccgactgcgaggagttcgaggtggaggaggcggtgttgatgaagtcagagatcattcgcttcatgatcgaggacgactgcgccgacaacgtcatcccgctcgccaacgtgaattccaagactctcgccctggtcatcgagtactgcaacaagcacgtccacgccgacgccgcggagaccaccagcgcctcatcagctgggggcggcggcgaggtcgacctcaagaagtgggacgcggagttcgtcaaggtcgcgccggcgacgctcttcgacctcatcatggctgccaactatctcgacatcaaggggttgcagggcctgacctgccgggcggtggtcgacatgatccagggcaagtcaccggaggagatccgcaagaccttcaacatcaagaacgacttaaccaaagaggaggaggacgcgatccgtagcgagaactcctgggccttcgacccgctccccgtccgtagtagtggaccgcggtggttactgttagctttgatctcgattgctagtttgctcgtctgcagttatcttctgatctgatacatacattaataagtagttcgctttgtctacaattattagctgatatatattgaggagttcgtctgtgatctgcagttatcagctaatatattaagtatttaggaattccatctacaagctgcgcatataattaagctacaaagtcaagaatcaaaatttcaagagattctatctacaaattcattgatctgacttttcagctccggacatctagttgggcgagtgtgcttaagaagggagagataagggcgcgagttttttgtactgtgcatgcagttaccacttctaactaatggcttaaaacaatagtggcaatgcaggtttataggttgagccgatantgatatatactacattgagcaaagagtttgcacatatctgtattttattgttagactgcacaacaactaacattatctgatgtggcctatacatttgatgcactcacttagctatgagatatgcatgatgaggttccttcgcactaacataaagtgcatgctcaggtcaaacctaggtaccattattagttagtggacaatataacttggcgtggaactaaaggccacagtcacaagtcacgaacctacgtgagattaaccagcatgtgcattaaatatcctgaatcatctgtcgcgtgattggttgcttaaactactgcacccagatcacgctcatcccattgaccgtgctttggca

SEQ ID NO: 6564 - DNA, 2413 bp, Zea mays
caaattaagcacgccattttctctgaaatgatatggagagacatttaataagtggaaagaaatgtttggcgacaacactactactttaacctttgaaatttgtagctagtttacttttaactatgtggactcagattgacgtgaaaaaaattctggaggtatcatcacttacgttttggaaccattctgctctccatttgccttgtccatcttgtgggcagaacttgatggctcggatagaacaaccttcaactcattgactctttctgtggttgtgtcttctaatttgatgctttgttttctttggccagatatgagaagaaggaacatccgagaaagagaaaggcaagagacaaatagcttatttattagttatggcggcaaaacagagtagcagtgtccggtttccctccaaaactaattctgcgtgcattgacatattctgggctgtgttcctgttttccattatttcagcccgttgaagtccataaaatttggttaggcaagcaggagcgttggatgcaaggaacggtggatgtagctgtactgcaagccggtgcagtaaaaacgctaagtcaggcgatccacgtccgcgcacattgggtaacgggaccgattccaaccatctgctcatttttgctcctttttctcctcgtattttcctatggtttgcatgggtcccaattaaaaattagattaattatatacatctcacttaacatttacaaaattaaatagctagttcaattgaatttagtggtattgaaaggatatgcatatacgataattgtttatttatgtgtcttttattgaacaaaactttcaactaactagttaacgggtacgagaacgtttcgccctcatcatacccgttaaccccgtgagtataaaatacccggtataaacttagcccccaaagcataaacttaggctttaaccattcatctcttttgactatttaacaaccttttagacgataatgtcgtaaaaagattaacaattatttgatgaccatgtaatgggatatgtaatgtgttatctatggtgttcttgaatagagccgtctgattggtatcctgtatgacagtggcgaagctagagtaaaatagaggagggtgcaaatagcttaagggtgcatggtaataaccgatacgtggtgcatatatggtaaaaatcttgtctgagtcactaattttgtaaaatttcgcgggtgcatatgcaccccctaccttctacctagttttgccgatgctgtatgagtcgatctagactgatgagtgcgtgtattgaccaagcaatatctcttgtttggttaactaaatatagcgagggtgagtctgccgcagtctccacgcaacgcatgtcaaaaatatattctccggctgcatgtatggtatggatacgccagaaaatcctgttctcgcgggccacactcgctgcatcccgccgccattcgcctgtctaaccacagccgatatataaaggaggtcacgtcgtcagggccaagtcacggtcttccattcgttaactcgttttcctcgttcccaatcatcttgccgcgcgccgcacgtagctagggtttcgtcctgtcgttgcacccgcattactagcattcaatccacaccaatggctgagaagaagatggttacgctcaggagctccgaccacgaggagttcgaggttgaggaggcggtggcgatgaagtcagagatcatccgtctcttgatcgaggacgactgcgccgacaacgccatcccgctccccaacgtggattccaagactctcgccctggtcatcgagtactgcaacaagcacgtccacgccgccgccgacgactccgccgccgcggagaccagcaacgcctcatcagctgggggcagcggcgaggtcgacctcaagaagtgggacgcggagttcgtcaaggtcgagcaggcgacgctcttcgacctcatcctggctgccaactatctcgacatcaaggggttgctggacctgacctgccagacggtggccgacatgatgaagggcaagtcaccggaggagatccgcaggacattcaacatcaagaacgacttcaccgaagaggaggaggaggagatccgcagggagaactcctgggccttcgactgatgtagtctccccgtccgcggacctcggtggttattactgttagattcgatctctagtgctagtttgttctggttattactgttagattcgatctctagtgctagtttgttcgtctgcacttatcttctgatctgaaacattgaaacattaataagtagttcgtttgtctacaattaccagttgatatattgaggagttcgtttgcgatctgcagttatatcagctaatatattaattatttaggaattccatctacaagctgcgcatataattaagctacaag

SEQ ID NO: 6565 - DNA, 2260 bp, Zea mays
  misc_feature (10)..(10): n is a, c, g, or t
  misc_feature (548)..(548): n is a, c, g, or t
tgccatatanttacatccagccttcagcaggatgcagcaaacaaactccattttactgcaggatataccatgaagattgcccaaaacctttatgagggtatcaacctttcctcagaagaaacaactgggttaataacgtacataagaactgatgggttccatatttctgatggagctgtggaggacattcgttcactagttaaagaaagatatggtcagaagtacgtttcggaggacattaggaagtatttaaagaaggtgaaaaatgctcaagaagcccatgaagccattaggcccaccagtataaggaggccgccatcatcattggttggaatacttgatgatgattctctaaaactgtacactctaatatggaaaaggacaatggcttgccaaatggaagcttccagaactgagatgattcaagtggatgttggcattcctgaaggagagatgaattttcattccactgcatcaaaactggacttcaagggataccgagctgtctatgaggatgatcaggccagtccatgcattgacagctctgnagggagattgtgtgcatgagtgtaactttgaggccttgtcgaaattaatggttgcagtgacaattccatttctttatcctctttctttctcaggctactgcagattatttgttatcatttaactactccattacgtaattcatctccttaccaggttaaggacttggtgtttcctgttaacgtgcatcttggccagcacttcactaaaccaccaccacgatattctgagggtgcattgattaaaaagctagaagaacttggaattggaaggccatctacttatgcatctataatgaaagtgttactggatcggaagtacgtgacagcaaaaagtcgagttctacaccctgagttccgtggtcgaatggtctcggcattccttttgcaccatttctctgaggtttctgattacaactttacagctaacatggagacagagctagataatgtctctgctgggtcaactgaatggaagggtcttctgaaagactactgggaacgattcagcaaatattgtgcagatgtgagtaaactggatggcagaaaggtagagagaatgcttgaagaaaaatttggtcctatcctcttttccgatgtttacaaggattgtagaatttgccctagttgttctgaaggaaccttgagattcaaagttagtaggtacggtgaaggctattttgtaggttgtgatcgacatccaaaatgcaagtacattgctcgctcactgtcacagcaagaagatgaaactgaacccatagaagaaaatgcaaaatcttttgaacccaggttacttggtgtcatgcctgattctgatcaaaaggtgtttttgaaacaagggccatatggctactatgttcaagttggagaggacaaaaaaggtctgtttccaaaaagggtttccctttccaaggtcaaagatatagactctgttactctagaagatgcaattgagcttttgcaatatcccaaaatcctgggaaaacatcctgaagatgataatcttgtacttataacacattctaaggttggatacaacatcaagcacaggagatttattgctcaagtgccaaagaacatggacccaaagaagatgacacttgagcgtgcactcaagcttctgagtagtaaaagtgtcagacggattggtcgtctaaaggggaaggtcgaaaagaaggaacccattgaatggcattagctgagcctgcctgcactcgtgtgtgcaaaaaaaaaaaaaaaaaatcagagagaagtcaacattcatagcatgcagaggttcagcctttcgtgtgtttaactgcttatgatgagagcggagaagggggccccatgtgtgacaaagaacaagtgccaagggaatgcacaaccagacatattcgggtcatatctttgatttcatatttttcctttagtcatcaacatcataagctgcattgaacgcgcggacacagaataccagactataaaattctgagcttaacaaagatgagagggtggtttcatcacctattttacataatcgctgcatttcctaattactttcacattttgtactagagataaatgcatcttttaccacaggaaacccattttagttgtgaccgtcgtgtaggttatgtactcatgtgtaagaattgtatatgctacttcacagctgaaattccatctgttttccaaaaaaaaaaaaaaaaaaaaaaaaaaaaactcgagcccgg

SEQ ID NO: 6566 - DNA, 1125 bp, Zea mays
  misc_feature (1125)..(1125): n is a, c, g, or t
ttattgggtgcctcgaggccggccgggattagtgctggtgtgtgtggtgtggttcgtccatctctcctgctagcttagctcgctcgctggcaacaacaatgaaagccgcaactggctcgtcatcagtcgctcgcgctcttgcgttgctcttggcggcgtgccttctctggaaggaagccgcgtgcttctcggcgtccgggctaaacaaggcgttcgccaccttctatggcggtagcgacgcttcaggaacgatgggtggggcctgtgggtacggcaacctgtactcgacggggtacggcacggacacggcggcgctgagcacggcgctcttcaacgacggcgcctcgtgcgggcagtgctaccggatctcctgcgactaccaggcggacccgcggttctgcatccgcggcacgtcggtgaccatcaccgccaccaacctgtgccctcccaactacgcgctgcccaacgacgacggcggctggtgcaacccgccgcggcagcacttcgacatggccgagccggcctggctcaagatcggcatctaccgcggcggcatcgtgcccgtcaactaccaaagggtgccgtgtgtgaagaaaggcggggtgaggttcagcatcaacgggcgcgactacttcgagctggtgctcatctccaacgtgggcggctgcgggtccatccagtcggcgtccatcaaggggtcgcgcaccgggtggatggccatgtcccggaactggggcgtcaactggcagtccaacgcgtacctcaatggccagagcctgtcgttccaggtcaccagcagcgacggccagaccaaaaccttccccgacgtcgcgcccgccagctgggggttcggtcagacgtttgcgacctcgcagcagttctcttagtatagacacatctttgttttctgcctcgttcgcttgtcgtttatatatatccctcactcggctcgactcggctcggctcggccctcgatcaataccttgtaaagtttacccggcctttgttgaaatgccccaccacctgccgcgcgcgatgcaggagatatatgatatatatgctttgacttgtgcttaatttcaaaaaaaaaaaaagacaagcggcccaaaaaaggggcggccctcn

SEQ ID NO: 6567 - DNA, 1083 bp, Zea mays
ccggccggggccattagtgctggtgtgtgtggtggttcgtcgatctcctgctaggtgctaagcttagctcgctcgctggcaacaacaatgaaagccgcaactggctcatcatcagtctctcgcgctcttgcgttgctcttggcggcgtgccttctctggaaggaagccgcgtgcttctcggcgtccgggctaaacaaggcgttcgccaccttctatggcggtagcgacgcttcaggaacgatgggtggggcttgtgggtacggcaacctgtactcgacggggtacggcacggacacggcggcgctgagcacggcgctcttcaacgacggcgcctcgtgcgggcagtgctaccggatctcctgcgactaccaggcggacccgcggttctgcatccgcggcacgtcggtgaccatcaccgccaccaacctgtgccctcccaactacgcgctgcccaacgacgacggcggctggtgcaacccgccgcggcagcacttcgacatggccgagccggcctggctcaagatcggcatctaccgcggcggcatcgtgcccgtcaactaccaaagggtgccgtgtgtgaagaaaggcggggtgaggttcagcatcaacgggcgcgactacttcgagctggtgctcatctccaatgtcggcggctgcgggtccatccagtcggcgtccatcaaggggtcgcgcaccgggtggatggccatgtcccggaactggggcgtcaactggcagtccaacgcgtacctcaatggccagagcctgtcgttccaggtcaccagcagcgacggccagaccaaaaccttccccgacgtcgcgcccgccagctgggggttcggtcagacgtttgcgacctcgcagcagttctcttagtatagacacatctttgttttctgcctcgttcgcttgtcgtttatatatatgcctcactcggctcggccctcgatcaatgccttgtaaagtttaccggcctttgttcaaatgccccaccacctgccgcgatgcaggagatatatgatatatatgctttgacttgtgcttaaaaaaaaaaaaaaaaaagggcggaccgctcacattata

SEQ ID NO: 6568 - DNA, 5347 bp, Zea mays
  misc_feature (5210)..(5210): n is a, c, g, or t
aaggtcttggaaagcatttgcaacggtccgcgaccgtggaaagaaagaatgcaacattgacggttccagttctgagaaggaagaatgtaacagtaactgctcgtcaatgaatggtatgcaagtatcagataagatatctgttgatgaaacgaataagggagctgatgtaagcaagttaatgccagaggatgctttctttcgcttgaagagtttgggagctggccttcatgaaaagtccctcgaagagctcacaaagatggcccataatttctatgatgagactgcactcccaaagctggtggctgatttcgcgtcccttgagctttctcccgtggatggaagaaccatgaccgatttcatgcatgcgaggggacttaatatgtcctctttaggccgggtggtagagctagcacggaagctcccacacatccagtctatatgcattcatgaaatggttattagatcctttaagcacatcgtccgagctgttattgctgctgttggtgacatgcaaaatatttctgcagctatagctgaaactctaaacatattacttggatctcccagacttgaaaatggtgctgacacagatgcccatattgacaataatttgcgtttgaaatgggtagagagcttcctttcaaaaagattctgctggaaactgaaagatgaatttgcacacttacggaaatttatcattctgagaggtctctgcagtaaggttggactggagctagttgcaagagattatgatatgaatagccctaacccatttgacaaatctgacattgtcagcattgttcctgtatgcaagcatgtggtctactcatctattgatggtcgaaacttactggaatcatcgaagatggcattggataaaggaaaattagatgatgctgtgagctatggaacaaaggcattgtccaaaattatagctgtttgtggtccataccatcgactgacggctaatgcatacagccttcttgctgtggtgctttatcatactggagattttaatcaggcaactgtatatcaacagaaggcacttgatatcaatgaaagggagcttggtcttgatcatccggaaactatgaagagttatggggatttatctgtcttctattatcgccttcaacacattgaaatggctctaaagtatgtcaaccgtgcactatatctgcttcagttctcgtgtgggctttcacacccgaattcagctgccacctacataaatgtggctatgatggaagaaggcatgggaaatgttcatgttgctcttcgatacttgcatgaagccctgaagtgcaacaagaggtcgcgtggtgctgcgcccggccagactgctgcaagctaccatgccatagccattgccctttcaatgatggacgcgtactccctaagcgtgcaacatgaacaaacaaccttgcagatacttcaggagaaactagggcaagatgacctccgaactcaggatgctgctgcatggctagaatattttgagtcaaaagcattagaacaacaagaggcggctcgaagaggcatgccaaaacctgattcatctattgcaagtaaaggacatcttagtgtatcagatcttcttgacttcataagcccagaccaggaaagaaaagaaagggatatgcaaaggaaatgcaggcgtgcaaagaataatatcagagctcatcacggtgaatcagttgaagagaaggagaattttcagcttgtttcaggatctcctcttgaagcaagcaaagacagttttcaagaagaaaaactggatgtgaatcctcctgctgtattagaagaaaattatgctgcccatgatgagcagaagcaatgtgatgttttatcaccagaagaatattctgatgaagggtggcaagcagctagtatgagaggaagatctgcaaatgtaaggaagaaaagcagtcgcaggaaaccggctcttatgaaattaatggttgatcattttgaagatggtcatacaggttctgtgtataggactggtttacaacctcaaacaaaaggaggcaaagaagattctgtaagtgctcctagccagctttcatttggaagttttttgaaaaccgacaagttgaatggggattccagcattgctgaagataagacgtgcaatggtagcgctaaccaagaacaacggacaaagccaacaggaattaacaggccaaccagtatcgcttccaaatttatatcatacaaagatgtggctgtttcgccccctggcacagtattgaaacccattttggagaagaaggaagcaaaggagaaagatagtggacgtgatattgacctagcactgtcatccgaggaagaagataaaaagtttacagaaaaagagaaagaaaagccaagtgaggacagtagcaaagagattctttcaagtcagcgagacttagagagtcatgcagaaatacctcctgacagcaacagtgatgaaggcccatctgcagctagtaaagcgtctggaagcaaactgtcagcttcagctcctccattcaatccaggatcagtgttatcaatgtcccagccatacagcacggtggcagtatatgatgccagtgctattcttcaggcaataccaagtcaagcaatggagattctcccttctgccattgacactagagtgcctcgtggtcctcggtccaccttgtactatcgtactgggcattccttccaaaggaaacaaggttacacgcacagccagagcactattgtaaggggtagctactcccccacaaccatgaatccacatgctgctgaatttgtgcctggaaaaacttcgcaacaatctgatgtggctgacagagaacccagtcctgctaatcctgtggccaattctgatctggatgttgtatcgcagaccacagatgaagcgagggccgaaacgcctgccacagaaaaggcaggtcaggttgagaaagtcgtttcaggtaaaggaaaggaaaacagggggaaagacatcgtgagaaactcatacaaaacagaacttgcaaggcaaattttactcagtttcattgtgaagtcggtgcacgacagtttaggtccctcccgggctgaaccagagaggaagccaagtggatcagatgaagctagtaatgaacagaccagcgtcttaggcaagaacgcttctggttctggtcgcaaagatccagataaacaagagaaagcgacggaggttactaagggcctgaaggatacagagggattcactgtcgtttcaaaacgccgaaggcgtccccagccgttcatgaaccccataaatggcctatattctcagccgtctatttgcacctctgtcagttaaggtcattgcgttttcgaagacctgcaatattttgagagatggacctttgccttcgcctttgcctttgcttagaggattggtagcagagattttccctatccaagtgagctgtgagcagcgagcatttagttaaactgtacaaaaggtttccgggataccctttttgtaataaaagaaactgatgtattccgcagtagctgtagcgctggatataatgttcctttgtatgttatatatgacagaatcataggaaatagcagatgttaagttaatccgataaaaaaaaaaaaaaaaaggggcttaaagaaaaacctcatgttgtgagccccagttaatcattgcaatttgcaaatatgctgccagactgccagagcagaagaaactgaatcttctaggcgccaagagttcgaaatcttattcatggaggcatgtctttggataccttgccagcgggtgagcagcacttcactgagaagcaattgcagctgcagacccaccagatcaccagaccaccggggcccggacaggcgtgaactggtcgatcggcagttttaagctgttgcagcttatactgtaggagtgtagtagctacgtaggagcagcctgtactgtagctgctgagaccacacaaaaactgaatcagttacaaacttgaaactttcattaattgctgtgaaccaatatccgatcgagattgttgtgaatacgctacatatacatattttatgacttattttgcgcttaaatttgaaaccggctctgtatggccattgcatgcggtatcagaatggcagcaacaccttttgacagcgaaataagctgcttcacagcagaacacagaacgccgtcgcaggctcgcagctagctgctatagcagcagcaggaggagccgaggaggagacagagtgagtagtccggacccggtagacgctgcagtgcccctaccagatcccagaggctaccagctacagcttccccgccataactgcttgcgaggtcaactcggcccaactccatgcatgcatgggcaagggcaaggcagcgctcacctgccgccctgccaatggccagcgccagcccatgccatgcaatgcatcggtagaaacaatataatcctggacggcgtagtgccaactgccagctgccatgactgccaaagtgccaaggccatcctcgcagcatctacctcgcttgcttcgcctctctgggggctctgcattctgaccctggacggcggaccggccgtgggtggctgctgcacctgtagactactcgtacatgctcacgcatggcaacgcagtgctgaattgctgctggctgatgctgcttgctacagggtacagcagtacatgctgcattcgctgttttattgctggcgcgcgcgtccatttactcggagagaccaggaccggcagaccgcaggcaggcatatgagctattgggcatgaacgcacagacagacagacagacagacagacagacacgcgcacgcaccacctgagctccgaatcaataccactaggctaggcaggcaggagtagcttgaaacctgtcacggggatcccgttgggttggggacttgagagatgtcggaggcaaggcgttcgttttgtatcgcttgccccggctggcttcgaattcaattcgctttgcttgggcagccagtgtcgcacgtgtgcgcggcggcgggctctcccaatcatgctttagctaaccggggatgatctcgttcgtctcagcgcagttctcaagctagggatacatacatacatacgttcccggccaacgcgtacaaatcatgtgaggcagccatcagcagatgatgagctctgcgatccatcgtctgcgctctgccgcagctagccacggaggcggcatggcgccngtgagcccgtgacggccctgtggtggctacctcccacttcccacacacatattcctctcctgtagatgacaacgttctgcagatgtcgcccgcccacattgcagctacgtactccctccgttttctttttatttgtc

SEQ ID NO: 6569 - DNA, 2657 bp, Zea mays
ctatatatcaacagaaggcacttgatatcaatgaaagggagctgggtcttgatcatccggaaactatgaagagttatggggatttatctgccttctactaccgccttcaacacattgaaatggctctaaagtatgtcaaccgtgcgctatatctgcttcagttttcatgtgggctttcacacccaaattcagctgccacctacataaacgtagctatgatggaagaaggcatgggaaatgttcatgttgctcttcgatacttgcatgaagccctgaagtgcaataagaggttgctaggagctgatcacatccagactgctgcaagctaccatgctatagccatagccctttcaatgatggatgcgtactccctaagtgtgcaacatgaacaaacaaccatgcagatacttcaggagaaactaggggaagatgacctccgaactcaggatgctgctgcatggctagaatattttgagtcaaaagcattagaacaacaagaggctgcccgaagaggcatgccaaaacctgattcatctattgcaagtaaaggacatcttaggtatgaaactacaaataatctgagcagtttcatttataaaatatttaaatttagattgaaacatctacctttccagtgtatcagatcttcttgacttcataagcccagtccaggaaagaaaagaaagcaatgtgccctggaagtgtcggcgtgcaaagaataataccagagctcatcatggtgaatcagttgaagaaaaggagaatttccagcatgactcaggatctcttggagcaagtaaagacggttttgaagaagaaaaacctgatgtgcatcctcctgctgtattagaagaaaattatgctgcccatgaagagcagaagcaatgtgatgttttatcaccagaagaatattctgatgaagggtggcaagcagctaatatgagaggaaggtccgcaaatgtaaggaagaaaagtagtcgcaggaaacccgctcttatgaaattaatggttgatcgtttcgaagatgatcatacaggttctgtgtataggactggtttacagcctcgaacaaaaggggagaaagatgattctgcaactgctcctagccagatttcatttggtagctttttaaaaactgacaagttgaatggggatcccagcattgctgaagataagtctttgaatggtactgctaaaccagaacaacttacaaatccaacaggaattaacaggccaaccagcattgcttccaagtttatatcatacaaagatgtggctgtttcgccccctggcacagtattgaaaccaattttggagaagaaggaagcaaaggagaagggtagtggacatgatatttatctaacactgtcatccgaggaagaagatccacagtttacagaaaatgagaaggaaaagccaagtgaggacagtagcaaagaggttctttcaagtcagcaagacttagagagtcatgtagaaacacctgacagcaacagtgatgaaaacccatctgcacctaagaaggcatctggaagcaaactgtcagcttcagcgcctccattcaatccaggatcactcttatcaatgtcccacccatacagcacggtggcaatatatgatgctagtgctgttattcaggcagtaccaaaccaagcaatggagattctccctcatgccattgacactagagtgcctcgtggccctcggtccaccttgtactatcgtactgggcattccttccaaaggaagcaaggttacacgcacagccagagcactattgtaaggggtagttactcccccacaaccatgaacccccatgctgctgaatttgtgcctggaaaaacttcgcagcaatctgatgtggctgacagagaacccagtcctgctaatcatgtggccaattctgatctggatgttgtatcacagaccacagatgaagtgaaggctgaaacacctgccactgaaaaggcaggtcaagttgagaaagtcgtttcaggtaaaggaaaggaaaacagagggaaagacatcgtgagaaactcatacaaaacagaacttgcaaggcaaattttgctcagtttcattgtgaagtcagtgcatgacagtttaggttccgcccaagctgaaccagagaggaagccaagtggatcagatgaagctagtaataaacagagcagcaacttagtcaagaatgcttctggtcgcaaagattcagataaacaagagaaatccatggaggttcccaagggcctgaaggatacagagggatttacagtcgtttcaaaacgtcgaaggcggccccagccattcatgaaccccataaacggcctctgttctcagccgtctatttgcacctctgtcagttaaggtctcattgcattttcaaagacctgcaatagtttggaagatggaccattgcttttgcttaggggttggtagaagaattttgccgtatccaagcgagcagcgagcatgtagtcaaactgtacaaaattttccaggataccctttgtaataataataaaaaaaaactgctgtaatctgcagtagctgtagcgctgaataaagtattcctttgtatgttagatatgacagaatcagaggaaatagcaagcagatgtttaggttaatccaacatcccagtagtgcttctcttaaaa

SEQ ID NO: 6570 - DNA, 2294 bp, Zea mays
acgaactaaactgttcctccagtcgctgaagccttgcctcaactgctaaaccagaacaacttacaaatccaacaggaattaacaggccaaccagcattgcttccaagtttatatcatacaaagatgtggctagtttcgccccctggcacagtattggacatgatacttatctaacactgtcatcctgcaagacagtagcaaagaggttctgaaaactgaagataagttgtcatgtagaaacacctgacagcaacagtgatgaactgaagctagctgaaaatatgtggtttctgaaaactgaagataagttgtcaagtctagagaaagtacttcaatacattacatcacaaacaagtctagagaaagtacttcaatacattacatcatctgaaaactgaagctagcctggaaactagtttaagacatgacatctgtccttattttctagacagcgttcatcttcttctttggagtcagttttttgacagcacgcctcactctcttctgtggggtagtaccaactgtttcttgtggggcagtctggagcgccggcgaggggcgccacggagctgtcgggagcgccggcgagggccgggagcacggagcagtcgcgagctcgtcgaggagagagcaggagcgcccagttcagtcgaggagacgagcagcgctcgggtagacggacagagagggagaggaagaaaggagcgagctcgcgatccgttttgccgaacgggaaatccttagtgcaacgtaaatgcagccggaacaagctaatcgatagcgcgactgttaaaagtgcccacgaagacaattttccaaccggaagcctattataatactaagattccaattgcaaggttggggataccaaacttccgaagcccgcagttcgggatacctctgctccaaataactcatcgcccgatgccgaatctccaatccatccgtcgtgtgctcgctctagccttttccttctccctcgcgacgcggcttcgcctccctattctggcacgttcccggttcaacggaccacgacgcattcccgtcccccaactcagcagaaataacacgccgagggcgcaaatccccgcgatccccacgccaatcggagaagcgagccgtcgccgatcgattcaccaccggacccaatcacaagtaaacctgcgccgggaaaccaaatccttctcaattccttcgcgacgcggaccgcaagccgaaggcgcgacgatgtccggagcggcggactaccaggagatggtggcgtcggtgccgccctcgctgaaggccatcacgctgacgcacgttcgctacagccggggcgacccgctgggtctcttcctcgcgtgggtctccctcgtcccggttttcatcagcctcggcggtttcgtctcccacttcctcttccgtcgggagctccagggcctctgcttcgccgcagggctcctcgtctctcaggccctcaatgagctcatcaaacactccgtcgcgcagtcccgcccctcgtactgcgagctgctggaggcctgcgactcccacggttggccgtccagccactcgcagtacacgttcttcttcgccacatacctgtcgctcctctccctccgccggtcgcgcgcgcgccaggtgatcgccgccgtgccatggccgcttgccttcctcaccatgctgtccagggtctacctagggtatcataccgtcgcgcaggtgaggacccctgaatttcggatccgatctgactagatgtgtttttttttgttcagaaatggtgcacccctacattaatcagtggaggttgtcctcctgcctcgcttgatgttttaaactgtggtgccctgtgacagatgaaatgaaaaattggaaacgtttatgtgctttaaggaaatgttgctacttcagacatttttaagggggtggggcttctttggtttcaagtgaaagttcgctaaggttgaaaatccacatgtgtgtttactaatgaactaaggacagaagtactaaagatcagcagtataacaaaaaagtgataacaaacccttgtagtctgagcaagttagaccatgccaccagggaaactactctacatttaaattgtaagtcattttagctttgtcctaagtcattttagcaaatgagtcaacactgtttcactatcttgaaagaaaactgtgaaaggttaatctccataagtatatatgaaatgagcatacgaattctagcaaatcattgtttaggtcggaatcatgaactgtctctctgtttttctgaatacaactgtgcatgtatacccaattgga

SEQ ID NO: 6571 - DNA, 1253 bp, Zea mays
ccggccgggccccccccgggcccggccgggacgacgcattcccgtcccccaactcagcagaaataacacgccgagggcgcaaatccccgcgatccccacgccaatcggagaagcgagccgtcgccgatcgattcaccaccggacccaatcacaagtaaacctgcgccgggaaaccaaatccttctcaattccttcgcgacgcggaccgcaagccgaaggcgcgacgatgtccggagcggcggactaccaggagatggtggcgtcggtgccgccctcgctgaaggccatcacgctgacgcacgttcgctacagccggggcgacccgctgggtctcttcctcgcgtgggtctccctcgtcccggttttcatcagcctcggcggtttcgtctcccacttcctcttccgtcgggagctccagggcctctgcttcgccgcagggctcctcgtctctcaggccctcaatgagctcatcaaacactccgtcgcgcagtcccgcccctcgtactgcgagctgctggaggcctgcgactcccacggttggccgtccagccactcgcagtacacgttcttcttcgccacatacctgtcgctcctctccctccgccggtcgcgcgcgcgccaggtgatcgccgccgtgccatggccgcttgccttcctcaccatgctgtccagggtctacctaggttatcataccgtcgcgcaggttttcgcgggagcagtagtgggcctcgtgtttggtgctatctggtactggattgtcaataccatgcttgttaattacttcccaatgattgaggagagtgcaatcgggaggtggttgtacatcaaggatacatctcatattccagatgtgctcaaatttgagtatgataacgcaagggcagcacggaagaaagttgctactgattgatcttgttatgcttctggattgcattttgctgttgttaaggcgccttataagaattgtgcatgatatttccttcagttatgctacacacgggcacatctgcacatgtagcagcagcaacattcagagaagaaatgctcaccggagcttgtttgatttagctcttcctgggcatacgccactttgtttttccccgtatcagtcactagccagacattattttattaaaggttgttcgactataacttgataattgcttacatttgaaaaatgacgtgaacaatacatgagttcatctctgcaaaaaaaaaaaaaaagggcggccgccaccgcggtggagctgcca

SEQ ID NO: 6572 - DNA, 2682 bp, Zea mays
aacgacctccgcccattccgctcgcggttgcctccgcctccgcctccgcctccgcgcctaacccaatccagagccagggcagggcaaccaaaccctaggccctcgcgctcgtggtatccatgggctgaccgcgtcccggtggggagcccggatccagagctagggttccgtcctcggcggcaacgccatggagtgggacagcgagtccgacggcgccggcagcgtcggcgtcgacgagcaggaagaggagcaggagcaggaggaggaggaggaggagcggggaggcgagggaggaggtggcgacgccggtgggatgttcacgctcgcgattgaaggcatgctgcgcgcgtcaggtccgtgcgggctcgtcgtcaccgacgcgctcgagcccgactgtcccatcatctacgccaaccgcggcttcgaggaggctacgggctaccgcgccgaggagtttcttggcaggaactgtcgattcctgcagtgtagagggccatttgctcgaaggagacatcccctagttaatgctgcagtggtttcagagattcaaagatgcataaacaacagcattgagttccgtggcgatttattaaatttcagaaaagatggatcgccactgatgaacaggttgcatctgacccctatatatggagatgatgaaactataacccattatatgggcatccagttcttcactgatgctaatgttgatttgggaccattgccctgtccaatgacaaaggaaccagtgaggtcaacacggtttgctccagataactcatttcgacccatttctgcggggccagagcacagcaatttctgccgggaatattctagcctcttccagttaacggatgaagtgctttgccaaagtatactgtcaaggttgtcaccaagagatatagcatctgtgagctccgtgtgcaggtgcttgtatcatttgacaagaaatgaagatctctggagaatggtttgccagaatgcttggggtagtgaaactactcgagctcttgagacggtgcccgctgcaagaaggttgggctggggacgtctggcaagagaactgaccaccctggaagctgttgcctggaggaaattgacagttgggggtgcagtggagccatctcgatgcaatttcagtgcctgtgccgtagggaaccgtgttgttctatttggtggggaaggtgttaacatgcagccgatgaatgacacgtttgtattggatttaaacgctagcaatccagagtggaggcatataaatgtgagcgcagctcctccaggtcgctggggccatactctgtcatgcttaaatggctcttggttggttgtttttggtggatgtggaaggcagggtctgcttaacgatgtattcatgttggatttggatgcaaaacaaccaacctggcgtgagatacctggagttgcacccccagttccacgttcatggcacagctcctgcactttggatgggacgaagttagtagtttctggtggctgtgccgattcaggtgtacttctcagtgacacatatcttcttgatgtaaccatggataggccagtttggagagaggttcctgcatcctggaaaccgccttctaggctggggcactcaatgtctgtctatgatggtaggaagatcctgatgtttggtggtcttgctaagagcggccctctgcggctcaggtctagtgatgtgtacacaatggacttaagtgaagaagaaccttgctggcgatgcctcactggtagtggaatgcctggggctggaaatccagctggcgcaggtccacctcctcgcctcgatcatgttggtgtgagcctgccaggtggaagaattttgatatttggtggctcagtggcaggtcttcactcagcatcacagctttatctgttggatccaactgaagaaaagccgacctggagaattttgagtgttcctgggcaccctccccgattcgcctggggccacagcacctgtgttgttggaggaacaaaagcgatagtgcttggtggacaaactggggaagagtggatgcttacagaaatacatgagctctctttggcaaacaactcagtctgagttcatggtggacaaaccggggaagagtggatgcttacagaaatacatgagctctctttggcaagcaactcagtctgagttcagggtggccaaaccggggaagagtggatgcttacagaaatacatgagctctctttggcaagcaactcagtctgagttcaggaatggttcttagtcatgctccttgcaaactaattgcggcttcttatgcgacctgaagcttgattgccttcaccttcagagtatcatctggcagctacatggctttacttgggagatgaaatggttttcactggtttgctcgctttatgtaggcagagggtagcgatatgttcatttttattgccgtttgcttggccttctttttaccagataattacagttcataagctactattgtggaatgagtaccagattttatatgtattctcagatgtttccgacttgcaatatgttaggaaaacaaaggactaccttgtacatagtttaagcttttgttgtacggtacatggagaccttgatgctgctgtcttgcggcacaggcgcacaactgctgagatggcgtgatgtaaggtgatcaccgatcgaccatgtttttgtgc

SEQ ID NO: 6573 - DNA, 3874 bp, Zea mays
atcaatgatgggtagtggatatgcatatgggttaatttttttagtgttatgaatatagctttatgtgcccactgagtatcttatccaccgccatccctacccgtaaggttggtggcacgtttacgtattctcttctcacccgtcctagcggcgaccggtgagtcaaacataacacgcggcagtggcacgacttgcatcgcccgtgcggcgccgcgccatgcaaaaatccaatttgtgaacgtggcgggtatgtcctttatataaaagacgaaacacacgcatcggcccctcgggcccggccgggatcatctattgaactccactcacagacagcagccacagcggagcttaattagcaatcattgactatgggtgcgctcttgccatggctggcatggttgctcgtctccctcgtcggcgtctacctcctcggccatctcgtgcaggcccgtcgtcgtcgtggtctaccgccgggaccccacccgctgcccatcatcggcagcctccacctgctcggtaaccaaccgcaccgctccctcgccaggctcgccaagacccacggcccgctcgtgtcgctccgcctgggctcggtgaccacggtggtcgcctcctccccggccgccgcccgggagatcctgcagcggcacgacgccgccttcagcaacaggtccgtgccggacgccccgggcgcccacgccaggaactccacggtgtggctgcccaacgcgccgcgctggcgcgcgctgcggaagatcatgggcacgcagctgttcgcgccgcacaggctggacgcgctccagcacctccggcgcgacaaggcgcgggagctcgtggaccacgtgcggcggctggcgcgcaggggcgagcccgtgaacgtcggccgcgtcgccttcaccaccagcctcaacctcgtctcgcgcaccatcttctcccgcgacctggccagcctcgaggacgacggcgcgtccaggaagttccaggaggtggtgacggacatcatgggggccgtgggcagccccaacgtctccgacttcttcccggcgctcgccgttgccgacctgcagggctgccggcggcggctggcgcggctgttcgcgcggctgcaccggatcttcgacgaagagatcgacgcgaggctgcgtggccgcgacgctggcgagcccaagaagaacgacttcctcgacctgctgctggacgccgcagaggacgatgacaacacggccggcctggatcgcgacacgctccgttcactcttcacggtgagccgcagaaactttccactagctacgactattgtatattcactgaatttctttctcttcatactctgcgcgcgactttaacgctgctgcacacgaaacagatacggctttcacacaaactcacaaaaaggaacgtcatcttcatatactagtaaaaattggcgtttcgtgttggattactctcgagagacgtgacctttatgcatactttacaagaattttgtaacttggtattcaaattgaataccaatgctggtgctgccgagtgctgtgcctgtgcctgcgcagtgcgcagcctgtgctgtgctgctgcctggtgctggtgcgtgacagcgtggtgcctgggcgcctggctgcctgcttggtgcttggtgcttggctgcttgatgccgagtgccgagtgtaggacgccaggagcaagactgcaggacagcaggagcccagcccaggtccgtgtgccgagcgcagatgtgcagtcgtgcagaggacagacaggcagtagaaactatcgggtactttgagtatacccgaacccaaacctgatagtttgggtatccgaaattttagatacccgaaaaatttggatcgagtttgggttgacctcctagttactcgaaaatcgaaatatataaaactcgaactacccgacctgaatttcgggtatactggaacgcacagtcctagttaatatatattactaaaatctaaaaaaacatcattaaaaatttattaagacaaatatacacatttccaagaatatatatatatttatctaaataacaatatatcaaatatgttcagattttgtagtatattgaacgtgcatgcaatgcgaacctatatgtaattcagcttaagagattgcatagaaccatataactgtaggctttgctgtttccaagcatgcaccacgtaaattaaatgtttcagaactcagaagtgagtttcgatcgttaaactaggtacacagaacaatgggtttaggaatttcatggatttctatatatatatcacagaaggccgctgtatttttttgtaaactaaacatgaaggccggctttgtagctcgttaaaaaaaattaacatcttgcttatgttttttttgtatatatatggccttcatgtatagtttacaaaaaatatcagttactgtgtcattaacgtctttgtagctcgttaaaaaaaacttaacatcttgcttatgttttaggacttgttttctgctgggagtgacacaagctccagctcagtggaatgggcaatggtggagctgcttcgaagcccgggttcaatggctaaagcatgcgacgagcttgcaacagtcatcggcccaagaaaagacatcgaggaatctgatattgggcggctgccctacctccaagccgtggtgaaagagaccttcaggctgcatcctgctgccccgctgttgctaccgcggcgtgcccaggccgacgtgaagatgatgggctacgtgattcccgaagggtctcgagtgttcgtaaacgtatgggcgatgggccgagacgaggagacgtggcctgagcctgagaagtttttgcccgagaggttcctggggaagaagacgccgcaggcggttgatctcaggggcggggacttcgatctcatcccgttcggtggaggacgccggatctgccctgggatgccgctggcgatcaggatggtgcatctgctgcttgcgtcgctcttgaatcagtttgcatggaggcttccggctgagctagagaggaatggagttgacatggctgagaatttcggcatcacgttgaccaaggccgtgcctctttgtgctatagccacagcgatctgagtcggcaagctattctattctagttaactattctatggtcgatatatgtacatgtatccttatcaaatttcgaaataaacttagcaaataggttagaggatgtttggtttgaagaatcaatctattctacatggagtgatgcatcatgattcatgaatccattctacatatttggtgtaatgaactcgttactcgtattcactacacaaggaacagagtactttgccgtcggaacacaggagttcagcttttggacttacggacttaccaaacaacataaagaaagaaaagaaaagcagcacaaggatctcatttggttttctgctcggtagacttcgctcgcttcttctgaatagaaattaaaatagatgcagatacactacctaccacggtgctagacgacgtgtggtcctgcacgctagtgctaatggaatcgatgctagtggtggatccagaaatgtatacttgagctttcggtgtgtaataataagcatggtatttcgttcgtgtgtacacattttttttcctatcgatttttatcgacatgtggcctttttttgcggtgctgtgtgtggccctagcccaggaacaggcgctcgattacatgcgcgcgccgccgaccaaagctatattctcgagggaaaatgtacatacgtgctggtaaacgatcgacggcgctagacaatgtacatgcatgtctgatttctgaactacctttgctatcggtcagagcccaccttatgaacatggtcttgataaaaaacatgtaccccattgaccaaag

SEQ ID NO: 6574 - DNA, 845 bp, Zea mays
gtccctccctcttcgcatccctcttgggtaccccgggcccggccggggttccttccgtccatccatccgccatggcgaccgctacgctactgagctcctccttcgccatgcccgccgccgcccgtagggcctcctccccttcctccgcctcattgagcttcgccacgtcgcagctcgccggcctctccctctccgccggcgttgcaactccaaccgccgtcgccctcctccccaagaggcagcagctccagcccattgtcgcgcggcgtgtgtgcccgttcacggacaagaagacgaaccgggcgaacaaggtgtcgttttccaaccacaagacgaagaagcagcagttcgtgaacctgcagtacaagaagctgtggtgggaggccggcaagcgcttcgtcaagctgcgcctttccaccaaggccctcaagaccatcgagaagcacggcctcgacgccgtcgcgcgcaaggccggcatcgacctcaacaagaagtgagcaagaagtgagcccatccgatgagcagccaaactagtgtggggtggcactagcttagcattcacgttcgcagggtcgtctcgtctgtctgtctgcctgcctgcctcctgctgttctttcgcaatcaaaccatatcattatatttcctccccgttttgatttgtgtaccataccaatcagtgtaggcagatcgaggttgcacatatacgtttttggtcccttgttgggtcctctgaatcgatcgtgtctccatttcacagtcgtgatcaatggcagaaagttaagtaacctggtcggctggtcctccctctcacgaattcgctgctggataaagtatagattcaattg

SEQ ID NO: 6575 - DNA, 1482 bp, Zea mays
  misc_feature (16)..(16): n is a, c, g, or t
cctcgaggccggccgntccggttttcctcctccccgtcctctttccgccgcctgcccagacaccacagagcaatgcccggcggccgaaagcgtccggccccgttcgccggtttctccccattcgctcgctccctcatcttctccgccgccacgtcaagctgtccaaaatcgcgtcctctccccgacgcttccaccgccgccgaaacccctcgccaagacgacatgccgcggccgccgtccaagcgcgtgaagcgagccgagccctccagcgacgaggtggaggaccgcggcagcagcggaagcgaagaggagagcttcagcaccagcggcagcgacagcgatgacggggaggagtcctcggaggagctcgagacggtgcaagcggacttcgccttcttcgaccccaagccgagcgacttccatggcgccaggctgctgctcaagacgtacctcgactctaagccctgggacctcaccggcttcgctgatctcatcctcgcgcagaccactgtaggcacggttgtcaagttggccgatgacgaggaggaggaaggggaagggaacggtgttcagaaggccaattctagtactaacaatgacgacgatgatctgtttggtctcattagcgtgctcaatttgggacaacacgccgagcaaaaatgcattaaggatcttaaggagtatctgcttgatgtctgtcccgacaaaggtactaagaagcagctcagatctctgcttgaagagaaagcgtcgagcgtgggcctgctggtgtgtcgccgctttgtgaatttcccttatgaactcgtgcctaagctgtatgacgcgctctttgacgaggtttcctgggcaacagaagatgagccaacacaagaactccaggactccttccggttcaagcactacctgttaatcgtcagaatgcttgagaggaagacccctccaaaacataaatcaaaggcgaacaaagatgatgacgaacctattatctatccaaagtttgaggatgaaatttttcacgagcttagctcatggtctttcacttttccaatacgttctgaagagtcagctcagcaggagatgaagaattacaaggagatgggcttagtgatggcaattaaagcaggcacagttccgaagttcagaaagaagctgggggatttggtgtccgaataggagcgtaattgaccgatgtggaattttgctgctgtccacgtggtttgaacatttccacattcagcttgttgtctgtaacgatgtgattctgactggagcttgaatggtggcaatggtattgttgacattgtcgttgatttgcaacaaggattctgttcgtgaactaatcaagtaaagagattttgagctgggtttgtcctaaggcatgtcttgtagtggtagataagcacagccacacactaggccgaacgccagggatgggagttgaagagtgctggcctcccggtcatcatggatgataatatcttc

SEQ ID NO: 6576 - DNA, 1569 bp, Zea mays
agaggccaagtagcctattcttcctctgttgtttcgtcttcacttctgaatcattttgtttagtattagtcaattctgtttcttacttatgaatcaaatacttgttaactctaaaaaaatggatgccttctgaatctcttatgagttaaatacttaaatggtctcattgcttcctctttttttgtcagaataatataatcggccttagtgccactaaaactggtttcttaaactttaaatctttctgcacagtgactgtaccaatatttttttttctaaatactaattccgttatgaaatattttaaaaggaaaaccagctaccttttgctaatcagtcaagggtaagtttttcccgaaacaagattttggtctccagaattgaaatatggcttttgtttcttgggtgactaccttttttttaaaaaaaaacaggaatatactctataataaatactaccacctgacacggagcttgatcctcgtgtgagctttccttgtgtagggcttcaagagctttccttgtgtagggcttcaacgagaatctctactaagtctgcaagggtagcataccattctttgttctgcatgtcattccttgttctgccatccctattctgcgattcagattcccattcctattccctgttatgcgattcccattctcgtttgtgcggcgtccgctgctccctcctcccttcaccacgcgacgcagcgacacgacgactgttctctcctccctcactcgccctctcctcccttccccatggcgtcttcgcgtctccgatcgatccaagccaccatggattttttcaaatccatcctcgccgagctcgatccgccacagatttctccgatcgatctgaaccgtagcctccccacaggtggagcaggagccagaacttgtcaaattcacctcctccagcggcgacgggtggggcttcgatgacctgctgaagacgctaacccgattgatgtcctgtatagccgcttcgaggcgcagatgcgcacgctccaggcagatctggccacattcacatccgaccctgaggatgtcgactctgcatcgtcgctgaggacaggtcactactcgatcgtcgtaggtcggcggaggcaggggaggagacacaacgcacacacgccggtggcagggccgacccccacacgccgggtctaacccgatcctcgtcgtctgtggttacttcagtgtcatcacggccaccaccgtgcttctctgtgttgccgtcaacgtcgtctccgccacccagtccttccacgctggctatgacgtgcgtggaacgccccgcttgccctgttccattccagtgcaactttccctctcctggatccggctggttcgggtgtggctctgttgttaaatgcactcattcatttgctatgatgtgatcctaagcaactctatttgccatgctcaacactcaatagggaggtgcctcatagagcccccgcttgatctgtggtcgggatcggattagccgctatgcatctcatggtgagtttggttagctactgatgctacatatgtgagcttgcaagtgcgtttatatgt

SEQ ID NO: 6577 - DNA, 1842 bp, Zea mays
aaatgcctcacaggccgaggctcccccgcgcctccgcccacgcgccgcggcagccagcaggggaggaggacacgaatcgtagtcggcctcccgcccgccccggcaattgttgttgctgctgcgcgcagggcggttctggattgcggtctgccccacccacgaacaatccatggctccatctccgcctcggcgtgctgcgctcctcctcgccacggtgcttctgctggcggcggccgggtccacccccggcgccacggctgctggcatcttccaggtgcgccgcaagttcaccgccggggtgggagggggtgctggcgccaacatcagcgcccttcgcgcccacgatggcacccgtcacggccgcctcctcgcagccgccgacctccctcttggcggcctcggcctccccactgacactggcctctattacacggagatcaagctcgggacgccacccaagcactactacgtccaggtcgacaccggcagcgacatcctctgggtcaactgcatcacctgcgagcaatgcccccacaagagcgggctcgggttagacttgacgctttacgaccccaaggcatcctcgaccgggagcatggtgatgtgcgatcaggcattctgtgcagccacctttggcggaaagctgccgaagtgcggcgccaatgtgccctgcgaatatagtgtcacctacggtgatggtagctcgacgataggttcctttgtcaccgatgcgctgcagtttgatcaggtgactagggatgggcagacacagccggctaatgccagcgtcattttcgggtgtggtgctcaacaaggtggggatttgggaagttcaaaccaagcccttgatggaattcttggttttggtgaggcaaatacatcaatgctatcacaactaactaccgctggtaaagtgaagaagatatttgcccattgtttggataccataaaaggaggtggaattttttctattggggatgtggtgcagccaaaagtaaaaacaacgccattggtagccgacaagccacactacaatgtgaaccttaagacaatcgatgttggtggcactactctacaactcccagctcatatttttgaaccaggagaaaaaaagggtaccataatcgacagtggtaccaccttgacataccttccagaattggttttcaaagaagtaatgctcgcggtatttaacaagcatcaggatataaccttccatgatgttcaaggttttttgtgtttccaatatcctggaagtgtagatgatggattcccaaccatcacattccattttgaggatgatcttgcactacatgtgtatccccacgagtactttttcgcaaatgggaatgacgtatactgcgtgggattccaaaatggtgcatcacagtcaaaggatggaaaggacattgtgcttatgggagatcttgtcctttccaacaagttggttatctatgacttggaaaatcgagtcattgggtggactgactacaactgttcgtcgagcattaaaattaaggacgacaaaacgggcgcaacatctactgtcaattcacatgacttgtcctcaggatggaagttccactggcacatgtccccggttctattgttggtaacaacggtgtgcagttatttaatatgctaactccactgtaaaggaaatccatctggttcgtatatcctttccacgaaaaggatcggagagatgtagggctttctttaggttgtgttctcccaccacggaaaacaatggaaacagaaaacactgtaatgctttactgagccattgtttaactaggtaatgctgaggtgaggtaatgttctgtcatttctttgggaaaa

SEQ ID NO: 6578 - DNA, 4393 bp, Zea mays
tttgcctaagttttggtgttcggtttgtggccaaaatgcattaggactaagctaaattttggcagccaatttgtaggccttagttttggccaaaaattggcaaggttttccaaaaatttgtaggcatagctaaaatttgacctacaaccaaataccaaccaaaatagcttggcaatgccttggcatgacacccttggcctacatccaaacacatcgtagtccacaggcacatgcgagaaaacaccaccaccgtggcgcccgcctcgtgtgccagcgtccagccacatgcgccgtgcagcaacacaaccgaccgcacccgggccacgcccgggaaaccccataaaccggacgcggcttctctcctcccatttacatcctcccatgcatactcccaccacgtggctgctttctattggtccttctttatctctctgacttaggcgaagaaatataattagcggaagctgtggcacatatttgtagtattaaaacaatcgaggcctctaacttcgagatcactcatcataaaaaaatcataattttagctaaggattgagcaaatcagtcaacaactacctccaaaatctagatcccaccatgaaaaaacagcaggcttgcggcgacctccagacattacgccttgttactgggcccgtggagcacttcgaccatgcgcgacttgacgaagctggaggcgcaagcaatggaggtcagagatgggcattgcgagcatgtgtttgacagcgagcagcggcgcgggcacccacttcggtttctttgacgaaggccatggcggacctgccttcgattgttgctggccgtggggcagcatctgatggagcaacaactctgatactatgagcgagctgcgagcctgtgtggataggggaacagggagccgacgtagcttctctcctcttggagcagctgggagccgaggagaaaggttgtacgtaccgcttccgctaattatattttttgtaatgagtgatctggatgttggaggtgcctaattgttttaatgttgaaaaatatgtgacacgactattatatttcttcggctgagtcggagagagataaaaaaggaccaatagaaagcagccacaaggttggagtatgcataggaggagagaagccgcgtcccccgcttctcgcgcccggccatctgcaacgccagccgcgggcgtcgcgcccagccacccgcccgtgaaccaccaccagcatagcctggccatggcaaccgcaccgcatgaaaggaaccacacccatcccctccctattttgccatgccactccccgccaccgaccctacctcccccggccctcttctcttccccgggccccccacggctcggcctgacgccaccacgattttctccgcacggcgcaccctcgccgcgtctccgctccacccaccacgttgcggcaagggtgcggcctacgacgcggagtaggaagaggagggagaaagggaggccgtgacgccggctggctatgctgcagcgtgcggctagcaacgcctactcctggtggtgggcatcacacatccgcaccacccagtccaagtggcttgaaataactgtcgttggtaagcatcccatttattcacccctgtcgtatgacgagttcgtattgcacattgcccaatgattggttgattttttttttcctttcttttgttgtgcagagatggaggacagagtaaaggccatgctcaacctcattggggccgatggcgattcgttcagcaagaaggcagagctctatttcaaaagccggccagagctcatcaatcacgtggaggagatgttcagatcctatcaggcccttgccgacagatatgaccggatatccagtgagctgcacaaggccaaccacaccattgccaccgtgtttccggatcaggtgcagttctcaatggaagagggggatagtgaggggttttctaaggcaataggtgggattgatctcagcaacttcaagttccctgcactggaaggcttgtccgtgggctcaggctcacagagcgcaaacaggggcaccagtccggtccccaagaggggggcccaggcacaccggaaggtcacccccaacatgaccaaggagaaggcacaggaggagatagacaagctgcagaaacagatcctggcattacagactgagaaagagttcttgaagacctcttacgacagcgcactaggaaagtatctagacattgagaaacaggtggcccaattgcaggatgaggtctgcaatttgcaggatgctttcagcaccggtgtagccattgaagacaatgaagctcgggcattgatggctgcacaagccattatgtcatgtgaggatacgttggtgaatttacaggaccagaaaaacaaattgactgaagaggcggaggtggagctccgacgagccaatgaggcaattgaaaagctgaaaaccttcaagaacgaatgtggactgcctcatgtgcaaatggatgggcatgatcaccatgaaatagaactggtccatgcactgcccttcgaggattctgatgattctgcgctgaatggaagcaggcttgacctccaggaaatatgtcaaagagtcaaagaaataattgaatcttaccctgagctatcagttgcggaattagcagataaagttgaccgacttgtggaaaaggtgatcagccttgaacttgccactacttcacagaatgctcagatcgatagaatgaagactgagatagatggccttcacgagcgcctgcatgctttggagcaagacaaggtggctttggttgttgattctagtaacttggctgacgggttgaggaaagttgaagaaatgctgcaagaagtacaacaaatttggaagtccgtacaaaatggtttcgagaacatttgtaaacaaatgactgaagccgcccatgaactaactgaattcgtcgaaacattacatgctcctgagcaagaaagcagtgacttcgtggattcatcgcgagactccaaacacgatacttctctggaagattactcaggactaacaagtctgtctgtgcaaaacgagccatccaaatctttacatggcactacaaatgaaactgataaacatgaagaaaccttagaagatcaagcccaaaaagagctagttccaaaagaatctgaagttgagggtaagattctattagaagactatgcatctgtacttcagagctacaaagatacagagcagaagctttcagaaattgagaagataaatcaagattaccatcttgaggcaatgtcagaactgaaggaacttaagagtgccaatgcaacaaaagatgaggagatccactcgcttaggcgcatgctacgttctttgcggaaaaagatgagtgcttctattattgagagtatagagaaggcagaagaaacatccaagataagcagcagtcctactacagaagacatagagattgccaagtcagaagaaacatccaagataagcgccactccaagtacagaagacaaagagattgctgagatagaggaatacattaagcaatggcaaattaatgactcactggcttcttcggttgcagaggagaaatttagagcagaaattgatagggtattaggggagaacttggacttctggttgagatttagcacatcatatcatcaaatacggaatttccaaatatgctttgacatgttgaaaactgagatgtacagattgactgatgaacaggaagacgggggaaattacggctttgctggtagttatcaggtagcaaagctggaatcagcagtactagaaaagaaattcagggatctaaatacagatcttcaagtttggattgaaaagaacgtgctattgaaaggagaggtagaaaacagattttcgtcactatgctgcatacaagaagatatatcaaagatcacaactctggataaatgtgatgaaattcacttcaacccttttcaagctgcaaaattccaaggagaggtgcttaatatgaaacaagagaacaacaaagttgctaaggagctagaagctgggctggatcatgtaagaggtctccaagtggaggttggaagggtgctcttgaagctcagagagaatctcgaggtatctctagaaagaagccatcgagcccaacaaaacttccggaacctgtcaacaaaagctggaattccccttagaacttttctgtttggctcaaagacaaggaaatcatcattcttttcgtgcatgagtcctggggtgcataagtaacacagtggttcaaaggttgggcgtagatgattactgacaaattgttttttgacatttaatcataaagagatctcagtgtacatgtcaattcatatgtgataattgcctttaggccttcaatgtaaaagatcctcatctcctaaaa

SEQ ID NO: 6579 - DNA, 1921 bp, Zea mays
  misc_feature (1417)..(1417): n is a, c, g, or t
gggcgcagaatttggtgcagcagtaatgggcgcagacgcgttgtcccccgggaaggaattgtcgggcgcaggtgacgggtgccctgtggcactcgtgtgctgcatgaaaaaacttagggaggcaacaaatcaagcaactgattagtattctcgttagtaccggtagcaccctcatgctggccaaagttggatgaagattttgagaaggggaacacagcctcatcaaaaataacgtctcgtgaaatatagacgcgactagtttctagatcaagacacttgtaccctttatgatgagaactatacccgataaaaacacaaggtttagaacgaaattctagtttgtgcttattatacggtcgaagatgaggccagcaagcacaaccaaaaactcaaaacaaggaataatttggaggagttttaaatagccgttcaagggggggtcaaattatcaataacccgagaaggaagcctatttataagaaaggtggcagtcatgaacgcttcatcccaaaactttaagggcatgtgcgcatgaactaacaaggtgatgccggtttctacaatatgatggtgttttctttcggcagatccattttgttgatgagtgtggggacaagaaacacgatgatcaataccaagtgaggtaaaaatttgttatgaagtttttgatactccccaccccaatcggactgtatgcattttattttggaatcaaggagacgctcaacatgtgcttgaaattgaagaaaaatacgttgcacatcagttctatcaaccataagataaatccaagtgaatttagtgaaatcgtcaataaagctaatgtaatacttgtagccacccactgagagtggagcggggccccaaacatctgaatgtattatttcaagaggtctagtagtatgatgaatagaaatattgtaaggaagttgatgacttttgcctaactgacaggcattacaaaccgatgataaactggactctttggaataaggtaaatgatgaagacgcaaaatagacctaacgacttgcgatgacggatgaccaaaacgtgcatgccactgatctggccgcaccgacacaaaggcttgatgaagagaagcaatatccgaaggcttgatgggatacagcccggactcacaccgtccttcaaggagtagctgacgtgtttctcgatccttaataagataataccaaggatgaaattcaaagaaaacgttattatcacgagttagtgtatgaacagataacaaatgtttagaaatttgtggcacatgaagaacattattgagtgcaagagggcgactatcggtattaagagaagaataaccagtgtgcaagatttgcaaaccttgtccgttgctgacttgcaccgtgtcaccaccattataattctcacgcatggtgagacgatccnaatcactggtaatatggtccgtagcaccagtatcattataccatctcggatcaagttgataggagcttgtcgccgctactgctgcagagggtggttcttcattgtatgcgtcatccatccggtaccagcaccgaatggcgctatggccttctttgtcgcagatctgacagcgaacgcgaggacgagtagaaggaacacctcggccagaagaaggaggggcacgaccgcgcccacggccacggccagtgccacggccccggcgaccaaaagggccaccacggccggcgacatgagcagatgcgccgacttgaagacgagccgccgtgtggtgcctgatctggcgagcttcataggccagtagatgagcaaaaacatcatccaaggttggagtagacggtagggtggtcatggtagtaacaaatggatcatattcgactggaagacctgcaaacagataggcaagaaactcctcgtcacgaagaggagagtcagcagccgcgagtt

SEQ ID NO: 6580 - DNA, 3020 bp, Zea mays
agaagctcgctgtctgtagcagatgcaatgacggcgcagagcacacgtattgcatgcgggtaatgatggaagaggttccagatagtgagtggttgtgtgaagactgccaaactgctgtagaatctgaaaaggagaatagactagaaaagtctcaggtgaaggttggcacttcaaaagagctttccttagaaggggagattaacaaacctgccattgctgcaaagggaagaagttcatctgactgtgaattgaaggctgggaatatagaaaacaaagagtcaaataccacaaatgagaggaatggcacagtcaaaaccaggacggaagaagatgctgtgacgacatcctcaactagagatatccggccgtttttctgaaactggtggcttgtacatgggggctgactctagaaagagaatggaaccatcacacgagacattcgtgtctgatgctgacaaaggaaagcaacctagccatcaagtatcaacttcattggtggttaatgctctgaagaatcaggcaccacagtctcgtggtaaattgtcaactttccaaatccacttctttcaataactcaaaggtccccaaagtgaaacagctattgaatgaagttcctcagaagccaaaatttttgaaggaatcttggtcctctattatcaataaaaaggaaggaccaatcagcatgactactaagtcagcgaccttcaaaaagcctaagccttgtgagccaacaaacaaggcaaagtcttccgtcttgtcacctgtcgaggagccaagggtgccgaatcagttggcgagccacaatgtaacaaatggtcagtgttctatattggggcctccctctgccacatcatcaatggttgctcctgttctaagaactgatagcacaactcagctgctctctacaagaaataacacagttgactcaaataatttaggttctgttcatctacaaggaaacagtgagctaaagaagcctcgtttagcaaaagtgccgggaagtatgatgctatctaatgctgaaagatccgcaggtgggattcttggttccggtgctcatcgagaagtgattcaaaattcagacccttcacatagggatgctaaaataaaggaccaaactggcttcagacagggtgcttctagcagcaatcggacaatccgttgccaaagatgtaatgaatatggccattctacacatttttgcgaagttgaaaaacttcgtttgtcttcaggaaaacctttgagtgagcgaaacttgaaggatgcatctgccaaaagaaataagacatccgaagttagtacattggcttctagtgaaaaaactccttccagagaaccagagcatgtcgtaaagtgtgctattaatcagaatctgataaatgggcctaatgatggtatacctgccccatccagccatgtaaagaagcactcattatcacctcgagctaatgtgtccatccctgggagcggagtagattgtagcaagcctaagttcaaaaataatgatccatctctatctggcacagcaggaatctttgttcataatggtcgcattatgccaaatgatcatagggatgaacctgctcaagggttttcagctggtgatgaaccaacgtcttcaactgtccctgagctgggctggatatggcaaggtggttttgagctgcagaggactggaagttcaccggagctgtgtgatggtttccaagcccatttatcatgttctgcttcacagttagtgctggacgcagttaagaaattcccttctaaagtccagcttgaggaagttcctcggaagaattcatggccaacacagtttcagaaaaacggtccaacttatgacaacataggtctttttttctttgctagagatgttcaaagctatgaaaatcactacagtaaattagttgagaatatgctgaagaatgatttagttctcagaggaagtgttggtactgttgagttgcttatattcccttccaatatcctatcaaagaacttccaaaggtggaatatgttgtactttctatggggtctattcagagttagcaaaaaagattcctctaacctcccatcttatctatccacaagtagagtagaacaaaattttaatgatgatctccaggccatggattggatgccatctacccattcattctcacagaacaggagtgatttagccgaactggaccctggtttgttaaagtcaactaattttgaaccgagtttggaagccagtcgtgaggtgtgtttggatggagagaactctttgaatcaacttgtacgcagaagagctctagatgatcacctagattcagatgcaaaagcatgttcaacgattagcaatggtgccatgggttcctctgccatgtctatgcaaagaaaacatcagaaacctgattatccagaacatcaagataaaacgagggacacttttggtggtaatgttagtgaaagagatttcgatgtgaacacggtgccagttacttgttctgtctccttaactcaccttcaggaagaacctggtaagctgagcacagccatcgacctcatggatatagaccatggggttagcgcaggtgcactggatcgttcacatgcatcaggtggtgcaggtaaaagaagttttgagacggccgaagtagctgatgaagtacccgagcataagaaaactaagctggataataatgcctgtacgaatgatggcaatagcgataaactaatgcctggaagctcaagcagtgatggcaagcgcgtgtttccacttgatctaaatgcagtgggggatgaggacatcgtaaatattccagccttcaggtgatgaagagttcgctgttccattacaaaccaaccgtggtggtttggttcagaatgagagatctgcattgtaaatcgcatgtgcagtttttggcctaatgttttcagacaacacttacagatgtgatgttcccctctttggcagtgaataattctgctccagaatatgcttacagatgtgatcttaaaaaactcgagcccgg

SEQ ID NO: 6581 - DNA, 2675 bp, Zea mays
ggcgcctatctaattatcctagtttttaaacccctatgaacagtgtaaataatcgtaatctattggaaggatatggaataagattacaaccgtaacaaacataaggtacaagggatttctcgaggccagtgcatgcctcaggtcaactggaggagatacttgtagaggtagaaagggagaggggagcagagaaggccagaggaaaagacagaaagccctgttccccgtgtgtgctagctaggatgttgtttgcgtccggaccgagggcaatggcaagcatacccaacaggccaacagccaacaccagactcatctggatgcttgtatcgatttagtaaaaaaaataatagcgacaaaaattatacacacacatctattacacaaaatgagaaatataaatatatttaggttattttatgcctaactgcgtttatttttaaatatatatgaatactatactctctcttacaatactatttgttttaacgcttagttttatgtctatatttaaatagataataataaatttaaatatatatatataatatacattaattatgaatataataaaatattaaaacaaattttaagttgaaacatagggagtacttattataagacggaggaaagaaccttttgctttgtgcttcccctcatcctccttcctttctcctccttccctctcactcctggcctggactctccctctaaaagcctccagctagctatcaaccctagcacgcaccacgcagcaggtccctaacatctatcgtcttcttcctccactccaatcgatcagcttaactagctgaggcagcgagctagctcctgaccactccactccacccgtccgtccgtgcacggcaccaattaattccatggcgctgtggtggtactgctagcccgacgtaccagcaagtcgtccccttgagattcaaggggaggatagctgcggcctaggcgtccttccgtccccagtccggcagtcccgagctgagtgcctgagcccccagtccccactgctgcaggagcaggacaggcactagctgatctgggtgcaactgcaagtaccaccacgcaccacgacggctgcacactgcacatgatcgggtcgcccaaagccgcccgcccgtgagatctgatcctgctgctgcctgttccgcttcaattctgacagcaccctagctgcctgcatgcgcgctcgcaagctgatgctgatctgatccaccaccaccaccacccatcacatcgtcgtccggattcaggagtgtgagggatctgatcttattgtcatcgatcgatcggggagatgatgctcaaggatctggcagcaattcagcagcatcaccaccagcagcagctggccgcggccgccgccgacgagaacatgtctaacttgacctccgcctccggcgaccaggccagcgtctcgtcccaccccgtcccgcctcccgccaagaagaagcgcagcctccccgggaatccaggtcagccgtttcccgatctgtcgattcagtaattcatgcacctaccatggtttccgtctcgaccgatgcatgttgtgatggactggatcgacgactgtgctcacctgaatttgttgtctgtctgtctgtctatctatctatccatctgattcggcgccgcgcgcagacccggacgcggaggtcatcgcgctgtcgccgcggacgctgatggctacgaaccgctacgtgtgcgaggtgtgcggcaaggggttccagcgcgaccagaacctgcagctgcaccggcgcggccacatcctgccgtggaagctcaagcagcgcaaccctaaggaggtggtgcgcaagaaggtgtacgtgtgcccggagcccggctgcgtgcaccacgaccccgcgcgcgccctcggcgacctcaccggcatcaagaagcatttcagccgcaagcacggcgagaagaagtggaagtgcgaccgctgcgccaagcgctacgccgtgcaatccgactggaaggcgcactccaaggtgtgcggcacgcgcgagtaccgatgcgactgcggcaccctcttctcaaggttccctttccttcccacgtcgcccgcccatggtcctcctctcctctcctctctatctgctggtacggtgcttgcaattaatgaaatgatccgtgtcctgtgcactgcatggtcgcgtcgcgtgcaggagggacagcttcatcacgcacagggccttctgcgacgcgctcgcggaggagagcgcgagggcggtgaccgccgccgcggcggtcgcgggccagcaccatccgggaccggccgggatgctcttctcgcaggccgccggcgggggcgacggcggcgcggggttacacctgccgccaggcgtgcttgacccgtcgcagacgctgggcggcggccacggcatgtccttgcaagagctgtgcctgaagagagagcagcagcagcagcagcagttcgcgccgtcgtcgtggctcacggcgcaacatcaccagcaggagctggagctgcccggatcggccgtgttcggattggcgaggccgctagaccagcaggagtacatggggaactccacaacggagagcacggcgggcctcagcggcttcgtcggggtcgcgccgtccgccgccggtggagcggcggcctcggcgcacagtcggcgaccgcgctgctgcaggcatgc

SEQ ID NO: 6582 - DNA, 4345 bp, Zea mays
gaagattgtgaggaaggaagaacccccaagtgaattctcactatgatgcaaattcatctacttccaggaagcttgaggctagtaacagtgaggagtttggcacaagagaaactgtttgtgtgctatttcagtttgcctatgataaaatcaaaatacgttcacatgggtaaatttgtatttcattgccttgtctacacattatgtttattcttgtacgactgctaccacatggtagtttgtggtatgcttatgctgactgtcggtagtttatattcaacttgctatacgctatactaaatgtaaaaatggtcgattgcatatttcacgtctgttgaagccgagactgtaacatatgttgttttctgtcaatcattgtgtttcaaaacttaataaaatttgcataaatgtcctacacttcgtgattattgttcttctagtaataccgtaacatagagcaattagcatcaacttttgtcatgcacaaacagggcatcaattaagacagttttagttttgtcctttttttttctaaagtttttgagtaactttgtttcagcatggaacgggaagtgcaagaatctttctatggtttctttgagttacagaaagtagaactttgcaaagtcaataagatgatatttcatgaataaaataatatgggctttattgtgaaagatgtatgaataaattactaacttcattgtactctagtctatatttgaattgatatctttgataaaatatagcaagggttaactggacatattcttgatcttggttgacattttgtgtctggtgggaatacgtcttaattgtaggacactgacatgaagttcttattttgcagactactcgagtgatctccgctcttatctcaaatactgcaaggaagttgtttttgctggaattacatcttcagatgaacagactcatctaatagagatcttttgggatatgtacaaagccagggaggtaatgcactttgattggcaatgttgttaattcttacctatattccttttgcatgaggtggatactggataaaatatcatatatgtaactgttcaattgtgcctattatggatcaattggtttcccttatcattcttgtgcagttcttcctgtccttgctatgtaactaattaagctttaagcgacttgacaagcaggtgtagtgtagcacataagctaagttttatgataaatatctatagaatgcaaatttaatttccatatttgaaaaataggaaaataaccatagaggaacgggggtggggacttcgatttgcaaaactcgaggcacttagttcaacaacaacaacaacaaaaccttttatcccaagcaagttggggtaggctagagttaaaaacccattagaagtatagaacccacgaatgaaggtttggacacatggatagctattttccatggactcttattcaaggctaaatctttgggtatatcctatcctttcaagtctccctttattgtctctttccatgtcaacttcggtcttccttttcctcttttttcattgctttcgcgccttaggatcccaccacgcactgacgcctttggaggtctccgttggacatgtccaaaccaactcaaccgatgttggacaagacaagattctcttcaattggtgctacccctagcatatcatcattctgtttttgatcccttcttgtatggtcacgaatccaacacaacatacatatttttacgatacttatctgctgaacatgtctttttgtaggccaatattttgcaccatacaacatagcaggtttaattgctgtcctataaaacttgtcttttagcttctgttactctcttgtcatatagaacgtcagatgcagacatcacttcatctaccctactttgattatatggctaacatcttcatcaatatcctcgtttctctgtaacattaatcctaaatatctaaaggtgtccttcctcttccgcaaaagaacatacactaagagacatcccctatgaccttatctatcaccaaagcaaaaaggtaagggctcaaagctgattcttgatgtagtcctattctagtcaggaagtcatctttgtctccatcacttgttcgaacactagccacaacattgttgtgcatgaccttaatgagtacaatacaacgtactttattggaactttatctttgtccaaagcccaccaaataatacccattagtattttgtcataagctttcttcaagtcaatgaaaaccatgtgtagatcgttcttttgttccttatactgctccattacttatcttatttacaaaatagcttccatggtttatcttctaggtatgaaaccaaattggttcaaagagatcctcgttattcctctcagacgatgctcgataactctctcccatgtcatcatagtatggctcatcaacttaattcctcggtaattagtacaactttggatatcctccttattcttgtaggtcagtaccaatatacttctccactcgttaggtatcttgttcgaacgaaagatatggttaaacaacttggttagccatactatagctatattctcgagacatcttcataccttaattgggataccatcacggcctatcgtcttaccccctatcatccttttcaatgtctccttaacctcagattcttggatcctacgcacaaagtgcctattggtgtcctcaaaagagtcatccaattgaaaggttgtgtctacattttctacaacacttggttattaacacaaattgaattagacctggaaccttaaaattttgtttggtgtaggatcctgcttagattgtattatgatagcactagcaccattctagttggcttgcacaagctttattgttgaactgcaagttattttgatgcttatcgtgtgccagggcaggatcataatatagaagatcatgtaaaatcccagtcccattctatggcagacattccaattacaaatggagtgaggaaacactaccgagatggagcttttgttaaagcaagttccttttctgcatcttcaggtcatgatgcaatgcaaatgctcaagtcagagatgcaagatcatggatttcattatttgccacctaggaaaccaaggaaatcagatggttatcttcgttataggcggcggcggctaagtggtggctttatttttgttgcacatgctgattattacttgttgctacgtgcttttgcaaagcttgcagaaattgatattcgtatcatgcatattagtgtgttgaaacttgagaagagactcgcatgtattgaggagcgaattgaaagaagcttgaacaccttacataacttttctactggaacagtagatgagctaagatctgtatctgactgaagttcctagtgtagtctcatactctgctagcatggaataccccctccattccttctggaaaaaaaacatgtggtgccattgcgtgactgtggttttgaaggatatacgtagcttgatacctcaggaattgagggcttctttctgtggcctcttggcattggtaagcaacctgagcacaacaaggtcagggcaggatgtgggtctgtatttgctgaagcaatatgtaccaagaattatgccccccttctttagaacgggcataattatatcagggtcctaatcagtactgtggtagattcagcaacagttccagtagtagacctcagtgcttggcagcaatggcactggggatctgcaatcatgaggcagtttcagtttgggaactggagtggcaagaggaaaaaggctggaacctgggctttttaaagaggctaatcagtactgtggtggattcagcaacagttccagtagtagacctcactgcgtggcagcaatggcactaggggatctgggttctgcaatcatgtggcagtttcagtttgggaactggagtggcaagaggaaaaagcatggaatttaggctttttaaagaaatgctatcaatattgtggtggattcagcaacagttccagtagtggattcagcaacagttcgaggtcagtacaattggtcttgtcaaagctgccgacagaactaaaaaaatatccagctgagtgaattgatgtactgccgacatttatttcgttccagcttccgcagcaagagctgatcgtttcaaaggtgacgagaaattggtcgtactagagatgtactgtctattccctgtattcgcaagtttaaaccaattatttgaactactgcagctgtaatccggagccaatataatatagaaaaaatagaagtcggtggattaaacccgtacccaacaaaaaaaaaaaaaaaaaaaaaaaaaaaaaaaaaaaaactcgcgggggg

SEQ ID NO: 6583 - DNA, 860 bp, Zea mays
  misc_feature (836)..(836): n is a, c, g, or t
cactcctacgggcgattggtttcctcctcgccggccgggacatcacggtaccattcaccggagatgactgttgtgagtatcatgtggtcgttagtgcaggtgcaggtgctggtggcggtggcattagcatttctggtaggcggtgcctggtgtggtcctcccaaggttcccccgggtaagaacatcacagccaaatatggtagtgattggctagatgccaaggcgacatggtatggcaagccgacaggtgctggccccgacgacaatggtggcggctgcgggtacaaggacgtgaataaggcccctttcaatagcatgggcgcgtgtggcaacgtccccatcttcaaggacggtctaggttgtggatcctgcttcgagatcaagtgtgacaagccagcggagtgctctggcaagcccgtggtggtgtacattacggacatgaactacgagcccattgcggcataccacttcgacctagcgggcacggcgttcggtgccatggctaagaagggtgaggaggagaagttgcgcaaggcgggcatcattgacatgcaatttcgaagggtcaagtgcaagtatggatctaaggtcaccttccacttggagaaggggtgcaaccccaactacctggccctgttggtcaagtacgtcgacggcgatggcgacattgtggcggtggacatcaaggagaagggctccgacacgtacgagcctctaaagcactcctggggcgccatctggaggaaggacagcgacaagccgatcaagggacccatcaccgtccaactcaccaccgagggaggcactaagaccgtctacgacgatgtcatccccgnccggctggaagcccacactgccta

SEQ ID NO: 6584 - DNA, 1116 bp, Zea mays
cactcctatgggcgattgggtccctcgaggccggccgggacatcacggtaccattcaccggagatgactgttgtgagtatcatgtggtcgttagtgcaggtgcaggtgctggtggcggtggcactagcatttctggtaggcggtgcctggtgtggtcctcccaaggttcccccgggtaagaacatcacagccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagcagagtgctctggcaagcccgtggtggtgtacattacggacatgaactacgagcccattgcggcgtaccacttcgacctagcgggcacggcgttcggtgccatggccaagaagggtgaggaggagaagttgcgcaaggcgggcatcatcgacatgcagtttcggagggtcaagtgcaagtatggatctaaggtcaccttccacttggagaaggggtgcaaccccaactacctggcactgttggtcaagtacgtcgacggcgatggcgacattgtggcggtggacatcaaggagaagggctccgacacgtacgagcctctaaagcactcctggggcgccatctggaggaaggacagcgacaagccgatcaagggacccatcaccgtccaactcaccaccgagggaggcactaagaccgtctatgacgatgtcatccccgccggctggaagcccaacactgcctacaccgccaaataaactaaccaaataataataagtatcaaatggcacacttgatagacctttattttttattttttatttaataaaaggatataaggagtgtgacaaacaacaacacgaatattgtattgtctatgtatctcctatatatgcaatcccaattttatcatggccacattttaaaatggaatatatgatatatatatgtacatatggattctacaaaaaggaccagccagaaccggcctaagatgtgcc

SEQ ID NO: 6585 - DNA, 946 bp, Zea mays
ggcatcacggtaccattcaccagacaaagacgaaagatgactgttgtgagtatcatgtggtcattagtgcaggtgcaggtgctggtggcggtggcactagcatttctggtaggcagtgcctggtgtggtcctcccaaggttcccccgggtaagaacatcacggccaaatatggtagtgattggctagatgccaaggcgacatggtatggcaagccgacaggtgctggccccgacgacaatggtggcggctgcgggtacaaggacgtgaataaggcccctttcaacagcatgggcgcgtgtggcaacgtccccatcttcaaggacggtctaggttgtggatcctgcttcgagatcaagtgcgacaagccagtggaatgctctggcaagcccgtggtggtgtacattacggacatgaactacgagcccattgcggcgtaccacttcgacctagcgggcacggcgttcggtgccatggccaagaagggtgaggaggagaagttgcgcaaggcgggcatcatcgacatgcagtttcggagggtcaagtgcaagtatggatctaaggtcaccttccacttggagaaggggtgcaaccccaactacctggcactgttggtcaagtacgtcgacggcgatggcgacattgtggcggtggagatcaaggagaagggctccgacacgtacgagcctctaaagcactcctggggcgccatctggaggaaggacagcgacaagccgatcaagggacccatcaccgtccaactcaccaccgagggaggcactaagaccgtctatgacgatgtcatccccgctggctggaagcccaacactgcctacaccgccaaataaactaaccaaataataataagtatcaaatggcacacttgatagacctttattttttattttttatttaataaaaggatataaggagtgtgacaaacaacaa

SEQ ID NO: 6586 - DNA, 1627 bp, Zea mays
cgatacttaatcaggggatgcatatacatatacctccaggacaagaaggtcaaacatgctagttttgtattaggattttccaagtggagatttatttgagtttcatcgtcattaaatagctcgccatataagcaaatttgatgacatgacaagaatttaataagaaagatcgagagatgaaacacatgatacttcattttataggcaaaaactattatggtttttttagaaactgtgtaataaaattctatatcgagtaatcccccttggttcttgggccctaggcggtcaccccacccgcctagggatagagctggccctacatgtaaggacgacgacattcccatacatgatgaaaacgacaacatctagagtttttttggagaggcacaaaattggttgcctccaatcacggtgaaatcaacaatgttgtagggctaccggtggtctcctggctccgagatatggagccaattattgagtggccaagagcaaagaccgcttgggcatgcatgcatgctcgacctcactgttgcatgcactgttacgtagaaagctctctcgattaatcgctagcccagccagcctgatggcgatatgggacccccgcctacgccggccggggcatcacagtaccattcatcggtcaaagacaaaagatgactgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacattacagacatgaactacgagcccattgcggcgtaccacttcgacctagcaggcacggcgttcggtgccatggccaagaagggcgaggaggagaagttgcgcaaggcgggcatcatcgacatgcaatttcgaagggtcaagtgcaagtatggatctaaggtcaccttccatttggagaagggatgcaaccccaactacctggccctgttggtcaagtacgttgatggagatggtgacattgtggcggtggacatcaaggagaagggctctgacacctacgagcctctgaagcactcttggggcgccatctggaggaaggatagcgacaagccgatcaagggacccatcaccgtccgactcaccaccgagggaggcactaagactgtctacgacgacgtcatccccgccgaatggaagcccaacactgcctacaccacttgatagaccttttttatttttttattcaataaaaggatataaggtgcgtgacaacaacacaaatattgtattatctatgtatctcctatgcaatcccaattttatcatggacacttttaaaatgaatacatatttgcggcctaatcgaaatatatgatacatat

SEQ ID NO: 6587 - DNA, 1041 bp, Zea mays
  misc_feature (913)..(913): n is a, c, g, or t
  misc_feature (963)..(963): n is a, c, g, or t
  misc_feature (971)..(971): n is a, c, g, or t
  misc_feature (981)..(981): n is a, c, g, or t
  misc_feature (995)..(995): n is a, c, g, or t
  misc_feature (1003)..(1003): n is a, c, g, or t
  misc_feature (1008)..(1008): n is a, c, g, or t
  misc_feature (1012)..(1013): n is a, c, g, or t
  misc_feature (1024)..(1024): n is a, c, g, or t
  misc_feature (1041)..(1041): n is a, c, g, or t
actcctccgggcgattgcgtttctcaaggccggccggggcatcacggtaccattcaccggacaaagacgaaagaaacgcctattgtgagtatcatgtggtcgttagtgcaagtgcaagtgcaagtgctggtggcggtggcactagcatttctggtaggcggtgcctggtgtggtcctcccaaggttcccccgggtaagaacatcacggccaaatatggtagtgattggctagatgccaaggcgacatggtatggcaagccgacaggtgctggccccgacgacaatggtggtggctgcgggtacaaggacgtgaataaggcccctttcaacagcatgggcgcgtgtggcaacgtccccatcttcaaggacggtctaggttgtggatcctgcttcgagatcaagtgtgacaagccagcggagtgctctggcaagcccgtggtggtgtacattacggacatgaactacgagcccattgcggcataccacttcgacctagcgggcacggcgttcggtgccatggctaagaagggtgaggaggagaagttgcgcaaggcgggcatcattgacatgcaatttcgaagggtcaagtgcaagtatggatctaaggtcaccttccacttggagaaggggtgcaaccccaactacctggccctgttggtcaagtacgtcgacggcgatggcgacattgtggcggtggacatcaaggagaagggctccgacacgtacgagcctctaaagcactcctggggcgccatctggaggaaggacagcgacaagccgatcaagggacccatcaccgtccaactcaccacccgagggaggcactaagaccgtctatgacgatgtcatccccgccggctggaagcccaacactgcctacaccggcaaaataaactaaccaaataataataangtatcaaatgggcacacttgatagacctttattttttttattttttattnaataaaanggatataaangagttgtgacaaanaacaacanaaatnttgnntggatatgtanctcctatatatgcaatn

SEQ ID NO: 6588 - DNA, 4298 bp, Zea mays
aatcatcaaaaagtccatgccaccttacatgaggagtgcattcagctagaaaatccaagctctggttgaaaagaagaagaaaaggaaaaggcgtcaattgtccccttcaaaatctgcttctgctcaagagacaacagaaccgtcagctacagcagttgatttattaatacccacaggtgaagttctgtctaataacagcccagggatacagatccataatatacatgcaatggataatctttcacaagaaaaggagcagaaaaaatctaggactagttctcctgacacatcaaataggcatttactggaaacaaaccctacttctcttagggaaactctaaacacttcaaatcatcaaggccatgacactttagatgaggagttcatccagccagaaaacccaagtgctgctggtaagaagaaaaagaaaaggcgtcaattggtcccttctaaatatgcttctgctcaaataacgacagaaccatcgtctggggcagccccagcggatttatcaaaatccacaggtgaggttctatctcacaacagtctagggctacagagcaataatatccatatattgtattacattattgaaaattgtttgtagtctagcatgagatactataatgtaccacatgccattcaattgcaaatatatttatcataggcttgaagtatttcatcatgcaacttggtattaactgcaggccattgatacttgagctgaacaactaatggaaaatttgtctatacattttttcctctggccaaaagacccagaatgctccatacttgccttgaatgtcgtatatattatagaactataaatccaccttatttatcttcttaatgacaaattttgagagtattttcattaggggtattgattttcttttattttttgtatcatccaggcgacaaagcatataatgctgaattgactagcaaaggtgaaactgtagttgaagcatctggtttgcctctttcatcttatgaacataatgatggaaaccaggggggcaaaagtgttaagtttgtgagcgatgatcaagcatctactgatttaatctctgaacaagagaagtttgatcatgctctcaagggatgtagggatcctttaattgcagatgacatttattctacaggtgaaaatgtagctattgaaggaaagactacaaaaggaagttgtgcccctttaaatggaggggacaggcatgaagaaataaaacacctcaatgagggatgtcataatgcaggtgtacctgaaacaagcaacatggagaaagatggcaaaagtacagatgtctctgacaagaggcaaacaagtcaaaatacctcgcaagtgaagaagcgcaagaaatcaaaggttggttctgttgacatgccttccgtggatgcttctggtgaaaaagatcatcggtatagtgaaaatgcgaccaaacaagatacagcttctactaaaagggagattgtccacgaaccttctatgcaacagatgtcaaacattgtgcatcagggggattcaaatgtaatagaaaatccaagtggtgatggaaagaaaaagaaaaaaagaagacaccattcagaatccttaaagggtatgaatcctagtcaagatctgaccaaatcttctggatttgtaacaaacgaaagctcgatacaatgcacaggtgctgctccaataaatgcaaagcaaacaaacttagtcattatagaaggagaaacagttactgggcacaggaagcttagtgaaaatctagatgtagcggcaacacatgttgttgatgaggtattgacagatctaagatctaaagacggcttaagtaaggatctggatgaaaatcttttaccaggacaaactcacctaggcagcaatcagaatggaatagaagttcctgaatccattgctgttaaagttggtagtactactgcagcattacctccgaaatatcctgcaacagttcactctgcttctcctgttaactcacctagacaaaggaagtctaaggggaaaaaattgaaagtgctatccaccatggctgactcttctcatcaatcaagtggtgtacccgaagaagatgctaatagaaaattaaaagagtctgattctttgaggtttgctgataaaacaagtgatcatgaggatatagtaactgcaaatgtggttgctcaagctgatgaaaaacgcaaagccactaagcgtcaaagaatcgagcggccggccgggcaggtacttgatacattggacttgaaggaagtgaatgacacagaagaaaatttggttcagggaggttctgtagttgacactcccttgagcactgctgggaacgtagagcagaaagactggtcttctgagactttgagtcctaaagaacaagaaactaattgttctactcatgggctggatagtcacacagctaaggacagccaggatgagtatgtaactgacaccattgggacccatgataatgaaaatgctgcaggaaccccagtcttgcatgtagttcagaaagatgccatggccctcaaatccgccagccctaattctcaaaaggagcaggaaacatctttgaactctgaactacaaagtcaggattgtcctctggaacatggttttagtgcagatttggtgaactccaggactgaaaagggagtcaggactacaagttctgctagtgctgttaaatctgattacaacaccatgtttcatcctgctaatggtagaatcaatgtccttgatcattttagccgcagcaatttgaatgatggttcatcaattgtcgcagaaagtaagcaaaacaatgaagatggaagtttaagggaagtgaagaataaaaagaagaaacgaaagcaaggtactggtagcgttgaaccaaatgatgttatagaatctcttccctcagagatagctagcttaactggtcattttggtaccagcaaagctgttgtgtcatctgttgcaacagaaaacatgaatggaggaaatgagaatgtgaataaaggcaaggagaagaagagaaagggcaaatctaatatggaagtacctactgctggaaaggaccatcctaattgtgatactcaattcattgatattggtacccaagaatcacttatttctattgtacaaaaagaaaggacaggtcaagacaatggaaaagagagcaacagtaaagctactcagaatgccagtataatgcaacatgaaccagaagatgccacttggaatcgtagccctgagaagaatcaccaccagagtgttgatgatgatcagaacaagttgctcactgaaaaggatcatgcacatataaataaagaagtgagaaaattcactcctcaaacaaaggcccatgctaagattagaaagcctgatgggtctactatcaaggaaaaggtggctccaaatcctaaacctgtaaccaaccttgtgaaggatttttccatgagcccacgagcatcaagtgacagcacagagggcatgccacaaagtgctaaccgatatagagttgcagtccggaaagtaccaagtaaaaggtatgaagagaccagtggaaactccaataaggcgagtaggaaagtaggctctggtgcaatattcaatgactctatcagcgaaggttctggtgatgaattggacaccaagactgtcatggaaagatcacctaataagtcatctacatctgctgattcaggtatttcatctgcagcctctggtgaaagcgaggttcctgatgatgatggcaccgtatcactatctcagaagagtttcaaaggtctgcacattagctccatcctccgtggctcccgtagctacaagaaggcactaaagaggcaaatggagctgctagacgacgacaccattgtgcctgatagccagcccgcggatggcctttggggctgaacatggttatcgtcaagagaagcgccgaccctgcttcatccttttttgccattgtccacctgatacgctggtgggctttataagttgtctaaaacacatgcccgaatgcgtgatgtcgctgatggcattgccatacgccacacgcagttcccttattttgtcgggcttaagctgtgatctgcctgaggatgaatcgatgatgttcatgatacagcttaccagctatatatatgtgttaatgtatgtaagaatgatacgcacgcttagtctctcacccatgagccatgggtccgttgagtcctgactgaccatcgccagaagttgtggtttgtgacaggaaattccatccttctggcttatctgttgtgtattttgcgtagctgcagttttattttttttc

SEQ ID NO: 6589 - DNA, 601 bp, Zea mays
cacgacgcttctgttctttcagaacttcctcttcctgcttcttttgttgtttcttagcttcagcctcctccttttcacgtctcttctgttctttcagagcttcatcttcctgcttcttttgttgcttcttggcttcagcctcctccttttcatgtctcttctgttctcttagggcctcttcttgctgtttcttttgaagttttctcatctgagcttcttctttctcctggcgctttatttccttctccacttgtttttgggctttctgaatctctttctcattaccaagtgagttcccattctgcggctcagagacactagtatcctcaagccttctaacattttggtcatttttatctgtctcttgcatcaattccttaactgctgatacagcatctttcacaccccgttctgtgttcttttgtgtcgctctttccaccattgatctgatcccttccaggttcagtgatttgtttaatttcaatgatgctttttttagatcatttacttggatgtaagctcctgaattttcaagaaccgacaaagtcgaatatatggcagtgattctctcatggattttctttctgacagatctccgtgt

SEQ ID NO: 6590 - DNA, 4083 bp, Zea mays
aaaaaaaatatatgcaattcgaaacatcatacatgagaatgagagttccacgcgtctcctcacgtagaatttttttccggtctggattattattaatttattatacaaattaaggagtatccatgctccgattcgttgagcaaagtggaaaaatccatcaacgccatactacatggcctaaatttagaaagcatggtagaagagacaagtggttaggcggccaggccactggcgaaaccgcgcgcgaccgctcgtttagtggtcgcgctgctcccgcggcgcgccccacgtggacgccgcgcgcagctatataatggtggattaaccctaggaacctgttgggtccgcgcaatcgtcgactgctgctgcgttctgttccgttcggaagatgttcttggagagcttccgggtggagagcccgcgggtgaagtacggcgacggcgagatccagtcggagtaccgctacgacaccaccgaagtcgtcccgccggggaatggcggcggcgcggggtgggtggtgcgcccaaagtccgtcacctacaacttcaagaccagcaccaacgtcccaaagctggggtgcgaagaaccaacaactcatcgatccggccgcctccatatatagatagatcgatcgatcgtcgatcgatcataaacgattgactaataatcgtgccgtcgtcgtttcattccaaatgatcgatgcattggctgcagggtgatgctcgtcggatggggcggcaacaacgggacgacgctcacggccggggtgatcgccaacagggagtaagttgatgatccaattagctgcaatgccacttccaccatgttccatccgtattgcaatattattgttccacgattcggacgatggtgttttcttgcagagggatttcgtgggagacgaaagagaaggttcacaaggccaactacttcggctccctgacccaggcttccaccatcagggtcggctcccacaacggggaggaggtctacgcgcctttcaagagcctcgtgcctatggtgatcctgctctctcccccctgcacctcctcttcactcgattcacgtcacaatccatgaacgcacatgaagattatcccgtatttaattatgtgtaattttcctcgataaaaaaaagtatcagttttgctgtgtcgacactgtgatgtacgcaaatccctttaatttcttcaataatagccatattctattgcttggatcatgcatgcaggttgaccccaactctatcgtgtttggtggatgggacatcagcaagctgaacatggccgacgccatggccagggccaaggtcctagactttcacctccagaagcagctcaggccctacatggaatccatgctgccactccctggcattttcaacccagacttcgtcgccgcaaaccaaggtgcccgtgctgacaatgtcatcaagggcaccaagaaagagcaggtggagcagatcaagaaggacatcaagtacttaaatcctactcaaaacatacaacactgacaaaaaaaagcataatatatagtactcctgtttttctgaatgcggccggattgttgtgaagttaatcatggatggggccggttcttcatgaactctatatatatatgcacagggagttcaaggaaaaaaacaaggtggacaaggtagtcgtgctgtggacggcgaacaccgagaggtacagcaacgtggttgcagggcttaacgacaccatggacaagctcctggcttcgttggacaagaacgaagcagagatctcgccatccaccttgtatgcgatagcctgtgtcctcgagggtgtcccgttcgtcaatggaagccctcagaacaccttcgtgcctggtgcgtggcgctagctagctgctctgcaaagattctacaagcaagtgtgttcggtgccgcattattcctcgttccatatgcttgtggtaatgtccgtctgttcatgcatgcgcgcgcagggctgatggagcttgccataaaaaagaattcggtgataggaggcgacgacttcaagagtgggcagaccaagatgaagtctgtgttggtcgatttcctcgtcggcgctgggattaaggtacgtaccatcgtcatatatgtatatctctatatataatgctgggattaattaagataatttgtgtttgacattcaagaataatctatccatctttaaatattggaattattaaagattggcacattggataataaggtggatttgttttttcccgtagcccacctcaattgcaagctacaaccatctgggaaacaacgacggcatgaatctctctgccccacaagtcttccggtccaaagagatctccaagagcagcgtggtggacgacatggtcgctagcaatcccatcctctacaagcccggcgaacatccggatcacgtaatcgtgatcaaggtgggtcggtcgacactagctagttgtgtttgtgactgatgctgcttcttgctcaaaggttgatgaatcatccctatattttgcagtacatcccctacgtgggtgacagcaagagggctatggacgagtatacctctgagatcttcatgggtggcaagaacaccatcgcgctgcacaacacctgcgaggactcgcttctcgccgcgcccatcatccttgacttggtgctcctagctgagctcagcactcggattcagctcaaggccgaagggcaggtgaacagatgagctatatatatgcttgcacaaaccagtgtttggatagaaattattgacgacgtttctacgtttgctctttgtgcaggataagttccactccttccaccctgtcgccactattctgagctacctcagcaaggctcctcttgtaattaagcttttcattttgtttgcaattgataccgtttttttttgtcatcagcatgtttatattggtctctaaaatggagtttcaaagaatttagaatgaaaacatcatgattgtcttatgcatgaacttggtagtaaattggtttcctaaacaggtacctcctggcacaccagtggtgaatgctctagccaagcagagggccatgctggaaaacatcttgcgggcctgcattggccttgcccctgagaacaacatgatgcttgagcacaagtgaagagtttcacgtcccttaattaactaccgcaagataggatgaatggaaaaggagggatcaagcgaaggtgtgggaataatcagtgactcctctgagcccaacgaagaaatgtcaggaggctacaggaaggagaagtgtaaggagagaagaccaggcatggatatatcctcttttcgaaggctatctatctattctttttttgtagatttgactcgttttttgtactcatgggacgagattgtgtactggctatatgtccactgtatgcagcatgaaacctttatttgttctgttgtgtgatagaggttatatatagaagtgtccagcctagtttttgaaactcctagttgattaatattttcactaggtggttgatgaacacatttgatatgctctagagacgtcaatggagctttgatcgctgattcagggccaattcttccccatgtggatggatatggttctctattctccatcccaaatccccgtgtccacgtccttttttgtatttacttataatgtatttgttgtgcagtatttatatttgtattgcatcttaagtcatcaactatgcgtttaaaatgaacctaaacttagttttatgttaaatttgaattgtcatcaaggacgagaatcatgcatgaattattttctgtgatgggacatgaatacggaccaattctctccggcaaactttaggccttgccggttaatgggatccaatctctggaataatattttccactccagaattgagtggatccctagttgtcaatctaatctttgttaggacttgttcggttatttccatttcatggcagttaatagggattatgagggattagaaggaattttgatttgctagggatttaaactcactcaatccctttaatataaatggattgagattaaaacaaatagtccgttagacacaattgtttcttaattgtaataca

SEQ ID NO: 6591 - DNA, 2129 bp, Zea mays
ccgcgcgcagctatataatggtggattaaccctaggaacccctcgcgtccgcgcaatcgtcgactgctgctgcgttctgttccgttcggaagatgttcttggagagcttccgggtggagagcccgcgggtgaagtacggcgacggcgagatccagtcggagtaccgctacgacaccaccgaagtcgtcccgccggggaatggcggcggcgcggggtgggtggtgcgcccaaagtccgtcacctacaacttcaagaccagcaccaacgtcccaaagctgggggtgatgctcgtcggatggggcggcaacaacgggacgacgctcacggccggggtgatcgccaacagggaagggatttcgtgggagacgaaagagaaggttcacaaggccaactacttcggctccctgacccaggcttccaccatcagggtcggctcccacaacggggaggaggtctacgcgcctttcaagagcctcgtgcctatggttgaccccaactctatcgtgtttggtggatgggacatcagcaagctgaacatggccgacgccatggccagggccaaggtcctagactttcacctccagaagcagctcaggccctacatggaatccatgctgccactccctggcattttcaacccagacttcgtcgccgcaaaccaaggtgcccgtgctgacaatgtcatcaagggcaccaagaaagagcaggtggagcagatcaagaaggacatcaaggagttcaaggaaaaaaacaaggtggacaaggtagtcgtgctgtggacggcgaacaccgagaggtacagcaacgtggttgcagggcttaacgacaccatggacaagctcctggcttcgttggacaagaacgaagcagagatctcgccatccaccttgtatgcgatagcctgtgtcctcgagggtgtcccgttcgtcaatggaagccctcagaacaccttcgtgcctgggctgatggagcttgccataaaaaagaattcggtgataggaggcgacgacttcaagagtgggcagaccaagatgaagtctgtgttggtcgatttcctcgtcggcgctgggattaagcccacctcaattgcaagctacaaccatctgggaaacaacgacggcatgaatctctctgccccacaagtcttccggtccaaagagatctccaagagcagcgtggtggacgacatggtcgctagcaatcccatcctctacaagcccggcgaacatccggatcacgtaatcgtgatcaagtacatcccctacgtgggtgacagcaagagggctatggacgagtatacctctgagatcttcatgggtggcaagaacaccatcgcgctgcacaacacctgcgaggactcgcttctcgccgcgcccatcatccttgacttggtgctcctagctgagctcagcactcggattcagctcaaggccgaagggcaggataagttccactccttccatcctgtcgccactattctgagctacctcagcaaggctcctcttgtacctcctggcacaccagtggtgaatgctctagccaagcagagggccatgctggaaaacatcttgcgggcctgcattggccttgcccctgagaacaacatgatgcttgagcacaagtgaagagtttcacgtcccttaattaactaccgcaagataggatgaatggaaaaggagggatcaagcgaaggtgtgggaataatcagtgactcctctgagcccaacgaagaaatgtcaggaggctacaggaaggagaagtgtaaggagagaagaccaggcatggatatatcctcttttcgaaggctatctatctattctttttttgtagatttgactcgttttttgtactcgtgggacgagattgtgtactggctatatgtccactgtatgcagcatgaaacctttatttgttctgttgtgtgatagaggttatatatagaagtgtccagcctagtttttgaaactcctagttgattaatattttcactaggtggttgatgaacacatttgatatgctctagagacgtcaatggagctttgatcgctgattcctaacagggagttctcgatgcggacagggccaattcttccccatgtggatggatatggttctctatcctccatccc

SEQ ID NO: 6592 - DNA, 2309 bp, Zea mays
  misc_feature (14)..(14): n is a, c, g, or t
  misc_feature (1698)..(1698): n is a, c, g, or t
ggtaccctcccggnccttccggggtgcctgtggcctatgcgggtttctagagagccacaggccacaggcaggcaggaggatcggacgagtcggcgaggaagctgcctgctttcagatagagagagttattaagatggcgttgcttcggctgcttgccatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcgtcgcgtcgctcgccgcacgcctcgccaagacgccgtcctctcggcccaccttgcttgacgagagccgcgcggggtcgtcgtcgtcgtcgtcgtcccccgatgacgagtcgtccctcgcgtccgtgccgctcggcccgggcacgtccgtcggcgtgggcaactacgtcacccgcatgggcctcggcacgccggccaagtcgtacgtcatggtcgtggacacggggtcctcgctcacctggctccagtgctccccctgcgtcgtgtcgtgccaccgccagtccggcccggtgttcaaccccaaggcgtccagctcctacgcctccgtgtcctgctccgcgcagcagtgcagcgacctcaccaccgccacgctcaaccccgcctcctgctccacctccaacgtctgcatctaccaggccagctacggcgacagctccttctcggtcgggtatctgcgcacgtcgtctgtacgaatacatattgtacggtactttatacgtactattcttattcttattactgttggcatgcaatatatgcaggtatctgagcaaggacaccgtgtcgttcggctcgaccagcgtgcccaacttctactacggctgcggacaagacaacgagggcctcttcgggcagtcggcggggctcatcggcctggcgcgtaacaagctgtcgctgctgtaccagctggcgccgagcatgggctactccttctcctactgcctcccgacgtcgtcgtcgtcctcggggtacctgtccatcggctcctacaacccggggcagtactcgtacacgcccatggcgtcgagctcgctggacgactcgctctacttcatcaagatgaccgggatcaaggtcgcgggcaagccgctgtccgtgtcgtcgtcggcctactccagcctgccgacgatcatcgactccggcacggtgatcacgcgcctgcctacgggcgtgtactcggcgctcagcaaggcggtggcgggcgccatgaaggggacgccccgcgcgtcggcgttctccatcctggacacgtgcttccagggccaggcggcgcggctgcgcgtgcccgaggtcaccatggccttcgccggcggcgcggcgctcaagctggccgccaggaacctgctggtggacgtggacagcgccaccacgtgcctggccttcgcgcccgcccggagcgccgccatcatcgggaacacgcagcagcagacgttcagcgtcgtctacgacgtcaagaacagcaagatcgggttcgccgccgccggctgcagcggtgccgggacgcgtactgtacacgcgcgggcgcggacgcgctcggtaactaaaactaagacgagcagcncatgcatgcatagaccgaggcgatttgggtggaaaccatcattaatttcgagtcgtccaagccacgcacagcaagttctttacggaccttgccgcatatgatatgtacatggtgacaagataaggtacaggagaattgatgaaagaagcgttgccggccagtcgtcgttgcacgagaacaaacacataaattaaaacattattacaggagtagggtatttattgtattgttcaggccagaaaaatatgtggaaagtgggtctttaacttaattcggaagaagcatatagcactccaaaaaaaaaagattcatattcatcacatagccaacagatagcatgtagtagctgttcatgcatgtaattctttggcaagtcctggtcaggaagtaccatttactgtgtgtaggacgaataaactgaagtgatgtgtatgtttctgatttctttcggacttgcaacccggggcccacgtggtttttttacccccttctatatgtactgtggaaaatattgtaaccgcccaagacacactcctatgctatatatgttgtatgcccaagacaccctttgttaacgaacaaagagatcgatgatgccaatatttatcact

SEQ ID NO: 6593 - DNA, 2408 bp, Zea mays
gtcatagagagagccactggccacaggtaggcaggcaggaggacgagtcggcaaggaagctgcctgctttcagaaagagtcatagagatagttattaagatggcgttgcttcggctgcttgccctctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccgggcacgtccgtcggcgtcggcaactacgtcacccgcatgggcctcggcacgccggccaagtcgtacgtcatggtcgtggacacggggtcctcgctcacctggctccagtgctccccctgcgtcgtgtcgtgccaccgccagtccggcccggtgttcaaccccaaggcgtccagctcctacgcctccgtgtcctgctccgcgcagcagtgcagcgacctcaccaccgccacgctcaaccccgcctcctgctccacctccaacgtctgcatctaccaggccagctacggcgacagctccttctcggtcgggtatctgagcaaggacaccgtgtcgttcggctccaccagcgtgcccaacttctactacggctgcggacaagacaacgagggcctcttcgggcagtcggcggggctcatcggcctggcgcgtaacaagctgtcgctgctgtaccagctggcgccgagcatgggctactccttctcctactgcctcccgacgtcgtcgtcgtcgtcctcggggtacctgtccatcggctcctacaacccggggcagtactcgtacacgcccatggcgtcgagctcgctggacgactcgctctacttcatcaagatgaccgggatcaaggtcgcgggcaagccgctgtccgtgtcgtcgtcggcctactccagcctgccgacgatcatcgactccggcacggtgatcacgcgcctgcctacgggcgtgtactcggcgctcagcaaggcggtggcgggcgccatgaaggggacgccccgcgcgtcggcgttctccatcctggacacgtgcttccagggccaggcggcgcggctgcgcgtgcccgaggtcaccatggccttcgccggcggcgcggcgctcaagctggccgccaggaacctgctggtggacgtggacagcgccaccacgtgcctggccttcgcgcccgcccggagcgccgccatcatcgggaacacgcagcagcagacgttcagcgtcgtctacgacgtcaagaacagcaagatcgggttcgccgccggcggctgcagctgagaagcgacacctacatacacgcgcatgcacagaccgactcggtaactaaaactaaaacgagcagcgcatgcatgcatctaccgtccggtttcgtctgaaaccatcattaatttcgatcgtccactccacgcacagcaagttctttacggaccttgccgcatatgatatgtacatggtgacaagataaggtacaggagaattgatgaaagaagcgttgccggccagtcgtcgttgcacaagaacaaacacataaattaaaacattattacaggagtagggtatttattgtattgttcaggccagaaaaatatgtggaaagtgggtctttaacttaattcggaagaagcatatagcactccaaaaaaaaagattcatattcatcacatagccaacagatagcatgtagtagctgttcatgcatgtaattctttggcaagtcctggtcaggaagtaccatttactgtgtgtaggacgaataaactgaagtgatgtgtatgtttctgatttctttcgtacttgcaacccggggcccacgtggtttttttactcccttctatatgtactgtggaaaatattgtaaccgcacaagacacactcctatgctatatatgttgtatgcacaagacacactttgttaacgaacaaagagatcgatgatgcaaatatttatcactaatatatatatatggctattggttagtttcgtgccttttgcacgatgaatataatggttgaacatgggacgaataggtggttagcaaagctgtacagcaggagagatataagagagcaactttagttgttgggatgttgcggtcttccataattattgccgcacaggaaaggctttagacagttagaaggagcatgctgcatttccatcgtcatgaaccgaaaagaggtcggacgtg

SEQ ID NO: 6594 - DNA, 888 bp, Zea mays
cattgggtacctcgaggccggccgggatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccgggcacgtccgtcggcgtgggcaactacgtcacccgcatgggcctcggcacgccggccaagtcgtacgtcatggtcgtggacacggggtcctcgctcacctggctccagtgctccccctgcgtcgtgtcgtgccaccgccagtcccggcccggtgttcaaccccaaggcgtccagctcctacgcctccgtgtcctgctccgcgcagcagtgcagcgacctcaccaccgccacgctcaaccccgcctcctgctccacctccaacgtctgcatctaccaggccagctacggcgacagctccttctcggtcgggtatctgagcaaggacaccgtgtcgttcggctcgaccagcgtgcccaacttctactacggctgcggacagacaacgagggccctcttcggcagtcggcggggctcat

SEQ ID NO: 6595 - DNA, 875 bp, Zea mays
gccggcctggctttcgaaaaaaaaaaaaaacattgggtacctcgaggccggccgggcgggatagagagagccactggccacaggcaggcaggcaggaggacgagtcagcgaggaagctgcctgcttttcagatagttattaagatggcgttgcttcggctgcttgccttctccctgctcttcgcagtggccactcctgtcagggacatcgccgatgatgcctgctcgtcacaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtcgtccctcgcgtccgtgccgctcggcccgggcacgtccgtcggcgtgggcaactacgtcacccgcatgggcctcggcacgccggccaagtcgtacgtcatggtcgtggacacggggtcctcgctcacctggctccagtgctccccctgcgtcgtgtcgtgccaccgccagtccggcccggtgttcaaccccaaggcgtccagctcctacgcctccgtgtcctgctccgcgcagcagtgcagcgacctcaccaccgccacgctcaaccccgcctcctgctccacctccaacgtctgcatctaccaggccagctacggcgacagctcctttctcggtcgggtatctgagcaaggacaccgtgtcgttcggctccaccagcgtgcccaacttctactacggctgcgg

SEQ ID NO: 6596 - DNA, 3955 bp, Zea mays
  misc_feature (3908)..(3908): n is a, c, g, or t
cattgggtacctcgaggccggccggggggatagagagccacaggccacaggcaagacaggcaggaggatcggacgagtcggcgaggaagctgcctgcttttcagatagagttattaagatggcgttgcttcggctgcttgccctgatctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccgggcacgtccgtcggcgtgggcaactacgtcacccgcatgggcctcggcacgccggccaagtcgtacgtcatggtcgtggacacggggtcctcgctcacctggctccagtgctccccctgcgtcgtgtcgtgccaccgccagtccggcccggtgttcaaccccaaggcgtccagctcctacgcctccgtgtcctgctccgcgcagcagtgcagcgacctcaccaccgccacgctcaaccccgcctcctgctccacctccaacgtctgcatctaccaggccagctacggcgacagctccttctcggtcgggtacctacgtacgttgtctgtacgaatacatattgtacggtattattattcttattactatattggcatgcaatatatgcaggtatctgagcaaggacaccgtgtcgttcggctccaccagcgtgcccaacttctactacggctgcggacaagacaacgagggcctcttcgggcagtcggcggggctcatcggcctggcgcgtaacaagctgtcgctgctgtaccagctggcgccgagcatgggctactccttctcctactgcctcccgacgtcgtcgtcgtcgtcctcggggtacctgtccatcggctcctacaacccggggcagtactcgtacacgcccatggcgtcgagctcgctggacgactcgctctacttcatcaagatgaccgggatcaaggtcgcgggcaagccgctgtccgtgtcgtcgtcggcctactccagcctgccgacgatcatcgactccggcacggtgatcacgcgcctgcctacgggcgtgtactcggcgctcagcaaggcggtggcgggcgccatgaaggggacgccccgcgcgtcggcgttctccatcctggacacgtgcttccagggccaggcggcgcggctgcgcgtgcccgaggtcaccatggccttcgccggcggcgcggcgctcaagctggccgccaggaacctgctggtggacgtggacagcgccaccacgtgcctggccttcgcgcccgcccggagcgccgccatcatcgggaacacgcagcagcagacgttcagcgtcgtctacgacgtcaagaacagcaagatcgggttcgccgccgccggctgcagctgagaagcgacacctacatacacgcgcatgcacagaccgactcggtaactaaaactaaaacgagcagcgcatgcatgcatctaccgtccggtttcgtctgaaaccatcattaatttcgatcgtccactccacgcacagcaagttctttacggaccttgccgcatatgatatgtacatggtgacaagataaggtacaggagaattgatgaaagaagcgttgccggccagtcgtcgttgcacaagaacaaacacataaattaaaacattattacaggagtagggtatttattgtattgttcaggccagaaaaatatgtggaaagtgggtctttaacttaattcggaagaagcatatagcactccaaaaaaaaaaagattcatattcatcacatagccaacagatagcatgtagtagctgttcatgcatgttattcttttggcaagtcctggtcaggaagtactatttactgtgtgtaggacgaataaactgaagtgatgtgtatgtttctgatttctttcgtacttgcaaccccgggcccacgtggtttttttactcccttctatatatactgtggaaaatattgtaacccacgcacaagacacacactcctatgctatatatgttctatgcacaagacacactttgttaacgaacaaagagatcgatgatgcaaatatttatcactatatatatatggctattgttagtttcgtgccttttgcacgatgaatataatggttgaacatgcatgggacgaacaggtggttagcaaagctgtacagcaggagagatataagagagcaactttagttgttgggatgttgcggtcttccataattattgccgcacaggaaaggctttggtcagtttggtggtgcatgctgcttttccatcgtcatgaaccgaaaagaggtcgaacgtgacattctttcttacgtccaagcgcatgttcagctgcttttgagaggctcgcgcgtatatatccgcgctacacgcttgggcaactttttgccgcgccggccgggaatggcaagaatagaaaaagaaacagccttgctacctccatgtaacatctcgtcctaataccatggaacatccctacaaaccaacacaaatctttcatacgcaccaccaaaaacttttcggttggtcacctatcacaaaattgctctgagccaaacacgcttagaggttcttttaaaatatacttccaaaaaataaggtgcaccttattggtatgaattttctactaatcctattaaaaattggtttcttaaaaaactaggttacttccaaacatgaccttacatgttggaggccaaagaaattagcaaaaaaaaaaaacatagcgtaatggagaactaatatatatatatatatatatatatatatatatatatatatatatatatatatatatatatatatatatatattaacaatgcaaagatcattcactaactttgttgagaactatgacagaatcaaaatcggataataaatctacaattgtagctgctaatgtctttgccattgtagatgagttcagagcaacttttattttctggaaacggggttaaagaaatttcaacacaaacagatattacgcatgcaaatctgcactaggcatcggctacaatcttcatttggctaaacttcgtttaaagaagtccaaacatgacatcggctaaacttcatttactggcagccagctgcagagattgacattgcagagatagagaaaaaaaacacatcctgcacaaacgaactgtacaggagcacatcgcgctctcgtctttcaagctggtatgcaccaagctatagtagaactagttattcaaaaaaaatgctactagaattagaacttaaaatgtaatatattggtagattctataataaagtatatttataaattttaagttttgtttgtgatatttggtagttcgattatacgacggccacatgaaaaccttgcactgacgaatcgttgacaattacagttacgagagtagcgctgctggaccatgaccacggatccggcgcgctgggggatgcagtgccgatttggcggagcccgggcccggcccggcgcgcgcgcgactcgctcctcggcggcctgtcactgtcagtcagcctgtggcatgcagatgctgggagtctgggacggtgggacctatgtatgtacgcagccgcgtcgttacgttccgtaggattcgcgagtcgtgacgagctgcgcgcccgtaccgatgatcagaacaagttcggtactctgtccacgtctgctggtccctcacgaacgccatgcgtccngcgggcccccaccaccggaccgggtcgccggccgggggaatcgccgt

SEQ ID NO: 6597 - DNA, 1039 bp, Zea mays
aaatcatttcccccctcttctccagcgtggcacagagctagggtttctcccacccgtcgccgccgccggctgcacccgccgtcgtccacggccggtccctccagctcccgccgcgcgcgctcccgccgctggacgctccagctcttgcacgcattctcggccgccgtcgcgcctgcacgccgctcctctgcggccgctccagcttgcccgcgcgtgctcccctcgactgctctagcttctgcacgccgtcggtcaccaatcgtcgcctactacgactcggccttcaagcggcagcttcatccgcgacgtccgcgtcgccgtcttgcgccacgacctcacccgagcgctctgcctactcccgaagccctcctccgcggcgcccgccccagcagttcctcctccgcagcgcccgccccatcagttcctcctccgcggtgcccgtcgacccgccgagcaccagcagcagcgtcgccggtggttgagctccaccgcctttgccgcgctccatctcttccggaagtgccctgctccaccgcccacctgtacggcagcctgacccagctattcggctgcctgcctcggagatctcgctgcctcgccgacctgaaatttgtgagtgcaaatccgtcagcattggactgttttactcatctataggatctgattttgggtgggcgcagttgcggagatgcagaggctgggggatttcaggctccctcccttcttcaactacccgccttacttcacgtaattgtcccttgttttcgctctatcttctgccttttattctcttccaaacgctccgacgactaggtctttgcctgctctcagtaacaatgccactagatgtttctgttatctgcaaccttgcagctgtatgtggaagagatggtccatgatgctgaattggttatggatgtagtctcgatcaatgtattcaggatgaatatttcaaagcgaatttgcactccaatatgttgaactattttggtggtttaatgaaataccaaagaatgttgtggcaaaaaaaaaaaaaaaa

SEQ ID NO: 6598 - DNA, 1053 bp, Zea mays
gtattacctagagttcaaagttatctaatgtacttttactatttgaaccctatgcactagttgagctatcattttcccccctcttctccagcgtggcacagagctagggtttctcccacccgtcgccgccgccggctgcacccgccgtcgtccacggccggtccctccagctcccgccgcgcgcgctcccgccgctggacgctccagctcttgcacgcattctcggccgccgtcgcgcctgcacgccgctccagcttgcccgcgcgtgctcccctcgactgctctagcttctgcacgccgtcggtcaccaatcgtcgcctactacgactcggccttcaagcggcagcttcatccgcgacgtccgcgtcgccgtcttgcgccacgacctcacccgagcgctctgcctactcccgaagccctcctccgcggcgcccgccccagcagttcctcctccgcagcgcccgccccatcagttcctcctccgcggtgcccgtcgacccgccgagcaccagcagcagcgtcgccggtggttgagctccatcgcctttgccgcgctccatctcttcaggaagtgccctgctccaccgcccacctgtacggcagcctggcccagctattcggctgcctcggagatctcgctgcctcgccggcctgaaatttgtgagtgcaaatccgtcagcattggactgttttactcatctataggatctgattttgggtgggcgcagttgcggagatgcagaggctgggggatttcaggctccctcccttcttcaactacccgccttacttcacgtaattctcccttgttttcgctctatcttctgccttttattctcttccaaacgctccgacgactaggtctttgcctgctctcagtaacaatgccactagatgtttctgttatctgcaaccttgcagcttgtatgtggaagagatggtccatgatgctgaattggttatggatgtagtctcgatcaatgttttcaggatgaatatttcaaagcgaatttgcactcctatatgttgaacttgaactattttggtggttta

SEQ ID NO: 6599 - DNA, 2709 bp, Zea mays
  misc_feature (1381)..(1381): n is a, c, g, or t
  misc_feature (1450)..(1450): n is a, c, g, or t
aggaaatttgagagaaaaagagtaacactttatttaacaaactttgatcacgttacgggcgccggatgttgacatgttgtagtatatatagtttttgtttcttgtgtaatttctctaaaatctagagttcaaagttaccttatgtacttttactatttgaaccctatgcaatagtaaaaaaaaaatttcccccctcttctccagcgtggcacagagctagggtttctcccacccgccgcctccggcgactgcacccgccgtcgtccacggccgatcgctccagctcccgctgcgcgcgctcccgccgcaggccgctccagctcttgcacgcattcccggccgccgtcgcgcctgcacgccgctcctctgcggccgctccagcttgcccgcgcgtgctcccctcgactgctctagcttctgcacgcgtgcccggccgccgccgcgcctgcacgccgtcggtcaccaatcgtcacctactacgacccgtccttcaagcggcagcttcatccgcgacgtccgtgtcgccgtcttgcgccacgacctcactcgagcgctctgcctactcccgaagccctcctccgcggcgcccgccccagcagttcctcctccgcagcgcccgccccatcagttcctcctccgcggtgcccgtcgacccgccgagcaccagcagcagcgtcgccggtggtggagctccaccgcctttgccgcgctccatctcttcaggaagtgccctgctccaccgcccacctgtacggccgcctgacccagctattcggctgcctcgccggcctgaaatttgtgtatattctacctgtataggagggttcatcttctgattcaagttttttgcgcgaagccatgtcttgcctagatgcttttgttgtacctaagggtacaactccttcaccatgctcgcttgctggtgcataatttactcgtttatttttagctaactctcttcatggtaaaaaaatattgcctagttgatgctagttacattaatggtcctggttttgtagctccacatcgatcgtcatcacttgaaagagtgggctgcaaatcaataatagcacaaaaccccaaaataattgtttaacttactacatgctcgggctagaaatatggtagagactagagagcacctttccctatgggacgatgggtacggaacagcgatgttcccatccttctccacctacgacgtaaacgaggatcatctgaactgtttcaactattgtgagcagttcttccgtaggcagcgctcagtcgccggcacctgttctggttgctggggcacctcctgcgccgccccctaggacaacttctcttttggccctcgaggcaactcttcagacccctggggcacctcgtgctccttgangcacctccgtgtgccggcccccaaacatttgttctgccgctatggagcacctcttgtgtcgacccctanggcaactcttctagcccccggggcacttgtttcgcccctcgaggcacctcatgcctcggtccctgggacacctcctgtgttgccccctaggccatctcttcctacctatggggcaactctttagaccctcgaggcacgtattccgccccagggcacctgtgctttgggaacttcccattggggtctcttgtaggcgtgcactgcatagcgccaccgtcactgaccgtctccactggtcatcgttgcgaccactcttaggtctcgacacctgctaaactacaccatggtatctaggtggttgtgcacatgcaactccatcgtttggatggtgcccgtctaagatccacgtctccattggaacatcgacatctgcatccatggccaccaacacagctcgggaaaattgcttttttaggtcacgctgccgctcaccaaaataccccggcattcgttgcactcgtgttagaattaatatatatgctcttgtgctaggatagtatagatgagcctttagacttctagatagtccgctgttgctgacaagctagctagcagcagtagtcggccaccaatagttgccaggcactgtagcaaccggacagctctagcaaaggtggttactgtagctagtcagatagtaggtcttgttagtatgaataatatagtttgtgtaatacactggctgctcactatttattttttgctgatttttctctcatatttacttggattttttatacctttcttctccccagggcgcttgggagcttcgtggccggccgggttagcgcagcagctctttctttgtatggattgtttcattagttgtcaacttacaaagcactctgcttgtttggttatgagcagaacagaaaacgtggggggtgggaatggtttctcgatggtaaccacagtttggccaatggtttggtacatttcaggttccagctgaagtaacattaaaatccggtgcgacttgttttctgtacatggtgactgggttggggtgggttgtttttttgttgttgaatgttagtatagattggcatggttacggtttggatttcagtccactagcggggctagacgcaatcctaagtccccttccagtccagtccaccacagcacaccgtagccattgccttcctcaccttatgccttacatctgctggagcaggagtgcaaatccgtcagcattggactgttttactcatctataggatctgattttggtcggtcgcactctgcggagatgcaca

SEQ ID NO: 6600 - DNA, 688 bp, Zea mays
  misc_feature (552)..(552): n is a, c, g, or t
  misc_feature (576)..(576): n is a, c, g, or t
  misc_feature (579)..(579): n is a, c, g, or t
  misc_feature (588)..(588): n is a, c, g, or t
  misc_feature (595)..(595): n is a, c, g, or t
  misc_feature (652)..(652): n is a, c, g, or t
accagagagtcagagtgcggaggtgaacgtgacgtgacgctcctcctctataaaaggagacgcctgtgctgcagtgtgcacagcacagcccgtcgcgcgccgctgcgttgaggttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcccgccccaccatagcaagccgcccaagcaccaccatggcaagccgcccaagtgcccgccgtgcacccctccgtacgtgcctccgacgcctcgcccgtcaccgccgtacgtgccaccatatgtcccgccgacgcctcggccatcaccaccaccgtacgtgccaccatacgtccccgtcccgccgacgcctcggccctcaccgccctacgtgccaccatacgtccccgtccccccgacgcctcggccgtcaccgncgtacggtcccccgaacgcacggncgncgaactcgncctacgntccacgaagccgccttacgtcccacgacgcctcggcatcacggcgaatgtggcaccntagtcccccgaacgctcggcataacaacctaggtgc

SEQ ID NO: 6601 - DNA, 589 bp, Zea mays
  misc_feature (554)..(555): n is a, c, g, or t
  misc_feature (560)..(561): n is a, c, g, or t
  misc_feature (563)..(563): n is a, c, g, or t
  misc_feature (565)..(573): n is a, c, g, or t
  misc_feature (575)..(575): n is a, c, g, or t
  misc_feature (577)..(577): n is a, c, g, or t
  misc_feature (580)..(580): n is a, c, g, or t
  misc_feature (583)..(583): n is a, c, g, or t
  misc_feature (585)..(585): n is a, c, g, or t
accagagagtcagagtgcggaggtgaacgtgacgtgacgctcctcctctataaaaggagacgcctgtgctgcagtgtgcacagaacagcccgtcgcgcgccgctgcgttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggcggcggccacagcaagccgcccaagcaccaccatggcaagccgcccaagtgcccgccgtgcacccctcctccgtacgtgcctccgacgcctcggccgtcaccgccgtacgtgccaccgtatgtcccgccgacgcctcggccatcaccgccctacgtgccaccatacgtccccgtcccgccgacgcctcggccctcaccgccgtacgtgccaccatacgtccccgtccccccgacgcctcggccctcaccgccctacgtgccacaatacgtccctgccccnncaacnnantnnnnnnnnncntnacnacnanatcc

SEQ ID NO: 6602 - DNA, 4241 bp, Zea mays
agaattcgaggtttatttaacatctcgtctctcttgcactgtaaaaagagaggggcagagtaacgtctaaggaagttagaataagaaagatttaggtcatggcaagtgaggttatagatacacgtaaacttgccaagcacaataatccacttagtagctagacagacacaaaggtgaagtatgataattaagctataacttccaccatgagacataggtgaaaagggaactagaaacttttgatgcttattggtgattgagttgtaatcttctttattttggcgttcatccatcgatgagtagaaaaaggatttaaaagtattattcatattgcaactcgaatttctctaattgtgcacgtgctagctttcactcgtgtttagattatgtacgaccgtcgacctatgccacgctatgtggtagtctgattttattaggcatgaaaggtggcatgcatcacatccagtgacggacctaaaaggtatgccagatggagaattcaacttatgtatacatagatttatacaggttgacctatgccacgctatgtttagattataatctccgttctctaatatttgtcgtcggctaatttatttttaaattaaagcacgataaataaaaaagaacggaaatagagtactaaattatacaggtataacgaacggtgtaaaaaattatcatgcatggctcctagatccgctatcacatcagcctttaaaatttccaatctcgtgactcctcggtctcctgccgtgccggagcatttcgtcggtcgtctaaattgctgaatttggctgggcagcatatcatatccatgcagcatttagccaggataataataatgccatggaccgcatcactgcgccctcggatcgaggacgcgccgcgcattggtggctgtcgtcgtcgtccgcacatggaaacagaaaaaaagggtggccgctgtgctcgagtgctcatgttcacccagtcacccagtcacccccgagagtagacggagactcgccggaaggctccaaacccgcggcaggggcggcagagtcacgggcgcgtccgccgctaccgaagagggcgcctgcgagtgcgaagtctcgagcacatcggtccccgcgctatcgccttcgccatgttccgtccgagcaaagcacggaagcacggccggcgtccggcggagcagggatagctagcgctagctagctacgactggaagcggacgcttctgcctgcgccactgccggcccgtgagccccccggccgttggcgccttgcgcgcgcgtcctcgccaggtgccgcgcgccccgtgcatgccgcgggcggccagcacgtggctcgtaatggacccgcccatgacgaatggaattgggaggacgcggccatgaatccacccatggtttgtgttgataaatcgtgcatgcaggttgccatcgcgtgcaccagagagtcagagtgcggagggacctcgtcgcaaacctcacttgcccggcccaaccgtacgtgacgctcctcctctataaaagggggggcccccccggcggtgcggacagaacagcccgtcgcgcgccgctgcgttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcaagccgcccaagcaccaccatggcaagccgcccaagtgcccgccgtgcaaccctccgtacgtgcctccgacgcctcggccgtcaccgccgtacgtgccaccgtatgtcccgccgacgcctcggccgtcaccgccctacgtgccaccatacgtccccgtcccgccgacgcctcggccctcaccgccgtacgtgccaccatacgtccccgtccccccgacgcctcggccctcaccgccctacgtgccaccatacgtccccgtcccgccgacgcctcggccgtcaccgccgtacgtacccccgacgccacggccgccgactccgccctacgtcccaccgacgccgccctacgtcccaccgacgcctcggccatcaccaccaccgtacgtgccaccctacgtccccccgacgcctcggccatcaccaccctacgtgccaccgtacgttccgccgacgccgccggcggtgcggacgtgcccgatcgacacgctgaagctgaacgcgtgcgtggacgtgctgagcgggctgatccacctggtgatcgggcaggaggccaggtccaagtgctgcccgctggtgcagggggtggcggacctggacgcggcgctgtgcctctgcaccaccatccgcgcgcgcctgctcaacatcaacatctacctccccatcgcgctcaacctgctcatcacctgcggcaagcacgcgccgtcgggcttccagtgcccgccgctctacgactgatgaacaccaccaccagccaacacttctatacgcgccgccatgcatgcatgatgtgatggcatcctgtgcaagctagcgctagctagtagtagcatgtctaccatttgctccgtgatttctctagttcttgctctcgcgagtatgcgtacgtaatgcgttgcttctcgtcaggactcgggaacttttccaactccgatgctaagcgtgtagcttgcttaatcagtcgatgtaccatgttaatcaagtgctagccctttctctgctctgtcgtcgaagttcttcggtcttcacttcttgatctgcagatgatatatgaaaacgttatacgaaatggaatataatattctatcttgttgacaacgactgactctggcactgcgaagtgttgcatgcagaacttttatatgaataccaaagttttttttttgcctatgtttttggcagtgtaatatggaggcatgtgttctaatatttgcagggaagcacctctttgttgacgtacgattctgatgtgatgtagaactaaggaacattttttttggacatttcgattgttttgtcggtgtactcttaactattttgttttccgtatgtggttgttagacagtttacaggttcctaggaggtgcaggtgcttaaatggaggtgcttaaacggctaaaactaaagggatgattcaagtaacggattaacggtgacaaagcagaaggaaaaaatgacagctctagtctaacccacttattcgatgcaatcacgttcagcagcttctgttgcttctacttcttgattcagatatattataagttagatcataacaatgattattggtcagacaattacagttttaatgcccccctctatcgatggtattcaatctcgattttcaaatgatgagcatgaagattaaggattgtctagttctaacttctaagtattagtagtgttcgagggatacttggactagtgatagaatcttagttttatttctttagccgtactataaggggtatgaatggaaagcttgacctatagttgagtatatatagtagttccctctatcttcactagatttcgtctagtgcagcaccattgagtccgttgtgcaccagacatcacaacatcggacagaagtcgtcatagcggcagctgcagcctcccctcatcggacgtgtacagtagtgtatcgtacatagcctccatcaaattggtatgaagagatgtccacccaagctgtcccgttccatagacgttttctcgaggaacaattttcctagtatggcaattggcaaaattagctctgcaccaaaagtggcatatgaatgggcctacaacttgggctttaggagttgtctgggtagacgggctaaaaatgtctgttcgcaacgcccgcgcacacagagcaggcaagcaagggcgtctcagtcagagccccaccaggctgcccactcggcccagcagacaaacaggcccaccaggctggccgactaagaattcacaccacgtccttggtccggtggtaaccgcagacccgtacctcattccggctcccttctcccgtacgaattcaaggcgcacgcggacgcacggcaatacggcacggcgctcagatctcaacggctgccgttgccggacagcgagcaccctcgaccgtcgtgtcacctgacaacgcagccgcagcagcttccttcccctgcaaggaagaacgagaatcgaatgcctcgcactgacgtggcagtccggaccaaccaa

SEQ ID NO: 6603 - DNA, 1396 bp, Zea mays
  misc_feature (5)..(5): n is a, c, g, or t
accanagagtcagagtgcggagggacctcgtcgcaaacctcacttgcccggcccaaccgtacgtgacgctcctcctctgtggagtgtgacctcgcgcggccgggacagaacagcccgtcgcgcgccgctgcgttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcaagccgcccaagcaccaccatggcaagccgcccaagtgcccgccgtgcacccctccgtacgtgcctccgacgcctcgcccgtcaccgccgtacgtgccaccatatgtcccgccgacgcctcggccatcaccaccaccgtacgtgccaccatacgtccccgtcccgccgacgcctcggccctcaccgccctacgtgccaccatacgtccccgtccccccgacgcctcggccgtcaccgccgtacgttcccccgacgccacggccgccgactccgccctacgtcccaccgacgccgccctacgtcccaccgacgcctcggccatcaccgccgtatgtgccaccctacgtccccccgacgcctcggccatcaccaccctacgtgccaccgtacgttccgccgacgccgccggcggtgcggacgtgcccgatcgacacgctgaagctgaacgcgtgcgtggacgtgctgagcgggctgatccacctggtgatcgggcaggaggccaggtccaagtgctgcccgctggtgcagggggtggcggacctggacgcggcgctgtgcctctgcaccaccatccgcgcgcgcctgctcaacatcaacatctacctccccatcgcgctcaacctgctcatcacctgcggcaagcacgcgccgtcgggcttccagtgcccgccgctctacgactgatgaacaccaccaccagccaacacttctatacgcgccgccatgcatgcatgatgtgatggcatcctgtgcaagctagcgctagctagtagtagcatgtctaccatttgctccgtgatttctctagttcttgctctcgcgagtatgcgtacgtaatgcgttgcttctcgtcaggactcgggaacttttccaactccgatgctaagcgtgtagcttgcttaatcagtcgatgtaccatgttaatcaagtgctagccctttctctgctcacagcagccccatccaccaaacagcatggactgcggatggatggatgctgttacccccgtcaggctttattttaagttaatcttaaggaaaaaatggtgcttcttggtgctacaaaaaaaaaaaaaaaa

SEQ ID NO: 6604 - DNA, 1445 bp, Zea mays
gtcgtcttttttccggtcgtggtgataagccgatcgattatggttataaagcccatcacccgagcaggaacccacaccacaccaccgccgacacactctcgctcgctctcgctagctagcgggaaactactatggcgtgggcgtctccgcgcggcacagcacctcagctcctcctcgtgctgtcgctgctgctggccgctgccagatgcctccctgcttcccctgagcaataatgcgcccccgccgagacttccgccggcggcgaaggcaagggagggcggcgcctcggtgtcggcggggctgctctccacgctgcgcgaggcgctggacgcggtcaaggacgtcacatccatcatctcgtcgttccccatcggcggcatcctcggggacggcggcggcgacctccgcctgtcgtccgccgtcgccgactgcctcgacctcctcgacctctcctccgacgagatgtcgtggtccatgtccatgtccaccgactcgagcggggcgggcggcggccgcctcggcaccggcgacgcccggtccgacctgcagtcctggctgagcggcgcgctcgggaaccaggacacctgcaaggaaggcctggacgcgaccggctccgtgctgggctcgctggttgccgcggggctggacgccgtcacgtcgcttctggccgacggcctcggccaggtcgccggcggcgacgacgcgaccgctccggcgtcgtcgttgccgccctcctcctcccgccgcggcgccgccccgccgcggtggctgcgcgcgagggagcggcggctgctgcagatgcctgtggggcccggaggcctggcggtggacgccgtggtggcgcaggacgggagcggcaacttcacgacggtgggcgcggccgtggaggcggcgcccgcgcagagcgcggcgcggtacgtggtgtacgtgaggaagggcgtgtacagggagacggtggaggtgaagaagaagaagtggaacctgatgctggtcggcgacggcatgggcgccacggtcatctccggccgccgcagctacggcgacggctacaccacctaccgcagcgccaccgtcggtgagcgcaccgtgtctactaactgttcctccccctcctccctcatgaactccaaataaaaataactaaaaatttcatgaaaactttttcgattaggatgttctaggtaatggtctcgtgcgttagacagtcgtttgaaaacacgctcagcaggaccgacttgatggctacttcacgaattgaatacgcgaactaatgcaatgcaatccgtttagttcttctcctgggatgagctcagtacagtaaagcttacacattatcagctttaagtaactgtttactacagtactaggcgtatatggcaacgtagaaatacggtcaaggtgtcatcattgcattgccccgcggtatatatggctacgaccgacag

SEQ ID NO: 6605 - DNA, 3823 bp, Zea mays
tcaaaataaaatttattttgcttctttagtggatttatcatcatcaatataaatataaaaaataaaagctaaaccaaatactattttgaaacggatggagtatacgataagtaattgagacattagtttaacaatataaacgagactagtcgataactcgatatcgtatcgctttttgcgtatttgtgtatagaatagataggtttaacaaaaaaaatactagcgtccagtgtctagggggcctctatttttgggagcccggtgtggctgcaccctccgcaccccctcaggaccggccttgataattacccctttaattcattgcctgtttccatgggcgtgtttgatttacaccccttggtccaggcagcaaccctagatgtacaaatttgattgcctgtggttagatcttgttaggtagcgtagacagatttatcgtggctgcaatgctctaaaaggacagctcaccgtagcgtaatgcattatagtaagtatgcatgttccttcacgaatcagtacagtaaccgtgtatctctaatactgtcttcaggtcctataaaatagaaagtgccgaaatattaatgatattgttaatattgtttacatagtgtagtttaaaatagaggatgaggtagataatcttctagagatagattaaaactcgacgtgcaaagataactctccggttgatcaaactcatgaacaacatagcacacacacgattaaaaaggaagaaaggcgaaaagaaaagagagagcaatccaaaaactcaccttccatttgtccgtttgctccgtgatcatgtgccccaaacgcaccgacctcaccctcccctctttaaataaccacactcccccgccggcccccaccaccaccaggccaccaccatcacgcagcacctctgccatccccgcttccctccctcactcccagccacccgaaccccaccaccaaccagccggatcaagtcgagtgaagcgatgctggaggaggcgatacccgcgctgctgagcgccgtccacgggtggttcacccccgccgtgctcttcgtcgtcctcaacatcgtcatcggcaccatcgcggtcacctccaaggccgccgcctcggcgaccggcggcgacgaggaggaagtcgccgctgctggcgcgggatgggagccgcaccggcggctggcccgcgtgccgtccatggcgttcgagcgtctcaagtcgttcaacggccgcttcgccacggccgagcccgcgcccgccgagacgggagtggtggatctggggtacaacaagcagccccacacggcggagatggagaaagagggccctgtcgtcgtcgagggcgctgtagatcctgagcccgagcccgagccccaacacgcggcgcacatggagcggagcaggtcggaggcggatgcagaggcgaagctgccgttgctcccgtcgcgtctgcacaagtccgccagcgacaagtcggcgttcgcgcacttcggcgccgaggaggtggaggagaccgtgcgcgcggtggaggcgcggcgccccgcgacgacgagggagaaccgcggtcggcggctccccgtggcggagccggagccggcatctgagtcgtcggagtccgagtccgagtccgaggaggaggaggccagcggcggcgaggtggacgcgcgcgcggacgacttcatcaaccagttccgtcaccagctgaagctgcagcgcatcgactccttcatacgccacagggagacggtccgccgcggccaggcggcggcccagggcgtgtaggtgtgccccagcggagggagcgagatgctgcaagagtcggtgacaccgtgaggagaggttgaaatggacgaagagaagctgcagtgaagggagatcgggtgggggaggaggagatggtaattcctgcctgcctccttcgccgtctgctttggtttttcccgtttgctggttcctggtgcgagcatgtcgtagctccacactatgcgtttttttttgggggggataggagaaccttgccttgcgcaatgtggtatgccacattgcatcgcatcatatatattcataatatatgcgaatcgatagtagaaggaaacccgtagctgtaaatctatggctctcttctctttgctagcattgctgcttcacggttctttacggctttgtttagattgctggtgcacatggtcacaggcagcggttctcctctctttagcgtctcctctgtcgcgggaacagaggaatgccgcagcgaacaatcacgagcaatgcgtgcgtagctggaacaatcacgcaatgctgatcagccctgccccctctctctggctctttctaccgtgaacggcactgttcgattgcgttggagcgccactggcgattttaagataaggcacgggcgattgcgcccgcggcggcagtcactcatgagcacaagctgatcccttggagattcctctagaaacctgtgtgaggcgcatagagtacgtacggccaagcatcgagatggtggaatcggcggtcgctcgcgggggcagtttattacttactgctggagctgtcccctgctgccctggaccccgtcgtgttcggtcgctttccgcctctcccccgccatcgccctgctttcttttaatcgccgtcgccgcggcgcgctctcacatggcaccacgggccgcattgcgcgctgctgagtggtggtgacacggcacctgctccgcccgttccgtctacggccgtataaaaatctgccatctttgccagcacctcatgctcgagctccacgttcgatgctgctcgcagtatagtactaatgcgtttgccatcggttggcgctgttcatcttcccgggccagctctctctctctctctctccttacaaaattgcaagcattggctcgtttcccggcaacttccagaggtgaacgttcaatctccaccccatcatcctgtgcaagtgagaagaagcgcagggcacagataggctactactaccagtccctgcatcctccctcctcccggaacgacagctgttttgttgcctcgcgggcggacggtggatggtcctactctcgcgtctgtgtcgccgtgcgtgcgtttgttagacgtggacgctgatctttgtgtttgcccactagtgtgcggtgcacatgcgaccttgcagcatcggattctgtcgccggaaacgaaatggaacaggacgaggatatttgttttttccttttctttttgactaggacacgctgctttctgatggatttctgataaggtgatgccttttcgtgacgacctttttattttgaccgaataaatatcaccgtaactcccttggtaaccagcaatataatgccggattctccatgggtaagcccatgtttgtttacctcaaggttatatgatccataatctataaatagatgcttatgttatataatcatgaagtctacgtggaagagatcaaagtaaaaaaaaacaagcccatcgacgatgcacagcacataatcgttgttccagaacacagcctggcactagtacatagaagctctgtagatgcagttattgttcacccattttatactgacgttttacagaactggctatgatagacgctagtagaaaaaattatttgtaaagacggtaattgagaattgccatggcggttgaaataagaaaaccgacagtggaaatagattttcactgtaggtcaaagtaataaaaccgtcagtggtaaaatattttccaaaaaacataaaatatgtttttaaaatagcaaaaaaaaattacaggaggcctcacccaggtctcactcgcccgtttccgtcgaagtataatccgag

SEQ ID NO: 6606 - DNA, 877 bp, Zea mays
agggcaccgacacagccgcgcgcttgcactctactcgtgtgctggggacctttgggtaccatgccccagaatacgccatgacaggccagatcaaccagaagagcgacgtctacagtttcggtgtgatccttctggagctactcaccgggcggaagccggtcgaccacaccatgccgaaaggccagcaaagccttgttacctgggccactccaaggttgagcgaagacaaagtgaagcagtgtgtcgatccgaagctcaacagcgactaccctccaaaggcggttgcaaagctggcggcggttgcagcgctgtgcgttcagtacgagtccgacttccggccaaacatgaccatcgtggtgaaggcgatcacgcctctcctgaacgcacctaaaccggctgctccggctgcgccgcaatcctgatcaaccaaccagccagatgacagaatttagcctgtgccgcatctctgactcctcaacaccgcggtttccctctgtttctgatcgtagatatgtgtttcaaggaaccgcgcatccttgctccatccatccagcgcttatgcttctgtaaaggaaaaaacaacactgatctgctggtgctgcaggacacatataggggaatttttaaaaatgttaatctgctactctgaattcgtgtgcttcttgctgtaagtttgtgttataccatgtgcagttttagagagtacacatgcagtttctagctacaaaagtaggcacgacgatggtttccagcttttccaaatataaaacaaattcacagccacagctacagagtgcatcagatcaagatagtattggctctttttcaccatatataattgctggtaccaattaccaaaggagcaaactctgatgac

SEQ ID NO: 6607 - DNA, 3576 bp, Zea mays
ggtccttgagatttgaacccgtgacttctctcatgtgaaacctcctctaccaacccaccctattttactggtgtttatgttacgttttccttccccacatattataataaataagtgtaaattggttgttttaggcactaaatgaattcaaacaataatgttgtcaactacaaagttgtataactttttgagatctacaacttttattttgataatttcttcacctgaggtagtttacaaaaatttaatttcaaatttgaaaacttcaaatgagttttcctatggtaagatgatttcaaatcaaaaagtcgtcaactataaagtttcgtaacttttcaagacttacaactaccattttgattgttttccatcagaggtcgtttgaaaaattcaatttttttgaattcagacacggtttcgttgacaagatgacttcaaatcttaaaggtgtcaagcacaaaattctataacttattaagacctacaaagtttattttggttgattgattatttattcatctaatatagtggttgtaacattatttataaatactatggatcactcttatagtttcatgaactataagagatatatataagttttatgaatatatttattttaattttatcatatgaaaaaatgaccaaagaaacgtacatattgatgatttatacaactttgtaattgaaaaaaaatttatattaaattattttaatgcttcaaaatatgatttaaaatttttccttgcctagtgtggtaaaaacacttggccgaagctcttttccgagtgtttgaaaagtttctttgctgagttttttttttgtcgaacggtttttgtttggcacttagaaaataaattctttgcctgaataaattctcgacaaatcaatcggcaaacttctgtttatcggtagggtgggcaagaaaaccaacgattggatgtatacatcatgcaaaagaagaaaagaaagaaagatagtcacgcggtaaatcacaaaggtcaaattaattaaagtgcacggggacggggagaagcgtgcattctgctttgctaagaatagaatggcggggcgcaacaaaacgcgagctgaatcgcgcgcctgcccggtggggcgcgaccgatacggcagttaaaaagggtgggacgccacctttcccgcggaaagaggagctcccaccgctaatccatcgtcctcgtccctccctacccgcggccggccacccacgccgttgctgctgttctggcgcgccctccacctcttcgtctctcgtaggtgccgtcgtcggagcttgcttttggggaggtaggtaacgagctcagccttcttctcgcacatcatcatgtccgcatttctggatccaccgctgtctgcttgtagccgatcgatttcttgcattatctcttgtctctagccccgtcgtgcctctctaatcgaacatagtaagagaatgtgaccatccattctgtgatgccatgggggaaatgccgaatactccaggtcgtgcggcatgatctgctgaccgccccaaatcaacccggccgcgcatcgaccgtcgtcatccagtccgacgaggaggaggaggaggagagggagaggggggagccacaaaactaagatgtcttgctgcggtggcgccgaggaggacagctacggcccgccggccaaccaggcggttccaccacccaatgccaacgcccccggtacagctacactacaccaggccctcggtctcgtctggccaccgccgccgccttctcatcccaatccatgcgtggcgcaggcaacagaggcgggccgagaggaccgggggcgccgagggtcggcggccccgccaagcccgtcagcattgacgtgcccgccatacccttcgacgagctcaaaaggatcaccaacaacttcagcgaccgcgccctcatcggcgagggctcctacggccgcgtctacaacgccacgctcagcgacggccgcgccgccgtcatcaagaagctcgacaccagcgcctcgcaggactccgacaccgacttcgccgcgcaggcattgcagcttgcctgccatcttcctgtttttctctcctttgttaacgttgcctgccctcatcaccatccccatcgtcgtacagatcgcgatggtctccaagctgaagaacgagtatttcctggagctcctagggtactgcttggaagacggcaaccgaatgctaacctatcagttcgccacaatgggttctttgcacaacatactacacggttggttggtgtagctctgcgcgcctctctgccgatccacgcaactcctcctctgccggcggtgacactgtttcgttggcgcagggaagaagggagtccagggcgcggagcccggtcccgtcctcaactgggctcagcgagtcaagatagcctacggggcagcgagagggctggagtacctgcacgagaaggtccagccgtccatcgtccaccgggacatccgctccagcaacgtcctcatcttcgacgacttcagctccaagatcgccgatttcaacctcaccagccagggcaccgacaccgccgcgcggttgcactccactcgcgtgctagggactttcggataccacgccccagagtaagatcgattaatggtgtcatctggcatgccaaattagttcttaccccaagattggcattctgaactgaaccgtcttctctgcagatacgctatgacaggccagatcaaccaaaagagcgacgtctacagcttcggcgtgattcttctagagttgctgaccggaaggaagccggtcgaccacacaatgccgaaaggccagcagagtcttgttacttgggtactgtcatttcgtttccttcttcaaaccggtgcagacgccaacgaaaatctcctgactctgaacgtcacaaaaactatataggccactccgaggttgagtgaagacaaagtgaagcagtgtgttgatccaaagctcgacagtgactaccctccgaaggccgttgcgaaggtaagcaaactagctagcgtacaaaaccaccggatgtgcgacagaggcttacacacgtactggcatttctttcttctcttcttccaattttcagctggcagcagttgcggcgttgtgcgttcagtacgaatccgacttccggccaaacatgactatcgtggtgaaggcggcacgagctcttctgaacgcgcccaaaccggcagctccagccgcgccgcagtcctgatcaacccagacgacagaattagcctggacctggacacggttcccctgatctgttcctcatcgcgcgcagatgtatgctaaggaaccacgcatccttgctccatccatccattgcatacaggggaattttgtaaaatgttaatccggtactctgaattcgtgtgcttttccttgtttgtttgcctggcttgttgtgagtttgtgatataacatgtgcagctttagaaagtacacatatgctgtttccagctagaaaaattacgcgagacctccaaaacctttttagttcacatgaagtgatactgaacaagagcttgcagattgagtgctaaaaaaaaaaaaaaaaaaaaaaa

SEQ ID NO: 6608 - DNA, 1668 bp, Zea mays
gcacgagccgatacggcagttaaaaagggtgggacgccacctttcccgcggaaagaggagctcccaccgctaatccatcgtcctcgtccctccctacccgcggccggccacccacgccgttgctgctgttctggcgcgccctccacctcttcgtctctcgtaggtgccgtcgtcggagcttgcttttggggaggtcgtgcggcatgatctgctgaccgccccaaatcaacccggccgcgcatcgaccgtcgtcatccagtccgacgaggaggaggaggaggagagggagaggggggagccacaaaactaagatgtcttgctgcggtggcgccgaggaggacagctacggcccgccggccaaccaggcggttccaccacccaatgccaacgcccccggcaacagaggcgggccgagaggaccgggggcgccgagggtcggcggccccgccaagcccgtcagcattgacgtgcccgccatacccttcgacgagctcaaaaggatcaccaacaacttcagcgaccgcgccctcatcggcgagggctcctacggccgcgtctacaacgccacgctcagcgacggccgcgccgccgtcatcaagaagctcgacaccagcgcctcgcaggactccgacaccgacttcgccgcgcagatcgcgatggtctccaagctgaagaacgagtatttcctggagctcctagggtactgcttggaagacggcaaccgaatgctaacctatcagttcgccacaatgggttctttgcacaacatactacacgggaagaagggagtccagggcgcggagcccggtcccgtcctcaactgggctcagcgagtcaagatagcctacggggcagcgagagggctggagtacctgcacgagaaggtccagccgtccatcgtccaccgggacatccgctccagcaacgtcctcatcttcgacgacttcagctccaagatcgccgatttcaacctcaccagccagggcaccgacaccgccgcgcggttgcactccactcgcgtgctagggactttcggataccacgccccagaatacgctatgacaggccagatcaaccaaaagagcgacgtctacagcttcggcgtgattcttctagagttgctgaccggaaggaagccggtcgaccacacaatgccgaaaggccagcagagtcttgttacttgggccactccgaggttgagtgaagacaaagtgaagcagtgtgttgatccaaagctcgacagtgactaccctccgaaggccgttgcgaagctggcagcagttgcggcgttgtgcgttcagtacgaatccgacttccggccaaacatgactatcgtggtgaaggcgatcacgcctcttctgaacgcgcccaaaccggcagctccagccgcgccacagtcctgatcaacccagacgacagaattagcctggacctggacacggttcccctgatctgttcctcattgcagatgtatgctaaggaaccacgcatccttgctccatccatccattgcatacaggggaattttgtaaaatgttaatccggtactctgaattcgtgtgcttttccttgtttgtttgcctggcttgttgtgagtttgtgatataacatgtgcagctttagaaagtacacatatgctgtttccagctagaaaaattacgcgagacc

SEQ ID NO: 6609 - DNA, 811 bp, Zea mays
  misc_feature (806)..(806): n is a, c, g, or t
  misc_feature (809)..(809): n is a, c, g, or t
gatggggtgcgcggcgtcagccgccgacggggccgagctccggcggcgggggtgggcgcgggcgggggagccggggcacagcgaggcgtccacctcgggtctgctggcgccgccgcaccagcaggaagggcaggaggccgagtcgtcgtccgggggcaggaggcgagggtgcaaggtggcgccggagcccaaggagctggaggaggggaccgccgcgctcccgtcgatgcccggctcgccgagcttcaggtactactgccagaagaagacggcggccgtcgataggatcgtggctgatgccatcgacgccgatgacaccgtcaggatcagagcgacggcgcgacagctgagcaataggagcgaaatcacggcaaacaaggcacaggactccaacgaggtctctcaacctaaaggggggaccaaatggcttaggttcagtggcttgtcgatcgtcgctgccgcttggcacaagcacaacttgttcagccgccaaagaagcaagccttcgccgcctcctgctgccgcttcagatgcaagctcccaaccctgatcaggcagcgctatatgggatcttctacattttactacgtctcagcttataaaaacacacacgcatggctcattcagtcatcgtttatgatgcatcgatgctggctttgcatcattcgctgatattttttcagccttggttagtccctgtaagctaaagctgattctgtaaatggtgcaaattagtgttaagaaaggagggcaatctggaaatccatccaagctttgcgtcatttggttaaaaaaagaaaaaaaanaanaa

SEQ ID NO: 6610 - DNA, 931 bp, Zea mays
  misc_feature (872)..(872): n is a, c, g, or t
  misc_feature (879)..(879): n is a, c, g, or t
atgcccctctacatctcctcttccccgcgcaccccccggcccccccgcctcccgagcccaccctccaatcttcgcttcctcaccatgagcgcctccccctcgagctcctcgtcccgttcggtgcgcggtgcggcggtgtcggtgccttccctcggcgccgacgaggcctgcgcagtggcagatgaagccttccggaggtacacgtcgccgagcttattgaggagaggcggcgtcggggtggccgtcgtgtggttcaggaacgacctccgagttatcgataacgaggcgcttctgcgagcatgggcggcttccgaggcggtcctgccggtgtactgtgtcgatccgcgggtctttgcggggagcacgcattactttgggttccccaagaagggagcattgagggcgcagttcttgatagagtgtttaggagacctgaagcagagcctgaggaaaaagggcctcgatttgctagtccggcatggcaagcctgaagagatccttccttcaattgcaaaggccgtcagtgcacacacaatatacgctcataaggaaacctgtagcgaagagctcctcgtcgaacgcctagtgagcaaaggcttggaacaagtccagattgctcaaggaggagcatctgtcccgaagaggcctctgaaccccaggttgcagctcatctggggagcaacaatgtaccacatcgatgacctcccgttcccagttagcagcttgccagacgtgtgcacacagttcagaaaggcagttgaatcgaagtgctcagttaggaactgcgcccagttgccaacgtcgctcggtccaccccctagttccagcatagatgagattggaggatgggggacagtaccaacactggagtnactaggncccagtgttacgagtctgagaaaggaatgcatttcataggaggagagagcgc

SEQ ID NO: 6611 - DNA, 3953 bp, Zea mays
  misc_feature (3000)..(3000): n is a, c, g, or t
agaaacgatatctgggagtaagaaaagaagtacactgcgattactggcatcatggcacgcacaaagtcttgatcttgtagactcggggagtattggcacttttgtcagtaagggattagtggatcgtttgatgttaccaacacagagttgtgcccagacacagtttcgggctgctgatggaggaattatgagctgtactgaatgggtgccaaggctgcaatggtttattcagggctattcgtttgtttctcaggccaaggtgttaccattacaatgttatgacatgatattaggcgaagattggcttgaggaagtaagtccattgtgggtggattacaagtcaaagcaactcaggtttacctatcaaggtactagagtgtccttgcaaggggttcaagataacatcacgagctgtcagagtatctcaggacataagttccagggattacttaatcatggagctgtctatcattgcatacagttgcttctgataaatcaggacaatgatttgcctacacaaggtcctgcctctcgagtatgtgagattcagaatattgagcaacagccaatacctctcagaattcagcagctcattgattcttttgctcacctcttcagttcacccacaggacttccaccacatcgcttagctgatcatcgaattcctctaatgcctggtgctcaaccggtgaaagtgagatcttaccgatactctcctgctcaaaaatctgaaatcgagaagcaattgaaggaaatgttgactcaagggataattcgtccgagcactagcccctttgcttctccggtaattttggtcaaaaagaaagatgggagttggcgattttgtgttgattatcgacacttaaatgcgatcacaatcaagaataaacatcccatgccaatagtggatgagctgctagatgagttggtcggagcttgttggtttactaaattggattttagcgctggataccatcaggtctgcatggctattggagaggagtacaagatagcattcagaactcataatggcatgtatgaattcatggttatgccttttggctttacaaatgctcccgcaacatttcaaggacttatggatcacatttttgctgatttattgaggcatggagtgatggtattcatggatgacattttgatttacagccacacattacatgagcatgagttgttgttgcaacaggtgtttcagactctgaatcaacacaagttcttgattaaaagaactaaatgcacttttgctcaaccatccatagaatacttaggccatgtgatttcagcccaaggagtatctattgaaccctccaaagtggctgcagtcaagaactggcctattcccaagaatgtgaagcaactccgaggttttttaggtctcacaggatattataggaagttcatcaaagactatggaattgttagtcgaccactaaccttattgcttaagaagggttcaatgttccggtggtctgagcaacagcaagtggattttcacatgcttaaatagaagatggttgaagctccagtgttgatggttccggatttttctaagcagtttgttctggaaacaggtgcttgtgatctgggtataggtgcagttttgatgcagagtgagcatcctgtggcatacctgagtaaggcattgggaatgaagaatcaggcgttgtcagtatatgagaaagatgccagcgctatattgttggcagtggaaaaatggaggccctacttacaatatcaaccgtttgtcatcagaactgatcatcacagcttgcggttcttaactgaccaacgggtttccacccggttgcaacataaggcgttagttaaattgatggaccttcaatataccattcagtacaaaaaaggatccacaaatgcagctgttgatgccttgtcgcgttgtcctgatcctccagacatttatgcagttttgaaagtggttcccacgtggttggcatgcctgcagcatgggctatgatgatgatgaggaaactaagaaacttattacagctgttaccttggatccagacagtcataagaattatacattaacttcgggtattctgaggtttaaaggccgtgtgtgggtggggaataacgcattggctcagcaaaacattttacaggcacttcattcaagtgggattggaggtcattctggtattcaaggtacctatcatcgtgtgaagcaactttttgcgtggcccgctctaaaaaaatcagtgcaacaatatgtccaatcttgtgagatttgtcagcaagctaaaacagaacatgtgaaatacccgggattattacagccactgcccattcctcaacaagcttgggagatagtgagtttggattttattgaaggcttgccatcctcagaaaattataatactatccttgtggttgtggataagtttaccaaatatggacacttcttagccttatctcctccattcacagcattgaaggtggctcaactatttttctcgcaaatttacaagttgcatgggctgcctcgcatgattatctcggatacggacaggatcttcacgagtatgctctggcaggaactgtttcgactgtcagatacagtgctaatgatgagctcgagttatcatccacagacagatggacaaactgagagattaaatcagtgtttagagggtttcctaaggtgcacggtgcattcgtgtcctcgacgatggcataagtggcttcccgtggcagaatactggtataatactaccatacactcttccttgggtcgttcgccttttgaagttcagtatgggtatgttcctcgcacactaggaattgctaatctaaagctttgtactgttcccgatctggaaacatggatgcaagaaagagaattgatgtatgaattggttaagcagcaattagcacatgctcagcagcgaatgaagagccaggcagataaaaatcggtctgagcggagttttgaagttggtgatcgagtatatttgaagnttcaaccacatgttcaatcatcggtagctctgcgatctaaccagaaacttgcattcagatattatggaccctacactgttctccagaaagtgggacaggtcgcttacaagttggaccttccggacagctcaaaaatatattcagttgtccatgtttccttattgaagaaatatattcctcctccacatgacatttctgttgatctttcttctgtgtgcacggatcctttccagatattaatgtcggacaccatattacagcaacggtgcattcgcaagggtcgtgctttggttcagcaggtcttggttaaatgggtgggactgacgaatcatttggctacctgggagcatgttgatgatatcaagtgtcggtttccagcaacaacagcatgagggcatgctacgtgtaagggaggggtaatgtcaggaccatggttagtctatcatcttcagtagagtattttggatattcgtggttgggctgtcagcccatgtaagaactaagaaatggtcagcagtatataagccagggtggtggagggttcaaaaggggagaaaagaacagaactcatttacctgtatcttcttcgttgcctcacggactcagctgtgttctctgtcttcctcttgctctccatcttcctggtgactgaattccattctcgggcaagtatccaagggaagagggttgggttcatgacagaaatcctcgcgatgctcactagtgtctgtctccaaggggatgtggggagggaggcgaggttttggggccgcggccgcgagacagcgagattttcgaggacgggggcgtctcatggggtggcaagatttccaggggcaggggcatggtgaagtgtggatgcccacgttgtgtctttatagagtagtatatagataacacttactatgcacgccttgacccaacagccaggtttgacgaaattcaggggttag

SEQ ID NO: 6612 - DNA, 6811 bp, Zea mays
  misc_feature (2531)..(2531): n is a, c, g, or t
ccgtaaaaattcatgaatttttaggctatttggtgtattattaatttcttgttgtagaaaatcatcaaaatacaattaaattcataaaaatattgtagtgtcgatcggaaattgtgaataagttaccaatattaataaatagtttataaaaagataattctaagttcccacatagagataatcttaagtccccacatgaaaatgttaaagtctattattttgttataaatttagacattatttcaatgattttggcctaaagatatgtttaaacaaaaatgtgttgtactacaaagttatagatctcttcgagctctacaattttcatataaactttatcttcatccgatttcatatgtaaaagttatgattttataactatattattatgcagaaaaagaaaaaacgggtacccgaattccgggtacccgtatccgacccgaatatccgggtattcaccgggtagtactcgttccgtatccgacccgaatccgaagctgtactatccgggtattacccgtatccgtcccgaatacaaaaatatccgtatccgtatccgaaaaatggtcccgaatcagtatccgtatccggtacccgtttcgggtaccctaacccgttttcacccatactaggcggtgatgtactcgtacttacatgtttgcgtataagccaacggccgcatccaacgtctatatctcacgctgctctgctctccccttgtgcatgcatgggtacagtatatacgaacccccgaccaggaaacggaaacgcagtttgcattttgcagcacgggcaagatacatatgtagatggacgccgagctgagcagcccgagcatggcatcaatgtccgtctctctctctccacacccgcccgtttcgagtcccaacggatccttccgcacatctcccacccttctcttggtcagaaaccgcccctgctcctccgtcctcacaccctgctctctctctctctctctctccctctgcttctgatccttcctcctccaccctttattctactcctcttctctctccggcgtaaaacaatcgtgctgtgagaacgatgggagagaaagagagtgagggagccaagtaatggcagggggggaaccttcttttcctgactcccccctgtgcctgctgcagcccatcatttgtccctgatccttgtgcttcgttcctgttgcgctttttttttcttgggccatcggtggactggagccgtcgccgaatcaggagacacttcccatttcttacaaggaaaggggccggggtggagcctcgccatccggcgatcatcctcctccagtcacagcacaggttcgcgttccatccccattccccctcgatggctccgtagccagggtctctgtttctcggcctgtcattcgccgcgaggggatcgtccctactccctaaccctctatccatacctgtgtttctcgcggaatcgatggcgcatccatctcctgcggatctcgcagaatttttggatctttctttgttctacattatacgcagttttgcgtcatcagcatgttcttgcatgtttctacatttctttttccttatcctggctgttctctccggatagacgtttcatccttgtcatctaaaaccttaacctgaaacaggagtataataagttcgagtttagagactattcgacttgacattttggagagagctctcggggaaaactgttccctgtcggaggttccatgccttcctgctcttgatcacttgttcttcaccgttaatctatatagattatatgatattaagtcggtttaaatccttagcgaggatacttcaattcacatggaattagaataatcgaacaaagacttaatttagtgttcagtttgatgagcgcgttagtccaccatcttctcactcatttttttttgttttgtttgtaaaatataatgaattgatctatcatcacctcattcgttataattagttagtattaatacgagaaatgagatcatcccatcaaatttaagaaaatagatctataatacaccatctcattttggatggaatgattaatcaaaccaaaaactctaggtggatgcgatgaaatagtcatgttccattctttatttccttttagtttttttagtacagtattacttggtaggggagtgtgctgctcgcatcgactttcgcatttcaacactgtcttgtttgttttgttctctaactatatggattaagtgttattgagtaggtttaaatcacaaacaagtcaaaacctttcataatttttttagtcccatcgaatccaataactgaacaatcctttatgaatttcttaaaaaataccggtactatatgagttgtcgtttagtgtcattgacacggtttttgttttgcaaccagcttcacaattttcatcaaaagaaatatcactaccgttgtcagattcctgttgtctctcaatgttatcattgtctacctctgtaactttgaagctgatgtttagtgtcatttaactaattttcaccccgttaggttaggttnaataatccaagcttgagatggaaggtcatgtagcaatggagtggaatgatcctaatccaggcccagaatccttgacgagcttccaaaccgaagctgttcgaccagacaccgcagggggccacagcaacgacgacgttgaagctggatttgagaagcatggcttggcagtcaccgtaaggccgcctgaggaggaagctcggtcagtgccactaaccccacagcttggccagaagtccagtcctggcagcagcctcgcggagaggatgcaggcaagagctggattcatggtgtcgaagctcaacatgcccttcagcacagcagctggagctgacaattcagtacccgaagttccatcgccctacctcacgatcccgcctggcctgagcccagcaacgctgctggagtcaccagtcttcgtttctaattccatggtatgtgctcttctctaggttatgatagggtgtggacgcgttaccagaatcagtattgctttcgtctatggatgctaaactggcagttcaagaatgcttgctttaataagcttttgacctctccagggagttcgtgaaagctctacttcagttccatgatgatcagttctgccttgttttgtaccatccagtctcttctttccaaacaggcttctgtttgttttctcaaaagcagaaaaatagtatcgtaccattcaaatatttcaaagttttcttgaaagcaagaatatgatgatcaatctctgttctttccatagttatgtggcaatgtatgccccacacttcaggtccaaacttcccccttatgtactacttggaactccaatataatagctgttaatgttgtcaaagctgcataggaatttcatgtgtttgctctcttcatattcatatctgtattttgaatcatcatgttatttcatatgtaaattaactaaggaggtatcaactaggacaattattttaatgaactccgatactgaagctatttcgtacctgacagcaatgttttttgtttccttgcaattcttcagggccaggcctcgccaaccacggggacgctattcatgtttggtagcacaaatgacaatgatcctattagatttggaggtggtcctccttcagggggacccggccctaatgcttttcctttcaagcccttagatctgaaatcctcacactacactgctgaagcaatgaaggttagcaacatttgaatagttcatatgttattcctgcgacgcttgcgtggtaatgattgaaggtaacatttgaatacttcataggttattcatgataacatttgcttgtgcgctaatggtaaaaggatctcttaacttagaaagtattcgtataaacgtgcagtttgcagtgatgtttgtttctgaaattttgccccgagtctagatgagaaatcggttaaatccaaatggttttgctctgtaagtcttttatctgttgcactacctgtaacagattagtttgtctttttggaatggttgaggcttgaagcacatttgtctattctctgagtgttagtgacacaaagtggctgttttgctgcattttgttcatactaattggagaaagaccagagaccagctaatgttagatagtttagaagttcaataaaaataatcctcactggcaactaaacaacaggctagtcttcctcgagttccaactaaacatataagaacatcgttctaattgtacatttcaaaatgtcaattgaacattttttgtttttttccattcatgatccaataccttttgatatcatttccttacgagttagttcatatttgctccgtcaggaacaaaatacgaagtcttctgtcaagactgaaaccaagattctgacagtacaagaggctagtttgctcagccaactgaaccagctgaatcacaattcgcagaccattattaatagtggcggtcctcatgaccccaagctcagccgtcctgcatctggcgccggtgcaggcaatgaacacatatcacccccggatcacggacagacagctgaggaaagtgatgcgagggaagactacccggcaatggctactaccacgccagcagaggacgggtacagctggaggaagtacggacagaagcaggtgaagcacagcgagtacccgcgtagctacttcaagtgcacgcatcccaactgcctggtgaagaagaaggtcgagcgctcgcacgaggggcacatcacggagatcatctacaagggcgcgcacaaccacccgaagcccacgcagagccgccgtccaggcgtccagcccgtgcacccgtttggcgacagtgcgcaggcggacgcagccgacaacctggggtcacaggcaaacgcagtggacgccaaccagccgaggcgtgcgggtgttcaggatggcatggacgcgacgtcgtcgccctcagttcccattgagcgctgtgactcgccggcctcgatgcaggtcgactcggcagccccggtttgggtcccccgagggcgcggatgtgacgtctgtgtccgacgaggtgggcggggacgacagggtgactcgtggcagtatgtctcagggcggtgccgacgcggagggtgacgagctggaatgtaaacgaaggtcactgattagtatctgcgcgtctgtaggtttcttgctagtcatgtcatgctctatctagactagagctgaccgtctggttatttcaggaagctggagtcgtacgccatcgatatgagcaccgcgtcgagagctgttcgcgagcctcgcgtggtgatccagacgacgagcgaggtggacatcctagatgacggctaccgctggcgcaagtacgggcagaaggtcgtcaagggcaacccgaatccaaggtttgtcagaagcagcagcttctttttttttccccagagctccaagaatggcattttgctcagtgtttttactctggcgtgtcgcgctcaggagctactacaagtgcacgtacccgggctgcgtggtgcggaagcacgtggagcgcgcgtcgcacgacctcaagtccgtgatcaccacgtacgagggcaggcacaaccacgaggtccccgccgccaggattagcggccacccgggcaccgcggcggcgacaggcgcgggtggcccgcgcaggctggagcacccgtcgctgcgcgacggcctgatggggcacttgggcggctgcggcgtgccgttcggcctgccgccgcctagggatccgctggcgccgatgggcaattacccgacgtatgcctcctccattccccttggcggcgccggccccacgtcactgccgagcctgccggtgccggcggggaccctcagcgccgtcgatgggctgaagctcccgatgctggcgccgtcgtccctgcagcagcacccgctgctgaggcaccggcaggcgatgcaggccgctggcctcgtggcgcccaaggacgacgtgaaggtcgagggcaacgttgccggcggcgctgccccgtcggtgtaccagcagatgatgtgcagcgggctgcggttgcgccagcagatgtagatacataaataaatgtggagaggattagtgattctcaagttattagtttcttaccagtcgtattaggatgagttcgtgataattgttataacgtgggaacaaacacccgttgctttctgtttttttttcacccttccacttcatttttagctcagcaactatttatttatttactgcccctcttcattgaggtttggtattcgttgagcgacaggcatcatatggtgtttcggtgcctctgatgttcaattgagaaatgtgttgtttctgggctggtgatttggcagcagcccagaaagcacttagcggcttagcccagctgattaggcactgttgttctagtaccaagcccatcacaccctagttttgttgggcctcacagagaaatttattttatactcccctttgtaaatatataacaccgttgacttttaaaaaaacgtattattcaaaaaattaatgagttatcatttattttttaaatttattttatcacttgaagtagtttgtgctttacttaaaattttacatttttgaataaatattttgaataagacgagtgatcaaagttttcaaaaaggaaatcaacggtgtcatatatttgtgaatgaagatagtaatatataagagcctcatagtcatggcagactttttagtctgttagatctatatcaacggtaaatacaattgtggtttgttatgagtttttttttataaaaggtataccaggtggtggtagaaggtttaggtgctaaacatgac

SEQ ID NO: 6613 - DNA, 3817 bp, Zea mays
gttcttttgctgttttggtcaatccctatgaggtggagttcacctttagaatttattccttttgagttcatgttatactgggtcataacctaatgcttaattgggtgtttggttgggcggaactaaatttaagtctaactagtccatgattcaatcatttaatgctacagtaaatatttgctaatcatggcttaattaggcttaaaaatttgtctcgccgtttaatctttatctaagtaattagttttataattagattatatttaatactcgtaataatcattcaaacatacaatgtgacccagtttatactttagtccttagaagcaaacacctagtatgtaaggccgtctccggcagctcccctatctcatccactactattttaaacgtcactgtgtgtcgtctacagtcagatattcggtggacaaagtccatgttagcctgctgacattacacccattatctttatttctttattagagcaaaggcagttgaagaatgataagcatatgtactgccttacaaatgaattgattgctcatctattcaatacaaaatgaatttatttgcttgacaccgacagaaaggagagcttcctccaggcagaacagcagtcagcaactcaggtgctgggcgccctttccccgacctagagattgagagcgagctaaacgagctgcggaggaaagccaaggaatattaggctcattccttgtcgattcagcaggcctgacggaatctcacttccaagaaaatatagtgcagctgcagattgctccattgcgcgtttcgaaagttgaaacacaagtgcgcattgactgtttgttaaagagtatggaatcggctaatttctcggcattttccccctcgagtgacatttgtacagctatccataaaattgttgtaaatcactactctctctagagcctttttttcatactatatataaagtcaaagttcgaagttcccacgccgtggtttttgcccccttttttttcgtgtcataacatgtgttttgtgactgacttgggagtcaggtcgatcaaatattctttttcctcgcaatgcctgtcgacgggtccaaccgtccaagtcagtgctcgatggtttcggcattgctgacgattcagtctcatgacctgcggttggttggtgagcaagtacgaagcttgctgctgctgctactactgccatcttgagtgtgcggtcgctttagtctttgatcagcacgcccgaattcagagctcctaccttgccaagaggagaaacgcgcagcacgtggactttgaacgctgcatcatgcggactttgaacggcgcgtccccggtgcatgtgtttgtattcttgcgtcgtcgtccttgctcgtacacaaccttgccctccaagtctcgtcgtagtgccatgcttgccacctttaaaaaaatgctgcaactccgtcgtcaaactaggccttcgcacaagatgacgttccgcttgcgtaatatcgtgcaatatgatacttgttccctgtaccctgttgcggtaatctcctgcattgccaaaaacactaatgctgacttggaagaaaattagcatattaccaaaaaagatcagtagtatggtcggtaagctcaacgctggcgtgtcaactcatccgatgctgggatgcctgtgaattcaaccgccttgactttccagcgctaccaaccccgtgctgcctctgccttggacgcgtcggaaacccaaacccgggcgctggctcctgccgaggacacgcgtgcgtggactttggcactttgggggtcccaaaccccaactgttttcgctgctctccgggttccacatcaggcggcggtgcaccggcacaacaacctgctggcctggccgctgcacctgaaaaccccatgccgcccgtgagaggatcaccgaaaattcgggccgggcggcctccgtgtcaccgagcgtggcaaatccttgaccgtttccctggccgtccaacgcagcagagcccaggggtccaaagccggataggaaaaaaaaacagttcacatcgtggtggtcgcggagttgaatgcttgaccggttcttgatccccgagggcgaaccggcaaaggcaaacagcagccagcagcacttaaaacgggtcagcattcctgcacgaaattttcaacctagttggctgcaaagcagagacctggcgcgggaggaaaaagaaagcacggcctggccggcgacccggcatataccacgtactgtctacgacgtaccgcgcccgcccagagtggcacgccctagccctatataaacgcgcggcagcctcttccggcgtgtcaaggccagaccagagcagagcagagcacttgcacagcacactgcacgctttgtccgtcgtcaagaagcctgccgagacacgtacagcggagctgaggcagagcacaggcagtagcagagatcaagagtcatgggccaccgtgcaacgctcgccgccgccgtccttctcgccgccgtcgtggcgctgtgcctggcggcgcggtgcgccgacgccgcgaggcccgtgccgccgagcccggccgccgcggggtcggcgtacgaggcgatggtgtccaagctgatggagatgctcccgcaggggccgagcgggggaggcgcgggccactgactgaacaccctgcgtcctgctcctgcacgtatgagtacgacgctgctgcgggtttcacgcaagggtgaaaccttgtctctagctgtagggtagccagggttctttggttcagtttacttctccatacactatttctttcttttgcttccctttgagcctcctctctggttctcaagagaaaaggagataggcctagctacctgcctcaatcttgtatatattttagtcatatattcttcttggttagcctagccctgcaacctgcgcatacgtgcatgcatgattgatgagaggttggactttggtgacgagttccatgcgtgtgtcttcgcctcttcggtgatccgtcagtccgtcacgctgcgctgcaggtccaagatcgcagaacaaatcgtatccaaccccgtttctcagggacgaagccagagcaggacgacgaacgcggcgttaggatcagtggtagatggatcgccgctacctagtcttcctttttgacttgtggccgtgcaacacgtggcgtcgccaaccgaaccatgatggcgcggacgatgggcatttgcacgcacgagcaagaaaaggcaaaaagtccaacgccacaagtcaatggccacctgctggttcttcgaagttcgaacaacaagtcgcagattttggcgtgcactgcacgggctacgcctgctagttgcttatgctagctggtctctgactccacgctccagctacggcgaaatagtggtagcagtttcgaacaagaagaagaagaagcaggcgatgctgcctgtgcgcatgctccgaatttctagggcacgagttcatgaaccacgacccagaggaacatgattggaaaacatggacatgcgagctgcaggaaatgggccagggcccagcaaaacagtgctctctttgggaaaagggacctgtgcgtccaaaggctcggtaagccgcagcccaaataagaagacacgaacgagcccgtctaccttctgctgcgctgtagaccttgttggattgtacggatttaggggaaattaaatacttttttatttaattttggatagaaagatatttaatcgtgttcaatcctcttcaatctatctataatcgaacaaaccctcaagaaccaagttcagttctgctagttttcatatataaataggatgcttgcgttagaatgac

SEQ ID NO: 6614 - DNA, 930 bp, Zea mays
  misc_feature (15)..(15): n is a, c, g, or t
cattgggtacctcgnagccggccggggctttccattcccatcgcttcgcttctcttctcttctccacacgaactcgccctctcgactctcgagagatagagcgaggcaccaagaagggaaaaaaaaagagggacaggaaaaaaatcattctcgtttcgctctccgctagaccccgcccaaatcaatggagattagggctccgccgacgagcctgaggctcgcgccgccgcccgcctccgccagcttccgccgaaccccgcttaggacctccttccttcgcggcagcgtgtcacttaaagttgtgcaagtacggcagtcaaatgtcaacagatttaagtgcaatagcatacgaagtaacctctttgataggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaataaatacaaagctgcagaacaagcttctgctgattggtatcggagggctcaacttgctcttcaaaagggcgacgaggatcttgctcgtgaagcccttaagcggcgtaaatcatatgctgacaatgcaagctccttaagatcccagcttgatcagcagaagggtgtagttgaaaatctgatttcaaatacccggcttcttgagagcaagatagcagaggccaagcagaaaaagggataccctaaaagctcgtgctccatcagcaaagactgctacaaaagtgagtgaaatgttgggcaacgtgaatacaagtagtgcccttgtctgcatttggagaaaatgggaggaaaaaagttatgggcggatggaattccccaggccagaggcaccctggccagtttagg

SEQ ID NO: 6615 - DNA, 1461 bp, Zea mays
gcacgagacggcccaagagacgcgcaatgggaatccgacccgagtccgcttcccacgccccgcgcttctcttctcttctcttccccacacgaactcgccctctcgactctcgagagatagagcgaggcaccaagaaggggaaaaagagggacaggaaaaaaaaatcattctcgtttcgcgctgtccgctagaccccgcccgaatcaatggagattagggctccgccgacgagcctgaggctcgcgccgccgcccgcctccgccagcttccgccgaaccccgcttaggacctccttccttcgcggcagcgtgtcacttaaagttgtgcaagtacggcagtcaaatgtcaacagatttaagtgcaatagcatacgaagtaacctctttgataggctaacaagggttgtcaggtcctacgcaaatgcagttctaagttcgtttgaagaccctgagaagattctagaccaggcagttctggagatgaatgatgacttgacaaagatgcggcaggccactgcacaggtcttggcatctcaaaagcggcttgagaataaatataaagctgcagaacaagcttctgctgattggtatcggagggctcaacttgctcttcaaaagggtgacgaggatcttgctcgtgaagcccttaagcggcgtaaatcatatgctgacaatgcaagctccttaagatcccagcttgatcagcagaagggtgtagttgaaaatctgatttcaaatacccggcttcttgagagcaagatagcagaggccaagcagaaaaaggataccctaaaagctcgtgctcaatcagcaaagactgctacaaaagtgagtgaaatgttgggcaacgtgaatacaagtagcgccctttctgcatttgagaaaatggaggaaaaagttatggcgatggaatcccaagcagaggcactcggccagttagcaactgatgatttagaaggaaagtttgcactgcttgagacttcatctgttgatgatgatctttcacaactgaaaaaggaattgtctggaagctctttgaaaggagagcttcctccaggcagaacagcagtcagcaactcaggtgctgggcgccctttccccgacctagagattgagagcgagctaaacgagctgcggaggaaagccaaggaatattaggttcattccttgtcgattcagcaggcctgacggaatctcatttccaagaaaatatagtgcagctgcagattgctccattgcgcgtttcgaaagttgaaacacaagtgcgcattgactgtttgttaaagagtatggaatcggctaatttctcggcattttccccctcgagtgacatttgtacagctatccataaaattgttgtaaatcactactctctctagagcctttttttgcatactatatatatagtcaaagttcgaagttcccaaaaaaaaaaaaaaaaaaacgcaatactcgtgccgaa

SEQ ID NO: 6616 - DNA, 1935 bp, Zea mays
  misc_feature (4)..(4): n is a, c, g, or t
gggnaatcatccgacccgacctcgaggccggccgggatcgcttctcttctccccacgaactcactcttgagagatagagcgaaacacaaagcaggcaaaaaaaaaaggatagagagaaaaaatcattctcgtttctctcactccgctatacccccgcccgaatcgatggagattagggctccgccaacgagcctcagtctcgcgccgccgcccgcctccgccagcttccgccgaacaccgcttaggaccttcttccttaacggcagcgtttcacttaaagttgtgcaagtacgacaatcaaatgtcaacagatttaagtgcaatagcatacaaagtaacctctttgatagactaacgagggttgccaggtcctacgcaaatgcagttctaagttcatttgaggaccctgagaagattctcgagcaggcagttctcgagatgaacgatgacttgacaaagatgaggcaggccacagcacaggtcttggcgtctcaaaagcggcttgagaataaatacaaagctgcagaacaagcttctgctgattggtatcgaagggctcaacttgctcttcaaaagggtgacgaggatcttgctcgcgaagcccttaagcggcgtaaatcatatgctgacaatgcaagctccttaaggtcccagcttgatcagcagaagggtgtagttgaaaatctgatttcaaatacccgggttcttgagagcaagatagcagaggccaagcagaaaaaggatacgcttaaagctcgtgctcaatcagcaaagactgccacaaaagtgagcgaaatgttgggcaacgtgaatacaagtagcgccctttctgcatttgagaaaatggaggaaaaagttatggcgatggaatcccaagcggaggcactcggccaattagcaactgacgatctagaaggaaagtttgcactgctcgagaattcatctgtcgatgatgatctttcacagctgaaaaaagaactctcgggaagctctttgaaaggggagctcccatcaggcagaagagcggccagcaactcaggcgccgggcgccctttccccgacctagagattgagagcgagctaaacgagctgcggaggaaggccaaagaatactagagagtagagactctccaccaaccatccttcccgggcctgacagaatctctcatttccaagtacatatagcacagctgcagatttgctccatcgcgccttggaaagttggaacagaggtgcgcctttgactgtcactgtcaaagggtatatggagtcgccgagtttctcggcattttcccgtcgacggacatttgtacagctagccataaattgttgtaaatcactacgctccctagagcccttttttttgcgtactacgtatatagtcaaagtttgaagtttccgcgtcgtggtttttacccccattttttccgtgccataacatgtgttttgtgactggagacttgggatcctcagccaggtcgatcaaatactccctttttttcttcttcttcttgcagcgcctgtcgacgagtccaagtcagtgctcgggtgcgactgcttcgttgtttcgttcattctatcgcctgttggtcagagagtatcaaagcttgctgatcctatcctgagtgtgcggtcgggtttttttttggttctttgaccagcgtctgaattcctaccttgccgtgcgcgtgcgcgtcacatatatatggactttgaatgctgcaccatacggactttgaacggcggcgcgtccgtggtgcatggtccctcttttttttcggttttactcttgcgtccttgctcgtacacaaacacaaccaacctttttcctctcatgtgtcgtcatcgtgacaaacattggcttcacacacgacggacgatggcgtagtctgttgtagcatcgtgcatgtcaagcactttgtacgaacttgaaag

SEQ ID NO: 6617 - DNA, 2563 bp, Zea mays
gtgaatggtgatacggtgaaggcagacgccgaaccaaaccaaaaggcgaaggcgaagaagaccaaccaaagcaaagccaacgggatctccctctcattccagaggactccgcgtcgccaggcccgcttcgcgtgcgacgccggcatatagggtttcgccggcgccggcgatggacccaccccccgtgagccccgatcgctgggggcccagtcagggcgctggcgtcgggccctccggcctccgccgatatggcctcaatttctccgcctccagcctcctccaggcccccatcgcggccctccttgagtactccggcgtagtccagtccggccctgccctggcggcgcaccacccgtccgcggggccctcgtcgccgttgtccgcgtcggaggtcgatggtcttctctccgctgccgccgctggggacggggaggtttcgatccggattcagggcggcccaggcgacacggaggccacgggcgggccggatgcggggacctcgtccgaggatttgatcgaggcgaccgccggctctgaggttgaccaggcctccgctgcgggcaggggtgcaggtgctacggatgcggaggcaaacggtggcggggccggcacgtcggggaacgggggcggggaccgcgcgtaccagcgctacgacgtgcaccacgttgcgcggtggttcgaacagatattgccgttctcgctgcttctactcgtcgtcttcatacggcagcatcttcaaggtttctttgtcacaatttggattgctgcggtaatgttcaagtcgaacgatatattgaggaagcaaactgccttgaagggcgagagaaaaatatctgtactcattggtattacagtaatcttcatgattcatgtgtttggcgtatattggtggtacaggaatgatgatcttctcagacctttgttcatgcttcctccaaaagatataccaccattctggcatgcgatttttgtcatcatggtcaacgatacaatggttcgccaagctgcaatggctgtcaagtgcatgctgcttctgtactacaagaactgcagaggtcgtaactaccgtagacagggccaaatgttaacccttgtggagtaccttctgcttctttatcgtgctttgttgccaacttctgtttggtatcgtttctttctgaacaaggaatatgggagtctcttctcatctttaaccactggactgtatctgactttcaagttgacttcggtagttgaaaaggttcagtcattcttggccgcggtgaaagcactgtcacgtaaagatgtgcattatgggtcttatgcgactgcagaacaggtacttgctgctggtgatatgtgtgccatttgccaggagaagatgcatgtgcctgttctccttcgctgtaaacatattttctgtgaagactgtgtttccgaatggttcgagcgagagcggacttgccccttgtgcagagcattggtaaaacctgctgatatccggtcatttggtgatggttctacaagtctattcttccagttgttctagactgcaagcggtaaaatcctaacataacaatggacgagctattgcatgaaaactcgagtggaggtccttttaacgccatcatgtgaaaccatcttccgcaatgttgagatcaatgtgagaaggttcatgacagtcacgacagtgcagtcgttatttgtttatatattcaaccaaatagtttacagagctttttagttgcaacagaggcaaaatgtttccagcagactgctttcagagcctttagaactctgctggacaaacaatttgatcgttgaggtctgctgagccgacaaccgtatgcctcctgtaaaattctggtatttttttttaattttttttttgcatatgtgggcttacgtgggtgtaactgaaatttgaaagtaccgcttgcacagcaagaattgccggtgggggttgaaagtggtaaatgaatgtaactgtaaagcgttgttacatgaagacaaaaatttccacccgttgcaacatagtaaatgctgacagacgcgacttgtgtactgttttaagttgggttgattaggttttctaactatataacttttgctaagtatcttaggtcctgtttgtttgagctgaagtttttagaacttttttttaagagctgctgctgggcttttgatcctaaaaagttaatgatagtttttgatgatatcattagtttcctaaacacatgaagccacatgaagcccataaaaccatacttttcagtttttttaatataaacgtcacttttctaagtttctagtttttcggaagctgaacaaaagttggcttttcacactaaaaagatggtaaaaagctcaaacaaacaggatctaaatatacaatataactagatacgaaacaggatctaaatatacaatataaggttgtctccaacaaggagcggtaaatgactctgtacgctaaatatagcggatggagacattcgctacgactccagcaacacacggtaaaaccttcgcaaaaatatagcgtgccttcgtcgtcctcgaaatgtggcggtcacgctaccgc

SEQ ID NO: 6618 - DNA, 1241 bp, Zea mays
gccaagcgcgcaattaaccctcactaaagggaacaaaagctggagctccaccgcggtggcggccgctctagaactagtggatcccccgggctgcaggaattcgcacgagaccattacctagaacatcctaatcgaaaaaaaaaaaaattgtccgtgttagcaccgcttgcacaataatggaacaaatgtcaaaaccatcgggggcaaaaggataggagaataaggaaaaaacaatggcggtgctactccgccgcgccgcggcgctcctcgtcgtcgctgctgtctgcgcggacggcgcctccacgttctactcctccgaccccaacctcggatccgcgcgcgtcgtcttccagacgaattttggtgatattgagtttggcttctttcctcatgttgcacctaagactgtcgagcacattttcaaacttgtgcggcttggatgctacaacacaaatcacttcttccgggttgacaagggtttcgttgcacaagttgctgatgttatgtcaggtcgaaccgcccctatgaatgaggagcagaaaaaagaagcggagaaaacaattgttggtgaatttagtagtgtcaagcatgtcaggggaatcctctccatgggaaggcactctgatccagacagtgctggctcttccttttctattcttctgggcaattcaccgcatcttgatggccagtatgctgtatttgggagggtcactaaaggtgacgatacattgagtaagctagagaggcttccaacccggagagaaggcatttttgtaatgccgatcgagcgtatcaacatcctatcaacttactattatgatattgatctagagagctgtgaagcagaaaaatctattctccggaggagactttctgaatcagcatcagaagttgagcgatggagaagaaaatgctttgcttaatggtggaataaggactgcatattccgtttcctgaggctggatatggacgacggtgtggaaatgtgtatgccgcgtgttcttatgctatcactgtaatacttgagtagatgttagatgggtcctaaggttccacatggatcttgtctgtaacacatgggcagatgagttgttacaataaaccttcaattcgtttagcctgtccctttctttttttgggtttgtgatggcatttttagtttgaatcatgtctttgttatctggaaaaaaaaaagccctcggcaaagaccacaaagaggacacgatgctacggattatatc

SEQ ID NO: 6619 - DNA, 1103 bp, Zea mays
ctccatagggcgattgggttcctcgaggccggccgggaatggaacaaatgtcgaaaccatcgggggcaaaaggataggagaataaggaaaaaacaatggcggtgctactccgccgcgccgcggcgctcctcgtcgtggctgctgtctgcgcggacggcgcctccacgttctactcctccgaccccaacctcggatccgcccgcgtcgtcttccagacgaattttggtgatattgagtttggcttctttcctcatgttgcacctaagactgtcgaacacattttcaaacttgtgcggcttggatgctacattacaaatcacttcttccgggttgacaagggtttcgttgcacaagttgctgatgttatgtcaggtcgaaccgcccctatgaatgaggagcagaaaaaagaagcggagaaaacaattgttggtgaatttagtagtgtcaagcatgtcaggggaatcctctccatgggaaggcactctgatccagacagtgctggctcttccttttctattcttctgggcaattcaccgcatcttgatggccagtatgctgtatttgggagggtcactaaaggtgacgatacattgactaaactagagaggcttccaacccggagagaaggcatttttgtaatgccgatcgagcgtatcaacatcctatcaacttactattatgatattgatctagagagctgtgaagcagaaaaatctattctccggaggagactttctgaatcagcatcagaagttgagcgatggagaagaaaatgctttgcttaatggtggaataaggactgcatattccgtttcatgatgctggatggtttcctgaggctggatatggacgacggtgtggaaatgtgtatgccgcgtgttcttatgctatcactgtaatacttgagtagatgttagatgggtcctaaggttccacatggatcttgtttgtaacacatgagcagatgagttgttacaataaaccttcaattcgtttagttttgtcttcggcttccccaattgtagtttgaggctgcgctgcacctgatggcatttttagtttgaatcatgtctttgttctcttgggaaaaaaaagcccttggc

SEQ ID NO: 6620 - DNA, 2337 bp, Zea mays
gatcgatttaaccgccgctgttactgatccgtccaggagcgatataagtcagaagatgattatccctatccgcctccgcttaccttagatgtctccgagatccaaaaacaagaacaagagcgagcagagcgtggcgacaaatcacccgctgccttttatcccgcaaccagcagcagcgaaggccgcgagaggcaggtagtagccgcacgccacatcaacccaccacggatggccggcggcggcgaccgtgacgcatccgacgcggagctccgcgcggggttcgagaccctggccgtgacgcggccggacccttccgcgggggtctacgaggtccgcctcaaccgcccggcgcagcgcaacgcgctgagcccggccgcgttcgcggagatcccgcgcgccatgtctctgctggaccgcgccccctcggcgcgcgccgtggtgctgtccgccgcgggcccgcacttctgcgcgggcatcgagctcgggggccccggggacccgctgtccgccgcctccgccgatcccgtggccgccgcggaggggctccgccgcgcggtcctcgacatgcaggcggcgctcacggccatcgagcggtgccggaagcccgtcgtcgcggcggtgcacggcgcctgcgtcggcggcggcgtcgacctcgtggccgcctgcgacatcaggtgctgctccagggacgcctccttcgtgctcaaggaggtggacatggccatcgtcgccgacctcggcgcgctgcagcgcctcccgcggatcgtcggctacggcaacgctgctgacctcgcgctcaccggacgcaagatcaacgccatggaggccaaggacatggggctggctaccagggtctttgattccaagcaagaacttggatgcgggcgtcgcaaagatcgccaaaggtaccaacatctactgttatctgtcttcttagacatactataattgctcatgcttctgccttgtttaacatcgagatgccgttctcgaatatctgtgtcgccgctagatcatttttgaactaaaaagtgacaaatagaaaaaataagggagggagtattaaaactcatgctgccacaaagctgaaagcaacaagctgtaattatgctatctagtgagcaacaaggactgtcacagcagcccttttgacaacccttgtaccaccaatatatcaagctcaagataattaattgttaactagcttgtagccttgtaggagtataacggttgttccaccatgcgagtattatgctccaacgagtgttctttcttacttcgtctgctacgttaaactgcaaactatcttgaactcactcgtgcgtgaacatgatctgtctgtcatgttcttgtcctggactgaatctatggctgacaatttcagaaatagctgacaagtcggcatgggcggtgattggaaccaaggccgttctgctgagaagcagggatgcgaccatagaacaaggcctggagcatgtagccacatggaacgcgggtatgatgaggtcgaacgatctgaaggaggccatcagagccttcctggagaagcggaagcctgtgttctccaagctgtaatgatcagataccatcataccatacctctgtgttacttaacaagtggtgctacgtatctggaaatgcaaaggaataaagtgtgctaggagtagacaattgtcagggaaaaagaaaaaaaaaatgcctgttctcgatggagctgtgaaggcatttttccatgtcagttgagcttaccaaagttgttttggtcggtatggatgaaccgggggtgttactgttttgttacctgttccagtctgtacgtagattcatctcttctgcaccgagacaaaatgccaaacaatcatctggagttcaaagtcatctggggctttgagcgaactgggacattcactacagtctgtggtgcacaagaaatgaatctgcgtacaaactggaacaggtaacaaaaccgtacaaactggaataggtactcaaaacagtactctctgtcctgaattagattcatatatatatgaataatttatctagaaacaaatctatctctatcaattttacaaggttaaatggtccaccaaacaatttatttttctcaaattctcctaccatttactgcaccctcttaatccattgtctgtgccccctcttaatcattgttgagtttctgtggttagaagtgtgtagtaaatattataacgtgcttttagaaccatcttcagttgatgaatacttcagtcgatgaagagtagtatgatcttttctctgtcatactaatctgttctaaaattaaaatgaaatactgaagcaaaatgccattttgtc

SEQ ID NO: 6621 - DNA, 1656 bp, Zea mays
gtcactccgccgggcgctggccgatcagggtcaccttctccaaagaatacatggaacaatgatcgatttaaccgccgctgttactgatccgtccaggagcgatataagtcagaagatgattatccctatccgcctccgcttaccttagatgtctccgagatccaaaaacaagaacaagagcgagcagagcgtggcgacaaatcacccgcggccttttatcccgcaaccagcagcagcgaggccgcgagaggcaggtagtagccgcacgccacatcaacccaccacggatggccggcggcggcgaccgtgacgcatccgacgcggagctccgcgcggggttcgagaccctggccgtgacgcggccggacccttccgcgggggtctacgaggtccgcctcaaccgcccggcgcagcgcaacgcgctgagcccggccgcgttcgcggagatcccgcgcgccatgtctctgctggaccgcgccccctcggcgcgcgccgtggtgctgtccgctgcgggcccgcacttctgcgcgggcatcgagctcgggggccccggggacccgctgtccgccgcctccgcctccgccgaccccgtggccgccgcggaggggctccgccgcgcggtcctcgacatgcaggcggcgctcacggccatcgagcggtgccggaagcccgtcgtcgcggcggtgcacggcgcctgcgtcggcggcggcgtcgacctcgtggccgcctgcgacatcaggtgctgctccagggacgcctccttcgtgctcaaggaggtggacatggccatcgtcgccgacctcggcgcgctgcagcgcctcccacggatcatcggctacggcaacgctgctgacctcgcgctcaccggacgcaagatcaccgccatggaggccaaggagatggggttggttaccagggtattcgattccaagcaagacttggatgcgggcgtcgcaaagatcgccaaagagatagctgacaagtcggcatgggcggtgatgggaaccaaggccgttctgctgagaagcagggatgcgaccatagaacaaggcctggagcatgtagccacatggaacgcgggtatgatgaggtcgaacgatctgaaggaggccatcagagccttcctggagaagcggaagcctgtgttctccaagctgtaatgatcagataccatcataccatacctctgtgttacttcacaagtggtgctacgtatctggaaatgcaaaggaataaagtgtgctaagagtagacaagaatgccgtctgcggtatcatttggcgaaacatccattcttgtaaggggaaaaaaaaatgcctgttctcgatggagctgtcaaggcatttttccatgtcagttgagcttaccaaagttgttttggtcggtatggatgaaccgggggtgttactgttttgttacctgttccagtctgtacgtagattcatctcttctgcaccgagacaaaatggcaaacaatcatctggagttcaaagtcatctggggctttgaccgaactgggacattcactacagtctggtgcacaagaaatgaatctgcgtacaaactggaataggtactcaaaacagtactctctgtcctgaattagatttaaaaaaaaaaaaaaaaaaaaaaaaagtcgacgcggccgcgaattcg

SEQ ID NO: 6622 - DNA, 1053 bp, Zea mays
ccacgaccgccagcagccatcgcatccgaatcccaagctttctcctctccgtgcaggtgcagcagccagcgcgcgcgtctctacaggaaacagagagcatccgagtcccaaagctcgcagctttgccagcaaagcaagaagacagttgcggcatggagctggagcttgggctggcgccgccgagcgcgcgccgtcccacccccatgacgatcgaccagcagcagcagcagcagcaacgccacctcgccgaggacgagctgagcagcacctcgtcggaccatcacccttgcgctgcgcgctccgggaagagaggattcgcggaagcgttccaggaggcggcggcgacgacgacgacgctgccgctcttcgacgacggctcgtcgtgcggcgggagaagcggcggcggcaagaggccgctggtcgggtggctcgagcctgacccttacgccttcgctcgcgccgccgccgccgccgccaagtacgtgaaggtgaagaaggaaggcgacgccatcggcaggaaagtggacctgtcgctccacgcctcctacgacgagctcctcgccacgctcgcccgcatgttcccgaccaccaccggcagccaagacgacaaggaaatcagcagcaagtccaccgccgccgccaccaccaccagcagccatatggacgtggtggtcacctacgaggacggagagggggactggatgctgctcggagatgtgccgtgggatgattttgcaaggtccgtcaaacggctcaagctactgggatgattggagtactgatactacatgttcttaattggagtataagcttcttttttgctgatgttttttaagagcacttggtgttaagaatcaaggcaatagtttggtggtgtacctgggccgggttacctcttgtgacaatacttatacgaacaggttttctggtcttttgcatgtgagaacgtttatcttggagatttgccgatgtgtttttgcgcagtttatgctgcaactacaatacaatacatgttcattaatccaaaaaaaaaaaaaaaaaaaaaaaaaaaaa

SEQ ID NO: 6623 - DNA, 1061 bp, Zea mays
cctcgaggccggccggacgaccgcctgcagccatcgcatccgaatcccaagctttctcctctccgtgcaggtgcagcagccagcgcgcgcgtctctacaggaaacagagagcatccgagtcccaaagctcgcagctttgccagcaaagcaagaagacagttgcggcatggagctggagcttgggctggcgccgccgagcgcgcgccgtcccacccccatgacgatcgaccagcagcagcagcagcagcaacgccacctcgccgaggacgagctgagcagcacctcgtcggaccatcacccttgcgctgcgcgctccgggaagagaggattcgcggaagcgttccaggaggcggcggcgacgacgacgacgctgccgctcttcgacgacggctcgtcgtgcggcgggagaagcggcggcggcaagaggccgctggtcgggtggccgcccttgagctcccgcgcagcagggcgtgcggcggcggcgccgccaagtacgtgaaggtgaagaaggaaggcgacgccatcggcaggaaggtggacctgtcgctccacgcctcctacgacgagctcctcgccacgctcgcccgcatgttcccgaccaccaccggcagccaagacgacaaggaaatcagcagcaagtccaccgccatcaccgccaccaccaccagcagccatatggacgtggtggtcacctacgaggacggagagggggactggatgctgctcggagatgtgccgtgggatgattttgcaaggtctgtcaaacggctcaagctactgggatgattcgagtactgatgctacatgttcttaatcggagtataagcttcttttttgctgatgttttttaagagcacttggtgttaagaaacaaggcaatagtttggtggtgtacctgggccgggttacctcttgtgacaatacttatacgaacaggttttctggaacgtttatcttggagatttgccgatgtgtctttgcgcagtttatgctgcaactacaatgcaatacatgttcattaattcaaaaaaaaaaaaaaacgacagcaacggaattcgagc

SEQ ID NO: 6624 - DNA, 7459 bp, Zea mays
  misc_feature (7041)..(7041): n is a, c, g, or t
catgacaatatctaggaatgtgcacatagagacctgcaggatccatgtacaatacaacagaccaggtgagtcagccagccaccgctatggggagctaaagcttgatcgaagcactacctggctgtctggtgtctgcatcaatcaattactataataacaaatctaaatctagtcgtctgaccgaagactcactatgttcttttcctattgaaatatacacatgcgaatgcaccggtggtcgcgtccctttttctttatactcatatatcatctctctctctctctctcttcttttgctgttggcttttcctcttcgactagtgaattggtctgaccgactgagcgcgcgaccatgtgttcttgttggcacgcaaacaagtcgaggagctttactttaccgggctactggaaatcatggcgtgggctacccctacgcatgcatttcgcgggagcatggtgtggttggcctgatcctgcaatttctgcgggatgatgcaagacaggtaggtaaacggcggggcgcagcgcatcacgacaccgcgcgatccttggatttttgtaggcagtgtggcaggcaatgctcgaaatcaatactactactactacaaatgtaggtaggcaaggcatttgtttctcgtaactgaaggcacttcgatcgcgttcgttagcttgggagcacacatggcgccaacgcatttttcaagtgcagaatctctgtggcccgcatttgaagcgtgggatgtaatttttttcttctttcagtgaataaagttaaactggttcgttacgaaacttttgtgaaggattcctgtggggtggagatattggacagtggcagtgtgatttttagccctcagaaaaccgcgaaccaatcagcaaccgctgcgggttgtttccgctgcctgaggagcgagcaacctcgttacggtttgagcactgctagtaacataaaacatgcatgcaacaacaggatcgcaggacacatcacatgtttacacttaacgcgtggtgcagtgcagactgcaggcttccgtgtgtgtgtgggtaatttacgaccatggccgcaccacgcgacagtaatcctgtacaaagatttgtactactaaaatgatgatgattctgtagcgtcctaaaccccctacgaccgaaatgattactcacaccctccgcctctcccggtcccggccaagagcgtgccgtgccctcctgctcctctgccgatgtgcccccgtccctgctgctctgtctgtcccccaccccaccggcgccaccgtcaccaaaccatcccccttcctgcagttacacaccataaaagctcccccgccccgctcgccgccgcggggcgaagcggattaatccagcaccgaaatgacgtgatccccattccattcaccctcgtcgttcgtcactgcacctgccggctgtgccgcccttgaaaaatcccaccacctccctcgccctccaggcctccactcattcctgcccccgacactcccactgccaccagtcctctcaccgccaggcgcggcacaatgcagccgcctacccttctcccgctaggcgccgtcgtggtcgccatcctcctgctcgccaccgccccgagccccgccgtctcccgccaccgccactcgtccgccgcggacacggagacgctcgatgtagccgcctcgctctcccgcgcccgcgccgcgctctccaccgacgccgtctcgctgcaccagtccgcggccgccgccgccgccggggcgaagcgctccccgcgagcgcgggagggcggcctcacgctgcggctccactcccgggacttcctgcccgaggagcaggggcggcacgagacgtaccgctcgctcgtgctctcccgcctccgccgcgactcggcgcgcgccgcggcggtgtcggcccgcgcgacgctggcggcggacgccgtgacccggctggacctgcgccccgcgaacgggtcggcggtgttcgcggcgtccgcggcgatccagggccccgtggtgtccggcgtcgggcagggcagcggcgagtacttctcccgcgtgggcatcggcagccccgcgcggcagctgtacatggtgctggacaccggcagcgacgtcacctgggtgcagtgccagccctgcgccgactgctaccagcagtccgacccggtgttcgacccgtccctctccgcctcctacgccgccgtctcctgcgactcccagcgctgccgggacctggacaccgcggcgtgccgcaacgccacgggcgcctgcctctacgaggtggcctacggcgacggctcctacaccgtgggcgacttcgccaccgagacgctcacgctgggggactccaccccggtcggcaacgtcgccatcgggtgcggccacgacaacgagggcctcttcgtcggcgccgcggggctgctggcgctgggcggcgggccgctctccttcccgtcccagatctccgcgtccaccttctcctactgcctcgtggaccgcgactccccggccgcgtccacgctccagttcggcgacggcgccgccgaggcgggcaccgtgacggcgcctctcgtgcgcagcccgcgcacgagcaccttctactacgtggcgctgtcgggcatctcggtgggcgggcagccgctgtccatcccggcatccgccttcgccatggacgccacgtcgggctcgggcggcgtcatcgtggactccggcaccgccgtgacgcggctccagtccgccgcctacgcggcgctccgcgacgccttcgtccagggcgcgccgtcgctgccccggacctccggggtgtcgctgttcgacacgtgctacgacctgtcggaccggacgagcgtggaggtgcccgcggtgtcgctgcggttcgagggcggcggcgcgctgcggctgccggcgaagaactacctgatccccgtggacggagccggcacctactgcctggcgttcgcgccgacgaacgcggccgtgtccatcatcgggaacgtgcagcagcagggcacccgcgtcagcttcgacaccgccaggggcgccgtcggcttcacccccaacaagtgctagcctagcctagcctaagcctgccttctggctaaccgtgccctgttagccacggttgtcagtagtaatgacaagccggtgtttaattagcgggagaatgattagatggggggtaattaagcggtgggccctgccgggtctggggaggagcgaaaggcaaaggcgaggacagatgatgccattgccatgccagcctgtgtccggcgcgatgggtccagctccagcagtgtttctctctttctctcgagtatgcgtgcgtggagccttgtcatgacgaattagatcgtgggggctcccaagttaagagtatttatttttattttatttgctatgtcaagaaaatggaagtttccatccagcggaaaagaaaaaacatgcatgcttttccctccctctgggccgtgcatgtacaccactgggttggcacaggacagcaattggtagagcgaagcggtgtcgtcggcggcgcctcttctcatgggaccctggtaaactttgctaggcaccggccgggattgcgtcaggctggctgttgcttttaacctccttcctactagcacggctttacgccacgcaacttcactcgtgctttcctccacaaacatcgccggaactgatagagagtattcgctgccaagtgcgaacttcgcacagaattctttttatataaaatcagaagttaccgcccgaactagcagggaggaagtggatgagatcgaaggaggccctgcgctgccgctgctggctgctgcgtccggtcagtgtcccgccctgagcagggggggccctctcggtttcctttcatttaatggtggttggtagccgttactgttggggcagcagaccagcagtcttgaatgcacctgctgcatgtgagccgagccctcagcgtcccagatgccgtggggctgggggggagctgggctttccactccccaaaggatcaaagagacacgtcgtctcgtcgagaactcacgggtgccgtggctggctagccgccacgtgtcattctaacgatccgataccgttggttttctgctagtactggatccttttttttatgccaaattaaactgcctgcaaaattcgtgcgttccaaacggactcctgtagttatataagttattgtaacaacgttaaaccttgcatgtactaatcgtttgagagtaaagtaataatagtattcgtcagccaccactttgttacgagcagactaatcccgcgccgctcacacaaggcgcagtcgcagtcgcaatcgcaatcgcacgcaaatataggattactgccgagcagcagcacgttctggtgaggagaaaaaactgcagcgccaaccgccaaggagggtaggtggcacgtcgctagcaacaatcttgttgagcgcaaataattagtggtcacgcgctcgctcttgcggtcgatgatgtcgcgcatcccgtattcccggcccaaccgcctactagtacgtacgtacgtacgtacgtactgtacgcatgcaaagaaaatgacagcgcgcgagaatttcgaaacaaacaaatcttttaaagaaacgcccatgcatgcatgtggagttgtggactgtgcccgtgtgccgaccgacgacgtgccgtgcggtgttatcaagaagcagtgcccaaactgatccacgggtcgattctggtggtaggcaaattgtggcaacagtttccgttagtgccccccatccctcttgttgtgacgctcctgcagtcccgtgacgctgctgctgcgtcccagtgactgggacccattaattttcgttccagttccaagaaaacggtgacttttgtttggacggagacggagagagagagggtaggtcggcgtcgctaggtggaacacgcgcgcagttactctctgacggcgagataaataaaccggcttcagggcaaaaaaataacaaatataatcctcacaaacggatgttaaatatgtaaccgaaaaacgacgctccgttgtgggaccgacgatgcaattacagaagggtggtgctgcatcatgacgcggccgccacggccatatatggccgccgcttggttacgtttgcagcacgccgtgtatctagcgaaggacgatggagcaggagaaagcgagaagcacagcggcggcacgccggcactcccccccccgccactggccacactgcatgcacgcacccagctggcctggccaggtccccatcgtgctcgatgtccttgttctcgagtccaccacacgccgggggtcggaagtcggaacggctctctggaaggtccgtcgacagtccaccgacacacaccaccaaacagcatgtccggtccccaccccgtccggtccgtcgaggggcaggccagctttgcttgctcagttgctcgctcctgccttttctgattttcttcccctcccctccgcccgttgctttcgggtggggaaaaaaaaaagagaaacctttcgactctcgtgtccagggctgagcacgagctccgaggccccaagtccggcggccgaagacgcgggcgccggcggggtggaggaaaaggaggaaggggtcgcgcacgcccccagcttggtgttcctcgctcgcacagcggcgtccgccttgcgtcgcgctggtgtggtggctggacgcttctcgagtctcgatgcttcactgctactgctggttgtgcaggcaccatttcgccatagaggggccggggccggactcccccgcccagcccaacagggaacaggcccaggcggatgtttcttcacgggccgactggcctgatttgctgagtggtatggtagcaactagagacatgatgactatatcatgctttgtggcccaggctagtaataactcccgtgctcgataaaccgagcagaatttcgttcggcaacggcagtctatttgaagggccagttttttccctcaaaaaaaaaacgagacaacgtgtgcaggaattattagacgatctttttggtaagcgaaagagagtgggaaccgaaattgtgttctggataatatggatggctgtgagtcgtttttctctccctgcctgcgagtcccgggcttcatctcatacgggaagttgatgtggtattcataaatcataaggcccgtctgctctgatgagtccttggatcgacatggcaatgcggccagtcctgttgtggaaggcagccagcctggaacaagtgcgaaacggaggagttactactgtactgtacttggtagtactgtacacacgagtgcatacccggcaggtcatggcagacactttccgcgtcttcgccgcccgtgactgtacggcgcgccaaggattgctgttagtgttagatccttcgctattttttatttgctgctcatttctcaaacctgtctcgttgtctgctactaatctaagtttatttattttggtcctcactcgatggcacgcacgtaggagaagctctttccctttttttttcccaacatttcaatcgaacatggtccatcacgtgattaatggtaatatatgacgtggttgcaaaatccatgtccatgtccgcgtagctacactgtcatctctaaaccacgggttgctcctagggatggcaacacataatttcccgtcgggttttagctcctcaaacctgtcccagtgacgaaaaaattcccccgtggggatccccacgaacgcttgcgggggacatttgttccacatcctcgttccccgtggggataaatccccgtcggagatccccatccacgctttaattataattaaatcgtacttcatttgttattaatgtaaaacattgtcacttatacacaccgttagatgtaaaaatcattatgtgcgcattaaaatcaatgtatttatacaacgggtgatctcttggcaagttaattctttatttttatcattaactattacataaaaatattgtcacatgtaagtttaacgggtccccacggggaacggggatagagaatgtttcttcatccccgtccccatttacccgtcgnaggagaattttccccgtttatatctccgtgggggagaaacttccccgtccccatcctctaatagaggaattcccggtagggaatcggtgatcgggtctcattgccatctctcttgctctcgtccaatccacgtttttttgggctgagtattgtactctcaggtctcagctgggacggagttcttggctgcctgatgatcaacctgcacataaaccatcagtatactatacctttggcgcggccttcaaacgtctggtacaaggtaggccttgcttgcggtcgcgcagaacctgaggcccgctccagcgagagctcctaaagcctcctgtactctaaatatagaggattaaacggttctctacgctctccaacagcgtcctctaaacggttctctaaatttagaggacaatactggata

SEQ ID NO: 6625 - DNA, 1981 bp, Zea mays
cttcccggcccgcaaggcctccactcattcctgcccccgacactcccactgccaccagtcctctcaccgccaggcgccagccacagcggcacaatgcagccgcctactacccttctcccgctaggcgccgtcgtggtcgccatcctcctgctcgccaccgccccgagccccgccgtctcccgccaccgccactcgtccgccgcggacacggagacgctcgatgtagccgcctcgctctcccgcgcccgcgccgcgctctccaccgacgccgtctcgctgcaccagtccgcggccgccgccgccgccggggcgaagcgctccccgcgagcgcgggagggcggcctcacgttgcggctccactcccgggacttcctgcccgaggagcaggggcggcacgagacgtaccgctcgctcctgctctcccgcctccgccgcgactcggcgcgcgccgcggcggtgtcggcccgcgcgacgctggcggcggacgccgtgacccggctggacctgcgccccgcgaacgggtcggcggtgttcgcggcgtccgcggcgatccagggccccgtggtgtccggcgtcgggcagggcagcggcgagtacttctcccgcgtgggcatcggcagccccgcgcggcagctgtacatggtgctggacaccggcagcgacgtcacctgggtgcagtgccagccctgcgccgactgctaccagcagtccgacccggtgttcgacccgtccctctccgcctcctacgccgccgtctcctgcgactcccagcgctgccgggacctggacaccgcggcgtgccgcaacgccacgggcgcctgcctctacgaggtggcctacggcgacggctcctacaccgtgggcgacttcgccaccgagacgctcacgctgggggactccaccccggtcggcaacgtcgccatcgggtgcggccacgacaacgagggcctcttcgtcggcgccgcggggctgctggcgctgggcggcgggccgctctccttcccgtcccagatctccgcgtccaccttctcctactgcctcgtggaccgcgactccccggccgcgtccacgctccagttcggcgacggcgccgccgaggcgggcaccgtgacggcgcctctcgtgcgcagcccgcgcacgagcaccttctactacgtggcgctgtcgggcatctcggtgggcgggcagccgctgtccatcccggcatccgccttcgccatggacgccacgtcgggctcgggcggcgtcatcgtggactccggcaccgccgtgacgcggctccagtccgccgcctacgcggcgctccgcgacgccttcgtccagggcgcgccgtcgctgccccggacctccggggtgtcgctgttcgacacgtgctacgacctgtcggaccggacgagcgtggaggtgcccgcggtgtcgctgcggttcgagggcggcggcgcgctgcggctgccggcgaagaactacctgatccccgtggacggagccggcacctactgcctggccttcgcgccgacgaacgcggccgtgtccatcatcgggaacgtgcagcagcagggcacccgcgtcagcttcgacaccgccaggggcgccgtcggcttcacccccaacaagtgctagcctagcctagcctaagcctgccttctggccctgttagccacggttgtcagtagtaatgacaagccggtgtttaattagcgggagaatgattagatggggggtaattaagcggtgggccctgccgggtctggggaggagcgaaaggcaaaggcgaggacagatgatgccattgccatgccagcctgtgtccggcgcgatgggtccagctccagcagtgtttctctctttctctcgagtatgcgtgcgtggagccttgtcatgacgaattagatcgtgggggctcccaagttaagagtatttatttttattttatttgctatgtcaagaaaatggaagtttccatccataaaaaaaaaaaaaa

SEQ ID NO: 6626 - DNA, 1412 bp, Zea mays
attctcgtccgcttttcctccccggcccgcgcgccagtatcggctgctctgcctcgtgcctccataaatccgggcccctcgcgccgggccgggactcgcccctccccacacctccgctcccggcctgtgccgccgtcgccaccgctcgctcgcccgcctgcctgcctgggcccgcagcaccgactctgacagcgcccgtcctgcttcctgtaccggcaggcgagggagaggactcagggagtgtgatggcggcaatgccggcgccgcttctgcctctgcttctgctggtggtggccgcggcgatgacgctctcccccgccgccgcccgcattcccggcgtgtacgtcggcggcggcggctggcagagcgcgcacgccacgttctacggcggcagcgacgcttcgggcaccatgggcggcgcctgcgggtacggcaacctgtacagccaggggtacggcgtgaacaacgcggcgctgagcacggcgctgttcgacgaggggctccgctgcggcgcgtgcttcgagatcaggtgcgaggagcagcccgggtggcggtggtgccggccagggaggccctccatcctggtcacggccaccaacttctgcccgcccaactacgcgctcccctccgacgacggcggctggtgcaacccgccccgcccgcacttcgacctcgccatgcccatgttcctccacatcgccgagtaccgcgccggcatcgtgcccgtctcctaccgccgggtgccgtgccgcaagtccggcggggtgcggttcacaatcaacggcttccggtacttcaacctggtgctgatcacgaacgtggccggcgcgggggacgtggtgcgcgcgagcgtcaaggcggccagcaccgggtggctgcccatgtccaggaactggggccagaactggcagtccaacgccatcctcgtcggccaggcgctctccttccgcgtcaccgccagcgaccgccgcacctccacctcctggaacgccgccccgagcacctggcagttcggccagaccttcgagggcaagaacttcagggtctgatgcatgggatgggatgcgatgggatgggacttgggagaagaagccaaaactcttttctttctttctttctttcttcttatacgtaattattactactcactcctgctaccgtactactgctactggagtactaagcgcgtgttactgtgttagagggtggtgggtgttgtcaatgcctgttttaaggtcacgccttccgcccgccttaatcccaggtccaggtcctctctgaaaaaatggagtcttttcttctgaacaagatgtgtggatgggattctctagagtttgtcagggtatattgccgtctcttcggtccctagcacttctctatgcatcaagtttgtgcctttggcttaaaaaaag

SEQ ID NO: 6627 - DNA, 1354 bp, Zea mays
attctcgtccgcttttcctccccggcccgcgcgccagtatcggctgctctgcctcgtgcctccaccggcacggcgcccctcgaggccggccgggactcgcccctccccacacctccgctcccggcctgtgccgccgtcgccaccgctcgctcgcccgcctgcctgcctgggcccgcagcaccgactctgacagcgcccgtcctgcttcctgtaccggcaggcgagggagtggactcagggagtgtgatggcggcaatgccggcgccgcttctgcctctgcttctgctggtggtggccgcggcgatgacgctctcccccgccgccgcccgcattcccggcgtgtacgtcggcggcggcggcggcggcggctggcagagcgcgcacgccacgttctacggcggcagcgacgcttcgggcaccatgggcggcgcctgcgggtacggcaacctgtacagccaggggtacggcgtgaacaacgcggcgctgagcacggcgctgttcgacgaggggctccgctgcggcgcgtgcttcgagatcaggtgcgaggagcagcccgggtggcggtggtgccggccagggaggccctccatcctggtcacggccaccaacttctgccctcccaactacgcgctcccttccgacgacggcggctggtgcaacccgccccgcccgcacttcgacctcgccatgcccatgttcctccacatcgccgagtaccgcgccggcatcgtccccgtctcctaccgccgggtgccgtgccgcaagtccggcggggtgcggttcaccatcaacggcttccggtacttcaacctggtgctgatcacgaacgtggccggcgcgggggacgtggtgcgcgcgagcgtcaaggcggccagcaccgggtggctgcccatgtccaggaactggggccagaactggcagtccaacgccatcctcgtcggccaggcgctctccttccgcgtcaccgccagcgaccgccgcacctccacctcctggaacgccgccccgagcacctggcagttcggccagaccttcgagggcaagaacttcagggtctgatgcatgggatgggatgcgacttgggagaagaagccaaaactcttttctttctttctttctttctttcttctgatacgtaattattactactcactcctgctagcgtactactgctactggagtactaagcgcgtgttagggtggtgggtgttatcaatgcctgttttaaggtcacgccttcccgccttaatcccaggtccaggtccaggtcctctctgaaaaaattggagccttttcttctgaacaagaggtgtggatgggattctctagcaaaaacaaaaaaaaaaaaaatagg

SEQ ID NO: 6628 - DNA, 1239 bp, Zea mays
cattgcgcaccttgcggcccccggcctcccaccgtccctgcaccgacgccgcccgcccgcctccgtgcgctgcactgaatctgacagcgcccgtcctgcagcggccggcgaggaagagctctcggcgagagggcgagcgatggcggcggcaatgccggcgctgctgctgctggtggccacggccacggcgatgatgttctcccccgccgccgcccgcattcccggcgtgtacggcggcggaggctggcagagcgcgcacgccacgttctacggcggcagcgacgcctcgggcaccatgggcggcgcctgcgggtacggcaacctgtacagccaggggtacggcgtgaacaacgcggcgctgagcacggcgctgttcaaccaggggctgagctgcggcgcgtgcttcgagatcaagtgcgaggaccagcccgggtggcggtggtgccgcccggggagcccctccatcctggtgacggccaccaacttctgcccgcccaactacgcgctgccctccgacgacggcggctggtgcaacccgccccgcccccacttcgacctcgccatgcccatgttcctccacatcgccgagtaccgcgccggcatcgtccccgtcacctaccgccgggtgccgtgccgcaagtccggcggcgtgcggttcaccatcaacggcttccggtacttcaacctggtgctgatcaccaacgtggccggcgcgggggacgtggtgcgcgcgagcgtgaaggcgtcgggcgccggggagtggatgcccatgtcgcggaactggggccagaactggcagtccagcgccatcctcgtcggccaggcgctctccttccgcgtcaccggcagcgaccgccgcacctccacctcctggaacgccgccccgcgggactggcgcttcggccagaccttcgagggcaagaacttcagggtctgagactctgaggccgcgagtggcggcgagaagaagccagcgctcaaggccttcttccgccgtactattatatataccgtgattactgctactagtagtcggtataaagcgcgtgttagggtggtgggaatgtacgtgaatgcccgtttagggtcacgccgtctcgccctggttcaagtactctctgaaaaaaaaggagccccttgctgccgttctcttctgaacatatgcgggcaaaagggagataagtatggtgattggatgcttaaaaaaaaaaaaaaaaaaaaaaaaaaaaaaaaaaaaaa

SEQ ID NO: 6629 - DNA, 1207 bp, Zea mays
gcacgagaccattacctagaacatcctaatcgaaaagtccctgctccgacgccgcccgcccgcctccgtgcgctgcactgaatctgacagcgcccgtcctgcagcggccggcgaggaagagctctcggcgagagggcgagcgatggcggcaatgccggcgctgctgctggtggtggccacggcgatgatgttctcccccgccgccgcccgcattcccggcgtgtacggcggcggaggctggcagagcgcgcacgccacgttctacggcggcagcgacgcctcgggcaccatgggcggcgcctgcgggtacggcaacctgtacagccaggggtacggcgtgaacaacgcggcgctgagcacggcgctgttcaaccaggggctgagctgcggcgcgtgcttcgagatcaagtgcgaggaccagcccgggtggcggtggtgccgcccggggagcccctccatcctggtgacggccaccaacttctgcccgcccaactacgcgctgccctccgacgacggcggctggtgcaacccgccccgcccccacttcgacctcgccatgcccatgttcctccacatcgccgagtaccgcgccggcatcgtccccgtcacctaccgccgggtgccgtgccgcaagtccggcggcgtgcggttcaccatcaacggcttccggtacttcaacctggtgctgatcaccaacgtggccggcgcgggggacgtggtgcgcgcgagcgtgaaggcgtcgggcgccggggagtggatgcccatgtcgcggaactggggccagaactggcagtccagcgccatcctcgtcggccaggcgctctccttccgcgtcaccggcagcgaccgccgcacctccacctcctggaacgccgccccgcgggactggcgcttcggccagaccttcgagggcaagaacttcagggtctgagactctgagctcaggccgcgagtggcggcgagaagaagccagagctcaaggccttcttccgccgtactatatataccgtgattactgctgctagtagtcggtataaagcgcgtgttagggtggtgggaatgtacgtgaatgcccgtttagggtcacgccgtctcgccctggttcaagtactctctggaaaaaaaaggggagcctttttcttctgaacatgtgcggacaaaagggagataagtatggtgattggatgctacaaaaaaaaaaaaaaaa

SEQ ID NO: 6630 - DNA, 2483 bp, Zea mays
aaatttggacatgagaaaaattcatcctaaaaatgtataaattgtttggcactggcaaactgctggcagtacatccctgagacatattttaaaatattttctactattaaggcagacctggtgcagtggtgagagctgtctcactaagtcattaggtcacaggttcgtagcagccttcccacatttgtgggggaaaggctggcatcggtttattccttctccagaccctactcgtgtgggagccttgggcactgggtgactgggtctgtccctttttattaaggcaacattcaagtaaattttatactatttcatgaccattggctcagatactggattttttatgtgatgctctaaatacctaacagatcagaaaagccaaccagcacaaggggatgtatggcgtgattttgccttggaaaatctctgattctttatgctctacattctacaaggtaagaattactcctaccttgattttggcctcaaacaatgaagattgcactcatttagggcacaccctaaagttagagaattcttgtgcttttacgtgtgcagcacacaaccagttgtgtgtgtgtgtgttgcattttatatgtgcttgtgcatctattagaattgaattttccagaagataccttctgctttcgtttaagcagaagtccaaaactataattgctttagatgaattgaaggctatcagcctatcatatgccaaagatgtaaataatccatttctgattttttaagaatcaaaggttgacatgcgacaagacttcatgattgtctgtaatttaatgtttttatgcaagttcaaaggcaaccagatgacatcgggaatggttacaatgtaagccaaattgagtattgttactattttgcatgtattaaaatgcaaaaaaatcatagcaaaaaccagtacccacgcgtccgatcagcagtttatattgtgttttgtacgtattaaaaatgcaagaatcatagcaaaacgagcaaaatttgaatccatcagctgtttatattgtaataaagtatgacaagctctctgaaaaaaaaatcagttgcgtaatctgtccaatgttgcatttgagctattgcgctagttaatccttttattttcggtatgacttgcagtgcctctagagatggagattctatgctaagggtttaggagctgcatggtggatggtacattgtgctttctgcgccgtgcttcctgaaagtctatctgaagttagtttaaaatatggtttatgcaagtgttccagatatttcccacgatggattcgagccttgtgctgaacttgtgctagcctagcctgttataagatctatggtaacgatgactgcaatttatctatgcaagtgatccagactgttggcacatgctggcacgccttgtgataacctactgctgaatgtctcccataaccttttgattctcgtgctcgatcgcaagtgtttctcgacctagcgtgaagagaatgtttcggtacttgaattctagcctgtggctgctaaacttgttctacttggatgggtcctgtcttgtcctgcgcaatcacatgcttaattggtactacatctgccacatgttgcactgctagttctagttgtaaattgtacggcatgcgcgtccgttctttcacaccttttaggttaactttatcggtcggagtctaaatttatcatctactctatctgcccccaaaatatagttctttctacttttttccacattcgaatgaattataatgaatatagaattacatatgaattgtaaaaacaaagtatattttgggagagaagtatttaaattttactttatctataaatatataaagtatctatagtgctgaaacaatgttgaaatagtgttttgcacatctattacgtccactggttaggatggccttacagagaggctgtgcggctggtctgcactctgcagctccatttcattcttctcttgaaatctgtttgacacgtactccatttcatttttctcttgagatcggtttggcttgtacttcatatgtctgtatatctatctatatacgtcgcaacttgcgtccaccgaagggcgtgagctgtcaaatcagcatcgtaccattacagccacataacaaaccatgcaggccggccgtttcccaatcattgggcatgatttgcactggcctatagtgacctttttcttataccttgctaatgatggcacatgacggccgtaacgaccatgttcactacttcctattaccgtgacctttctcttgtccaattcgctgtaattgatttccttttactgcgcacttagctaagagcttcttcaagaggggccctaaacacggctgtattttaaaatgtagggctaacaacccaaaaaattcatcaaataattataagactcggtctctcagatcttaaatatagtaccctatatattgaagttatatcctctttttctcttattatatgactattta

SEQ ID NO: 6631 - DNA, 786 bp, Zea mays
ttgggtccctcccgcccggccggcccggggagcaatccttcatttactactctacaacgaagaacagaaagagcatcgagagcgagccgccattgcctagaggactcggcgagagctccattcgattcgagactcgagagcatagccgtgcactgggaagaggaggtctaggagcagatgagcgggctggagctggagctgggcctgagcctaggcgtcctcatcgacgtcgtcgacgagcagtggatgcgcgacaccctccccgccgatgacatccccgtgccgccggccatggcagtcaaaactgaggacgccgaggatccagcgcccgccaatcaggaaagccaaccagcacaaggggatgtatggcgtgattttgccttggaaaatctctgattctttatgctctacattctacaagtgcctctagagatggagattctatgctaagggtttaggagctgcatggtggatggtacattgtgctttctgcgccgtgcttcctgaaagtctatctgaagttagtttaaaatatggtttatgcaagtgttccagatatttcccacgatggattcgaggcttgtgctgaacttgtgctagcctagcctgttataagatctatggtaacgatgactgcaatttatctatgcaagtgatccagactgttggcacatgctggcacgccttgtgataacctactgctgaatgcccccataaccttttgaagctcgtgcttgatcgcacgcgcggccccacctagcgtgaagagaatgtttcggtacttgt

SEQ ID NO: 6632 - DNA, 1470 bp, Zea mays
cggtggagtccaaccccggcccgtctctctgcttgcgaggggagcccgtgcgtcatggacacggagccgctgctgccgacgcacctcctccacccgctgccggagcactcggaggtgtcccacttctcctcaccgccctcccccgcctgcccatccccggcctccttctacaaggaccgcatcatcttcggcgcacacccgccgccgccgccgccccctccgcctccgccgccgcgctcgcaccgcgcccaccaccgccacagctccgtcgacggcctccacgaccttgacctgccctccggctcctcgtccatgccctcgccgccgtcggacccggaggacccttccgccggcggcggcgcgccctccctcctcgaattcatcgctggcgcccgcaccaacctccaccgctcccgcaccgccccggccatggcgccgctcagcgccgtggcgctcgcggccgccgcggcggccggggaccagactccggcgccgcccaagcgcccctccatcgtgctgcacgccttcctcttcctgctcgcctacctcgccctcggcgtcaccttctacgccgccgcgcccgccaacttcacctcctcggcggggcccacgcaccccgtcgccgacgcgctctacttctgcatcgtcacgctctgcaccatcgggtacggggacatcacgccagcgacgcccgccgccaagctcttctccatatccttcgtcctcgtcggcttcggcttcgttgacatcctcctctccgggatggtctcctatgtgctcgatctgcaggagcacctcctcatcaccgcgctcaataacccaacctctgcgcgcaagcaccgccacaactacatctttgacatcaagaagggcaggatgcgcatccgtatgaaggtggcgctcgcgctgggcgtcgtggctgtctgcgtcggtgtcggggctgcagttctcaggaaggtggagagccttgggtggctcgacgccgtctatcttgcagtgatgtcggtgaccacagtcggttatggggatcaggcgttccagacactagctgggcggctttttgcatccgcttggctgctcgtgtccaccctggctgtggcaagggcattcctctacttggcagagatgaggattgacaagaggcaccgagccatggctaactgggtgctgtcgagggacatgaccgtgtctgaatttcttgctgcagacatagacaacaatggttatgtcacgtaagtccatgacttcacattttcctgcttgcatttactacctatagcaagattatgtccaaatgatttcctaattttgccgaggacacatcaatcatccattcatataccatgcaaatgggtggttttaagttgattatcctccagagaggttttaagttgatttcctatttcaagatcactttttagacattatggaactaatcgggcaaagtaaatattttgaactctcagggct

SEQ ID NO: 6633 - DNA, 5154 bp, Zea mays
cttggcttctagggccacacgcaccgatcgatgattcatgcacgtttttgttaaagccccgtttggttacagtagtcttaggactaaaatttagtccagagactaaactttagtccctacactgtttggttgtagggactaaatagattttaaatacattaaatacaacgcataaatactaaaatacacattttcttgtttcacgtcaaggcaagggcaattggagtaaatgttggcctttaatcctttttagcacccatatgagggactagagagtaaaaccaattagtcattactttagtccatccgtttggcaaaatagagactaaacgagactaaaaccagagactaaagattagcccctctaaccaaatggggtctaagggcccgttttgtttgagggactaataaagattagtccctttattttaatctcatttagtcactacattgccaaacggtgggactaaaatagggactaaactgttttattctctagtccctcaaggggtgactaaaagagactaaatcatataaattccactttttgcccctcatttatttcagttgcactaattaagggagaatgataagggatattttagtctttttacgattcatttaatgtgttttgaaaagttttagtccctaaaaccaaacagcatatgactaaactttagtcttctaactaaactttagtcactcgactaaagtaaccaaacgggttctaagtctctcgatctggattatcgaatgtgaaaacaagacaattgcacatcatcggcaatgtgaaaggagtagcagcggcagcaccttttaccacatcgtacgtgttgcagacttgcagttgcactccgccttcctcctcccccatctctccctgcctgcccggccgcctctgtgagtttcagaagaagaaaggtggtggcgcagagcaagttgcatatccggccggttccggttccggccttttgtcgctcgcctcgcgtctggctggcaccgcccaccatctcttttctcgcatgcatatgtccggaaggcagcccctcgcttggcgcactggagtgaaaacctctcgcacgttttggcttggaggaccgggatcgctgagaggccggccggcacagaccgatcgatgccggtcgctgtcgtcggcgggtgaggtgaggcgaggtggcggttacggcgaagaaggccaatagaaaaacgcggagggggtgagggagggagagcgagcgagagatcggggagggagatctccgcgtcgctgtccccgcccgcgttgcgcctggattgcacccagccttggcccgcaatccatccgcgctttccggcgccacccaccaccgcccaccgccatatatacaccacgctgcgcgcgccccttatcgatcccgcctcttctcctccgtgtatcgatccggctagctgacgacagcgagggagcttccgatcccgccagcacacatcaaggtagcccctccatgcatttccccccgccctgagctctagctcccatgcactctcgctcgcccatttgctgaactgcggcggctgggctgatcgatgatgcatggtctgcgcgcgtgtacagttgtttaattttcgatccattcgcgcgaagcgggccggccggccggcgaggaaagggtggtggtgcggcgcgaagcgtttcggccggtgctccagtaccttgcagtcggcgtgctaaaaggagtgtgtgaagccgccggcgcagctagctttggcacgagcacgaccgcaccaggccagctcaggtaatctgctatccatcttgttacgtctgcacgtaggtttcgatagtccagctacggcagtactgcatgctccacagtcgggatgtgcgaaggacatgctaattcgacagtgttttcaaaccttgagaaaatctaaggcaagctgttgtcgtcgggattcacagtcttaattattttctacggcttcttgtttagaggaaagcaaatatgcatgcatgcattaatatggtcatgagctttactgatgcttccgcctcaggatatagttgcaaaatgtttccgagacagtgaactacgtactccaaagtcttctctctttaccacgctgtcatctttgaacgttgatttagccaattcaacgtaaaggtctcgccacgggggtatgaaatctagcttcattgacacaaaagaaatagacaaagcaacgcatatactgggttttcgtccgggtgatcatatgatatatgctactgtcagcagggccaaaactaagtgggtgtttggtttctagctatggactaatttttattccttacattttatttcattttagtttctaaattgtcaaatacgaaaactaaaatagagttttagtttccatatcttttgtggtcaacaaaggagagatattacgcggcttgttcggttagattaggggtagactaagagaaattagattcctccttattcagttttgaatagaaatgaatttaattccccctcgttcctcacaatcccactcaaaccaaacatggccttaattagatatattgtgttgaatggaccaaaatattttcaaaactccattaatagctaaagctgtaagattttggtggggtctcattcaaaaccacaagtgcttttatcactatagaaactaagggtcaagttttctaattagaaaaaaactttcgttacatattcttgaacaggacggcccgggccatacattattatcattcattttgctagtacaaattagataggcccacacaccagaagactagctgacaacagaagttatggctaaatgatagctttattgttaaccatggtgcagtgaggtttgcttgacgtctaccagctgcgcataataacttggctcggaagaagaagaagatggacgctttcacacatgttcctcccggctttcgtttccaccctaccgatgaggaactcgttgactactaccttaggaaaaaggtagcactgaagaagatagatttggatgtgataaaagatgtggatttgtacaagattgagccttgggatctgcaaggtacatcaacctaaactcgatttgtactccgagcttgcatgatgagacataaaactgtacttagctgagatatgtacacctcaaagcatgtgtggaacaacaagcttcttgtggagtcattatgcatgaagctcaacggttataagccgctaactcacttctacatatgcatggtgacgaaacagaaaagtgcaggattggaagcgaagagcagaacgagtggtacttcttcagccacaaggacaagaagtacccaaccggcactcgcaccaacagagcgacgacggccggtttttggaaggccacggggagagacaagccgatctacgtgaagaactgcctcgtagggatgaggaagacactggttttctacaaaggccgggcgcccaatggacagaagtcagactggatcatgcacgagtatcgcctggagaccaacaacaatggaattccacatgtaagttgtacagatcctctagaatacatgcattatccatgtcagcgtcctacgcgtccgttagttattccacctgtctaacaaaagctcgtatgcatgcatgtcattcaggaggaaggatgggttgtatgcagggtgttcaggaagcgactcgcgactgtccaaagaatggtcggggactcgccttactggttcaatgaccacgcggggttcatggcgccggagctcggctcaccgaggcaggcggcgcaccaccagcagaacgtcatgatgtaccacaggcaacagagcagctacagctacccttgcaaggtggagctggagtaccaccacctccttccccaggagcacttcctgcagcagctccctcagctggagagccccaagctccctgaccttattggccaagtagacactactctccagccagcatgcggccttacacaggagcatggtgcccctcgctacaccctgcaggagcttcaggccgagcctctctatctggcgactggcggggacacagattggcgagctctcgacaagttcatggcgtcccagcttagccacggagacatcacccctaataaggattcagctaataactactccaatccggcactgcaggtgattcagcagtctgaagagaaagaagaggccttggactacgtgtcaacgtcagcctcctgtggaggggacaatgatttgtggaaataacagcgtcaatggtaatacatattcacatacgcactaaatcactggactagtgcattattccctcattacacagttaataacattgaggcgtgctggatgtaatgtaacgtagtatataaagtagccaactgattcatgtgtcatggtatagtagaatggtatgtgcataacaaagtgtaaccgagtaggtcacacgtccatgcataagttggcataatgtctggtgttaataataaggttagctaacagctgaagctaaggagcttcagcacctgatttggcaaaacatccgtgaagaattaggtaatttgtcaaagagacaatgcctatttgtattgttcttctgtccatgtatacttgtgcacctttgttgtcattctatttatttaaagataaatatattcaaaacaataaggctggttctaacctcagtagacaccaacatatatatgacacgggcgagccggcaatcggtactgatcgtcatgcttgtgaacaacacgaatatccttgtggtccatttccgcgaagcaactctttattcttcgtggccatcgagcccttgggcgtgttaccgacgaatcacacctagagctccatttggtacatcaatgccctagcttagatgacataggtatgggcgtggctcgatagatccttgccaagttaccacaaagctctcttatttacgtagcgtgtcctacccctcctcatcctgctgcagacgaggggcgttggtaagcatggggtccatatcttttctccttacttccgtataaagaacattatggggttgtgttgtcccaggggtgatctctgtcacggaaggtcgcgagaggggcaaaggtatgaaccctcccatctcctcgggggagaggattttcgtaaatggagaaataatgagtaaggggtttatggacaatgta

SEQ ID NO: 6634 - DNA, 875 bp, Zea mays
gtgcggccggccgggtccaatatccctccattctcctaccaaaaatcgcagcgccgcccgcaccaatctcgaagtgttcgaaagtttccagacccccaaaaggcgaagcggcgatgagttccaccggaggcggcggccgcgggaaggcgaagccagcgaccaagtcggtgtcgcggtcctccaaggctgggcttcagttccccgtcggtcgcatcgcgcggtacctcaaggccgggaagtatgcggagcgcgtcggcgccggggcccccgtgtacctctccgccgttctcgagtatctcgccgccgaggtgctggagctggccgggaacgctgctcgggacaacaagaagaaccgtatcgtgccgcgccacatccagctggcggtgcggaacgacgaggagctgagcaagctgctgggcactgtgacgatcgcggccggcggcgtgatgccgaacatccatcagaccctgctgcccaagaaagctggtcagaagggggacatcggctctgcctcccaggagttctaagcgtttcggcggaatgaggagagggaccgccccctgtttctgtctcgtccgcgtggttgtgtttcagctctgcggtttttgggggagtgctgtcgatgagttgggattgatatgggttgtggggatgtaaacaaacgcagcgcgttgtttcatgaatgaatgatggatagaaggaacatatctatcatgatttctaccctggttgcatttggatccgatttgctcctatcgtttggtccattgtatcagacctgatgatggaactctttatatcggttctatgaactctgcatcatatgatcaaaaaaaaaaaaaataatgttgggatatacagtccgggaactctga

SEQ ID NO: 6635 - DNA, 698 bp, Zea mays
ttgggaccctcgaggccggccggcaatctactcctccattctccaccgcgccccaacctcgaagagttccgaagtttccacaccctcaaagcgaagcagcatgagttccaccggaggcagcggccgtgggaaggcgaagccagcgaccaagtctgtgtcgcggtcttccaaggctgggctccagttccccgtcggccgcatcgcgcggtacctcaaggccggcaagtacgcggagcgcgtaggcgccggggctcccgtgtacctctccgccgtcctcgagtacctcgccgccgaggtgctggagctggccgggaacgctgctcgggacaacaagaagaaccggatcgtgccgcgccacattcagctggcggtgcggaacgacgaggagctgagcaagcttctgggcactgtgacgatcgcggccggcggcgtgatgcctaacatccaccaaaatttgctgcctaagaaggctggtcacaagggggacatcggctccgcctcccaggagttctgaacgcgtcttcggaaggaggagagacgcgtggtgatgtttgggctttgcggttttggggctgttgtcgatgggtttgagactgatggtttgtgggatgtaaacaaatgcagcgcgttgtttcatgaatgaacggatgaagatgaatgatggatagaagaaagtatttattcatgatttcctccct

SEQ ID NO: 6636 - DNA, 644 bp, Zea mays
gtttggcaatgtcttcatgtcatggaacgccttgtagaagttctgaacggtcttgaccttcctctcatacggcacagactcgcatcattcctacctatgagaaaatcgttccttctcggcgaactctacttccagcgcctgcagaatgttggcaaaaacttggacctggacttcctcgccaatgctctggcggtcttctcttccgatacgcttcggccccgaccgtcctgcctcgcatttcacccttttatgccgcgaccatacgtgatggaagctatggggacttcgggagcctttttggcaaagccagtacccatgctatatctagatcctgcccattggttatctgtctcgtcagatgaccagccaagctaacacactgctaagcaagacggagatcaacgccagctatggaagtccttggccttctttattttgcaagtgaaaaaattatttgtaatgaaattcagcaataggggtagaagttgctcacataagtgaagaggcttctaccaggaaccagccataacaaaccggcggtcaggtcactacgcataaggcatattcgatagacgcattcgaccaggggattccgtcatgccacctctattatacactccagataccttaagagcgtgatacat

SEQ ID NO: 6637 - DNA, 2534 bp, Zea mays
catgcatccatttgaggttgctaaccgctgtgttatcgacgaaacacaggtaacttctacatcactctttctggtaccagtttccattgatttcccatgttaccgacatgaatgtactctgatgatagatgatcgtcgaggaaattaatatattaaccactgttctcttcaagaatgacaaccagtttaggcagctttgaggtccaaaattaaagggtaattctcaaacctaacctgcattcatatttaatttcagttttgtaaaattatcgaaagaaactatgccagccaatttaggcagcttgtattttatttattaaaaaggaataagattacaaggggctaaaaaacccttgcagaatatttacaagaaaggggagcgggggagagagaatacaattcaaatatgtccacaaaactggaagctggagagggagaggcagaaggaggagagggagactgaataatattacaaagaggttggtgatagttagtcttatagtatgaggtagccgaagttgcaagtggcaccagcaacgaataagttatcttagtataatcacatgtttatgaagaatacacattatcaattgtcaccggttccctttactttcaggtacctggagagcaaaccaacgcattggcaccctacccacactgtaaatctcaaggacatcttggatgtgaacaagattaacatgtctctctcagtccagcacaccatgaactttcaaaacatccgggagaagaacatcaggaggtctgagctcgttatggagttgaagaaaatattcgaggagatgtccattcggtaccaccttctaccccagaaagttgaactcacctacgtcgactcgaacccactgcccatgggtccttctcatacaagatagaagatgggtgaagacttttaagtctcatactgacaacttgatccgtttcatgggatctgacaactgatggctagctgtgcagtctgttctgaagttactaaaactctgcatagtagatattagctcgtagaataatttgtcagataatgcatttgtaagcggtgatggtactggtgatcaatgctttgggattggccattacaccatttgattatctacaccgtttggtgcatcacaatcgaaaatgttgcgaaatagccactactaaagaaattcagctgggagattgaagtgggcctgtcgaaatgttattcttcacaatagtaccatgtaattcagctgtgagactggtagtcactcttgtgcatattttttgttggcaaaaatctacttcatgtccggtgttcaagaggttcctgagcttcaagaagaagcatagggggagggaggtcactgtaatcgactgcatgtcgccgcccgtgccctggccagccgacgacgccagcggcaggtggcagcctgctagctggtgggtcgggcaaacacatgatgggcttctctgatgttgcctctgatgatatggaccatagctacacgatatctccacaagatactccttctcaatttcttcgtgtcatttgacattagttatcgtgatattatatattcccgttgcaacgcacgggcattcacctagttgacgatgaagaatggaatgtcgcggcggctcagctcatcatccactgacttggcatggtcgggtcgtatgtatcctgctgccgcccgcgcgccagcctgagccaagtccaatcggttccggcccatgggattgatagaaaaatcgatgccaagtcaattggaaacactgctgcgtgcagtgctgcccgtccacgacgtctcctttactagcaaccacgaccaaaaggaagaacacacaggagagcagagcacttggtggcaacaagaggagaggagaggagaggaggacgcatgcatcagctagctaggaaatgccaaacgcctgtctcgtcagtggtcagtgtcattgtcgaagacgaatggacaagagccccgtgagttgctccgctgggggtacgtagtagtctgggcaggcatggcgtcggcgtcgtcgggcactgggcggtggtaggtggccgaagttgcggtgctgctggcaggcatcgtatggagccacgttcaatgcgcgatcggtatggaacggaacactgtgctgcctgtacaagtacaactggtatgctgtgacagcatgggagtcaagtggcaatggtggtagggatgggggaggcggcagaggaggggctggagggcattgtcattgtcgcagccgcctctgctctgctcgtctgcagttccgaggacgaatcttgtctgctctgcctctctgcccctgctctcgcattcggatatgcagcccagcaggcccaggaggaggccttctttggtttgtcgcccaacactcgagagcaagcagtgaaccaaagaagcccataacgtagatatcaaaccgatgtaacctgctaacagcggccgattgctcactcgttcctaatccagcgaacgaaacgaccgaacaaacactctccgctaagaatgcatagttagcatgcattgctcaccacg

SEQ ID NO: 6638 - DNA, 1547 bp, Zea mays
cagcttgagaagacgacgctcatccggcaacggccactcacaacatggttgccaggccttcttgtgtattggatttttcctccgacatggcacgagaagaggcggcgcttcgccgcgctttgtttgtcacgatcattggtacaaggccagaggtgttaggctctgaagtcattgaagaagtggcacgaagttttgagatcgaggcagattccatgtccattcatcagaccttcccggaggatttcatcctgattctctcggatgaggatgctgcaacaaaggtgctcaatggaggaagagttctcagagggcctcagtttcatattcagttcaagcgctggacaaggctggctcatgcaacggcagctgcattgccgtcgctggtcgacatcgagatacaagggattccgttgcacgcttgggggcgcgccacccctgaacagctacttggtaattcctgttggatcacagatgtgcacccggatacttccctgaaaagagatttttcatccttcaggcttcgggcttggtgttgcgagttagagaagcttcaatgtgccatgaatctggtcattgttgagccaacgccagcggatcatgtgaaacggtgtttatcctacagtattgaagtgactgtcaccccagtcgagaagccactgtcagatgggacccctccacctcctcctcctggcaacgacaacaggcatgaagatggcgatcgtcgccgtcctgaggctccaccccctcgacgccggcgagaagaccttcgggaggggacccatccaccaacgtctgggccctcttgctcctgtgaatgactgtggtaggggctctgccaatcacagcacaagcgttgcacccgaggcgccaagatctgctgagacagagacggttcaggtcccaagggcaacaagatccgaagaggcagcgacggtccaggttcctgctttggacgatgaagtcttttcagcgccccttcctgttcttgagttgtcggctctctcgggggacgtgttccggccggcggctgttggggtaaagagccatgggggtgaagccgaagcaaaaaactgtttccatcccgaggttgcctcgggcctcacgtctggggcacgcgtacagccgcccaacagtaatgaggcactcctggcaggggtcctggttgggccgctggaatgggccaggcaaacctcgccccagctgtctgggccgctgatggttcctgggccggtttcgccccactcactcctgcgtaattatctgctggacatttctgttttggatgggccgctggaatctggtgcgttggtttcgccccagcataccattgctgggtcgctggaactgagcgtccaaatttcgtcccctccagagcctgcttgggccctcagtttagttgcagcccagaataaaaatttaactggccagggcagtacgtccctaaaagtttatactaggaggacagctgataacaggaggcaaaagtatgattctcaggattccccactcattcaagcccttcagccaaatcaagcctcttctcctca

SEQ ID NO: 6639 - DNA, 1130 bp, Zea mays
  misc_feature (1108)..(1108): n is a, c, g, or t
tcccccgtttttgcaggaattcggcaccaggattatctctaccaagtgcaacaagagcagccagccatgtctgttgacatggttgattatcagagaactttggctagggagattgaagcccggttagaagccaagtgtgatgctttggctgatctatttgctatggatgaaagggattcgtcatccctcagtcaaatttcaagtgctaggcttccagaaagggtaaaattaatcatcgaagagatagagaaggaagaggcacatctcctggaggaccttgcttcaatggacagaaaatttgctgaacattataatgtcttggagcaaattcttgctgtgcttatacagtttgttaaagacaagaaattggagcatcagcaccaatttgatgatctgaagaagacctggcttatcaaaaggtgtcggacaatgaatgctaaactaagctatctggagcatcatctattgcgtgacacttacaccaaggacacagtaccagcactgcacaggatcaggaagtatcttgtagaggccacaaaagaagcatccaattcttataatgaagcggtttcgcggttgcgtgagtaccagggtgtagatccacggttcgatgtgattgcgaggcagtaccacgagattgtaaagaaactggagggcatgcagtggacaattcaccaggtggagatggacctgaaacctcaccatgaccacgcagctgtttaagtccacatctgttggaggccatgtttattacctgaatgcagcgggtgcgagttaggggggttgcagtggatttgatttgagtcagagggtttctgtttgtgcatgtttttttttgtgtatatccatgttggataatagcaccatcaatgcttgcttagttatacggtcatgtattcggtttgtttgatgacgagaaacactagaagagagcgagacatggaaaacaccagaacaattatcattgtactacgcatccactgccatgtcatacaaaacaaggcaagtctagatgacttttattaggaatcctaatggctataatggaacgtagtagccgagaagaaggcttcgtccggaggcatctgttttgccaggaagtgattanaaaaaaaaaaaaaaaagcggcc

SEQ ID NO: 6640 - DNA, 687 bp, Zea mays
  misc_feature (5)..(19): n is a, c, g, or t
  misc_feature (70)..(75): n is a, c, g, or t
  misc_feature (92)..(93): n is a, c, g, or t
  misc_feature (96)..(96): n is a, c, g, or t
  misc_feature (101)..(101): n is a, c, g, or t
  misc_feature (121)..(121): n is a, c, g, or t
  misc_feature (124)..(124): n is a, c, g, or t
  misc_feature (127)..(127): n is a, c, g, or t
  misc_feature (130)..(130): n is a, c, g, or t
  misc_feature (133)..(134): n is a, c, g, or t
  misc_feature (136)..(136): n is a, c, g, or t
  misc_feature (142)..(142): n is a, c, g, or t
  misc_feature (149)..(149): n is a, c, g, or t
  misc_feature (193)..(193): n is a, c, g, or t
  misc_feature (199)..(199): n is a, c, g, or t
aaaannnnnnnnnnnnnnngggggggtggtgtgcggggggggcggggaaatcctttccaccccgccaggnnnnnnctttcggacgggggaannaanggganaaaattccgaaaaaccccgnggnggnggncgnncnagaacnagcggancccccgggcggcaggaccccgcacgagaccaggaccgagaacanccgaancgaaaaattatcggaaaaaaaaaaaacaaaaaaaaactctcactcgacaaaaacaaatctccctaatttcagtcatgaaggcccaggtcgcagcagcaactgtcttggtcttgctcctcctgacctttgctgcggaggctcgtacgtgcatgtcgcgaagccaggaacagaaagggaggtgctttcacgatacggattgtgccgccgtctgcgtcaaacagagcttcaccggaggcttatgcaacgggcggccgccgttcaagcagtgcttctgcactaagccatgcaagagagagagagctgatgctacactccggtcgtcaggcctctgatcatgttgtgcttgatccgcatgacagcgcgactctcgcttgtatgcctaggttgatgtgtatgtaataaataaacaaaatagtaaatgacatgtttttcttacatgaaagtcaagcgattttgcttatctgaccggcaaaaaaaaaaaaaaaaag

SEQ ID NO: 6641 - DNA, 1551 bp, Zea mays
aaattcgtgtaggtaattaaccacttcatgttacttgttgccaaaaaaaaagtgatgattctgcttgtacacacgccttgtttttttttcctgttccctgtgacttctgttgaacagcaaaagctatgagcgctaagatgctgtgggaatgaatagaacaaaataccaatcctgtgggcgtttctttttttccttttgatccaattgcttcattcggggtagtaattttacaaagcccagttatggggatacattggtttcaaaaaaaaaaactcgaaattctcccgcctatccaccttgaattggattggatttgcttcgagcagtcagtcttgccgaagtttttaggagttctccgacctcgtagtcaatcactcagtctcggagacacacattgccactgcgatggccgcccaccaggactcggcggcagcggggggcaggcctcctcgtcgtcctcgcgtcctcctggcagcctccggcagcgtggccgccatcaagttcgaggtcctctgccgcagcgtcgccgagtgggcggatgtccacgcggtggcgaccgcgtccgcgctggaattcatcgacgtggcctccttccccggcggcgtccctctctacaccgacgaccaggagtggtctagctggaagcgggtcggcgacaaggtcctgcacatcgagctgcgccggtgggccgacgtcctggtcatcgcgccgctctcggccaacaccctcgcaaaggtacgccgtacgcacgccagctggtcatcgcgctcgccctcaccggtcgccgctgacaactctgcctgctgccaggtcgccggcgggctgtgcgacaacctcctcacctgcgtcgtgcgcgcctgggactacagcaagcccgtttacgtcgcgccggccatgaacaccttcatgtggggcaaccccttcacggcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatatggcagtggagcgcttctcgtctttcatttccccgtacagatcgtcaagcaccctgaaaacctcctcagcttcagacggcggcgcgctccaggccgtgaaggcgaacaccttgttcctcacttcaatccagctctgccccggattcttcctcaaccctgcctccttcatcgtcatcctcaccctcttggagtcgtcccacatcccacacgcggcgtacaggtttgtgatcagcgtgcggttgccggtggttgccgtctcagcctgcagaactttggccatggcagcttcggccagtgctgcatccccgtgaatcctgcaggagttgagcagcgctccccacacgcacaggtcaggcttcatcggcatcgtatcaatgagctcacacgcgcccctcagcaggccagcacgccccaggagccc

SEQ ID NO: 6642 - DNA, 1681 bp, Zea mays
ctcgaggccggccggtagtcaatcactcagtctcggagacacacattgccactgcgatggccgcccaccaggactcggcggcagcggggggcaggcctcctcgtcgtcctcgcgtcctcctggcagcctccggcagcgtggccgccatcaagttcgaggtcctctgccgcagcgtcgccgagtgggcggatgtccacgcggtggcgaccgcgtccgcgctggaattcatcgacgtggcctccttccccggcggcgtccctctctacaccgacgaccaggagtggtctagctggaagcgggtcggcgacaaggtcctgcacatcgagctgcgccggtgggccgacgtcctggtcatcgcgccgctatcggccaacaccctcgcaaaggtcgccggcgggctgtgcgacaacctcctcacctgcgtcgtgcgcgcctgggactacagcaagcccgtttacgtcgcgccggccatgaacaccttcatgtgggacaaccccttcaccgcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatcttgccacaaaccacggggtagaattagatggcaattgttctacgcaatgtttgcaatggcatcatacatggcacatggcagtggagcgcttctcgtcttccatttccccgtacagatcgtcaagcaccctgaaaacctcctcagcttcagacggcggcgcgctcccggccgtgaaggcgaacaccttgttcctcacttcaatccagctctgccccggattcttcctcaaccctgcctccttcatcgtcatcctcaccctcttggagtcgtcccacatcccccacgcggcgtacaggtttgtgatcagcgtgcggttgccggggggggccgtctcagcctgcagaactttggccatggcagcttcggccagtgctgcatccccgtgaatcctgcaggaattgagcagcgctccccacacgcacaggtcaggcttcatcggcatcgtatcaatgagctcacacgcgcccctcagcaggccagcacgccccaggaggtcaaccatgcaggtgtagtgctccatggttggggagatcttgtgctcccgcaccatctggtcgaacaagcggcggccctctgcgacacgccctgtgtggctacacgcagaaagcacggcgacaaacgtaacgccgtcaggctcaatcagagccctggtcaagtcttggaacattgcaagggcttcgtcacacataccatgtgcgccatagctcccgatcatcgagttccatgagatcaagtccctgctcttcatcccgtcgaacaccttgcgcgcagtagcaaccttcccacacttgccgtacgtgttgaccagaccgttctgcaccagcgagtgccggtctagcgctgctttgatcgtgtggccatggacctcctgacccagccgcaacgccagcagttgtatgcaggctgaaaggacggtcgctaatgtcaccgcgttcggcaaaagccgctgttgctgcatttgccggcacagctgca

SEQ ID NO: 6643 - DNA, 2689 bp, Zea mays
ttttttttttttcttttgctggtaagatatacattctgtttcttaataaattaaaatatcagtctgaagttacaattccaggcactgcctactgtcgtgctgaaaccaaaagggcaaacgatcccttcttctataccagtggagtaggctaaaccctaatatacaccttccaactccaacagcacacgaaaattttactatgtcgtacccactaatcaaaaccggaaaaataagcgaggaaaacagccgttccacataacgtcgagcacatggcgcgcgctctacgaagctggcctaatggtagaagacgacgggcgggacggcgaacccggaatccttgaggaacgggactacctgcggtcgctcggagaggtcgtggtagaaggcgtactccgcatcgtagtcgtggaggtctagctccgccttttggttgctgtggtaatgatgcttggcgtcggaagacttgctgaagccaaacacgctgactctgtcgcacactcccacggcgaccatgatggcttgcatcccggacgagtaatggaacatggcggcgtcgtgcgcgcggtcccactcctcgggcgcgcggccggtctcggcgacgaatcggcggagggagtagtacttgacgatgcgcgcgcagaggacgtcgaggcgggcgtcggtgacggagatgggggagccgtggcgggaggacgaggtggcgttgcaggcggcgacgtcgacgaaatgggcggcctggcagatgtagagcaggatggggacgccgtggccgtaagggtggcagaagcagccgggccggcgcgcgcagaggtgaagaacgttgctgttgatgaaggagaagttggtcttgctgccaacgtgcgcggcgtagcctgagacgcgggcgttgttgaggcggaacacggctgcgtgggaatcgatgagggctccatggttcgcgcgcaggaggatgccgctgttgccgacgacggcgcaggaggggatgcgcccggggatggagagcagggaggggagggcggcgaggacggcagggtcgtagcggcggaggcggtgccaggagcggaggtcgcggcgcagggcggggtcgatgcggagctgctcgtggcgcgggagcgggtggagcaggatgtcgtggtcgtcgtccgggtagcggccgcggcgcgggagcgggaagctgcggtggcggtggaggtggagcgggtggaggaggcggtcgcggcgccacgcgcgggcccgcgccgcggaggccgggaggcggccctcgaggagtccgtccacgtcccggcgcagcgacgcttccgacggatcggctgcggccaggcggagcagcgtagcgttgaggcgcgccgggtcgagcggcgggggctcctgcgcgggcgggggcgccacggcgcgacggagcgcggtggagaaggaggccgcgccgacgagcccgacgaagatgagcaccgcgaaggagcgccgcagcggccgcttcatcgccgccgcgggcgcagccccagcctggggctagctgggtcggagccaccgcatccgcatgggggcacgccaatcaggcaaaggaggaggagagaggtgagagagagcccgcgacgcgcggggcgtgtccgtgcgaccgatccgagccgagcactgtccgagtggcgaagtgggcgtgtgggcgcttaggatgttctaggtaatggtctcgtgctttattggtcgccgtgctaacgggcttgcgacttgcgaggcgggtaggattataggagtgtgctattcatggttggttggactttggggttcggcaaacgggggatccaatgtgccctgctccggttcgtgcatcgggcgcagtaatcattttgcgtgggtggagcccgccaacatgcctgcacgatgcggcaggtagacccgttcacccgtgatgcgaatgcgatgcaggggcgggcccaaaggggacaaagtaggccatgcctctctttatacttacagtaatgtttatttactttttaagtacaaaaaaattaaactttaggggtctaaaacagtctatttctaggtcttcttgtcggatcgatcaacccgatgtcctcctaatcctattcctgctgtcccctccttcccgatgtgcaaccccgaccctgccccattcgtcgtcgtcgtcgcaacgaagcgacctgctgccattggccattgccactgaacggactatgaacgccacgccgcatgccgcttttgatgaccgcatgggcttgtttaaccagatccatcaacctccccttctccggcacctgtacgtttatttttcatagtttagggatgatgaagatcatcagaagatgcacgcttcatttattcgctgcttagacctccttggacttgggctcatatggacattgcccccgacgacgcgccaacgggttggaaggctcgctcgtgatcaaggatctcaatttttataatctcaacaaattataatctagattatataatctataaattttacttgtttatttacctgcgatggatctgtgccgtagtttttctagtcatcctttgtcggtctcgtcgtctggatgaatatacacgtctctaatcccgtttctcgtccgagcgcaccatgattggaagacaacaagaatctgcagccttcattaaaacgaaagttaggaatcgatctgtcagcacttggatgatgggcaaggca

SEQ ID NO: 6644 - DNA, 1372 bp, Zea mays
ctgcagtacctggcaaaggagttcagtgctcgatcaatgggaagcatgttttggtgagtcataggtgaatgtcatgcttccatatcccttttaatttacattgtctgggctgctgtatatggcatgttatggtatcttccaattttcctccaaaatactccctctgttatatggctgtctcactgtctctgaataaacctttgcttatctttaaaactaatgtattggcattggcaggtcggaaaccgttctttgatgactgaaaacggtgtgaccattcccccagaagcagaaactttcttgatagacctggaatcgaatgcaaaaacaggcatacttgtggcatatgatggcgattttgtgggtttgatgggcataaccgaccccctgaaacgggaggctgctgttgtagtggaaggactaaaaaagttgggtgtccatccagtgatgctcacaggagataattggaggaccgcgcaagctgttgctaaggaggttaggctcgtctttgtgtggtctttttctttgacttcaattcattcataagtttcacatgttaacttgtctttccattttcatttgctcgtgctgttgtacttcgacaggttggtattgaggacgtgagagcagaggtgatgccagccggaaaaagctgacgttgttcgctccctccagaaggacgggggcaccgtcgccatggttggcgatggcatcaacgactccccagccctggcagcagccgacgtcgggatggccatcggcgggggaacggacattgccatcgaggccgcggactacgtgctggtgcggaacaacctggaagacgtgatcaccgcgatcgacctatccaggaagacgttcagccggatccggtggaactacttcttcgcgatggcctacaacgtcgtggcgatccctattgccgcgggcgcgctgttcccgtttactgggctccagatgccgccgtggctggccggcgcctgcatggccttctcgtccgtaagtgtagtgtgctcgtcgctactgttgaggaggtacagaaaacccaggctgacgactgtgctgcagataactgtagagtgactgtgaatactgaatactatacgtcccttaaccgattttttgcagaaatgaactggaaattgcatcggaaatggcgccttctgtaaattgtacacccctgtcccacattaaaattcgttatacttaattattggattcatacaacacttgatgtatgtgcttcatacatatgtctagacataaaaaacacttagattcattaccatccaattgaatatagacataaaaaacttagagctaaaacaagtactattttggattggagggactaaaaaaaactcgagggggg

SEQ ID NO: 6645 - DNA, 1285 bp, Zea mays
cccgttcttgtgagtacgtgtagaatataaaggattccacatctacaggaggggagttgcgtaagaaagcttggagactaaaaatcgttctttcgctacgtccattgcctttcttcatcaagcaacaaacaaaacaacaacaggagaacaggcaaaggcctccctcccttcttccctccctcaaatcaggaaaccatccaacttgtcgatcggccttgcttgccttggtactcctgcttccgccatggttcagatcaaagagttccggatcgtcatgcccatgtccatggaagagtacgagatagggctgagctacaccatcatgaagatggagcagcagaacaccaacagcaaggagggcgtggaggtgctgcagcaggccccgttccacgaggatgccaagcttggcaagggccacttcacttccaaagtttatcatctgcaaagcaagattccgtcatggatgaagggctttgcacctgccagcgccctcgcggtgcacgaggactcgtggtgtgcgtttccaaagagcagaacagtgatcaagtgcccgctcttcagcaagtgctcactcaccattgacactgtcaccaggcccgacaacggttgctctgaaaatgcgcacggtttgagcggcgagcagttagccgcgagagaagtcgagatcatcgacatcgcatccgtgtcgcgggactactggagcaaggcgatcggtgctccgagcgtcgacctgactgccttcaagtcacagcggacagatcgaggcccccttctcaagggatggatggactcgtgccatccggtgatgaccacgtacaagctggtgaccatggacgctcccatatggggcctcggcgaacgcctggaagactgcatcattgcgggggagagggcgctgttcttggcatgccaccggctgtgcttcgcgtggatcgacgagtggtacggcatgaccgtggagcagatccgcgagatggagcggcagacggacatgctgctcaagaagacgctgaagaaggccgggagcaataagcacgagggcaacacgaagacgctcaaagacgagctagtggccgtggggagctagtggccgtggggcatcaaacatgtcacagattaggcatgtgcaagtgtaatgtgtccacaattaactgaagaaaatatgcatcgctgtatgtatctatatacaatcaaggcaggcaggcatctgtggtttgtctttaaccccctaaaactagcaagcttgctcgtgcaaatagtattatttcactgctttctgcattct

SEQ ID NO: 6646 - DNA, 1469 bp, Zea mays
tcgcgatctagaacacaaacaaaaaaacaacaggagaacaggcaaaggcctccctccctcaactcaggaaaccatccaacttgtcgatcggccttgcttgccttggtactcctgcttccgccatggttcagatcaaagagttccggatcgtcatgcccatgtccatggaagagtacgagatagggctgagctacaccatcatgaagatggagcagcagaacaccaacagcaaggagggcgtggaggtgctgcagcaggccccgttccacgaggatgccaagcttggcaagggccacttcacttccaaagtttatcatctgcaaagcaagattccgtcatggatgaagggctttgcacctgccagtgccctcgcggtgcacgaggactcgtggtgtgcgtttccaaagagcagaacaggtgagcagttttccctttggacagactctgtaatgtaatgaaatgtaaatattccagtggctgagaatgttctctcaacttgtcccccattgtgtttccatgaacggcggcgcgggttccatccattctgactcgcccgcacgctagtgatcaagtgcccgctcttcagcaagtgctcactcaccattgacactgtcaccaggcccgacaacggttgctctgaaaatgcgcacggtttgagcggcgagcagttagccgcgagagaagtcgagatcatcgacatcgcttccgtgtcgcgggactactggagcaaggcgatcggcgctccgagcgtcgacctgactgccttcaagtcacagcggacagaacgtggccctcttctcaagggatggatggactcgtgccatccggtgatgaccacgtacaagctggtgaccatggacgctcccatatggggcctcggcgaacgcctggaagactgcatcattgcgggggagagggcgctgttcttggcatgccaccggctgtgcttcgcgtggatcgacgagtggtacggcatgaccgtggagcagatccgcgagatggagcggcagacggacatgctgctcaagaagacgctgaagaaggccgggagcaataagcacgagggcaacacgaagacgctcaaagacgagctagtggccgtggggagctagtggccgtggggcatcaaacatgtcacagattaggcatgtgcaagtgtaatgtgtccacaattaactgaagaaaatatgcatcgctgtatgtatctatataggagtacaatcaaggcagccatctgtggtttgtctttaactccctaaaactagcaagctagctcgtgcaaatagtattatttcactgcttcctgcattctatttctatcttttattaggtgagtgtccgtgcgttgcaacggaaccgtataataacacaataacttatgtacatatgtgtgttatattgttacatgtatgttctcgtgcgttgcgacagaagtaaaacatttgtataaaacattgatacggaacgac

SEQ ID NO: 6647 - DNA, 1555 bp, Zea mays
gcacgagaccattacctagaacatcctaatcgaaaacccctcatcgccttcgtggcctggcctgcccgtcgtgtgcggctctgcgcctctccctccctccctcccttccccgatcgtaaccgccgcctccgatcgatcgccacgatgcggctcttctgacgtaccgccgggcgtcaccgtcaccgaccgagacccgcgcccctcgcctggactccatggccgcgtcctccccgctggtgctgtcgctgctcctcttcgcgtcgctgacggcgctgctggtcctcgcgccgcgcctatccccgccgcagccgccggcggccgccggtggtggtggtggcgaggaggccgacgacctccgcctgttccgccgcgcggctctggagtcgtcggcggcggacggccctcccaaggtggccttcctgttcctgaccaactccgacctcaccttcgcccctctctgggagcgcttcttcgcggggaacgaggcgcggctgcgcgtgtacgtccacgcggacccgtccgcgcgcctgcttcttccacgcgtgcacgcagcagctacatcgaggtgctggagggcgagccgcagatggcgtcgcgctacgcggcgcgcggcggcgaggagggcatgctcccggaggtgccgtacgagcggttccgcatcgggtcgcagttcttcgcgctggcccggcgccacgccgtgctggtggtccgggagcgccggctgtggcgcaagttccgcgcgccctgcgtccccgagatggcgcaggactcgtgctaccccgaggagcactacttcccgacgctgctggacatggcggaccccggcggcgtggcgcggtacacgctcacgcgcgtcaactggacgggtagcgtcgcgggccacccgcacacgtacgccgcgccggaggtctcgccaaggctcatcgcagacctccgcgcctccaaccacacccaccacccccacatgttcgcgcgcaagttcgcgcccgactgcctcggcccgctcctcgccatcgccgacaccgtcatcttcaaggactgatggcgggcggctccatccaggtactacttactactcggcagcagagggctgggcctggggctagtcaaggccgccgacgacggacggcgcggcaccggaatcagtggcgttcttctcccgtttggaccccccctgcagcgtcatgcatgttcatcagctccagtgtttctgtgtagtagattaggagtgtagagaagaggaggacgacgacgacgacagcacgcggcgacctaatgcgaagcggcaggttgtggttgcgtgcgtgtacgcgtcctcgatcgtcgtccatccgtgaaaaaaaaagaagaaaaaatatcgcgcgcgtgtgtggcttttgcctagcgtagccagccaaataaggttctactgcaagtaataaatcctagtgttgtacagcataggtagccgccactcctgctctgtgggtttcgtgtctcgatgtttttgtgctttgcagtgtactacgtacatactaatacgtgcttccaacttccatcaaaaaaaaaaaaaaaa

SEQ ID NO: 6648 - DNA, 1341 bp, Zea mays
ttgggtaccccctgcccggccggggtttccctcccgtggtttgctgaataaaactttattcatcattgcttataagatgaaactgggcaacatgaggaaaggaattaaacatgagaaggcagccccattctttgacaaattagttttcagcaaggtgaaagaaaggcttggtgggaaattaagagttattgtatctggaggtgcccctctagctgtaccagtggaagagtttttaagggttgtgacatgtgcttatgttgttcaaggctatggactgacggaaacttgtgcgggatctatagtttcgataccaaatgaacactccatgcttgggactgttggtccacctgtccaacatatagacgtacgtctcgagtcagttccagagatgggttatgatgctttgtctagcgtcccgcgtggagagatatgcataaggggaagtgttctgttctctggatactacaaaagagaggaccttgagcaggaagtcatgattgatggctggtttcacactggagatattggcgagtggcagccagatggatccttaaaagtgattgatagaaagaagaatattttcaagctttcgcagggggaatacgttgcagtggaaaatctagagaatgtgtatggtgttcttcaagatatagattcgatatgggtatacgggaacagcttcgaatcttctctcgtcgccgtcgccaacccgaaccagcaagctctcgagcgctgggcggaacagaacggcgtcaccggaagcttcgctgagctgtgcgagcatccaagggccagagaacatattctcgcagagctcaccaagatcgccaaggacaagaagctgaaaggctttgaggtcataaaggctgtccatctcgaccctctgccgtttgacatcgagcgcgacctcatcaccccgacgtacaagaagaaacggccgcagatgctcaaacactaccagggagtaatcgacgcgctctacaagggcatgaagtgagacggcacgtttgcagagtcgcaaggggtactgttgtgaattgtgatgcacatatttgtctatatgttgtttcagtatactgtggtgtgtggagtcactcggagggttgtgtattgttgtattgagataaggggaatataaataaaataaaaattagtttgggtccccaacgcgcggtggagagcgtgcgcacaggctttttgagctggacagtttgtattgaaattacataagcgatcagacaacgttaagcgctaggcactgggctgaccaagattaactcagctgagggtattaaattctcctctagtcaaaattgaatagaagacgatttaatccctatc

SEQ ID NO: 6649 - DNA, 2140 bp, Zea mays
gtcgcgcctcgccctccccgactccactccactccactccactcgcccgcgcccgccgcccgcgtgctcctccctcgcgcccgccccgccccgctccgcccctatctatatccattcccgctcgtccccctcaacaaccctcctcacggcgcactcgtgttcgtgtcatcccgcccgcaggccgcagtccatggccaccgccagcctcgcgctctcgctgcgcctcgcgccgtcctcgcgcccgctgagcctccgccgccggggggccaccggcgtcacctgccgcgccaccaccgccacgttccaccagctcgacgccgtcgcggtgagggaggaggagtccaggttccggacggcggcggcggagggccgcaacctgctgccgctcacgaggtgcatcttctccgatcacctcacgccagtgctcgcgtaccgctgcctcgtcaaggaggacgaacgcgaggcgcccagctttctattcgagtctgtcgagcaggggtccgagggcaccaatgtggggaggtacagcgtggtcggggcgcagccttctatggaggtcgtggccaaggctaaccatgtgacggtcatggaccatgagatgaagtcgaggagggagcacttcgtgcctgatcccatgaggatccccaggacaatcatggagcagtggaacccgcagattgctgacagcctccctgatgcattttgtggaggatgggttggattcttctcatatgatacagtgcgttatgttgaaacaaagaagcttcctttcagtaaggcaccacatgacgataggaaccttcctgacattcatttaggcctctatagtgacgtcattgtgtttgatcatgttgaaaagaaaacacatgttattcattgggtgaggacagactgctatcgttctgttgatgaagcatatgaagatggaagaaatcggcttgaagctttgttatcaagattacattgcctcaatgtcccaacactttcttctggttctataaaactcaatgttgaaaactttggcccagtaatgcaaaaatcaacgatgtcaagcgaagaatataaaaatatcgttgtccaagctaaagaacacatcttggccggtgacattttccaagttgttttaagccagcgttttgagagacggacattcgccgacccctttgaaatctatcgtgcattgcgcatcgtaaatcctagtccatatatggcctatctacaggcacgaggttgtattctcgtggcatcgagtcctgaaattcttacccgggtacaaaagaggacaataatcaatcgtccgcttgctggaaccataagaagaggcaaaacaaaagcagaagacaaaactttagaacaattgcttttgagtgatgaaaagcagtgtgctgaacatattatgctagtagatcttggccgaaatgatgttgggaaggtgtccaaaccaggttcagtaaaggtagagaaattgatgaatatcgaacgatattctcatgtcatgcacatcagctcaacagtaactggagagctacgcgatgatcttacgtgttgggatgcgctacgagccgcattgccagttggaaccgttagtggcgctccaaaggtgagagcaatggagttgattgatcagctagaagtgagtatgcgtgggccgtatagtggtggttttggagggatttccttccgcggcgacatggacattgcactcgctcttcgcactattgtcttccccaccgcatctaggtttgataccatgtactcgtacacagacagtaagtcccggcaggagtgggtggctcacctccaggccggagctggcatagttgctgatagcaaaccggatgacgagcaccaagagtgtataaacaaggctgcaggtgttgctcgtgccattgaccttgctgaatcgacatttcttgaagagtagtctagtctaatgaaggaaatgtatgtttaagttctctgtataattatggattgtcctagaaaacaggctttcttaggccgaataaaaactcaactgtaataaagttaataaatggacaactttagctcaaaaaaaaaaaaaaaaaaaacgagaggcggcccgtttaaggcggacaatcaagaaaagcatgaaaaaacatccaatattgtgatgttc

SEQ ID NO: 6650 - DNA, 1291 bp, Zea mays
tctgcccgccggcgttcgcctgactcgcccccactcccgagtggccgaagccccgaccggcgaccccgcagatctgtccaagcgttcgcctgactcgcccccactcccgagtggccgaagccccgaccggcgaccccgcagatctgtcccattgttctccgtcctccccgtcgtgtcctccttgatccttcttcgagtggcaagtgctgacctcgcctcctattcctccggtagccctactggggcgccgggcgcacagatctgctcacccctggacgctaggcgctgcccagctcttccctgccagccggtcgcggcggctgcaagccagcacggcagggctgctggtgcctgctcttgtcctccggcacagcgcagggtgtcggggtcgctcccagctggccatcctctcggcccccttgttgcacagcgagtcaatttggtgaatcccccctcccctctcacgctccaccactgatcatggggctactcagcattatccgcaagatcaagcgcaaggagaaggagatgcgcatcctcatggttggcctggacaactcggggaagacaaccatcgttctcaagatcaatggggaggacaccagcatcattagcccaacccttggattcaacatcaagaccatcaagtaccacaaatactctttgaacatatgggatgttggaggacagaagacaatcaggtcttactggagaaactactttgagcagactgatggattagtttgggttgttgatagttcagacataaggaggcttgatgattgccgtgctgaactccacaatctcttgaaagaagagagactagttggagcttcattgttggtttttgcaaataagcaagacatacagggagctctaaaaccagatgaaattgcgaaggttctgaatctggaagtgatggacagaagcaggcactggaagattgtgggctgcagcgcttacacgggagaggggcttctcgagggcttcgactggctggtccaggacgtcgcttctcggatctacgtcctagactgatgctatttgccgcgtcagtcgtcctagacggatgctatttgtcgcgtcagtgctacttgagcatcattagagtgtggtgcctgcattaaagcctgtactaaggccctgtttgtttaaggtttagggtttaggaatttgtgttcactcttactcactttggatttgcggtggtatttgtttgcttgtgttatattgaggtaaatttaaacgttcatgagttcatttctctttatttatatgtcagattaagttt

SEQ ID NO: 6651 - DNA, 1349 bp, Zea mays
gcacgagaccattacctagaacatcctaatcgaaaaaactgcaaaaatctccccggacagagaagcgttcgcctgactcgcccccactcccgagtggccgaagccccgaccggcgaccccgcagatctgtcccattgttctccgtcctccccgtcgtgtcctccttgatccttcttcgagtggcaagtgctgacctcgcctcctattcctccggtagccctactggagcgccgggcgcacagatctgcccacccctggacgctaggcgctgcccagctcttccctgccagccggtcgcggcggctgccagccagcacggcagggctgctgttgcctgctcttgtcctccggcacagcgcagggtgtcggggtcgctcccagctggccatcctctcggcccccttgttgcacagcgagtcagtcggatacatcttttatcagatttggtgaatccccctcccctctcacgctccaccactgatcatggggctactcagcattatccgcaagatcaagcgcaaggagaaggagatgcgcatcctcatggttggcctggacaactcagggaagacaaccatcgttctcaagatcaatggggaggacaccagcgtcattagcccaacccttggattcaacatcaagaccatcaagtaccacaaatactctttgaacatatgggatgttggaggacagaagacaatcaggtcttactggagaaactactttgagcagactgatggattagtttgggttgttgatagttcagacataaggaggcttgatgattgccgtgctgaactccacaatctcttgaaagaagagagactagttggagcttcattgttggtttttgcaaataagcaagacatacagggagctctaaaaccagatgaaattgcgaaggttctgaatctggaagtgatggacagaagcaggcactggaaaattgtgggctgcagcgcttacacgggagaggggcttctcgagggcttcgactggctggtccaggacgtcgcttctcggatctacgtcctagactgatgctatttgccgcgtcagtcatcctagactgatgctatttgtcgcgttggtgctacttgagcatcattagagtgtggtgcgtgcattaaagcctgtactaaggccctgtttgtttagggtttatggttttagggtttagggatttgtgttcactcttactcgcttcggatttgcggtggtatttgtttgcttgtgttacattgaggtaaatctaaacgttcatgagttcatttctctttatttacatgtcagattaagtttttcccccgcggtggagaaaaaaaactcgagagtcttctagaacgccc

SEQ ID NO: 6652 - DNA, 1555 bp, Zea mays
tgcatgcctgcagtacgtcaaaaggaactgaggaagaagataaactcacgctgttacctattgccgtccataaaccgcgagctactgaggcactgagcaccgtgcggtacgttgaaaggaactaagaaggaagaagataaactcacgctgttacctattgccgtccatgaaccgcgggtgacgagatttaccggctcttacctctgtcaatggcgagaaacagcgaaggctttccattccagcaacaatacaaccgtgttgtttccattttgtcaattgccgcgacatgtcttctattttggtgaagcccactctgcgggctttccataactgcaaaaatctccccggacagagaagcgttcgcctgactcgcccccactcccgagtggccgaagccccgaccggcgaccccgcagatctgtcccattgttctccgtcctccccgtcgtgtcctccttgatccttcttcgagtggcaagtgctgacctcgcctcctattcctccggtagccctactggagcgccgggcgcacagatctgcccacccctggacgctaggcgctgcccagctcttccctgccagccggtcgcggcggctgccagccagcacggcagggctgctgttgcctgctcttgtcctccggcacagcgcagggtgtcggggtcgctcccagctggccatcctctcggcccccttgttgcacagcgagtcaatttggtgaatccccctcccctctcacgctccaccactgatcatggggctactcagcattatccgcaagatcaagcgcaaggagaaggagatgcgcatcctcatggttggcctggacaactcagggaagacaaccatcgttctcaagatcaatggggaggacaccagcgtcattagcccaacccttggattcaacatcaagaccatcaagtaccacaaatactctttgaacatatgggatgttggaggacagaagacaatcaggtcttactggagaaactactttgagcagactgatggattagtttgggttgttgatagttcagacataaggaggcttgatgattgccgtgctgaactccacaatctcttgaaagaagagagactagttggagcttcattgttggtttttgcaaataagcaagacatacagggagctctaaaaccagatgaaattgcgaaggttctgaatctggaagtgatggacagaagcaggcactggaaaattgtgggctgcagcgcttacacgggagaggggcttctcgagggcttcgactggctggtccaggacgtcgcttctcggatctacgtcctagactgatgctatttgccgcgtcagtcatcctagactgatgctatttgtcgcgttggtgctacttgagcatcattagagtgtggtgcgtgcattaaagcctgtactaaggccctgtttgtttagggtttatggttttagggtttagggatttgtgttcactcttactcgcttcggatttgcggtggtatttgtttgcttgtgttacattgaggtaaatctaaacgttcatgagttcatttctctttattt

SEQ ID NO: 6653 - DNA, 1007 bp, Zea mays
atcgcatcagcgtcaccaataccacgcgagccgtccccccctccttgtccatccccggccggcacgacgaaccgcctgaggagggagcaatagctcggggctctcgctcttggctgcgtgtctgaagctgttgatgcgagtgaaggctcggtttccatggctctcatggcggcggggatggacgaccacgacgagtacgccaagctcgtcaggaggatgaacccgcccagggttgtgatcgacaacgaggcctccgacgacgccaccgtgattaaggtagacagcgtcaacagccacggcacgctgctcgccgtcgtccaggtcatcgccgacctcaacctcgtcatccggaaggcatacttctcctccgatggaaactggttcatggatgcgttcaatgtcaccgaccgtgacggcaacaaggttctggacgcctcaaccatctcctacatccagaagacgctggaggtggacgactggtactacccgggggcgcacaacacggtgggcatcgtgccgtcgggggactacacctccatcgagctcacgggcacggaccgcccgggcctgctctccgaggtgtgcgcggtgctcgcggccatgggctacgcggtccagagcgcggagctgtggacgcacaacacgcgcgtggccgccgttgtgcacgtcacggacgccgagactggcggcgccatcgaggactccgcccgcatcgccgacatcagcgcgcgcttgggcaacctgctgcgcgagcacagcgacgtgcgcgctggcggcggcgcgggcagcctggcactccacaaggagcggcggctgcaccagatgatgttcgacgatcggggagtggaaggccacgccgcgaccgcgccgcccgacggctcgctgcggacggaggtgtccgtgacgcatgccgagcgcgggtacaccgccgttgtggtccggtgccgggaccggcccaagctgctgttcgacaccgtgtgcaccatcacggacatgaagtacgtggt

SEQ ID NO: 6654 - DNA, 3388 bp, Zea mays
  misc_feature (7)..(7): n is a, c, g, or t
  misc_feature (9)..(9): n is a, c, g, or t
  misc_feature (12)..(12): n is a, c, g, or t
  misc_feature (29)..(29): n is a, c, g, or t
  misc_feature (45)..(45): n is a, c, g, or t
  misc_feature (49)..(50): n is a, c, g, or t
  misc_feature (63)..(63): n is a, c, g, or t
  misc_feature (71)..(71): n is a, c, g, or t
cccgggntncgnaccccacgcccgtccgnaaaagggtggaatatngccnncgagtccgcgccncccccccnccaatgggcttataagaaagacccaaggatccagaggaggaaagaggaggagaaagctgagaaacagagaagaagggaggcgaagtatttggcaaagaaattacaagaagaggaagcagcaaaagctgttgaagaggaaaggctaaggaaagaagaagagtctaagaaagctgcagaagctgctctacatcagaagaagctaaaggagaaagagaagaagctgctccgcaaagagaaaactcggttgcgcactcttgcagcacctgtcattgcagatagccactttggtctatcagaggcaaatgttgaatcggcatgtgcttcacttgatatggaacagctgaagaagctctgtgatggaatggatggtaaggatgcagcgggaaaggcctggttgctgagcaatgtacttcccaatgaaagttcctcaaaggaagcaaagaaaattgaagggaatggtgtggagccttctgccccaaaatccaactctacaggaggtagagcgacagaaggcagtagcagcatattgaacagctatgagaaaaaagagagaccatggggaaaggaagagattgagatgcttaggaaagcaatccaaaagtatcctaagggaacttcgaggagatgggaggttgtttctgaatttattgggactagcagatcggttgaggaaattctcaaggccaccaagactgttcttctgcagaagccagactcatcgaaagctttcgactctttccttgagaagcggaaaccgacacaatctattgcttcgcctctttcgacccgagatgaaattagttcaactgagggagctgggactgcatcgtcaaagtctgcagcacaatctgcgagtagccagacagccaatgagaaagctgctgctgatcctgtcacggatggaggaccatccgtatcagatccagatgcctggacggatgcacaggtcctggctctagtccaagctttgaaggcttttcccaaggatgcaagccaaagatgggagcgtgtggctgctgctgtcccaggtaaaaccgtagtccagtgcaagaaaaaagttgcggcaatgagagagaatttccggagcaagaaaagtggggagtaggcaagtgcaagaaaagcattgcctcgctggaagtacatttttcaagaaagagtctctggatggcaatgtttatagaatgtgttctgcatcttagctggcgaggtattgcttggcgaacctcatgccatatcaaatggagggagtatcttgcattagtgcactggttccgtagcaaactagagagccatatctgtttttattcatttatatttatatataactataagaatagataggaatatacattgtgagacctgttatcgaagtgagcattgtttttccgggccacactttgtagtggctagctacgtctgttcttgtagcatcttaaatgctacttaacacaattgctaatggccaggtcctgttccttattcctaaatcgctgtaatagtgacctgttttagattccagcgtatgcatatatggatgcatttgacattctaaaaaaaaaaaaaaaacgccccaaacgtactggcattgaccatccatagactccttgtcattccaatttagcacgtccagcagcatttaacagtatcgcgcatccgtcttttggctcgcctccacttctgtattttgcaaggtgttttggtcttgtctctttcagcagcctccctgacctatccttctttgttttggcacatatccacttctgcattttgcatggtgttggtcttgtcactttcagcaacctccctgtcctatcatgcatccctagtttacactgttaactctttcagcaggctcctaatctcactcatctacatttttctttacgcggaggagagagaaccggataggtgggcatctccatttttctttatgcagaggagaaccagatatatggggtgtggagatgtttggccccattttgcatgactggatagggagtatgctggagcgatgcacaatgagtcaatgactcagaccgtgtaaaatgggaatacagagtgggatgaggagtccgcttcggctgatctctagtcatatttcaagcttttataaaaaacggtcttagttcaagttatacacttcattttaaactgtaagatgttgtctttttagatatatattattttgctatatatttaaacatatatttgtgttgtgaaaaatttaaaaggccaaagtatcttatgatcttggaacaaagagagtattacaatcaaacaacaaatctcgcatatcctagattttgttgcctcatgcaaatcgtaattatggctttctcctcaatttggttttgaatttaacaaaatatccaaaaaaacacatgaatatttatgttaacattttgacctgaatattattgtatggaaacatttttttatcaagatactatcgaattcatcgtgcatattcaaacatgctgggataaggctcgtttgtttgtctccccaggctggagaaacgacgccgaattgccgccaccacccgcctagaacaatccaggcagagtttcctccgaagacccaatagagcaacgatgatcgccaacaccatgaagaatgttgcagggacaaccaccgccgatgccaccccaccaagcctccgcgcgttgccacctttcgatgatcgacacaccaacccagtaggtccccaacaccagagctcctacaccagccggccagctagtgcgaaaccccaagatggccgaggcgaggaggcctacatggagggtggaggatatccatggacgacacccttaatagggtaggagttgcgccctcaggcgtcaccgcagtccgcccacaagcaggcatggatttcgtcggaggacccaccaccaatcatccccacgctcggatccaattggtcaggggcagcgcggacactgtttgagcatccaacgttgggacccccaaggtcagagttacatccgacaaggcaaaaccagtggcgtgaggccaaggggcgcgaaaggccccaccatcacccaccggctgaacgggaggtggtgagatggaaatagccaggaggctcaagatccggcctctagctggccagagagccccaacggaagccacaacgttgggaatcgccgaggtcgccgtccttgggaggctcatccttcacttccgaggcaaccccacccttccatcccattgctagtcaaagacaaaacctatgcatataccttttccttcactttgtctttcacttcattacttctcatattttcttctatctcttctccttgttaagcttt

SEQ ID NO: 6655 - DNA, 1050 bp, Zea mays
cgcggcccgtgggcggccgcgtgcgctcgctcacagcaaccggcggcgacatcactctcactactgcagctcagctcagcaagagaattgttcgatcgatcgtcgtcgacgatggccgccgcctcctcctcgcagcaaccaccacgcctgctagtactcgtggcggtctcgtgtctcctcctgcagagcgccatcaccagcagctcggcggagtcgtcgatgcagtgccacgaggaggaccaggaggcgctgctggccgtgaactccgcgctgggcagcccctatcacttcgcgtcgtggacgcccgacaccttctgctgcgactggtacgacgtggactgcgacaacgtcacgggccgcgtcgtcggcctcaccgtcttcggcgacggcaacctgacgggcgccatcccggacgccatcgccaatctgaccaacctccgcacgctggtcctgcgccacctcccgggcatctccggcggcatcccggtctcgctcgcgcagctcgccaacctcacccagctcaccatctcctccaccggcgtctccggcccggtgccgtcgttcctgtcgcagctaacggagctcaccctcctagacctctccttcaactccctcgacggccccatcccggagacgctcgccgacctccccgccctctccagcatcgacctcagccgcaaccgcctctcgggccccgtcccgccgctgctcctcagcaagtacgtcgacgaccaggcggcgtacctcgtgctgtcgcacaacaacctctccggcagcatccccgccgggttcgcctccgtcagcttcgcgtacctggacctgtcgcgcaacgccttcgccggcgacgcgtcgggcgtgttcggcaaggggaagccgctgcagcacctggacctctcccgcaacggcttcgccttcagcctcacggccgtggacctgccggagcagctggcgtacctggacctgagccacaacgccatccgcggccgcatcccggcgcaggtggccgacctagccgggctgaagttgattaacgtcagctacaacaagatg

SEQ ID NO: 6656 - DNA, 3738 bp, Zea mays
ctgcagttccattgattccatttctcaggttgcactcgaactatcatttatggaagcagttcaagggtgcagcaaaacggtcaccttccaaacgtctgtaacatgtgaaatctgtggtatgtagatgcagtttttctcatgactccttttttaggtatttagtccttctaatttttcccctggtgatgatttctttttcaggtggagccggtgtgcctcctggaaccacacctgaaacatgtctatcttgcaggggttcaggatttgttagttcttcctccggcacattgcttttgtctatccagtttaactagtgatcttattaatgttagtttttaactattgttgacagatattcatgcaaaccgggcccttcaggatgcaatcaacctgcacaaaatgtggtggttctgggaaaactgtgaaggtaggatttttccttagtgatactagaagataccacacacgttgctgccagtattgcaaagaatttggaatggaattaagtggagacgatgtggatagtttgcaattaagaggttggaaattagtgggatgacatgactattagtaggagatagtatggatagttagtgagggatggtgtggataccttgcatgttgacttagggtgcgtttggttgcgggacagccaggacagagacgtcctctggcgtattttcttgtccctcaaaatttgagggataactggggacaacactgggatagtcatgtcccaacctttgaccctgaaccaaataaccttattcgagggatcgtcccatcccgtcctgtcctgtcattgcaaccaaacacacccttaaagtaccagctttataagagatatagatatgtcagcaggtgcaaaaaaatagtgtaggacagttgtactctcaggcctcgtattctatgaatctccttagcactaatacacctctggcacgaatatttgactgaggctgatgatcctgtggccttaattcctttgaacctcaccatatgttatcctactagtcataaatgatttgtttcctaactgcatataaaaccagttctattctatcttgttagctacttaaaagaggagagataattgagttaccttgtccttacgaattctgattaattagcaccacaccgttgttatgcttctctgttactcttttaggaattctgcaaggcatgcagaggaaacaaagttgtgcctggaaggaaatcagtccgccttgacatactgcctggtgggtttcaagttgccttggttcattggaatgttacggtgctgttaggatgctcgtgttctgtgttgcaaggtgtaattgaatgttatccttttgttgcaggttcggataatgaggacaccataaaggtggttcgatcaggtggagaagacccagatggccgtccaggtgatctttatgtgaccctcgaggtcagtcctcttggactcttacagtttagtagcacagttgatgacaaaggaatggatataattaaccttcacaatgctatttttttctccaggttcgtgaggatcctgttttccgaagagagaaaggtgatattcatgttgatgctgtcctgaatgtgactcaggtaatttggtgcatcttccaacattctgttcatttggacccttttagtatagttaaatgaagtgccccattggtgccaaccaccttcctacagcgctatacatcaacttacaaaagaaagaaaaggtgtcactgctaccaccaagagaattagaatcttgtgtgaatcttttaaatgaaatagcctatctactagtaactcggacagtcaggtataggctaggctataacttcgtgcctgcatctctactcccctagtcccctcgaagttgtccaccagactctcttgcaccactatttccttagcaatttttagtagcatgcttattctgattgcgcatatactttgtaggcaattttgggagggacagttcaagtcccaactctcagtggagacgttgttctaaaggtatatatgtcagatagctcatttccatcatgcttctctttatatatctgataattgaccttctcacaggtcaagcccggtactcaacctggtcagaaggtagttctgagaggaaaaggtaatctactgtgcacgcttttgttcttttttggcggtgcattatctctttaattacggattgtaacacggctatgatgcgtctgtgaaatgattagtccaaaaggtttctggaacatagccatgtcagagattgttttcttgtgtggaagtaacaaaattatgaatcgatcgaacaatcaaattctactgcatgtgtcaagactggaaaatttatctggcgtctaggtgaactgccaatttgaactgaagaagctggtggaaacttgcatgctttatctaaaccctgatgcatctatcctgcagggatcaagacaagaaactcaccgtaccacggagatcaatatgtccatttcaatgtcaacatccccgagtaagcaagcctagccgcctctcaaaatggagtagtcttatgctatctatcgtgcatccaactgctgcaagtgagactcacatatgatgtcctgcagaaatttgacgtctagacagcgggagctgatcgaggaattcgcgaaggaggagcaaggcgaagacgagaaggacgccaaggcagcagctggagcatcggggggatagccggttttaggagccacagtagtgccttttagctggtatttataccgtgaccgtagacctgtctcaaattcgcagcggaaagatttatagataggtctttgtttcggattttgtagctggaataaatgaataatacgtctagaactgattttctgtctttttcgtgagtcttctaagcatgatcccatccgcgcacggtgcacctctccctcctcttctcgcttcctgcgggccaacccgacaggtcatcgatagcagcacaatcatacaaagtggaatcttaaatcatggttatggttatggttgttatctctaaacatatatttacaatgttataaccagactagttaaatagttcgccaagtcaaattttagttactcaacaacaaaataactctacaacaaaatagctatctgacttatcaagctatctgactctcgaaattagttctctcattggccaaatttggctggccatctggctagcaaaactagatagataatttgttgaaatgagatgctacatatagaatgtaatctttatgaaaacgtaaataaagagtcaaataaagatataaaaataaagagttttttggagatgctctaacataatacacatgttttttgttttatattatatacttaaacaaaatatttttatttttatttaatttttatggaaaataggtaaaaaataaaaacaaattgtgtcacataataggccttatttttattttattttttttatgaaaaataggtaaaaaataaaaacaaattgtgtcgcacaatagacctagcacggtatagtgattggtttgagccaacacgagcatggtggacaataggctagattgtacaagctcgatggacaataggctagatcgtgctcgggctaggctaaactgtggatctgacccattggatatatatactaatatactaaagatgcacttgcataggtagacagcggcataagcaagacgatggccaattgaaagggaaatgtgctcttgagccatttctataaatgttttggtgatt

SEQ ID NO: 6657 - DNA, 561 bp, Zea mays
  misc_feature (528)..(528): n is a, c, g, or t
ccgcgatgcgacgcgggcttcagacggacgcgtgggcggacgcgtgggcggacgcagcgggcggcgccggcgaggccacacgcccaccatcagtcagccgccccgccacagccatgcgcctccccgccggcgcacgcctcgcgctcctgctcgcccgccgctccctctcctcctccccccgcatcccgcgggcgcacacagggatatggagcgaggcgccctcccggagctctcccttctctccgccgagcagcgcccgcaggtccttccacgggaccaggccggtggcggcaagggactactacgatgtgctcggcgtcagcaagagcgccagccaggcggagataaaaaaggcctattatgggcttgcaaagaagctccatccagacacaaataaaggtgatgcggatgcagaacgcaagtttcaagaggttcaacgagcttatgagactttaaaggatgaacaaaaaagatcattatatgatcaggttggccctgatcagtatgagaaaactgcttctggcggangcggaactggcttcgagggtggttttggaaatc

SEQ ID NO: 6658 - DNA, 1726 bp, Zea mays
ccggccgggaattttttttctatttcgtccgatccatatgttacaggattaagcgttgggggccgcggggccccagcccagctgacaacaccggcctccgagaagcagcgcaggcgcagggcattccagaacgttcggcggcggcgaggcgacacgcccaccaccagtcagccgccccgccacagccatgcgcctccacgccggcgcacgcctcgcgctcctgctcgcccgccgctccctctcctcctccccccgtatcccgcgggtgcacacagggatacggagcgaggcgccctcccggagctctcccttctatccgccgagcagcgcccgcaggtccttccacgggaccaggccggtggcggcaagggactactacgatgtgctcggcgtcagcaagagcgccagccaggcggagatcaaaaaggcctattatgggcttgcaaagaagctccatccagacacaaataaaggtgatgcggatgcagaacgcaagtttcaagaggttcaacgagcttatgagactctaaaggatgaacaaaaaagatcattatatgatcaggttggccctgatcagtatgagaaaactgcttctggcggaggcggaactggcttcgagggtggttttggaaatccatttgaggatatttttggtggtggcggtggcggtggtggaatgaatgatttctttaggaacatttttggggatagggactttagaggacgagatgttaaggttgcactcgaactatcatttatggaagcagttcaagggtgcagcaaaacggtcaccttccaaacgtctgtaacatgtgaaatctgtggtggagccggtgtgcctcctggaaccacacctgaaacatgtctatcttgcaggggttcaggatttatattcatgcaaaccgggcccttcaggatgcaatcaacctgcacaaaatgtggtggttctgggaaaactgtgaaggaattctgcaaggcatgcagaggaaacaaagttgtgcctggaaggaaatcagtccgccttgacatactgcctggtttggataatgaggataccataaaggtggttcgatcaggtggagaagacccagatggccgtccaggtgatctttatgtgaccctcgaggttcgtgaggatcctgttttccgaagagagaaaggtgatattcatgttgatgctgtcctgaatgtgactcaggcaattttgggagggacagttcaagtcccaactctcagtggagacgttgttctaaaggtcaagcccggtactcaacctggtcagaaggtagttctgagaggaaaagggatcaagacaagaaactcaccgcactacggagatcaatatgtccatttcaatgtcaacatccccgaaaatttgacgtctagacagcgggagctgatcgaggaattcgcgaaggaggagcaaggcgaagacgagaaggacgccaaggcagcagctggagcatcggggggatagccggttttaggagccacagtagtgccttttagctggtatttataccgtgaccatagacctgtctcaaattcgcagcgaaaaaaatatatagataggtctttgtttcggattttgtagctggaataaatggataatacgtctagaactgattttctgtcttcaaaaaaaaaaaaaaaaaaaaaaaaaaaaaaaaaaaaaaaaaaaaaaaaaaaaaaaaaaactcgagactagttctctctctcctcgtgc

SEQ ID NO: 6659 - DNA, 1638 bp, Zea mays
  misc_feature (16)..(16): n is a, c, g, or t
  misc_feature (28)..(28): n is a, c, g, or t
  misc_feature (40)..(40): n is a, c, g, or t
  misc_feature (52)..(52): n is a, c, g, or t
cggccgcgtgggcggncgcgtgggcggncgcgtgggcggncgcgtgggcggncgcgtgggcgcagggcattccagaacgttcggcggcggcgaggcgacacgcccaccaccagtcagccgccccgccacagccatgcgcctccacgccggcgcacgcctcgcgctcctgctcgcccgccgctccctctcctcctccccccgtatcccgcgggtgcacacagggatacggagcgaggcgccctcccggagctctcccttctatccgccgagcagcgcccgcaggtccttccacgggaccaggccggtggcggcaagggactactacgatgtgctcggcgtcagcaagagcgccagccaggcggagatcaaaaaggcctattatgggcttgcaaagaagctccatccagacacaaataaaggtgatgcggatgcagaacgcaagtttcaagaggttcaacgagcttatgagactctaaaggatgaacaaaaaagatcattatatgatcaggttggccctgagcagtatgagaaaactgcttctggcggaggcggaactggcttcgagggtggttttgtaaatccatttgaggatattcttggtggtggcggtggccgccggggcgggcgcgtgggctttaggaacattctcggggatagggactttggaggacgagatgttaaggcttgcactcgaactatcatctgtggaagcagctcaaggctgcagcaaaacggtcaccttccaaacgtctgtaacatgtgaaatctgtggtggagccggtgtgcctcctggaaccacacctgaaacatgtctatcttgcaggggttcaggatttatattcatgcaaaccgggccattcaggatgcaatcaacctgcacaaaatgtggtggttctgggaaaactgcgaaggaattctgcaaggcatgcagaggaaacaaagttgtgcctggaaggaaatcagtccgccttgacatactgcctggttcggataatgaggacaccataaaggtggttcgatcaggtggagaagacccagatggccgtccaggtgatctttatgtgaccctcgaggttcgtgaggatcctgttttccgaagagagaaaggtgatattcatgttgatgctgtcctgaatgtgactcaggcaattttgggagggacagttcaagtcccaactctcagtggagacgttgttctaaagatcaagcccggtactcaacctggtcagaaggtagttctgagaggaaaagggatcaagacaagaaactcaccgtaccacggagatcaatatgtccatttcaatgtcaacatccccgaaaatttgacgtctagacagcgggagctgatcgaggaattcgcgaaggaggagcaaggcgaagacgagaaggacgccaaggcagcagctggagcatcggggggatagccggttttaggagccacagtagtgccttttagctggtatttataccgtgaccgtagacctgtctcaaattcgcagcggaaagatttatagataggtctttgtttcggattttgtagctggaataaatgaataatacgtctagaactgattttctgtcttaaaaaaaaaaaaaaaaaaagggggggggcgacagcaacgaaaaaaaaaaagaaaa

SEQ ID NO: 6660 - DNA, 1840 bp, Zea mays
ccggccagaaacgtaagcagacttggccatagtccactgtccaccgcagctccgtcgaccgtcgtacagacgctgccggcgacgcgcgaagaagaggccgcgaagatggccgactcgccaacgatcgatgccgtctttcacaacgcggtcatcgtcaccatggatgatgcgttccgcgtcctccaggacggcgcggtcgccgtcgccggcgaccgcatcgccgctgtgggcccctccgctgatgtcctcgccgccttcccctgcgccgtgcagaccctcgacctgggtggccgcattgtccttccagggctcgtaaacacacacgtgcacacatcgcagcagctggcgcgagggatcgccgacgacgttgatctgatgacgtggctgcacgggaggatctggccctatgagtcacacatgacggaggaagactcctatgcctccaccctcctctgcggcattgaactcatccggtctggggtgacatgctttgcagaagcaggtgggcagtttgtttcagaaatggcacgtgcagtggagttattaggctttagagcgtgtttgacaaagtcaacaatggattgtggtgacggtttgcctccaaattggagttgctgctccactgatgattgcattcagtcacagaaggaactatatgaaaagcatcataatacagctgatgggcgtatcaggatatggtttgggttgagacagataatgaatgcaactgatcgtttactgcttgaaacaagagatattgcccagaagctaaatactggaatccatatgcatattgcagaaataccatatgaaaatcaacttatacttcggaccaaaggaattgatcatggcacagtgacatatttagacaaaattgatttcctgaggagtaatttactggctgcccattctgtttggttgaatgtacctgagataggctttttttcaaaggctggtgttaaggtttctcactgtcctgcatctgccatgcgtatgttggggtttgctcctattagagaaatgctggattctggtgtttgtgtctcccttggtacagatggagcaccgagcaataatagaatgagcattgtggatgagatgtacttagcgtccctaattaacaaaggtcgtgaggcatatatcagtggaacaacaaacccaactgctcttcccgctgagacggtgctgaagatggctactattaatggtgcaaaagcagttctgtgggacaatgaaataggttcgctggaggttggcaaaaaggcggacttggtggtggtgaatccatttacatggtccatggtccccttacatgacagcattgccaacattgtctactgcatgcggacagagaatattgagtctgttatgtgcaatggtcggtggatcatgaaggatcataaaatcatgaatctcaatgaggaggaggtaatttcttcagctgtgaaaagagcgaacgacctccttgcacgagctggcatcaatctccccagacggatgaactacgtatagtttttctcttgctattttgtcatgtattgccaattgccaccatgccgcgctaatcctagagctgcaagcttgcatgttggcccggagacatgtttgcaggatcgtagtcatcgcttgcagtttctaccagtgttgaatagaaaataatgtgcagttgtacatgtggcttcagtaataaaagcaccatggaagtatcaaattgtaccaacagtaaaaaaggattataataatggatggtttttaatgtgatgttgaaaaaataccaaaaaaaaaaaaaaaaaaaaaaaaaaaaaaaaaaaaaaaaaaaaaaaaaaaaaaaaaaaaaaaa

SEQ ID NO: 6661 - DNA, 2222 bp, Zea mays
  misc_feature (2116)..(2116): n is a, c, g, or t
tcaggctcttttatgtgtctctgcttcctttcctgtcaaagtattggggagttcatttccgtgtgtacccaacgtacattaaagatggtgcagcctgcttcttaaatatgggatcaatatctggtattgctacttttttagtccttcaaaaatctttgtctttgtaaggtaaatttagaccatgacatttcttaaaagtgaacaaatcactaatgttttcttaccattcatattcagtttctgaagtttccaccattctgatagtggttaataactagacccacctgcttgtttgagttgaactttataagtgtggtgagaattcatagttgtagttacaacaatggattcaaaatagcaatgttcgttaagatgtttctttactaccaagttgtccttcacaattctgattcatttgaatttccgcattagcttataattgtttttttataagaaggaatcgtacaaggatgccgaacaagcatctcacttattgttataaacttctaaactgtgcaggttgtgaaggggcgccgctactaccactactatttgtgttggttaacatgggattcaatatatcattactacacctgctaaagatctcctcggcagtcatatcttccttggcttctacattctcaggtttccatactgtcttgagtgcaccatccaatttacttacatcagcggatagcacatcaagttttgtgctttggtttcatttaacttcacaatgttgggtgcttcctgttagtgctgccagcagtcagttgaattatatcatttattaggaacacaatgaaaagctcttcagccttggacagttcaaaagctggcttagagcagaaaaccaacattccttttataattgtatgcatgtaagatgtagcatggtatatgaactgatcaggaatggtggttttctcgtgcagttccgctgtccatctacgctttcaccctaccactgccgtatatcggtgtggcatcatctctgccacctggctttgttacgggtgcagcagtactcaccgctagcttactactgtacagcctaccacaggcacgacattttggaaatactttttcacaacaaaaatgactagttagcatccatttcttcattgatttatcacccttcattccaagatggtgctgggttcgaaaggtagaacagaagttctcctcagggccacctgactgatgtactccgatgttgtatggtacatatcatatatatgtatacccaccaataaaggcgaggaaatagcatactgatatataggggaataaagatcgagaggaggactaagtatctggccgtcagacatttgatgttactgagtgtgaaggtcggagaagagtatgcacagcgggggcagtagcatcatcaccgcagggacgaagcggaaagatcagcggcggtggcagcaccaatgacagccacaggaggatcactgtcgctgccagcaacatcatcagtactcctttgctcatcgtcgacgccaccgccctgccctcctctggctccccggctcctgtctttttttctaggttttcatgtttgttgtgaggaagttgttgtaccatgtgtgagagaaagaaaacgttgtaccctacggagctgggaagctatatatgggccagatggggtgttttggcatgtgtgtccatgtgactgggcatgtttgaattttttatccttttaagcatgtgtgcttccatttccagtagaaagctgtacttttggcggacccggaccgttgtaccatgtgtgagagaaagaaaacgttgtaccctacggagctgggaagctatatatgggccagatggggtgttttggcatgtgtgtccatgtgactgggcatgtttgaattttttatccttttaagcatgtgtgcttccatttccagtagaaagctgtacttttggcggacccggaccgtatttctatctattatatgaatttctatatattattattaaaaaaaaaaaaaaaaaaaaaaaaaaaaaacagagcgccacgtcgtcttctaaatatcagtcgttcgatgccacatcaacgctgcacatgaaacgtctatcggtttgtatacggcatcgacgttttgctggnagcctccggagaccgccatctcgctcgctctgtcccagctagggctgacaatgggctataatttttgcactataagatttaaggatcgaagcgggttaggatcggg

SEQ ID NO: 6662 - DNA, 1517 bp, Zea mays
aagatatgaaggtgtcacacaagtgttggaaaggaagaagctaatacagaaagtaaccctgaacttcttccagatgctgttacctacacaacattactcaagggtttaggaaatagccgtgacctttattcagtcgtgaagattgttgtggagatgaaatcttcactaatttcaatcgacaggactgcatacactgctatggtagatgctttgctagcttgtgggtccatcgatggggccctttgcatttttggtgatataataaagcatgctggcaagaacaatgatttgagacctaaacctcatctttatctttcaatcatgagagcttttgctacgagaggtgatgttgatatggtcatgagatttaacaagcgcatgtggctggattcagttggatcaattagccgtgccgccaaagaagagacacatgagctattaatggaagctgccataaataataatcagatagatttggctagagggcttctaagaagaatagtaaatgagaaagaatgtttctcttggacaagtagagtaggcctggtcgcagttaaagttgaaagcttatctggattcaccaactctcttctaaggccccacgtatttccacagattatcttgaatgatccagttgagaagtatatggttccatttcaagaatctcgaccattacccgccgacttaatattgcggaaggttgtgatgcgtttgttgaaagagcgtgcagttcctcttgtggatgattggggaggatgcattggcatagttcaccgcgatgattgtaccaagctggacgcacctcttatttcaatgtctagagggccacctctgtgcgtacctacttcaaccaccgtggagcacgtcattgacctcctcctgagaaacaagtccgagatggtgatcgtggtgaagagtggtaacatgtacgaaggcagctacacatccagctcaagacccttgggcgttttctccctcgccatactatggagcttcaccggcgactactcgtcaggatcagatgatgtccccgacgcaggcatctcccgggcagcaaaacccaaaccagacgccgaggcctgcaaccacagctagtttggtgtttcttttgctcagcttatagcaactccgcgtcgtgttgccgggcaaactagtcatgtaatggtcctccagttggacaaggggtgcatgcgaaaaaaggttttgatcctgaaaaaaaaaaaaaacgtgctgcgtacgatgtcttctgatgcacagagcgaaagtgacagtggactggagatttcctcccagccttcggttgacgcgccccaccgcgcagtgatggtcctgagtcctgaccggtttggtggcatgtggcatccctgctctcactcacggtgccgttttccgatcagtaattggtaatccccttggtaactaatttgggtctatgctaagatgttcaccgatcagtatcagtagttctgtgcgcagtgtattgctgctgcctgatgctgggactgggatacagaatc

SEQ ID NO: 6663 - DNA, 511 bp, Zea mays
aaccctaaacccccaccaaaacccctcctcgcctccctcccctccatccaatcctcgaaacgagcgcgcgggcgaggaggtccccctctccgagatggctagggtttttcgcgggtccctcctcctgatgtccccggcggcggcggcggcggcggcaggggccaagaaggcggcctccacgaagccgagggcgccggccgggatcacgaagccgatgccggtcctccgaggcggttccgcaggttcgccggcggcggcgcgcgaggtcgcaacgctccgaggccatcaaaggctcgtctgggcccacatcaaggcccacggcctccagaacccgtccaacaaaaccgagatcaactgtgacgcgacgctcaagagcttgtttggtgggagggacaagatcgggatgatggaggtctcgaagctactgagccctcacttcctgaagaactagcaagcggtgcatggagccggcggcagcgcttcgcggttgatttgggaatgtttagtctgc

SEQ ID NO: 6664 - DNA, 902 bp, Zea mays
gcacgaggctccagtctggggctctgggcccaaatacaaaacggttggtgccaaagccgcccgccgccgtaaccctaaccccacacccactcataaaccctccgcctcctcgcctccctcccttccatccaatcctcggaacgagcgcgcgggcgaggaggacccccgacggaggatggcggcggcggctagggttttccgcgggtccctcttcctgatgtccccggcggcgggcgccaaggcgtcggcagccaagaaggcgggcgcggcggcggcggcggcggcggtggccaagaagaccgaggcggccactacgaagccgagactgccgaccgggatcacgaagccgatgccggtctccgatgagttccgcaggttcgccggcggcgcgcccgaggtcgcacgctccgaggccatcaagctcatctgggcccacatcaaggcccacggcctccagaacccagccaagaaaacggagatcaactgcgacgccacgctcaaaagcttgtttggcgggagggacaaggttgggatgctggagatcaacaggctactgaacgctcacttcccgaagaactagcaagcagcagtccgtggggccagtgatcgcgctttggtaaaggactttcttgtggctggcctcttgtggtccatgtgaagtcccaagtcccactaggtggttacgcccgaaaaccgtgtgatgccattaagacttacagactttgttcagcagttgggtttttgggcgtgatgcatgtaaaaaggatccccagtgtttctgtttctcttgtgatcctgtgaggacaccgatgtgggaaatctttaagtctgctaatggcaaatcttattagtctttaaaaaaaaaaaaaaaaaaaaaaacccgcgggggggcccggtaccca

SEQ ID NO: 6665 - DNA, 3914 bp, Zea mays
tccactctcatccccactcagggcccaaatacgaaagggacttttaaatccgtggctctaatccgtaaccctaaacccccaccaaaacccctcctcgcctccctcccctccatccaatcctcgaaacgagcgcgcgggcgaggaggtccccctctccgagatggctagggtttttcgcgggtccctcctcctgatgtccccggcggcggcggcggcggcggcggcggcggcaggggccaagaaggcggcctccacgaagccgagggcgccggccgggatcacgaagccgatgccggtctccgaagcgttccgcaggttcgccggcggcgcgcgcgaggtcgcacgctccgaggccatcaagctcgtctggacccacatcaaggcccacggcctccagaacccgtccaacaaaaccgagatcaactgtgacgcgacgctcaagagcttgtttggtgggagggacaagatcgggatgatggaggtctcgaagctactgagccctcacttcctgaagaactagcaagcggtgcatggagccggcggcagcgcttcgcggttgatttgggaaatgtttagtctgctaatggcaaatctcagtccacgttcatcccagtctttgattcgtggtcttagcgtcatgttcgtatgcgtggggttgcgttctttccgatttcctcttgtcggtctgcagcagtgttatctgatacgcgtgaaagtaactattttttaagtttttaattacatgataaccatttgtattacgatactataaatgttgtatactttttttaaaaaaaactctaaaaactgatttagaaaaatcagatagatcagttgcagtgtatatggtgagctgaatagaggaatgaccgaagagaaggtgaaatgggagtacaattttttgagggaggtatttaaatttgaatataaagtacaaatagaaggatttaggaaagggaacgttggattcagccttatagtaggttggattgggccgtttttgtgcctttgtggcgagtagagatgtcaatgaggaatttcccatcggggattaactcccagacccgtacccatgagcacagacccgccccatccccgaacccgaacccgacctccggtacgaaaatcttcccatacccatccccgaccgggtaccaaatacccatggggacccgtacccgacccgactattcaccatttcagaatttcagcatatggacataacacaattctgcatttcagcatgcatattttgtagtttcatcaacatactcatgcaaaataaatagtgtcttctagtagccacatgtccacatataacaaatatggtcaaacagtaaatagaaatatctcttagtacatgttttatcatttaagcctggatgctatagtaaatcgggtaaaacagccccatgggtaatcgggttcgggtttagccctcccaaacccgtaccctccatacccgatggggaaaagatttctcccaaatctatacccacatctatacccatggggatcaattttaacccatattctaaccctaatagaagaattccccacggttaatcgggtttcggggcccattaacatctctagtggcgaggaacatgaactccatttcggcaggtcctccgtagtaggtcagaactcagaagcattggtgatatctgtgggtcgttcagtaccaactcttcaagtggatctatacctgaaaggttatgaaaaagaatcgcatttttcttggcatctggacacccaagttccaagtgtgtagtggaggtgttctgactcatgaggtcataatgttattcttgcagtatcactatttgacagatattatgtttgcgtatcgatgaagcgtgtctgtagcaattcctctgttacttgtacctgccacagacagaaaaaaataaactagagcatggcctgtttttagcatctttgcttctttgttattttgcagagtactctgtaccttgcctctttgcttcttcgttaatcgttagtttgcagagtactctgtaccttgctatcctgacctactgtacatcagtacatgtccgtgtcaaaaaaactgtttttgcgccctgaactcataagcaaagctcttcatggtccgtctgcagaacccgtccaacaaaaccgagatcaactgtgacgcgacgctcaagagcttgtttggtgggagggacaagatcgggatgatggaggtctcgaagctactgagccctcacttcctgaagaactagcaagcggtgcatggagccggcggcagcgcttcgcggttgatttgggaaatgtttagtctgctaatggcaaatctcagtccacgttcatcccagtctttgattcgtggtcttagcgtcatgttcgtatgcgtggggttgcgttctttccgatttgtatagtcggtctgcagcatgttatatgatatgcttgaagtttgcactcctcccttgtcatcgctggatgcctggataaacaaaaccagctgttgactgactttgtaagttgtacctctgttgcttacgaaatattacttcccttctcgaatatttgtcgtctgctatttcatttttcgaactaaaccgcgacaaaagaaaaaaaagaacggacggagtatttattattagccaactgttgttttcttttgagggcttttggttcagagaggagttgaaatctaacaaatgggagaacataggtagtgtttatttgggattataattcatttatattatgtaatctaacttattttgaactaacacttagaacttgtttgtttgagattatgatctgactagattatataatctaacaaatttagattataaccttaaacaaacattttcgtttaaaataaattagattatataatttatgcaaattacaatatcaatcaaacaggcccatgtactaccagcaatgcccgcgtatcttaattctggtgtacaaatagctgacgtagattcgattattgtggaccctgtatcgagtccgtacgtggtaaaccggtggtgctcggctgtcgccacagccactgccgagccacttgtggcgggtggctgcgtggctggtggttcggcctcgaagcttctttctcacctcacaggtcagtgtccgccgatggggtcactgctgatgcgtgatgcctccctcccgcgtcagcgctcctgtcctcacacgccccggtgcactgcacctggacgccttcccggccctctcccccaccgataaataacccgcccctcttcgcagcgagatgcaacaaggccacatcagcagagagcccagcaactgaaaaaaccaaccatcgcgcgggcacggttgcggttgctacctcccgatcccgtcctcccgcaagccaagctctctctctccccctccccttcagcacgatcggagtccaagtccatcccatccagacccactcgacagtcgacccgatggcgccgtccatctccgtcggcgccgcggcgccgtcccgtgcagcgggcgcgagcacgaagaagagcgcggacgaggtggagctcctgcggcggcggaacgcggagctggagcgggaggtggcggcgctgcggctggagctgggcgcggcgcggcgccgcgccgagacggcggaagaggccgaggagcggctgtgcgtgcagctcggcgacgccgaggtggaggcgctcgagctcgcgcgcgcctaccaggcccacgtccacgagctcgccagggagctcgccgccgcgcgcgcggccccggcacgcccggccagataggttctcgtgggctggtagtaggctactagtagctatagcgtgcggttcagcgggatggctgtggttcccgcgtttggttggcgtcggacggcaccccgcgccgcggtgccatttatttgctcgccgccggcatcgtcgtctttgctt

SEQ ID NO: 6666 - DNA, 893 bp, Zea mays
gcacgaggagagagagagagcgcacggccctcgtgcgtttgggtcttttaaatccgtggctctaatccgtaaccctaaacccccaccaaaacccctcctcgcctccctcccctccatccaatcctcgaaacgagcgcgcgggcgaggaggtccccctctccgagatggctagggtttttcgcgggtccctcctcctgatgtccccggcggcggcggcggcggcggcggcggcggcaggggccaagaaggcggcctccacgaagccgagggcgccggccgggatcacgaagccgatgccggtctccgaagcgttccgcaggttcgccggcggcgcgcgcgaggtcgcacgctccgaggccatcaagctcgtctggacccacatcaaggcccacggcctccagaacccgtccaacaaaaccgagatcaactgtgacgcgacgctcaagagcttgtttggtgggagggacaagatcgggatgatggaggtctcgaagctactgagccctcacttcctgaagaactagcaagcggtgcatggagccggcggcagcgcttcgcggttgatttgggaaatgtttagtctgctaatggcaaatctcagtccacgttcatcccagtctttgattcgtggtcttagcgtcatgttcgtatgcgtggggttgcgttctttccgatttgtatagtcggtctgcagcatgttatatgatatgcttgaagtttgcactcctcccttgtcatcgctggatgcctggataaacaaaaccagctgttgactgactttgtaagttgtacctctgttgcttacgaaatattacttcccttctcgaataaaaaaaaaaaaaaaaaaaaaaaaaaaaaaaaaaaaaaaaaaaaaaaaaaaaaaaaaaaaaaaa

SEQ ID NO: 6667 - DNA, 1086 bp, Zea mays
ctgcagcctgtggggatggggcgggcgcggctcgcccgcgagattggcggggcgagggagcgcgagggcgatgggcggagccattgtgaagtgtggacgccctccccgcccgctccgggagtagtacaagatttctcctcctcatcagtccccactctgactctctccagtctggggctctgggcccaaatacaaaagggtttgtgggaaagccgctcgaatccgtaaccctaaccccacacccactcataaaccctccgcctcctcgcctccctcccttccatccaatcctcggaacgagcgcgcgggcgaggaggacccccgacggaggatggcggcggcggctagggttttccgcgggtccctcttcctgatgtccccggcggcgggcgccaaggcgtcggcagccaagaaggcgggcgcggcggcggcggcggcggcggtggccaagaagaccgaggcggccactacgaagccgagactgccgaccgggatcacgaagccgatgccggtctccgatgagttccgcaggttcgccggcggcgcgcccgaggtcgcacgctccgaggccatcaagctcatctgggcccacatcaaggcccacggcctccagaacccagccaagaaaacggagatcaactgcgacgccacgctcaaaagcttgtttggcgggagggacaaggttgggatgctggagatcaacaggctactgaacgctcacttcccgaagaagtagcaagcagcagtccgtggtgccagtgatcgcgctttggtaaaaggactttcttgtggctgacctcttttgtggtccatgttaagtcccaagtctcccacttggtggttacgcccgaaaaccgtgtgatgacattaagacttacagactttgttcagcagttgggtttttgggcgtgatgcatgtaaaaaggatccccagtgtttccgtttctcttgtgatcctgtgaggacaccgatgtgggaaatatttaagtctgctaatggcaaatcttattagtcttttgtccaaaaaaaaaaagggcggcagctcccgccgtggtctctctctctctctcctcgtgccgctcgtgc

SEQ ID NO: 6668 - DNA, 1041 bp, Zea mays
tcacgcgtccgcccacgcgtacggcttggccttcgtttccgcttctcttgcgctttcgactcctgctagctggcggggcggctcgcctctcgcgccacaatggaggtcgaggacgacgacaacacggcggcgccgagcgcgtggccgagttcatccaggcgtcgccacctcctccagttccttctccacgcctccatgaggctcgacctccggcccatcgtcaagtacgccgcgcttaccttcttcgctggacgcttcctcccggcactcccgaggaagatggggttctgcggcgcgcgaagcggccgaatagtcaggtcctggctcctcgagcccctgagggacagcaatctcgagctattcgcgctcgtcgcggtgtggattgccagcaagatccacgatcagaagccaatgtcagtgaagagcctcaaagccctgggtgatcgcatcatcgccgaccagcatttcatgtgccgtgattttgccagtgccgaattggtgttcttggaggtagtggaacacaacattggattttcaagcatttgtttcatatacctggagtagcttctcatgcatttcagggaaatatcaaaaataggcgaacttttggatctggatgtgtgcatggaaattttggacattctgtatgaaacggaagatacctcgttactttttaattgtccctgctcacttgctgcttccactcttgttgctgcatatgctatatcagttcctaagcaaacatgggagtttccaatccttccttgggtcaggtttgctacatcatacgatgaagaggaaatcatgaagattgttctgacaattctcctacatgtgcttaaactggatggtatcgaagagaagggcaagggacgttttgatgccagatgtttgtcgtgaatacatgcttttagaagacactgtagctagtttttgacaggcggttttgagattgagatgcccataatagttatgtgaactaaaactatatgatcaagggagtgcgcgtaagcgccttgcaatggaaaaaaaaaaaaaaaa

SEQ ID NO: 6669 - DNA, 3307 bp, Zea mays
  misc_feature (2)..(2): n is a, c, g, or t
  misc_feature (7)..(9): n is a, c, g, or t
  misc_feature (12)..(12): n is a, c, g, or t
  misc_feature (19)..(19): n is a, c, g, or t
  misc_feature (26)..(26): n is a, c, g, or t
  misc_feature (29)..(35): n is a, c, g, or t
  misc_feature (39)..(40): n is a, c, g, or t
  misc_feature (47)..(47): n is a, c, g, or t
  misc_feature (63)..(63): n is a, c, g, or t
  misc_feature (70)..(70): n is a, c, g, or t
  misc_feature (77)..(77): n is a, c, g, or t
  misc_feature (83)..(85): n is a, c, g, or t
  misc_feature (87)..(87): n is a, c, g, or t
  misc_feature (103)..(103): n is a, c, g, or t
  misc_feature (107)..(108): n is a, c, g, or t
  misc_feature (120)..(122): n is a, c, g, or t
  misc_feature (124)..(124): n is a, c, g, or t
  misc_feature (126)..(126): n is a, c, g, or t
  misc_feature (135)..(137): n is a, c, g, or t
  misc_feature (144)..(144): n is a, c, g, or t
  misc_feature (148)..(149): n is a, c, g, or t
  misc_feature (152)..(152): n is a, c, g, or t
  misc_feature (155)..(156): n is a, c, g, or t
  misc_feature (158)..(158): n is a, c, g, or t
  misc_feature (160)..(160): n is a, c, g, or t
  misc_feature (166)..(171): n is a, c, g, or t
  misc_feature (174)..(175): n is a, c, g, or t
  misc_feature (177)..(179): n is a, c, g, or t
  misc_feature (187)..(187): n is a, c, g, or t
  misc_feature (190)..(191): n is a, c, g, or t
  misc_feature (201)..(202): n is a, c, g, or t
  misc_feature (204)..(204): n is a, c, g, or t
  misc_feature (216)..(218): n is a, c, g, or t
  misc_feature (225)..(225): n is a, c, g, or t
  misc_feature (229)..(232): n is a, c, g, or t
  misc_feature (236)..(238): n is a, c, g, or t
  misc_feature (247)..(248): n is a, c, g, or t
  misc_feature (251)..(251): n is a, c, g, or t
  misc_feature (258)..(261): n is a, c, g, or t
  misc_feature (267)..(267): n is a, c, g, or t
  misc_feature (275)..(277): n is a, c, g, or t
  misc_feature (284)..(284): n is a, c, g, or t
  misc_feature (288)..(288): n is a, c, g, or t
  misc_feature (291)..(292): n is a, c, g, or t
  misc_feature (298)..(298): n is a, c, g, or t
  misc_feature (304)..(304): n is a, c, g, or t
  misc_feature (308)..(308): n is a, c, g, or t
  misc_feature (310)..(315): n is a, c, g, or t
  misc_feature (323)..(330): n is a, c, g, or t
  misc_feature (336)..(336): n is a, c, g, or t
  misc_feature (338)..(339): n is a, c, g, or t
  misc_feature (342)..(343): n is a, c, g, or t
  misc_feature (346)..(349): n is a, c, g, or t
  misc_feature (355)..(355): n is a, c, g, or t
  misc_feature (360)..(360): n is a, c, g, or t
  misc_feature (365)..(366): n is a, c, g, or t
  misc_feature (368)..(368): n is a, c, g, or t
  misc_feature (370)..(371): n is a, c, g, or t
  misc_feature (377)..(378): n is a, c, g, or t
  misc_feature (383)..(384): n is a, c, g, or t
  misc_feature (386)..(387): n is a, c, g, or t
  misc_feature (392)..(392): n is a, c, g, or t
  misc_feature (395)..(395): n is a, c, g, or t
  misc_feature (399)..(400): n is a, c, g, or t
  misc_feature (405)..(406): n is a, c, g, or t
  misc_feature (409)..(409): n is a, c, g, or t
  misc_feature (411)..(413): n is a, c, g, or t
  misc_feature (419)..(419): n is a, c, g, or t
  misc_feature (421)..(421): n is a, c, g, or t
  misc_feature (425)..(429): n is a, c, g, or t
  misc_feature (431)..(431): n is a, c, g, or t
  misc_feature (433)..(434): n is a, c, g, or t
  misc_feature (436)..(437): n is a, c, g, or t
  misc_feature (440)..(442): n is a, c, g, or t
  misc_feature (444)..(446): n is a, c, g, or t
  misc_feature (449)..(449): n is a, c, g, or t
  misc_feature (455)..(459): n is a, c, g, or t
  misc_feature (464)..(467): n is a, c, g, or t
  misc_feature (469)..(472): n is a, c, g, or t
  misc_feature (476)..(477): n is a, c, g, or t
cnccccnnnccncccaacnccccccnccnnnnnnncccnnccccccnaaacaccccccccccnccccccnccccccncccccnnncncccccccccccccccncccnncccccccccccnnncncnccccccccnnnccccccncccnnccnccnncncncccccnnnnnnccnncnnncccccccnccnncccccccccnncncccccccccccnnnccccccncccnnnncccnnnccccccccnnccnccccccnnnncccccncccccccnnnccccccncccnccnncccccncccccncccncnnnnnncccccccnnnnnnnncccccncnnccnnccnnnncccccnccccnccccnncncnncccccnnccccnncnnccccnccncccnnccccnnccncnnncccccncncccnnnnncncnncnnccnnncnnnccncccccnnnnnccccnnnncnnnncccnncctttccgcgctgcttttgacccgcccggccgctggcacgcgtctccccgtacgagcacgcaactacgcaaggccaccccgccggtctctccttcccccgccagatcctccgctccttcgcccactgccgccgcggccgcgcccccccccccgggttgttgcactgtagtactggagtggaggtccggtcccacgtttgggggtggactcgacaaacgccaaaccgagcaccccccaaagcctgattctgctcaacactgcgcctgaacaattttctctggtggggctgcaaagacaaattaggagtgcttccaagttccaatccctgtttgcttgtacagggtataattaaagaggcaacggagtcatgacccttttgagggagtatcagtaactgcatgatcttttcgagggaggcacgatggaaggaaataacctaccctctggaagcttgatgcaaggaacaccttacagtaatgtggacttgcagcatcataaacatatgcaaatgcctgcaccaagctctggaaaccaggctttcaaccactctcagatgcctggcaatttccccatttgtctgaaccaggttacagattccgaccagctacctgaattccaatttggagagcacggcaaggtcagtcaccaccatcatcctcaccatcacaagcagcatgcaacgaatagcatgagcgatgatgaggagcatggtgtgcatgaggatgccactgatagccagatcggcaagggaaagaagggttccgcatggcatcggatgaagtggactgattcgatggttaggcttttgattactgcagcatcctacaccggggaagacccaggagctgatttaggaggtggtaggagaagctgtgcaatgatgcagaagaaaggcaagtggaaggccatatcaaaagtcatgggcgagcgaggctgcctcgtgtcgccgcagcagtgtgaggataagttcaatgacctaaataagaggtataaaaggcttacagatatccttggtcggggtactacttgcagagttgtggcaaacccagaacttctagatggcatggctaatctctcagataagatgaaagatgacgcgaggaagatattgagctctaagcacttgttctatgaagagatgtgctcctatcacaacaataatcggttcagtttacctgaagatcctgcacttcagcgatcgttgcagcttgctcttaagtgtaaggatgagcatgatgcaaggaagcgagcaagtggagatgctgatgaagatgatcaaagtgcagacactgataatgaagaagagaatgatgatgagcatcccatcacgcatgccaataaggggaccctactcacgcgtaaaagattgcggtacatgccggcggatatggaggatgtaggtttcggcaactcttccagctcacatgactgtagctggagatctgatccccatagcattgcagtggacatcaacaaagcttctccagatggaactaacttggcttcggttcaaaaagacttggctacacagtctgcggagattgagaaacagcgcatggaaattgaagttcaggcattggagcttgcaaaacaacgtctcaagtgggaggcatttagtaagaagaaggacagagagctagagaagatgaggttggaaaatgaacaaatgaagattgagaataaacgtttggagctagaggtaagatacaaggagttggagcttgaacacaaaccacaaggccatggcagtcatgcaacatgataatatctttaaaatcacgaagactgaaacgcaagatagtaagctttgtctcctgttatcactacccagagaaataattatgagtaactcatttctaattctgtcaccaaatccttgatattcatgggttgctagagtaggtgctatttggtaccagacagttcagtcatgtttatatttattttgttctctgtagatgtttcagagaaacgagaacttccgatgcatgcttagggaaccatggaatccagagatattccgctgatctgcactaagagttctactaatcttagtgaccgatctttgttatacttctcaataaccatgaaatcttttgtatactcacattttccatagactggctatttaatttgttgatgtgcttattttacatccacaataatgccagataagcacagtagagcctcatcacacgtgtcatgggcaattgactaaccctaaggcctaatgggcgccttatactaccaacctggcacatggagagccagaccacaagggcagggatagaagggcactgccgctaatagatgatattcttcttccttgccttgattgatacatgtctccttataaaataggtttgcttgactcataagcaagatgactaatcttatctaccctaatgggcctctcatactaccgacccggtccataaggcctagctgactgtgcatgacatcatgcattgcgggtaggctttagtgatgaattatagatatttgcttccaaattggttggctaagtattgtcaaaagaacttcacattgcttctctggctgccaggcagagtccttccatgggacaatattattttctaaacaaaatttaatgtactttaatatgttttttcttctttcaacaaccaacatcctacaactttacgaactaacactagtctgaattgctggaatgtttgatgtagtatatagtgtacagtcatatcatatgcacactgccagactgcctaatatccagtgttgtgtacattgcaggcttcaacataacttaattttagggctagtttgggaactccatttttccaaggga

SEQ ID NO: 6670 - DNA, 1748 bp, Zea mays
  misc_feature (811)..(811): n is a, c, g, or t
cggccgggccccagccgcccgggcccggacgccctgtaagagctgatcagcactcaacaagcgatcgatcaagcggaggcggaggaccagcagtaggagtagaatgggcggggatgcggcggcgatgaggccggtgctgcacctcatggtcgggctggtgctctacggcgtcgccgaggagatgaccgtcccggcgcttgtcgacaaggtcaccgccgcgctctgccccgccgacgaccagtcctgcccggaggccctctacctcaccggcctgcaggcttcggttggagggatcttcaggacggtagggttcactctgatgggccagctggctgatgagtacggccggaagcctctcatccttctcaccgcctccacctccatcatcccattcgctgtgctcgcatggaacagttcaaggactgccgtgtatgcctaccttgctctgcgcaccctctcgttcatggtcggccagggaaccatattctgcctcgccattgcttacacggcagatgcggttgagccatcaaggagggcggctgcatttggcttctttgacggggattttctctgcggcacacaccttggggaccgtgctctcgaggttcctgcctggggggtggattttcgaggtctcaattgtcttgctgatctgctctatcctctacatgaaagtatatttggttgagacagttcagagacctccttctgcgccttctcggcatttgtccatgccagctctgcttgtcaaattaccgcaagaacgttgggaatctatcaaggacaacattagcatagtcaaaaacagcgnaaacactcaggagaatctcatatgttgccttcttttacaaattgggcatgattgccattagcgacgttctaatgtattacctgaagtccgtatttggctttgacaaggatcagttctcagagattctaatggttgtcggcgtcggttcaatcttttcgcagattctggtcctccccttccttagccaaataattggtgaaaagggcgtcttatgcatttcaatactcgcatccattgcttatgctttgctttatggtgttgcatgggcttcgtgggttccatattttagctcttcattgggtatcatctatgttctggccaaaccagcaatatatgcgataatttctggtgaagtactgtcaactgaccagggaaaagcgcaaggttttattgcaaccgtgcagtctgtagctatattgttggcaccactatttatgagtccactgacctcttacttcatttcagaggaagcgcccttcgactgcaaaggtttcagctttattgtggcgagtttcttcttggcaatctcgttctgcctcgcttggatgcttaacccaggaatgaaggacaagggcacaaaagctgccgtttcagacagcgctgatgaggaagcagcgcaagcaccactactggcaaaatggaacagaccatgactccaggaaactgagctataaagctcagctggagtgtgcgtaaaattgtaggatatgtgaattagagtgccaacaacatagggcttgcctgtacctgtagtatagtgtctgtacataccccagaacgagaaagccgataaagctcggtgttttgtgccatccagccttcactgtttcaggcaaatggatctttatattatgtgctaaaaaaaaaaaaaaaaaaaaaaaaaggacgaaggctgtccgctatacaggatccaggctgccgcacgcgcgcacatagc

SEQ ID NO: 6671 - DNA, 1604 bp, Zea mays
acccctagccgccgcccgtcgctgtcccgcaccgccgcaccggccaacccccgcgcccctcaaccgtctccgtcgccgcgccacccgcaccgggacccagtatggccgcctccggcgcatatccgggcacggcgttcaagatactcctctcctgccccgacggcctccctcgctcccgcgtttcggtgaagtttggtcggtcattcgacaggattccccatcctgatgcagccttggaggaatctataagtgaggtgtgggaccaaagccttcagcggaacccatatctatacagcggtacaaagtttcggtatggaggaaatgccttgcactacaaagatgactcagatcatgatcttgagtcctgtgtctcacttcatttgggtctcacagactacaggacatttgtgggaacaaatctcaatccattgtgggaattttttttggttccatctgaagatgattctgtacattgccaacacttgtcagatgcactgggaaatggtgctatagttgaaacatctgacaaaaagattattgtattgcaaaggagctacaatgtggcggactttccaggatactatgttttccctggaggacactcggagccgcaagaaattggaatcatgggtcatcaaactgatgaagaagactttgctagtctcactgaacgagtttcacaagaaatgtttgacggagtcatccgtgaagtggttgaggaaactggagttcctgctagctccctaactgatcctgtcttcattggagtttcccgccgagaagttaacgttaggccgactgcgttcttttttacaaaatgtaacattgattccagtggcgtaagcgagctttattctagagctcaagatggctatgaatctactaaactctacacagtatccgttgaagagctacaaggaatgaggcagcggatgcctggatgccacaacggtggtattgctctgtatgagttgatgaggaatgctgcaaaaaaaagtgaagatgtcattgatgaatagttctgatggtgttattacaccacaaacaagtgtggaggtattcgcatctcgtacaaacacccgtgcagaacactgcatgtgacatccatcagattgctgttctttgcagtagatatgtgccatttccatgtttgttgagcctgacataggtctccttagaccgctgcataagtgcccacaaagagcatgaagcttaaagtttcctctgaatactaccggaataaatttcatctccggatgtaccaccaaaggaggcacaccagagcggcatcatgatgctaatctacatggtgagatgacccgtggattgtaatgttctttcaggattgaatttcctgggcaagtgatgcctgaatctgtcagctgttcttctgttggtttctgctgtagcggtgtactaggagtatgtaggaaccgaaggtgaagcttacattactttgctctgagaacgtttatatacttgttacctttggtatggatatactagttcgtgctagggtatggattctacatatttcatcttgacttttatcgcttcaccccaaaaaaaaaaaaaaaaattcgagtatacccgggggatgtttc

SEQ ID NO: 6672 - DNA, 1636 bp, Zea mays
  misc_feature (1629)..(1631): n is a, c, g, or t
gcaccgggacccctcgcccccggaggttgttatccacgtgccgccgcaccggccaaccccgcgcccctcgaccgtctccgtcgccgcgccacccgcaccgggacccagtatggccgcctccggcgcatatccgggcacggcgttcaagatactcctctcctgccccgacggcctccctcgctcccgcgtttcggtgaagtttggtcggtcattcgacaggattccccatcctgatgcagccttggaggaatctataagtgaggtgtgggaccaaagccttcagcggaacccatatctatacagcggtacaaagtttcggtatggaggaaatgccttgcactacaaagatgactcagatcatgatcttgagtactgtgtctcacttcatttgggtctcacagactacaggacatttgtgggaacaaatctcaatccattgtgggaattttttttggttccatctgaagatgattctgtacattgccaacacttgtcagatgcactgggaaatggtgctatagttgaaacatctgacaaaaagattattgtattgcaaaggagctacaatgtggcggactatccaggatactatgttttccctggaggacactcggagccgcaagaaattggaatcatgggtcatcaaactgatgaagaagactttgctagtctcactgaacgagtttcacaagaaatgtttgacggagtcatccgtgaagtggttgaggaaactggagttcctgctagctccctaactgatcctgtcttcattggagtttcccgccgagaagttaacgttaggccgactgcgttcttttttacaaaatgtaacattgattccagtggcgtaagcgagctttattctagagctcaagatggctatgaatctactaaactctacacagtatccgttgaagagctacaaggaatgaggcagcggatgcctggatgccacaacggtggtattgctctgtatgagttgatgaggaatgctgcaaaaaaaaaagtgaagacgtcattgatgaatagttctgatgccccggtttcgcccgtatcgccgggggaggtattcgtatctcgtacaaacacccgtgaagaacactgcatgtgacatccatcagattgctgttctttgcagtagatgtgccatttcatgtttgttgagcctgacataggtctccttagaccgctgcataagtgcccacaaagaaataagagcttgaagcttaaagtttcctctgaatactaccggaataaatttcatctccggatattccaccaaaggaggcacaccagagcggcatcatgatgctaatctacatggtgagatgacccgtggattgtaatgttctttcaggattgaatttcctgggcaagtgatgcctgaatctgtcagctgttcttctgttggtttctgctgtagctgtgtactaggagtatgtaggaaccgaaggtgaagcttacatactttgctctgataacgtttatatacttgttagttgttacctttggtatggatatactagttcgtgctagggtatggattctacatatttcatcttgacttttatcgcttcacacaattgccatcttggtgaattcaagtatagcctgtggatgtttctttgnnnaaaaa

SEQ ID NO: 6673 - DNA, 1949 bp, Zea mays
  misc_feature (1918)..(1918): n is a, c, g, or t
ccagcgtccgccttactacattaaacatagcaaacaacaatttcagtggttggataccaaaagaattcagctccattccagatgtaacacttgaaggaaactcatttgccaatggacctgctcccccgccaccaccttttatgccaccaccccctcaaaggccacggaatcgtcctaagcatcctcaggggccaggagatgctcctaaaggttcagaaagccacactgttcaaagtaacaagaagcaaggccttgggacaggtccgcttgtgggcataattgctggatcaatagttgctgttttatgtgtgtttctgcttctgttatgctgcatgtgcaatgctcagaaaagaactgatgatgccagcagtgaatcaaaagattttggaggacctctaacagtaaacattgagagagcttctagcagggaaatcccagagcagatggatgacacgtctatagcaactgtgaagctcccacctgctgagaaaatgactcctgagagagtttacggtaaaaatggttctgtaagaaagacaaaggtccccataactgcaacaccttatactgtcgcttctctccaagttgctactaatagtttctgtcaagattctcttctgggtgagggctcacttggtcgtgtttataaggccgatttcccgaatggaaaggttcttgctgttaaaaagatagatagcgccgcactttctttacaggaagaagacaatttccttgaggctgtatcgagcatgtctcggctaaggcatccaaacatcgtgccattgacaggatattgtgttgaacatgggcaaagacttcttgtctatgagtacattgtaaatggaacgctgcatgatatgttgcacttctctgttgaaataagcaggaagcttacatggaacatccgcgtaaggatagcactaggcactgctcgagcacttgagtacctgcatgaggtgtgcatgccgtctcttgttcatagaaatttgaagtcttcaaacattctactagatgaggagcataatccacacctatctgactgtggacttgctgccttgactccaaatactgaaagacaggtttcaactgaagtatttggatcatttggctatagcgccccagagtttgcaatgtctggcatttatactgtaaagagcgatgtatacagttttggagtggtaatgttagagctattgacagggcggaagccactagacagttccagagagaggtcagaacagtctcttgttagatgggctacccctcaacttcatgatattgatgcacttgctaggatggttgatccagcattaaacggaatgtacccagctaaatcactctctcgttttgcagacgtaattgcactctgcgttcagcctgagccagagttccgcccacccatgtcagaggttgtccagcaacttgtgcgcttgatgcagagggctagcatcgtgaggcggcaatcaggagaagagctagggttttcatacagagtcccagaacgagaaggagacctgagagacatttccttctgagcaagtgcgtccacgatagaagcgcaaaacagtttggaggcttaatgtgcaaagaaaatatctagagcactcgtatagtcatatcgattggagaactcgagctgaccgcaacaattcaggatcggatgagttttgagaagataatttcgttgcctattgttcaactttgttcattcttctacattcgtctcattttcagtcagtatacttgttgcagctgtatttaaaacgagactcaaattgatggtggtgtatagctgattattggtagagaagaaggaaaagaaatgtaaaattgatgctccgttatgttttaatgatagaaacctcaagactctacagccattcgcacatactggatagattcctcgcgtcccaggccnatataataaaacctacacccgttctgctcct

SEQ ID NO: 6674 - DNA, 1337 bp, Zea mays
cgctattttactttctgtggtagctaccacccttatagtgagaaggcgttcaagacacggaactgtctcaaaacgttcattgtcaaggttttctgtcaaagttgatggcgttagatgtttcacatttgaagaaatggctatagcaacaaataattttgatctatcagcccaagttggccaaggaggttacggcaaagtctacaagggaattctaggcgatggagcatttgtagcaatcaaacgagcacacgaggattcccttcaaggttcaagggagttctgcacggagatagagctactatcaagattgcatcatcgcaatttggtttcattggttggctattgcgatgaagaggatgagcagatgctggtttatgaattcatgtcaaatggcactttacgtgatcatctttctgccaagtccaagagacctctaagttttggtttgaggttgaaaatcgcattgggtgctgcaaagggaattttgtatctacatactgaagcagatccacctatattccaccgtgatgttaaggccagcaacattctgttggactccaaattcgttgcaaaggtagccgattttggtctctcgaggcttgctccagtgccagatgtcgaagggacattgccagctcacgtatccactgttgtcaagggcaccccaggctatcttgatccggaatacttcctaactcacaaactgaccgacaagagtgatgtttacagcctgggtgtcgtgttccttgaaatgttaactggtatgaaaccaattgagcatggtaaaaacatagtgagagaggtaaactcagcttgccagtcgggcgcagtttctggaataatcgatggccggatgggcttataccccccagaatgcatcaagaggttcttatcactagcaaccaagtgttgccaggatgaaactgatgacaggccttccatgtgggagattgtcagagaacttgagctcatcttgaggatgatgcctgaagaggacctgattctgctggaaacctcagaaacagactcgaccgatgtcagtaagtcgttgtcatcttcagcgaccaggaccctcttcgtctcgtcacaggcctctgggagtcttgatgcgagcagcggcatgatctctggaagagtaactccccggtaggcatggtgtaatacttgtgaatatgcaagtttgttctgtaacattataggcttaccactcctaggacctgtcttttatgaattattcatattcagccgaacgtacagtagataatagcttatgatacactggaacatagctggcattgcattctttacctttctaatataaaaaaaaaaaagcggcc

SEQ ID NO: 6675 - DNA, 1214 bp, Zea mays
ctgttgaatgttgattgcgagctagtagtagaaaccgatcgattctttgtcaaggaggagcagcatcatgtgtttgtgcaaaattcctttcttcccaggtggcccgcctaactgcaacgcctccactcctccgtctgtagctagtagagcaacgcctacacaacttgcagcatcatgtttggatctgtagcagtgtagtggtacgtgcagtaggagactcgcttccgtcttccctatatggccgaacaacggttttaatggcttttgtcatgtagtccgcagaccgcagtgaagcgtgtcgacaggcgtcgttgcgcctagctcatcactcatcagctagccccccgccgtctacccctctccgccaacgcgcctataaatccatggggccccccgggccggcccggaatcaatccggccgggtaggtagcaggcagcagcacatctcagccttcacccctctcacactctcttcactcagttcgagcaaggggggcagcgagcgaagcggtaggtagcagcagtacgtgctgccgccaagctagttagtgccaatggcgagggcggtggcgatgctcgtggccctggccctggccctggcgctgatcgtggcggcgagcgcgggcggggcggcggcgcagcagtgcagcgcggcgcagctggcggcgtgcgccccggcgatcatcagcgggtcgccgcccacggcgtcgtgctgctccaacctgcgcgcgcaggagccgtgcttctgccagtacgcgcgcaacccggcgtacagcagctacatcaacagccccaacgcccgccgcacgctcacctcctgcggcatcgccgtcccgagctgctagggcgctagctcgtgcctcgtggtgtggatgaataaaaagatgcatgtcgatctctgcttactgttatcgtatctgtagtacctcgtgtgatatgaacaatatgtattatttaccaagagcggttgtgtcaagacattcgtgccagacgacagtgatggcgtcgtagcccccagccgctagactgggtgggcatcgagaaccaaacggttaacgatggcggtatatctcaaattattgtcttatttagttaggtctgatttgcgtctatgagtaagtgaaagaccacgtaaacactttgcactatataattcattagaattctttatcttaattcaaaatatatttttaaaaaaaaaaaaaaaaggccct

SEQ ID NO: 6676 - DNA, 781 bp, Zea mays
gccgtgtgggtccctcgagccgggccgggtcaatcccggccgggtccgcgcgcaaggggcagcgagcgagccacgtacgaagtagtacgtgctgccgccaagctagtgccaatggcgagggcggtggcgatgctcgtggccctggccctggcgctgatcgtggcggtggcgagcgcgggcggcgcggcggcgcagcagtgcagcgcggcgcagctggcggcgtgcgccccggcgatcatcagcgggtcgccgcccacggcgtcgtgctgctccaacctgcgcgcgcaggagccgtgcttctgccagtacgcgcgcaacccggcgtacagcagctacatcaacagccccaacgcccgccgcacgctcacctcctgcggcatcgccgtcccgagctgctagggcgctagctcgtgcctcgtggtgtgggtgaataaaaagatgcatgtcgatctctgcttactgttatcgtatctgtagtacctcgtgtgatatgaacaatatgtattatttaccaagagcggttgtgtcatgacattcgtgccagacgacagtgatggcgtcgtagcccccagccgctagactgggtgggcatcgagaaccaaacggttaacgatggcggtatatctcaaattattgtcttatttagttaggtctgatttgcgtctatgagtaagtgaaagaccacgtaaacactttgcactatagaattcattagaattctttatcaaaattcaaaatatattttatgggccgccgggggacacacacccacgttccggcc

SEQ ID NO: 6677 - DNA, 4032 bp, Zea mays
  misc_feature (29)..(29): n is a, c, g, or t
ggtaccctcgggttcggccgggtcattanttccgcgcgcccggccccgtttatgattctacccctcttggaagatacttagccgggtttcttcagatctgagtattgttgaccttgatattccgtttggcttcatgtttagcattggtgctggcataaatgcatatagcaatctaggagtattggctgttgttacatggcaagttctgttcgtctctgtgccaatgattgttttggcaatcaggttgcagaggtattatttagcctcatctaaggaattgatgaggatcaatggcactaccaaatctgctctcgctaatcacttgggcgagtcgattgcaggggctataacaataagggcttttcaggaagaagatcgtttctttgagaaaaacttggaacttgttgacaagaatgctggtccatatttctataattttgcagcaactgaatggctcattcaacgtttggagaccatgagtgctgcagttctttctttttctgcccttatcatggctcttcttcctcaaggaacttttagccctggctttgtaggaatggcattatcttatggtctatccctgaatatatcctttgttttctctatccaaaaccaatgccagctagctagtcaaatcatctctgtggaaagggttcatcagtacatggacataccaagtgaagcagcagagattattgaagaaaatcgaccagcaccagactggccccaagttggcagggtggaccttaaagatttgaagattagatacagacaagatgctcctcttgtattacatggaatcacctgcagtttccacggtggagataagatcggtatagttgggcgaacaggaagtggaaagacaactttaattggtgcactgtttcgtcttgttgagccaactggagggaaaataattatagactctatagacatcaccacaataggcttacatgacctgcgttcacgtttgggtatcattccgcaagatccgacactctttcaaggaaccataagatataatctagaccctcttgggcaattctctgatcaacaaatatgggaggttctaggcaaatgtcagcttcttgaagctgtccaggagaaggagcagggattggactcacttgttgtggaagatggttcgaactggagcatgggtcaaaggcagctcttttgtttgggacgtgcacttctaagaagatgccgtatcttagttcttgatgaggccacggcatctatagacaacgctactgatgctatccttcagaagacgatcaggacagagtttagagattgcactgtcatcactgtcgcacaccgtatacccaccgttatggactgcgatatggtacttgcaatgagtgacgggaaagtagtggagtacgacaagcctacaaagctcgtggaaaccgaaggatctctcttccgtgatcttgtcaaggagtactggtcatacacatcgaattgaaatatctaggagaaactgtgacaatcacatgttcactcgttgcagtctcttaaaaaagagataacaggagcctgttctcacacacatccgatgaactattctatctcaagtccgaagtagaggtgtcaggcattgtcgggaagtgcttttgttaactagttgaacagggggaaacctgtcgtcccttaataaaaaggaaacctccagcgtttttttgctccgatattgagcgaataaaccgaaatatctagtggaaggcgcatcaagtatgcatccttgatactgctgcaatactgcatgttcacagaaatgcttgtgcggcaggctgttccaaggctttaaactttatggtgctttacattcctaataaaccgaattgtgtatatgatgtttgggaaaatggtgatttttcaggtttcagctccctctcttgctcacgtttaatgtattatcagtgtaaattcatccgtgattggatttaaggcaaccaatttgttggtaaagaaaaaaattttcacagcgtgtgcccttcaaacttataactcttgggctccctcatatccagggtaagggtctgtttggtttgtggctaactgtgcgtctgtgccacactttgtctaaggttggtcgttcgaattgaagaactaaccttagacagaaaaattaggcaaagtgtagcaagttaggcagggaacattttaaataagatgagtggtcaaagtttatggtgtcatatatttaagaacggtggagtattattttttcttctgcgatataattctaggtgggtatcctcaggctcaggtcccctaggtttctttgtcaccatttatttcgtatccagttccagagaaaatactatactaatgtcccgaaataaatgaagtgagtagattgtgaaaaatatatttcatggtgtatctggtcatgctaatgccaaagtcataaatattggtgctctttttataaatttgatcgaatttaaaataattggatttataacaattttgaagttcatttattttgcgaaggagaaagtactggcacaagtttttttttttttttttttttttgaacgaagtattccgatgtactatgaaaaatgcattttgtacaataacaatcctataaagttgacccaaaagaataaatatctatttcgactgcatctgtaatccggatcatgcaaattgagttgtacgcttctcttgcgccgcagacgatttttcgctgaaaactgcaagaaagttagttgattgggccaccccatgtgtggcaaaacaacgagggaaacgttagaatcctcagcgccagcggctggtggtactcggagaggaactggcctgccgctacgggctacggcggcgtgctgggctcctccaactcggggcgcgtccttaccaccttcgccgatggcatcctgctcccgcgcaccgtcatcctccccagttcctccccggccattgcccgccgctccatctcctcccatcgccgcctcctgctccagctgatcgcgccggccaccgagagcgccaagacgctggctcccagcaccccaccggcgccgacacccaccgtccacgcccaccacccggctgaggctggcggcggcgtctcgggcagccgcaccactataccgaagtggcccgtgccggtgaccgcgcacgtggacgcggagcccgacgtgacggcgtacgtggccacgacctccccgctggccgcgaacgtcacgcacagcgcggcggccgcgtcgaaccccttgtccagagccgccgccgacagctcgtcatcgaactcgacgcgcaccggcgcgccgagcgcccggagcgagacccgggcgtcgggccccgccgccgcgtcgtacgcgaaaaagccggccacgggcgcggccagcgcgtagaggcgcggcgcggcgaacgcggccgccgagccgccggtgaagcgctcgaagacgatggtgaggcagcgcgcgaacggggccggcacgacgcgcggcgggacgacgaaaccggcggcgttgacgccgtcggcccagagcgcgttgctgctcacgcgcagcgcccaggcccggacgcccgcgccggagaggttgcccgggaggggcagcaggtcgacgggctgcgtcgtgtcgttggtggtggtgtcgcggagcagctcggacgcgcgggcgcggaccgcggcctcgacggccgagatgttttcggtgcgaccctgcgccgtgcacggggccggaaaggaggcggcgaggacgacgtgcacgagcagcgacagaggcagcagaggcgccttggccattgacgccttgtcttcgtcggtagctagctagctctgcggcggcgtgtgacggcggcggcggtggcggcaggaagccgccatgtcgacggagaggaatggagtggtggtggtttcctggttggagagaagaggaggaggctgccaggttgaacacggaggctaattagcgaaggcgaggagtttgctttatttaggaggccatggccaagggcgttaatggctggccggacgttcatatgcacgcagcccggtaaggagaaagacag

SEQ ID NO: 6678 - DNA, 2764 bp, Zea mays
  misc_feature (16)..(16): n is a, c, g, or t
  misc_feature (44)..(44): n is a, c, g, or t
aatcggggagaggggngtaaatcttagcggtggccagaagcagngtgttccgcccgcgcgggcattataccaaaatgcagacatttatcttcttgatgaccctttcagcgctgttgatgcccacacagcaactagtctttttaacgaatatgtcatgggagctctgtcagataagactgtccttttggtgacccatcaagtcgattttttgcctgtatttgattctgttctgttaatgtcagatggtgaaattattcgtgctgcaccttatcaagatttattggcacattgtcaagaatttcagaacctcgtaaatgcccataaagacactattggtgtttcagatcttaacagagtcagatcccacaaaacaaatgaaaacaagggatcgattgatattcatggaagcttatacaaagagtctttgaagccatcaccagcagatcagctgatcaagacagaggaaagagaaatgggtgacactggtctcaagccttatatcctttacttgcgccagaataaaggcttcttcaatggctctatgggtattctttgccatgtgattttcgtatgtggccaaatagcacagaattcatggatggctgctaatgtccagaatcctgatgttagtacacttaagttgatttctgtgtacattgcaattggattcatcacagtgttcttcttgctgtttagatcgatagcacttgttgttcttgggatccaaacatcaagatctttattttcccagttactcaactcattgttccgtgcgccaatgtccttttttgattctacccctcttggaaggatacttagccgggtatcttcagatttgagcattgttgatcttgatgttccatttggattgatgcttgctcttggtgccagcataaatgcatatagcaatctgggggtgttggctgttgttacatggcaagttctgttcgtctctgtgccgatgatggttttggcactcaggttgcagaagtactatttagcctcagctaaggaactgatgaggatcaatggcactaccaaatcagctctggctaatcacttgggagagtcggttgcagggtctataacaataagggctttcgaggaagaagatcgtttctttgagaaaaattcggaacttgttgacaagaatgctgcttcatatttctataattttgcagcgactgaatggctgattcaacgcctggaaacaatgagtgctgcagttctttctttttctgccttcatcatggctctcctccctgcaggaacttttagctctggctttataggaatggcgttgtcttatggtctgtccctgaacaattcctttgttttctctatccaaaaccagtgccagctatcaaaccagataatctctgtggaaagggtgaaccagtacatggacataccaagtgaagcagcagaggtcattgaagaaaatcgaccatcaccaaactggccccaagttggtagggtggagcttagagatctgaagatcagatacagggaagatgctccccttgtactgcatggaatcacatgcactttcgaaggcggagataagattggtatagtcggccggacaggaagtggaaagacgactttaatcggtgcattgtttcgtcttgttgagccaactggggggaaaataattattgactctgtagatatcaccacgattggcttacatgaccttcgttcacgtttgggtatcattccgcaagatccgacactctttcagggaaccataagatataatctagatcctcttgagcaattttcggatcaacagatatgggaggttcttgacaaatgtcagcttcttgaagctgtccaggagaaggaacagggattggactcacttgttgtggaggatggctcgaactggagcatgggtcagaggcagctcttctgtttgggacgtgcactgctaagaagatgccgtgtcttagtcctcgacgaggccacggcatctatagacaatgctaccgatgcgatccttcagaaaacaatcaggacagagttcagagactgcactgtcatcactgtcgctcaccgtatacccactgtcatggactgcagtatggtacttgcactgagcgacgggaaactggtggagtatgacaagcctacgaagctcatggaaaccgaagggtctctcttccgtgacctcgtcaaagagtactggtcgtacgcatcgaatgggaatatctagaagccacctccaaactacgaccgtttgcatgtttccactcgctgcatcctcttgaaaggagatacaagaatctgggcttgcacatccgaagaactattgtatctgaaatcttgagaaaaggcgtcaggcattgtcatgaaatgcttgttgtcaagttttcaccactcgtttttcagcaactttttggtagtttctgttttgggtcattgcttcccttccaggcgctgaataaaagaaaacatgtctccatccccccccccccccttcttctcccctccaaaaaaaagtagaggaaatcctcaacatttctttgctcacagtgatactttatgctcataacaaaaattcttaggcttggtgctcaacactattccattcagaatttgtggtgtatgcttacattcctacaaagctgtagtagggtatatgatgtctgtttttttggggtgcaatcatggctttccgccaccctcttgttcatgtttgatgtatattcatcggtgtctggagccaagcaatttggtggtaactctgttttttcactgc

SEQ ID NO: 6679 - DNA, 2841 bp, Zea mays
ggaaaaacatttttttaacctccataaacttaacactcaattacaggtacatagttgagcagtatagtatggctatgtgcatttcagaaccttggtgtatccctaacttctttctcaaaatatagcatgcgacaagtgtaccttacgctcggcaaagttgttgtaattatttttagcttggtgatattgctaaactaagaatgctaattggtccctccaaattgaaattttcagatccaagtttgcgggaaaacagcatatgtttctcagaacgcatggatccaaacaggaaccgtgcaggacaacattctctttgggtcttcgatggacaggcaaaggtaccaggaaacactcgagcggtgttctttagtgaaggatcttgagatgttgccgtatggagaccgtactcagatcggcgagcggggcataaatcttagcggcggtcagaagcagcgtgttcagcttgctcgtgcattgtaccagaatgcagacatctatctccttgatgaccctttcagcgctgttgatgcccacacagcaacgagtctgtttaatgtaagtgtcaaaaaaacagctgtgaattgaagtatttatcatagactagtacttttaaaaaaatctattttattggcagggatatgtcatgggagctctgtcagacaagactgttcttttggtgacccaccaagttgattttctgcctgtattcgattctattctggtatgctttattacgttatccttgttagatgtatagatatgtgagggttcctttgcatatgcacactcacttgtgacttgtatatcaaattatcaatcaacctttgggcctggtaatagttggttgtcctcattctaacacgacggtatcaaagagctaggtttcgttttcttgccggcggtctcgagcctcggcaccaccacgcgccccgcggcgctcgcgccgcttgccatgcaccccccgccccggatccttggcgggccatgccgcgcagctggcctctgtggccacgcgtaactgtcctcgccaccatggaggagcaggccgctgcgttgtccttccgcgcggacgacgcgcagctcctgctcgccttcctcggctcggcaccccgacgcccgcacgcgcggcacccgaccgcctgctcgcgcgtttccccgcatttctgcggcttggcacttctttacctttttcttaaaaagagagagaaaaaggaactcctttcatgcgttccccgggcgctctggttctgttggtgtcccgtcattttcagcacaaattagagtgaccaacagttgtgagttcctgttatgttctccccacgacacccatatacctactgaatgctgatggtgatgccaaaagtgttttacttgaggaatgctgatgatgatacacagggtgttatacttgaggcatttgaggttgggactgagagctatcagtttgatctcgatgtcaacttggctgcgtgcctgcgtggggagaaatgtgctaatgccatccttgccagcatggaggtcgatctctccatgtccattaggactagtttgggaatctcattttctcatgagattttcatttttccaagggaatttagtttattttcccttgggaaaacagaaattccttggaaaaatggagttcacaaactagtcctcagaggtcttgccactccataccttatgtgggaccgcctccgtcacatttacgatattcatcacagttaatttcttccaaggcacatacataggcccacaatagattcttaatctccaaactcaatgttgtctttccaccattagtttaagagggggtgctagatgtatagaggtgtgtggtattttccctctactttggagagtccctttgcatatgcacactcgctcactctcttgtatatctctgcctttgggcctggtaatagaagttggttggactcattatagcaatcctattatctctttatgtctttcgactttctttctgatgatcgaacattattttgttaaaaatcatattgttctactaaatcaaaaggtcatccattgtccatcatcaattgatagtttcagaatcaaagaaagacttaaggaaaaaagtgctatgcaaagatattactccctccatgtttatatgtattttagttatcatatattttttgtggttgatgtcatctaagaataagtgtttcttggcagttaatgtcagatggtcaaattattcgttctgcatcttatcatgatctattggcatattgtcaagaatttcagaaccttgtaaatgcccataaagacactattggtgtttcagatcttaacagggtgcctccccatagagaaaatgaaatattgatcaaggagacaattgatgttcatggaagcagatacaaagagtctttgaagccatcaccaacagatcaactgattaagacagaagaaagagaaatgggtgatactggtctcaagccttatattctctacctgcgtcagaataaaggcttcttctatgcttctctgggtattatttcccatatagttttcgtatgtggccaaatatcacagaattcatggatggctactaatgtcgagaatcctgatgttagtactcttaagttgacttctgtgtacattgcaattggaatcttctcggtgttcttcttgctatttagatcattagcagttgttgttcttggggtcaagacatcaagatccttattttctcagttactaaactcattattcccgacagcaacggccacagcagcgtctccccctcttggaagaatacgtagccgggtttcttcagatctgagtattgttgaccttgatattccgtttggc

SEQ ID NO: 6680 - DNA, 1819 bp, Zea mays
gggaaaaaatacccgtgacactaaatttgccaaactacctaaagttcagtctaggggtgataataatgtaatggagtagtattttatgatattcttttaaaacttctattttttcttccatttaaattgcaccgccataatctacacttgtcttgggaaaaagaactgagtcaaataccctcgtcgatgagatcaaactaaaataaataacttcttgtctatgaaaaaaaggggcagacccaatgccacagacgcaggctcccacatgagtgaggtctgaaacagggataaaccgaggcaattctttccctcgcaaatgcgaagaggttgcttcgaactcttgacctaatgactcagtgaaacaactctcaccattgtaccagacctacccttcacccttgtcgaggaggtcaaaataaaataaataacttatctttttaaagggaaaatcatatatttgatttccataaaaaatatgggattctcattcgtaggcacacgaacatcagtaatattctttgtacagcatgacatatgaggttgtctaattctctgactgacatttcgttgtgtagttgtggaagatggttcgaactggagcatgggtcaaaggcagctcttttgtttgggacgtgcacttctaagaagatgccgtatcttagttcttgatgaggccacggcatctatagacaacgctactgatgctatccttcagaagacgatcaggacagagtttagagattgcactgtcatcactgtcgcacaccgtatacccaccgttatggactgcgatatggtacttgcaatgagtgacggtatgttttcttcttgaacttgctagatgttagagtttatgtatttgggtgttttgcccctttggcctatatgtacttgtgggaaaccctaactctaacagtacttttgtcctatgggctgttaatttattcactctttttcctccaatactagagatacagcagttcagcacaactagaatctggaatctggggattcttcctaaaacagtattgtgtttttctttaaaaaggcctaaaacaatatatttgttgatacaagcaagcactcctttttctgatatgtatctttactaccttttctgcggtgatttatgcatgccaacttggcaaactcgtgtcagatcttaaacataaaccagaactgagcagtatatcttgccctttctctttattcttttctgcttagttttgttagattgtggaagcctgcctccagatagtattgcagcatgccagcatttacatgcgatacgggacttgcagtgagtgacgggaaagtagtggagtacgacaagcctacaaagctcgtggaaaccgaaggatctctcttccgtgatcttgtcaaggagtactggtcatacacatcgaattgaaatatctaggagaaactgtgacaatcacatgttcactcgttgcagtctcttaaaaaagagataacaggagcctgttctcacacacatccgatgaactattctatctcaagtccgaagtagaggtgtcaggcattgtcgggaagtgcttttgttaactagttgaacagggggaaacctgtcgtcccttaaaaaaaaggaaacctccagcgtttttttgctccgatattgagcgaataaaccgaaatatctagtggaaggcgcatcaagtatgcatccttgatactgcatgttcacagaaatgcttgtgcggcaggctgttccaaggctttaaactttatggtgctttacattcctaataaaccgaattgtgtatatgatgtttgggaaaatggtgatttttcaggtttc

SEQ ID NO: 6681 - DNA, 2007 bp, Zea mays
tccggaagcgaatggagtagattggtagagaacatggtcgaggtatcttccacaatcacaagtctcagcccccagcaagagacagtaggttcagatcattgaacacaaaataactgcatgctcacatcgttcagatcattgaacacaaaataacctgcacagaagtggttatgaaagattctacttgatagcagactaattgtatatcccctctcacattgttcagatcattgaacacaatatatatcctgtgctcacagagactatatgcacctatatcctagacacacatgcatgttgttaacttgaatcatattataatgcatagagaatgggcaatatgtgctcataggacggtctttgccaggaggatgtcaggtaagctctcatctgcatactcaatactaacgctccagatggaggtcgcccctcgctccccctgctccaagagaggagtgagggcgacaaggcctgcaggattatgaacaggagcctggtgtgcatctggcataccacgaacttgtacaggatcatcagcaacacgttgtacaatcgcagccatatcagcaggagcatccaacagatcatcaacttcctgaagcagctccaatagaccggcactgagtcccaaggcggcctcacggaaggccccggtgtggcggagagctgcctgcgtaaacttcctctcgacgtcctcgagcacgccaagcctctggcgatcgatcaggccactgcctatgttctgtagcgcgtgggatatattgagcaccatcttcttcatctcgcaggcacttgcaacgcgatcgaaattagcgaagcagtaatagaaaggatgctgcattgcagcttcgatcgcatgtagcatgtcatcggcatcaccgaggtggagctgtgatatacagaactcagttagcagtccctggttcggcaatgtcagcagcagccggaggtgatccaggcccctgatgcgtttgtacaccgtctccgtctccgtctcctgcgactgctccacgtccagtgaaacaaacgatgcgagcggcacgctggggtagtcgactgaactcgtgaggagctcgtccatggcgtccagatgcgctctcatacgctcggccaggtttgtgtatacctctgcggcatgcgaggtagccggagtggtgttgggcccactgtggcggccagcgggctccgctgggaacgccgcgagcgtggtacgaatggcgactacgagatgttcaacgccatcgcgaaggatccctggttggaggttgacggggaggccaaggcctggcatggaccggacgtggtcgaccagctcccagacgatacagtcgttgcgaagcgcttggtgcaggtccgagagctccgcggagagttggaggaggccagaacggagagcgctcgcctggaggagagaggacgcgttgctgatccgcaccggtcgtctggcgttgatcgcaaccaaacggcgcaccatctcgccggcgtcgttgaggcggagacgcagcacggcgaggtgcgtgacgtctacgtagtggtcctcgtggtacagcaccgattccacgtcgccgaggcccagaatgctgacaacgggttggccaccgacggtctcaacggcggcggcggcggcgtggtggtggtgcagtgggagaatctccgtctccacctcctcctcctcctcctccagatgcacttcgtcatcaccaactccaccaacacgttgccgcttcatcgtgagattggagggaccgaaatcggcacttatttggctctgtatttcagtcagtttggttctggatttcgtagcgactctggtttgaatttggggagggagggagggagggagggtgcgatgacgaaagggatatttctgaagttcttacggactgaaaccgaagcttcgagaacgatataaactgtacatatttgaagggcgtaagtgtaggggtgccaaacctacagcgatttcttgtggctatgcagtcgatggtgttggtttctactgcgttc

SEQ ID NO: 6682 - DNA, 1555 bp, Zea mays
tgatgctgtaccaaccaagactgtgtctgggcaaaggaacattcagttatcaggggtcatgcctaagggagaaggcagcaagcagctgtcgaaggagaaaggggagggtatctctattgacgcacttcataagctcaaccagaaaaacatctcagcttggaacatgaagaggctgatgaggattgtccgctttgggacgctaacaactatggatgagcagatacaacaagcaacaggcgagggggatgaatcagcgacacatatacgaagtgaatatgaggcaaagattgctgccaagaagatctttcacaatgtagcaaagccaggttccaagtacatatacttgtcagacttgataagattcatgaggcaagaagaggctgttaaagcaatgaatctttttgaaggagcacaggagcacaacagggtcagcaagaggtctctcaagaactgggtggtgaatgcatttagagagcgcaaagctcttgcccttacactcaatgatacaaaaactgcagtaaacaagctgaaccagatggtcaatgtcgttgtggggataattgtgtttgttctctggcttcttattctgggaatagcaacaacacatttctttgtcttcctaagttcacagcttctcctggcagttttcgtatttgggaacacattgaagacagtttttgaggcaattgtcttcttgttcgtgatgcatccctttgatgttggtgaccgttgcgaaattgaaggtgttcaggcggtggttgaggaaatgaatatcatgacgacggtgtttctccgatatgataacctgaagatatattatccaaacagtgtacttgcaacaaaaccaattatgaatttttacagaagtcctgatatgggagaagcaatcgatttctctattcatgtcgcaactcctgtcgagaaactggccctgatgaaggaacgaatactgcgctacattgacaacaagaaggaacactggtacccgggtgcgatggttgtactccgggacgtcgatgacaccaacaaactgaaagtgtcaatatggctgcggcacacgctcaacttccaggacatgggtatgcggttcgtcaggcgagagctagtgctccaggagatgatcaaagtcctgaaggacctcgagattgagtatcggatgctgccacttgatgtgaatgttcggaatgcgcctccaattcagtccacaaggatgcctacaacatggagttattcgtgaatcagtgacagggccggaccatttggccgtgacgttgcagatgcggacttgctatggatttggtggtcttaagctgcaagaactggtggtagcacaagcggattaagctgcaggtgcttggtagcaaatattagaggtagagaatagtagcatattagctagcatgtagagagctgttagctgtgcctgcagtcgtcacttgtgcaacttgtaattactgtattctcttgcgtgatgataattttctgtacatttgatggggaaatgacggtttggaaagagaagcaattgaaggagatggcatggtaatgtgtatgc

SEQ ID NO: 6683 - DNA, 2766 bp, Zea mays
attgggtacctcgaggccggccgggatgttgttagatgatgtcacgttgtaaggactcctcgtccatcggttccacacagttcgctgcgattttaattcacccgcttttgctttttctgcagttaaaacggctttaatccagcatcctaaccgcctaaggattgttgaaaaaaaaactaggtcttccactcttcctccactagtctactcggcagatttcactgactctcaccggcggtttttgtgcctccaccggccgccgccatgccgtacctcgtccgcgagcggctctacttcggcggcatcaaagacgccattgccgcactcacggagtcttcctccacgccggacttcacccacgtcctctccgtggtcagctccgcctccatctccttcatcaccgattgccgcccgggcctcgagatccccaccgaggaggtcctccgcgtagtcgccggcgaggagggcgcggcaccgactgccgcggttcccccggggacgctgatgcgggtggtggagcgcgccgggcacgggctgcgggtcacgcgcatggccgtgccgctgcgggacaccgaggaggaggacctgctcgaccgcctcgagccctgccttgagttcatcgatgagggcaggaaggtcgggaatgtcctcgtccattgctttgctggggtgtcgaggagcgcttccatcattgttgcttatcttatgagagcagaacagaaatctcttgaagaagcattagaagctctgaaggagatttctgagtcggcgtgcccaaacgatggttttcttgaccagctgaaattatttgaagaaatgggcttcaaagttgatacttcaagtcctttgtacaagagattccgcttgaaattattaggccaatcctacatatctggggagaaaataagcagctatatgtttgaagatgaccctggcctttctctagagtctggctcttgtcaagattcttcaaaggttgagcaacgtaaaacagcttaccgctgcaggaaatgcaggagagttattgctgtagagggcaatgttataagtcatgttcctggtgagggtgaatcttgctttgattggaaccgaagaaagagtggtcatccatacaacaacaaagaacatggttgctcatctttgtttgtcgaacctctgaaatggatgactccagtagaagacggcgctttggagggaaagctatcatgcatccactgtggagctcggttgggatacttcaactggtcaggaatacagtgcaactgtggtagctgggttactcctgccttccaaattgttaagagcaaagttgatatcagcaccatctagacctgtgagcaaacgactggcaagtttgagggacgaggagcgcgacagcagtgacgcctgacggtttaatgttttgtgtaccatatgaacgctacgtatacaggtgaagcaatagcgtattttatgtttttccattgccgatcagaagctgtgtgtggcaaataccgtataaaatttcgcatttgctgatgtaacaagtagccgtgatgtcggccatctgcccatctgtttagctggaacgggagcgaatgcagattgtgcagagaaatgaacacggttgtgtttctattctttctgtggattcaaatgtgcgcccaatatgaatactcgttcgtttctttttttcaacggtgcacatgcatcttaaggttccaacttgtcatatgcaatcacctagtctaacagttcttcaaatttccttgctacatttaggagctgtttggttcgtgtttttatgccccgtggtggttcacgtcgatacccaatcccttttcggtgtttggttggatgactccgtaataaatcacggcgcgtgcagttacgaccctatgggatcgaggcgtaagaccactacccctcctctagtgctgttacgtgatcccaaggtgagtacacatgtttaccaaacggatggcgctaatgcatgcaacataacaaataccagcaagagctgattgcatcatcgttggcgctcccttgaacgaaacaaacaccaccttagttcgttggattcatttatctctactaactattaagaaggtaacgtagatcaaaacgtgcccctgctcaccttatcatgcggcatgctcatatgtgaaaagtaaagatataaaacttataccaaatgtcgtgttagctactcacagaagtacattatttatctcccatattgtttgatctattttaacctacttatcaatacatatagctatgctatgctagctttgatggatgttcaatttggaaggatgagctgaaccgtgtgcatttgattctttctcgtccttccaaattaggttcttgttgtgttcttagttgcatctgggtaatgaatgattaatcaagttttttcagttaaatctttgactgtgaataaataccaaaacattcagtctatatttagaatataatattagtgttaaggtgatattttggtacacggatttttcatatcatagtgacagttatcgttacatatctatgtttatacaaatttttaattctcgtggcaacgcacgggcatatatctagttattatttatgtttgttctcttttgcggtcattaatatttctttttgataaacttggtttgaccagagatatagaactagattgctagaattgcgtccattttcaacaggaggcggtgttcagtaagcgttgctcgctgcaacttggaagaaacaccaaatgcatgtgaatccgacagttctgca

SEQ ID NO: 6684 - DNA, 852 bp, Zea mays
atttccgttccattcaattcaattctatggagctagccaggcaggatgctacgtatagaacacgacccagcggcaaagacaagacaagaggagatttgctctatatgcaccccatgttgttagatgatgtcacattgttgatgtaactttcaaaacggctttaatccagcatcctaacagcctcaggattgttgaaaaaaaaactaggtcttccactcttcctccactagtctactcggcagatttcactgactctcaccggcggtttttgtgcctccaccggccgccgccatgccgtacctcgtccgcgagcggctctacttcggcggcatcaaagacgccattgccgcactcacggagtcttcctccacgccggacttcacccacgtcctctccgtggtcagctccgcctccatctccttcaatcaccgattgccgcccgggcctcgagatccccaccgaggaggtcctccgcgtagtcgccggcgaggagggggcggaacgaaaatgccgggggtctccacggggacgttgatggcggggtggggggaacgcggcgggccacgggcctggggggtcccggcggatgggccggggccgcttggggaaaacccgaggggggagggccctgtttcagacggcttagagcccgggccttggggttctacgcgaggggggggggagaaagggccggaaaaagggctccgagacagatgggttaggcgcgggggggggcggagggggggccaacgccaacagggggcggcttccgcggtgaagggaagaaacaagaaagtgtccctgaggagggaagagaaggcgggggcgcggggggcggagtcccccgacacg

SEQ ID NO: 6685 - DNA, 2255 bp, Zea mays
gaggagcctcccctgcctctcttcccgctcgctgggccctgcggctcgcagccagcattccgggctccgggtcgccgtgagccgcgggaggtttcgcgcggatctgaggctgcccgggctggggaattcgggttgataccggcgggagtcgggctgagttgatttggcgagtttaggtgtgcggagggaggaattccgggaggaacagttggttggtctgcgagagtttggtggccggtagggtggccgggcgggcgggcgggcgacgtacttgcgccccggaggccgccgtcgctgcttcgggcaagcgatgatcgagcagttcgtcaacttcgtcatccggccgcctcgtgcagagtacaatccagatcagtatttatgggagccagagttcactcttgccggaaggaagtataaaaggctagatttggagcttacgaatgaaagaagtcagaccttaaagtgcagccactatgttcctgctgtcatcccagaaaacacttcccttccatgtgtagtctactgccatgggaatagtggatgcagagcagatgcaaatgaagccgctgtcatacttcttccttcaaatatcaccctttttacacttgactttgcgggatcagggctatcaagtggagattatgtcagccttggttggcatgagaagcaggatctcaaatgtgctgtgtcctttctgcgtaagaataagcaagtttcttgtataggtctttggggacgctcaatgggtgctgttacaagtctgctatatggagcagaagacccctcaattgctggcatggttctggatagtgctttcgctaacttatatgacttaatgatggagcttgtagaagtttacaaaatacgagttcctaagttcacggttaagatggctgttcagtacatgcgatgcgtcattcagagaagagctaaatttgacataatggatcttaatgttgtccagtttgcacccaagacgtttattcctgcactatttggacatgcttcaaatgatatgtttattcagcctcatcacacagaccatattcatcaggcttatgcgggggataaaaatctaatcaaatttgagggtgatcacaattcgccaagaccccagttttattacgactctgtttcaatattcttctacaacgttcttcacccacctcagtttccttcaacctgcacacataaacttgataagtattataaccttggtgcttttaagggtgctgctggtactaatgagagcttattgtatgagatcatcaatggtctacgggcagctggcactgatgcaggaagttcatcagctgctacagctagtttcacgaatgctacaaaatcagtagttgaattgctgacagagagggtaaatcagctatctgttaaaaatgataatgacttggattttcttttggatgaaaaccataaccttactgagatggacggtaacacaggagagtgtcatttagaggataaatcaaacagacaaacagatgaatgctgttcgtataccagctcaaaccgagagagctggggaagatgttcttccttgggtggagctagtgatggattgtcatcaggcgaacagcctgagatacctaatcataagcttaagagcttgacactaagggctctagcaacaccactgagacgggtacgaaggaaacctctcgcgatcccgaaggagaagaatcgatcactgtggaagaggttgaaaaaggagaggcaacagatgggggaaaacatatcccagcgtctgcggttgtgtctccaaggccaggctcgacacaagagaaccaaatcgtcttgacaactgtggatacatatttagctcttggacaaatctgctaggaactcactgatgattcagcaaccgagccgcgccgcaatttggagcttctggcactcagcgccaatggtgccgtgtacattggttgaagattacctagaaatcttagatcatggattgtcccggacccaatgtgttaactgtcagtctttaatgttcgtttcttatgttttttttcaatgtaatcctgtaaaattgaaggctagaactgcccctgtacttgtggttgggggaggggcaccggttcgttgcttttttcaggatttgtgtagggtttggaggtcgagctgtatcgacagaatctcattttctatgttgctcggtaacgtctctgatttgctcgcctcccgtgccgtcggcgacggcgcggccgccggcacgtgcatcgcatattcccatt

SEQ ID NO: 6686 - DNA, 1722 bp, Zea mays
ttctgccctagtgtagtgatggtggtgaacgttgtggtggttactccgtgtaaccaacccccatcaccagctccagcaggatttgccccgcacggcaagcagcggcgtggccggccgaatccccaacccaacctgcgtcggcgcgtgggaatggcgagaaaaaggcggcgaacaggtcactcacgcacaccgaaagcgcagctgcgaggctggtctccgctgttacgtctctgcccgcctctcccccacccctcctctggtccaagtccccccaccgcagcggccaccactccatccgagtctcttcgactccaagccgttccgctccccctgttccgcgcgacgccgatgcaccccaagctgccgcgggccgcgcgcaggctcctctgctgcggcggggccgccgcgtccccggaggaggacctgtctgacgaaggaaggcgatcgttgaggtgggtgttctcgttgagagagcttcgatcagcaacaaacagcttcaattacgataacaagatcggagaagggccacttgggagtgtgtactggggacaagtctgggatggttctcagattgctgtcaagaggttaaataacgcaaagaacggcacagaagccgaatttgcttcagaagtcgagatactgggaagaataagacacaaaaacctcctgagcttccgtggatactgtgcggacggacccgagcgcgttctggtgtatgacttcatggcaaactcaagcctgtatgcacatctccatggaccgcattccgcggagtgtctcctcgactggcggaggcgagcgtctatcgccatgggcaccgctcgggctctcttgtaccttcatcgccacgcaacgcctaagataatccacggaagcgtcaaggccaccaacgtgctgctggattcagacttccgggcgcacgctggcgatttcggtctggcaaggcttattcccgacgacggaacggaccacgaaaagatagccagcagcgagagccagcgaggctaccttgctcccgagtacgccgccatgtccggcaaaccaactgcaggctgcgatgtatacagcttcgggatcatactgctggagcttgcgagcggcagaaggccagtcgagaagtcgggttctggcaaggcttgtggaatccgaagctgggtgctcccgctcgcaaggcagggcaggtacgacgagattgcggactcaaagctgggcgacaagttctctggacctgagctgagaaggatggtgttggtcggtctagcgtgtacacgttcagaacctgaaaagagacccacgatgcttcaagtcgtgccgttgctgaaaggcgagtcgaaagaaacgcttgttaagcttgaaagggaggagttgttcagcccagactcgacgacggtgagttcgcagggaacaccgaccccagatgggagcacggactctgcgccgccgctgaagaaagataaagaactggttggggcgtgagttgcgatatattgctgttctaggagattgtagagtgcgtatttgtggtattgatgattagtctgtgcggtttgacgtgaatgggaattgtataggcattgtttttttctaagttttttttttctgtcccttttgagggagtaaggaagagccggcgggctggagtactctgttgctttgcagctttttggttcattatgcttcgtccaaaaaaaaaaaaaaaaaaaaaaaaaaaaaaagggggcg

SEQ ID NO: 6687 - DNA, 1072 bp, Zea mays
caccactacactcaagggttggcaccgcacggcaagccgcaagcggcggcgtgggccgtgggctgccgaaccccagtccccaatcggcgtcggcgcgtgggaatcgtcagaaaaacgcgacgaacagccgaaccggtcacaccgaaagcgcagttgcgaggctgttctccgctgtcacgtctctgcccgcatgtcccctccccctccaccgtctctctaggctctagtagtctagtcctagtcccccaccggccaccaccaggcaccacgccagccagccccaccactccatccgagtcagagtcttcggctccaagccgccccactgttcctcctcggctccgcgcaccgcgccggcagcgggaggagaggggtcagggtgacgccgatgcaccccaagctgtcgcgggccgcccgcaggctcctctgctgcggcagggccgcctccccggaggacctatctgatgaaggaagtggatcattgaggtgggtgttctcattgagagagcttcgatcagcaacaaacagcttcaattacgataacaagattggagaagggccacttgggagtgtgtattggggacaagtttgggatggttctcagatcgctgtcaagaggttgaagagtgcaaagaatggcacagaagcggaatttgcttcagaagtcgagatattgggaagaataagacacaaaaacctcctgagttttcgtggatattgtgcggatggacccgaacggattctggtgtatgactttatggcaaactcaagtctctatgcacatcttcatggaccacattctgctgagtgtctccttgactggcggaggagaatatctattgccatcaacactgctcgggctctcttgtaccttcaccactatgcaacacctaagataatccatggaagcatcaagaccaccaatgtgttactggattcagacttccaggcacatgttggcgatttcggtctgataaggtttattcctgatggaatggatcatgaaaagattaccagcgaaagccaacgaggctatcttgctcctgagtacattatgttcggcaaaccaact

SEQ ID NO: 6688 - DNA, 1918 bp, Zea mays
caatttaatgatgcccccaacaaagaaagcgttggctatggagaaagtggacgtggcaagcatggagaaaaatctctagctgaatcagtgggatcacttaacattggcattattgattctgagttcatggattcaagtcctctaattcatgataaagaatcatgttttcctctagaacctgagggctccgttaatgaagataattttacagctgtgctttcacaatttaacgatgcccccaacaaagaaagtgaaggctatggagaaagtggatgtggtaagcatggagaaaaatctctagttgaatcagtgggatcacttaacattggcattgttgattctgagttcatggattcaagtcctctaattcatgataaagaatcatgttctcctctagaacctgaggactccgttaatgaagataattttacagctgtgctttcacaatttaacgatgcccccaacaaagaaagtgaagcctatggagaaagtggatgtggtaagcatggagaaaactctctagatgaatcagtgggatcacttaacattggcgttattgattctgagttcatggattcaagtcctctaattcatgataaagaatcatgttctcctctagaacctgaggactccgttaatgaagataattttgcagctgtgctttcacaatatagcgatggccccaacgaaggaaatgaaggatatggagaaagtggacattacaagcatgaagaaaagtctctagatgaatcagtgggatcactaaccattggcattattgattctgagttcatggattcaagtcgtccaattcatgataaagaatcatgttctactggttctgcagctgaccaatgttcaaggactataccggctaaatatgaattaagttcagaagagtcagattccacaggcagtcatttggtgtttgacagtggcaagaattatctggagttgaacaatcattctgtcacagatttggaaaggatttacgatggacatgccacgtctgtagatcaatatgttcggggaaatggggagacattagctgaccatccaaaaaaagaggaagctggcctccaaaaggacactggcaccatagctcaacatcgtgatacccttgcttgtgatggggagtctgtgtgttcgagttgtgaagagccgagacgtggattaaatggcgagccatcagacttcagctcggagtcacactcgagactgaccccaacacataacacaggtggcaaattgtcgatggtttctgaacatccagtgcataatatggagtcagatatgactgggatggcaagtgatagcactaacccggagctgaatcctgaagccagcaccaggaacgaaatggacggctcccgatccactgataacccagtggaaccagaaaacgtagctcaggacagcgccactcgaggaaggcctgaaggcgacgcccccagatcagggaaaggggttctgaggtcggtcgctggaggaatcacccttgtcggcgcagtgttcttcatgttccatctcagtgccgcgctgctgcagaagaagcaaggggggaagctttgcgacggtcataccatctctttcgggaaaatctgctcggagcaacgcaagggccaggaacatgggcagagaaaacgtccctgatgcgtatcccggggggcggctgaaggcttgacaagacgatggagcacagtctgcttcacagaatctggatgaactctgtcgacccaccagtcaagttgaagtcagtaccctgccttctttcatgtacagaacgacataatcatatgatttaggtgatcgattacagcaaatagtgggacagattttgtacaagtatagttgaggcatgaataaagtctagtttccaaccaaaaaaaaaaaaaaaaaaaaactcgagggggggccc

SEQ ID NO: 6689 - DNA, 1679 bp, Zea mays
cctcgaggccggccggggaaccaccgtcatctcattttccttttcacgcccactcactcacccgccgccgccatcccctccttgccgtctccgggcacggcctcgtcgaatcctttgctcctcctccgccgcagccgctgccatggactccacgccggcgcacgaggcggctcccggagcctcctcttccgccaccgccgccgccgaggatctggcgggtggcgtggcggcgatgaccctggatgagcggttcgctctgctgcgggggatcggggaggagtgcatccaggaggacgagctcaggcgcctgctcgagaacaagcccgtccccatctgctacgacggcttcgagccctccggacgcatgcacatcgcccagggcattgtgaagaccatcaacgtcaacaagatggtcagagccgggtgcaaggtgaaaatctggattgccgactggttcgcgcagctcaacaacaagatgggaggcgacctcaagaaaatccagacagtcgggcgctacatgatcgagatttggaaggcggccgggatgaacctcgacggggtggagttcctgtggtcctccgaggagatcaaccggcgcgcccacgagtactggccaatcgtgatggacattgcccggaaaaacaacgtcaaacggataatgagatgctgccaaattatgggcagaagtgaccaggacgacttgactgctgctcagattttctacccttgcatgcaatgtgctgatatatttttcttgaaggctgacatatgccagttggggatggaccaaaggaaggtcaatgtgctagctagggagtactgtgatgacatcaaaaggaagaacaaaccaattattctttcacatcatatgctccctggttttaaagaaggccaggagaaaatgtcaaagagtgacccatcctcggctatctttatggaagatgacgaggcccaagttaatgtgaagataaagcaagcattttgccctcccaaaattgttgaggggaatccttgtttggagtacattaaatacatcgttttcccttggtttggaaggtttgaggtggcccggaaggaaagcaatggcggtaacaagacatttacaagcatggatgaactaatttctgattatgagactggtgctttgcatcctgctgatgtcaaacctgcactggcaaaagcaataaatgaaattttgcagcctgttcgtgatcacttcaacaacaacaacgaagccaaagttctactaaacactgtcaagaagtacagagtaaccagttgaggagcggaaggtgttcatctttagggtgaatgtcgctgattgaaattcttatatgcttattctgttactaatgccaccactcattttagatcaagcattgagccattggttatcagtgtataatctctatgaaggcattttggtggcagtggccttgtctgtcattggctacaacgttctagataaaaaaacatttaaattttgtggaagttgaattatcttctcatgtgtgtatgactgtatgtgagactggttgaaagtgcaagcgacaaggcatatatggccgaggagtttaaaaaaaaaaatacaaaaaaaaaaaaaaacaaacacactctacctacacacaaacaacaaaaaataaaaaaaaaaacccctaaaaaaataaaaataaggggcc

SEQ ID NO: 6690 - DNA, 1496 bp, Zea mays
cctgctctcggcagtctctgcacgacctcgtcgaatcattggctccctcctcctccgccgcttccatggactccacgccggcacccgaggcagcccccggcacgtcctcttcctccccggccgcggccgccgagggtcttgcggggggcgtggcggcaatgaccctggatgagcggttcgaaatgctgcggggcatcggggaggagtgcatccaggaggacgagctcagacgactgcttgagaacaagcccgtacccatctgctacgacggcttcgagccatctggacgcatgcacatcgctcagggcgttgtgaagaccatcaacgtgaacaagatggtcagcgccgggtgcaaggtgaaaatttggatcgccgactggttcgcgcagctcaacaacaagatgggaggcgacctgaagaagatccagacggtagggcgctacatgatcgagatttggaaagcggctgggatgaaccttgacggggtggagttcctgtggtcctccgaggagatcaacaagcgcgcacacgagtactggccaattgtgatggacattgcccggaaaaacaacgtcaaaaggataatgagatgctgccagattatgggcagaagtgaccaggacgacttgactgctgcccagattttttacccttgcatgcaatgtgctgatatatttttcttaaaggctgacatatgccagttggggatggaccaaaggaaggtcaacgtgctagctagggagtactgcgatgacatcaaacggaagaacaaaccaattattctttcccatcatatgctccctggttttaaagaaggccaggagaaaatgtcaaagagtgatccatcctcagctatctttatggaagatgatgaggcccaagttaatgtgaagataaagcaagccttttgccctcccaaaattgttgaggggaatccttgtttggagtatattaaatacattgttttcccttggtttggaagatttgaggtcatccgtaaggaaagcaatggtggtaacaagacatttacatgcatgaatgaactaatttctgattacgagactggtgctttgcatcctgccgatgtcaaacctgcactggcaaaagcaataaatgaaattttgcagcctgttcgtgatcacttcaacaacaacaacgaagccaaagttcttcttaacactgtcaagaagtacagggtaaccaattgaggagtggaagctgtccatctttagggcatgtttacattagggtggatatcgccgtttgaaattcttgtatgctattctgttactagttgcataggtagctcaaaagtttcatgtttctagatatataaaaagaatactttacttgttgactacttgatgtgcatcatagggctcaacctaaacagtgttgcactgtaagtattcgataaaagataaacaaagccaatatccaggagtaaaaaaaaaaaaaaaattgatttaaaaatgtcttttggccatgtccaatgg

SEQ ID NO: 6691 - DNA, 813 bp, Zea mays
aaataatttatattctaaacgctatttagcgcaagcaattaccgagccgagccgagcctctcgggtgggctcgcaatatgaccgagccggctcgcagctgcaccgagccacgtcgaggcgagctgagctgggatcgtttccagccctacccctgttcctaatagttagggcaaacaaactaccggttgacctgcagccggtgcgggtgggattagttggcgttggctactttttcagaacgggacggtctttctgtcggccttgttggagctgttggcggttcaccgtcacggtactcctgctaccttgtcgtgttttcaggtaaagttcaggacccacgtacaagcctttgcgagtgtccgtacgtagcagccgcacacgacattctgctcctttttctttcctgggccgacggacggcccacgatcgtctgaagaagagcaaattccagcccatcgaagggagaacgagcaggcggcgccttttagactgttcccacaaaaaaaaattatgcatgtcctcagaagcaaaagagacacttgctattgccatcgataaactcagcgctctgtagcctttcattccatgtatgtggacgtcgttctttctcgtatcacaaggagtgcttggtttttttttggggttcaagttttattggtgaggtagggagaaactagtggcctttggtatatgatagctattgtagtagtggccactggtggggagagggggcccatcgagcacgatctgtagtgtaataaatgccagagcagacgagtcagctgaaaggagcccagcacggcaacacctgca

SEQ ID NO: 6692 - DNA, 2982 bp, Zea mays
ttttctcaataggaaaacctgaactttgcaaagctgtcttaataggaaaaaaaatctgaactttgcaaaggtgtcaatttatctatcttcgtttaaccagtttaaaggaaaattcgtcaacatgttcaatatcagtttcaataaagtttaaagttggcatcggtctcgaatgctacattattatccatgctgctttgcactcaactccctccctgcaaaagttgcacttttgagttctggcgaacaatctgaattattcttcttgttcagtgaaaagcgaaagccccctcccccaagatcgtatgtgtgtatgaagatgaagaaacgattcccgcgggcgcgctatccggaaggtgaaagaaagccaaacaaaggtgcaaggaggaggagacaagcaatcaaacccagcaagcaacatagaaaatgtgcaacgagcggtagtccttatccctctacgtcaatcgcagggaaaacaatctcaagtcagacaagaacccgcccgcgtcgcaagacacatacatatattctccctcgctctcaaacccttttccactcacgaagagcagagctgttgctagagctggtcgtcttcctcttcctcttcctcctcctgcctcgatctgacgagagctcagccttgccttagtctcgccatcgcagaaggcagaagcactagttcctgacagccacaaaaccaaccaaaggccaagctaccgtgaggcgagggaaagggaagaaagatcacatatcgcctattcgcctacctctgcgtgcatcagaagatgatccccttcataaagatgaaacattcccattccctccactagaagctccgggaggacgcagcaagctcaccgaagccagcaaccgatggatcagaggcgcgtcacagcgaggttcggcagcaagacgagctcggagcggaggatgctgcggcgcgtgaggctccccttctggtcctgccctccaaaccggcctccaggcacctgagcgcctcgaatcctcgatagaacagctggtctcgtgctcccctcccccctgtctctctactctgactttctttctttctttctccgctccgctccccgtgcccctcctgctccttggaccctgcctgttctgtcagtcagtctccctccctagaacggcatggctctgcgttttgtgtgatctcgtcgcgagcctgtccgccggtgccggtgcctcaatccccttgggagaagcaagggctcctgtctggtccgtgttcttgggaaccagggccttggtactgctgctgccgcgtgcttcactgcttcctggctgctccgatcctctcgtctcgtgtgtgaaagaaacattccggaggcgcgtgtccttggcccgttgtgcccgcaacttgctggatgcaagagctgccctgtccctgccccgagcccctgtttccatcggaaaaggcaacagctcttgcctgcttggcacctgccgagtaattcgttatatatacagtgctcccacgaggccacgaagcactagttggcagctgctgcgctgttatgttcttgtgcctcgtggatcgtcgccgtcggcctcgaagctttccacgacgaaatggacgacataggctccgtccccttcgccgacgccgggctcctcgacgggttctacggcggtagccatggacatggtggtgactacgggctgcttgctagccagctgggagcgggagcgggagcgtcgtcgacgtcgcctgccatcttggacggcagcgtgccgctggtcgacgccgcggcctccgcggaggaggcgacgaggaggaagggagaccacctccaggacgacaaggcggcgatggcgctcaagagccacagcgaggcggagcggcgccggagggagaggatcaacgcgcacctcgccacgctccggaccatggtgccctgctccgacaaggtcagtgcctctgtctccttgtcctgtagcttgtcggtagtaacttgtcccagtgcacgcatgggcgttctaggcgccgacgcggtggcggcggggggtcggttgcaccagcgcgccgggctcgggctaccggtccactgccggcgaggatgacgcggcttggcagtgcagcaaacttggtcaccgactcagcgttgaaactgggccgaaacccagtcgaggaaaggcccaacaatatctggctctagctaggcccaatttctaacctttattgccagatagcatagtccataccgagcccaacctaaacctgaagcccaactctgtgactggcatctgcatgcagatggacaaggccgcggtgctggcggaggtgataacccacgtgaagaagcttaagtccaccgcggcgcacatccgagaccgctgcgccgccgtcccggccgacgcggacgacgtcgtcgtcgagctggtccatggcggcgcggcgccgccgtcggccggaggcggcgtcctcgtcagggcgacgctcagctgcgacgacggcgcagacgtgttcgcggacgtcaggcacgcgctgcggccgctgcggctcagcgtcgtcggctccgaggtcaccacgctgggcggccgcgtccgcttcaccttcctcatcacatcgtcgacgtgcggcgacgtgggcgccgtcgtcgtcgactcggtgcgccaggcgctccagtccgtcctcgacagggccaactctgcgctggagttcgcgccgagggcgtcgcttctcaacaagcgcaggagggtgtccacgttcgagtcctccagctcctcttctgcttgacgccgatcagatgattgattcagagaagacgaagacgaagacgtacgtgcaagcaacatgcatcatgtacctttgttatactgtgtcatgtgttgctgctgcaaacggcagaccctatgtatcaaaaaaaaaaagaacctgtacacatatacggaggcatcgaggggtgtctacgtaggaataggattgcaggaacagtaacataatccaacggtggtctctat

SEQ ID NO: 6693 - DNA, 3664 bp, Zea mays
atcataattgtttccatcaaagtgcggtggcttcccaatgtgcacattgttgttactagccatattgtcccactccgggatgattagatccacaaacaatggagtcctcggctccgataccacttgtagggtcgagatggcggactagagggggggtgaatagtcctttctaaaaataaaaccaagacagaactactcgagttctgtccaaacaccagtccttcaactacggacggtccgccacctgggaccagacggtccgcagtacaaaaacttcatgaaacacagaaactccgcgtttctaaccatcatctcaagttagacctgcggacggtccgccatgctggcccggacggtccgcggtacctcaattcaacccacattcaagaaatcgcttttgaataagtttttatttcacgaaccaaagcgttgttagccctcatgcaaatgcaccaactatatgagcaatgaggcactaaagacatgtcaagtaagataattgacccctcttgatagtacggctatctagcctactaacccggtcaattatcaacctctaagcaccttttgaccggtaaaacaaaaacctattgttatacctttgccttgagcattcaattccatctccttaaatgatgaacaatgggcatccataagtgtagccaaccatgataccttttaccatttgtccatagcatgaagttcctccaccatcatcatcaagccacttgatcaatagcccagatcaacacatggcttgataattctataatgatatgatccactccatgttatcacatggccttcttggttcatcaatctcaacatagcttgctcttcaccattgctttatgtccatcggtgctaagtccttgctcttgcttcaccgccacgcggtccctcacacatgagcctttgacttgcccttcacactagccacttggtccatcgaagccaagccatatctcttgatcttctccatatagccacatgacaccatgtcatgtcttcatatgcaatgagctcctttatcacactagttgagcatctcaatatcaccaagccacatcaccaccatggctaaaataactcacactagtgtacctgtggactaatcacctgtgtatctcaacataaacacttattagtccatataagttgtcaatcaattaccaaaaccaaacagggtctcacaatctccccctttttggtaattgatgacaactctacaaagatttgtcgtttttgttctttttccaagctagcttttcacacaagtgtaaattgctagtttggcaaagttcttatgttccttatccaactttaagctcatttgttaagatttggataagcgccataaaaacggtttggtagtgatatcctcgcctacatgtgtgcttggatggtttggtttcaagcttacacacatgcaaagatatgaaaattgaggggacattatcactaccacatgatgctaaagtatacaaaatagaaatgtacctttgtagcgtgtttactacttttcatttcttccttagcatcatcttgctagaaacaagtgaaactagataccacatgagattataataaataggattctagttactcctttcacactaagactaggcttataaatatcactaaatcaatcatcatccaagtcttagttctagcaaccacttacacacaagtatgtaggaatataagacaaatgtgatgcaagcaagcaatgtagtgcacaaacaaatgcatcaaacatatattcacgagcttgctccccctacttgtgtgcatctcttgttcaataaaatctcataccattatactttgctcttgatccattcgtattcattctaactcaattgatcaatagctccccctgagttcatgtccaattttctcttgtgcatatttccatatctttgttccaacttgcacatttacatatctttgttccaacttctccccctttgtcattaattaccataaaagggttgttctaaggctctgggaaaatgtacttgtgaatattataccaacttgaaagtactcaataagtttttgatggacaccatatgcatgataaaatccttgacatcacttgcatgaacttattttaggagagagttgctctcttgagttgatgatcacttaaggttgtggatcacttgaagtcttgtaccactcaaaggatatcaattgtatgattgatctagaaaccacttagtgaataccaattgaaggaataatattggcttggacatttctctgtagatattgatgccacttgaaggttttgatattcatttgcattggtatcttcttcataagtcatcctcatgagcagctcaatatgtgacttaaccaaatagatttgcttaagcttccaagttcgggttgaaccctctttaagcttcttcacacgcattacgcggttatcttatcgaggttgttcttgtagcttgttgcaatccaaaataaattaagtacatgggttcactttgctcatgaacaaactcatatgctaccactagtttcaatcaacaaaaataaccaatagtggtagaacatgaatttaaatctttcatttaatatgcatgatactattaagtatgtactatatgcactaaccgcatactagtagggatgatatgatcatgcacatcacaatgatacctttgctatgttggagtagagaatagtcaagattcttttgatttagctctccaatagcaatgtgaagtccaattgaatagcttgctgaagaccaattatcaataagaaatccattcttcaccagtatgaagttgagaacccatttaagatcaagtgcacaatttgaacgttgtagttcacatgcatttgttccttcaataccacttgtatgtgacagaattatgaatttgcacggaatataggaatatcacttgtaaggatgataccacttgttgagatattggtccagaaaattcctttgtttatgcaagactgctactcacggacggtccgcagtgggagctcggacggtccgtgtcctgatctctcggactgtccgtggcctaggaccggacggtccgagacctggaacttgcactccattgagctgtctgttaatttctcagatagttgaattttaaaataggatcattgctcatttatgaactttatgactgcaccaagcattagcattcaaccatatataaataatttgcatgaaagcacatgatttgagtataagtgatcatgaattgatgtcaaaccagaaatacttggaaaatactcaaaatcaatccatgtttgaaacatcaatcatatatgcttgatttgcctttgaatgtgttgcttgttctctttcctgatcaatcttttgattgctccaaataagtaccactttgcctctagcaatccttttcttactttttggtgaggagtaaccaatttgaacatatggaatctcttttcactgaatttcatgaacaagctcaaaagagatgtcgttagtaatacacacaccgctttcccttttataacactttgaatatataaagtaggcagttacttaaacaaggaaaccttattatatgaactaaaattctcttaatcttcaatgcttaattttaacaaattaaacatgcatgataaattgattaagttcaaaggctaa

SEQ ID NO: 6694 - DNA, 2318 bp, Zea mays
ctcgaggccggccgggaggtcatctatctccctctttgccatccggcccatccccagcctgtgtttgcatcccatttgcttcccccccctcttgcccatcccctgtgctgtgctgtgaactgcggccgggggcatccttgttggggggtggcgtaggaggctgctgacactactgcagagcagggcagccatgaggcttcctctccctctgctggccctggtgtgctgcgccctgatggcgcgccagcattgcgctgcggcgggcaaggcccggcacttgaggtgggagatcagcaacatgttctggtctcccgactgcgaggagaaggtggtgatcggcatcaacgggcagttcccgggcccgacgatccgcgcccgggctggcgacaccgtccacgtccagctcaggaacgcgctccacaccgagggcgtcgtcatccactggcacggcatccgacagatcgggacgccgtgggcggacggcacggcggcgatctcccagtgcgccatcaaccccgaggaaaccttcacctaccgcttcgtcgtcgacaagccggggacgtacttctaccacgggcactacgggatgcagagggcggcggggctgtacgggtcgctggtcgtggacgtggcggagggggaggaggagccgttccagtacgacggcgagctcaacctgctgctcagcgactggtaccacgagagcatccacacccagatggtcgccctctcgtccaggcccttcaggtggatcggcgagccacagtctctgctgatcaacgggagaggccagttcaactgctcgctggccgcagcgcacacgcagggggccaccaaccagtgcgccgccaccgccgccaacacgcagtgcgcgccggtggtactccccgtgcagcctaacaagacctacaggctcagggtggccagcaccacctcgctcgcgtctctcaacctcgcgatcgggaatcacaagctgacggtggtggaggccgacggcaactacgtggacccgttcgttgtggacgacatcgacctctactccggcgacagctactccgtcctgctcacgacggaccaggacacgtcctcgaactactggctcagcgtgggcgtgcgcggcaggctgcccaagacggcgccggcgctggcagtgctcaactaccgccccaaccgcgcgtcggacctgccagccctcgcgccgccggtcaccccggcgtgggacgactacggccacagcaaggcgttcacgtacaggatccgcgcgcgcgccgggacgcccccgccgccgccgacggcggcccgccgcatcgagctgctcaacacgcagaaccggatggacgggcgcatcaggtggtccatcaacaacgtgtccatggttctgcccgccacgccgtacctgggctccctgaagatggggctcaagtcgacgctggcggcggcgcgccccgcggagacgttcagccgggaatacgacgtgacgctgccgccgccgaaccccaacacgacggtgggggacaacgtgtacgtcctggcgcacaacaccaccgtcgacgtcctgctccagaacgccaacgcgctgtcgcgcaacgtcagcgaggtgcacccgtggcacctccacggccacgacttctgggtgctgggctacggcgacggcgcgtaccgcggggacgccgccgacgaagcgcggctcaacctccgggacccgccgctgcggaacacggcggtcatctttccgtacgggtggacgatgctccggttcgtggcggacaacccgggcgtgtgggccttccactgccatatcgagccgcacctccacatgggcatgggcgtcatcttcgctgaggctgtggacctcgtcgccaaggtgcccaacgaggctgtatcctgtggcgccacggccaccgcgctcatggccggcggtcacctgtgattgccatcaaatattggtggccaggctagggaaccgcgcgccttgcctcgcgcgcatgcatattaatgcccttctgtcgtacgagatctctggtcattaattagtgttatttattaatatttcttctatctcttttttccgtttattgagacgtgaacctagagtgtttgtgcttggctaaccatcccatcttagataggttgttgcatcgtaagccaattccttaaattaatgaaaatgcctttttctcaggtgttgagagaccacctctattccacaattgaaacaaaaatttaaggcctgagaaagtgatggactattctataccaaaaaaaacaaactcctaagtgatatatactattcgaaggaggtcagacattttgcttct

SEQ ID NO: 6695 - DNA, 2446 bp, Zea mays
  misc_feature (291)..(291): n is a, c, g, or t
aacttgtggagtggactagtgagagctctgataaatttatatgaacttttaaattgccatgtatttttattttaattattgtgcaatctataatttttaatttaataaaaaatattatgctatgtgatttctgagcgttgaaataaatctatgtgaattacttaattataaaatagaaaagttgatgtggttatagtctaagacaatagcgctcgtgttctagagcaacaatgacgagagtggagtcagagagtggcaacaacgagagcggttgggggcgttggctccagnctcatgaacagtacagtcgccctgattgaaggtgtgagtctagtcttcttagtttttttttaattctccagtcccactacttgcacctcgcactttactctttctcatctctcgcagctagcttcgagctcgctgaacaagtgaagccatagcgggagcagctacaacgaagtgatcctccatgggcaacaccttcggcttccgtggtggcctccgcgccgacgtcgccgatctgatgcaggttcggatccacgtcgttactgacaaaaaactgccagcaacatagaacaatgttctttctgtctttgcccctcttgtgtccctacggtgtacgtgcttgttcatacgctgccggctgcagctcctggaggttttaattccaagcgtcttccctctttttgctagggaacaaaacaataatgacatttaagttacagtagtgaattccatgtgtcttcccatggcaagagattcgtcttcttttttttcccctaaaaagacaggagattgttcgatctttctcaacaataaactgatgagacgaggacgaggatcctgctggaccaatctgttgtttccagtctgagtgatcgagtgtttttggcaggatgctggcgaacacctgaggagcagtggggtgttcgtcaagagagcggtggcttctcagtaccaaagcaagtgagatgctgctgctctctgtactgtttcttcgtcagagaacaaacccattgatgaaccgcgaaacatctcgccgctccgtcgattcggctctactgtccccgtggccacagactcacttctctgtctacctgttcgtagccgcaccgggaacgacgaaatcgacgagtcgtccgccgaggagctgcgcgacgcggcgagctacgtgcagcacaacgcgatgctgatccaggtgccggtggtagggacagcgaggacgttctggcggctatcggacgaagccacgaggatgatcaggaagctcgcgttgatcctgaggaaccaccactccgtctgcaagtgcctcgccgctcctctgcaggcgtccaacgtctgggtcgggagcgctgggaacgccaagctaaggggggcgaggttcaccgacaaaggcttcagcgtcgagcgcgtgagggaggactacaggaacctgtccagggtgctccagcagctgatcagtatctctggtggggataccagcaaactgcctccggattacatagattttctctcgctcttgacggaggacaaccttacaaacaaggatgagttcttggttgtaaaccatgctgctctgctgcctctgaaaaaccggtacctttttttttaactcagtttcattgtcttcttcatgttgttgttgttgctgctgctgctgcaggctcatttgggttagttgtggtcacagcaccgaggccttcctgatgctatacgacaggatcgtcaagtacctcggcaaaagaaaccgagcgaagatgaacaggatactctcctgcctcccctaccaggacgactggctggacaccgcgacggcgaatgccaagatcaaccagtggattgtgaatgtccagaatacaaaggagtacaggaagactacactcgatctcctgcggctcaacagaaacgtgagaagccacttgcacgagtacggccacgacgacgacgtcgaggagatcctgtactgtgagtggcccatgctgctcgtcgtcatggagaagatgttgcaccgggaaggcgagctccaagacacggacatcgagaacaagttcggctagccgctagccggtctacactgcaaaacagatgagatggaaggtgtgttctgcgtttcctggggttggaaatggtgagctactgttcttcgatcttctgtgagaatgttcatggtgatggagtgacacgctaccggtacctggtttgctttatgtaataggctacctgctttctcttgtcccttcaacttggaaaaggcaacgccagtcagcttcataaactgtggtctaaaacatcgccttaaaactttaaaatctttatgctgtaaagtcgtcttgtcattgagtttgcattcatcctttaatctctgattcttgtaaaaaaaactctattgcaccagttgggaacctcctttaaaaagtttttctaaagaaaaaaaaaaaaaaaa

SEQ ID NO: 6696 - DNA, 1469 bp, Zea mays
cggccggggtccactacttgcacctcgcactttactctttctcatctctcgcagctagcttcgagctcgctgaacaagtgaagccatagcgggagcagctacaacgaagtgatcctccatgggcaacaccttcggcttccgtggtggcctccgcgccgacgtcgccgatctgatgcaggatgctggcgaacacctgaggagcagtggggtgttcgtcaagagagcggtggcttctcagtaccaaagcaaccgcaccgggaacgacgaaatcgacgagtcgtccgccgaggagctgcgcgacgcggcgagctacgtgcagcacaacgcgatgctgatccaggtgccggtggtagggacagcgaggacgttcttgcggctatcggacgaagccacgaggatgatcaggaagctcgcgttgatcctgaggaaccaccactccgtctgcaagtgcctcgccgctcctctgcaggcgtccaacgtctgggtcgggagcgctgggaacgccaagctaaggggggcgaggttcaccgacaaaggcttcagcgtcgagcgcgtgagggaggactacaggaacctgttctgggtgctccagcagctgatcagtatctctggtggggataccagcaaactgcctccggattacatagattttctctcgctcttgacggaggacaaccttacaaacaaggatgagttcttggttgtaaaccatgctgctctgctgcctctgaaaaaccgcaccgaggccttcctgatgctatacgacaggatcgtcaagtacctcggcaaaagaaaccgagcgaagatgaacaggatactctcctgcctcccctaccaggacgactggctggacaccgcgacggcgaatgccaagatcaaccagtggattgtgaatgtccagaatacaaaggagtacaggaagactacattcgatctcctgcggctcaacagaaacgtgagaagccacttgcacgagtacggccacgacgacgacgtcgaggagatcctgtactgtgagtggcccatgctgctcgtcgtcatggagaagatgttgcacctggaaggcgagctccaagacacggacatcgagaacaagttcggctagccgctagccggtctactgcaaaacagatgagatggaaggtgtgttctgcgtttcctggggttggaaatggtgagctactgttcttcgatcttctgtgagaatgttcatggtgatggagtgacacgctaccggtacctggtttgctttatgtaataggctacctgctttctcttgtcccttcaacttggaaaaggcaacgccagtcagcttcataaactgtggtctaaaacatcgccttaaaactttaaaatctttatgctgtaaagtcgtcttgtcattgagtttgcattcatcctttaatctctgattcttgtaaaaaaaactctattgcaccagttgggaacctcctttaaaaagtttttct

SEQ ID NO: 6697 - DNA, 870 bp, Zea mays
  misc_feature (869)..(869): n is a, c, g, or t
atccttctgactcgtccctggcctggtggtgcgagatctttccttctttcccacgctccaagaaagaaaaccagaggcgccccccgttagccaattccgtttgtttccgacggcggcaggaaaaacaaaaaaaacaagaccagactgagggctcctctcccgttccgatcgccaattcgtcttccaccgcctgcaacccttcttcccttctccgtcatcgtgacggcatcacgcgcgcgctctcctctcccacgagtccgtcagcctgctaagtcttaagatggcgtcaagcaatggtcagacagaagctccagcaccatctgtccccaaaaatcccgctatggcatcatgccggaagaagaaaacagatgatgctaccttccttgaagatctgaaagaccacatggatgagttcattcatgcctctatggatgagcacaagacctgctttaagaagacaattcagaagatgtttgggatgtcgaaggctgttgcagagagatccgcggaagcaaacaaagctgaagttgaaagtgctttgccacttcagaccagtgtctcgcagtagaatttcatgttggtagtttcttgctcgtgccaatagttttataagggtttttgttgctgtgttttctgaaacgcataagcgtgtcagtagcatgttttcataaccggattgtagtgcttcattatctatagttttctgtacgtgtaaaatagaccagcgtaacagcgtagtttgcttcattctccgaagtcttgtatggctgtacacccaggcatctgggcatcatgaacccaactgattggctaaatgaaataaatctcctccatccaacagcaaccacaaaaaaaaaaaaatttgcggnc

SEQ ID NO: 6698 - DNA, 829 bp, Zea mays
aagcaggggtccccgcgcccggcccgcaattccgtttgtttccgacggcacaaggaaaaaaaaagaccagactgagggctcctctcccgttccgatcgccaattcgccttccaccgcctgcaaccctttcttcccttctcggtcatcgtgacggcatcacgcgcgcgctctcctcttccacgagtccgtcagcctgctaagtcttaagatggcgtcaagcaatggtcagacagaagctccagcaccatctgtccccaaaaatcctgctatggcatcatgccggaagaagaaaacagatgatgctaccttccttgaagatctgaaagaccacatggatgagttcattcacgcctccatggatgagcacaagagctgctttaagaagacaattcagaagatgtttgggatgtcgaaggctgttgcagagagatccgcggcggaagcaaacaaagctgaagttgaaagtgctttgccacttcagaccagtgtctcgcagtagaatttcatgcagtagaatttcatgttggtagtttcttgctcgtgccaatagttttatataagggtttttgttgctgtgttttctgaaacgcataagcgtgtcagtagcatgttttcataaccggattgtagtgcttcattatctatagttttctgtacgtgtaaaatagaccagcgtaacagcgtagtttgcttcattctccgaagtattgtatggctgtacacccaggcatctgggcatcatgaacccaactgattggctaaatgaaataaatctcctccatccaacagcaaaaaaaaaaaaaaaaaggcgcccccgtataaagagctc

SEQ ID NO: 6699 - DNA, 761 bp, Zea mays
  misc_feature (734)..(734): n is a, c, g, or t
  misc_feature (752)..(752): n is a, c, g, or t
gccggccgggctcggctcccccaaattcgtttgtttcccacggcgcaagaaagaaacaagggtacaagaacagcccgctaaaggaaagaaacaagggctacacaagaacagcttgagagctcctctccgatcccgacccaccgcctgcaactcttcttctctcctacgtgttcgtcagcccgctaagtgttaagatggcttcaagcgatggtcagacagaagctgcggccccatctgtccccaaaaaccctgctatggcatcatgccggaagaagaaaacagatgatgctaccttcctcgaagatctgaaagaccacatcgatgagttcatccatgcctccatggatgagcacaagacctgctttaagaagacgatccagaagatgtttgggatgtcgaaggctgttgcagagagatccgcggcagaagcgaaggaagctggagttgaaagtgctttgccacttcagaccagtgtctcgcagtagaatttcacgttggtagtttcttgcttgacgccggcctttttttatacaagggttttgttgctctgtgttgtctgaaacgtataagcgtctcagtggcatgttttcataactgtattgtagtgctttcatcattctccgaagtttgttgtgtgagtatgccttaaatataccagtgtagtttgcttcattctccgatgccttgtatggccgtagacccccatgcatatggacatcctgaacccacctgtnaactcattgagcggttcntgattggct

SEQ ID NO: 6700 - DNA, 2329 bp, Zea mays
  misc_feature (5)..(5): n is a, c, g, or t
  misc_feature (25)..(25): n is a, c, g, or t
ctttngactacattttggggtgttngcagatattcttatggaagacgtcttgaatggctcacagatggtgttagcatgctaacttccttatcgcttgaggaatcctgtgagaacgatcgcggccgcgtcgacctgtgaaggaactgcagttacagcacagaaacattatttagatagcaacacaactgatgtggataaatcatctgaatctagcaatggagtttcgtcaacggagctgtctgatactgacagcagttctgggtgtagagaaaaccagcttgactttgtttctaaagaacaacagcaaaatagttcttgtgataaagaacagagtaattttaaaagagaaatagtcacttgttctgatgcttccgaagtgtctgatcattttgttccagaagatacatcatttgatcagtctggagttaagcaccatgaacttcattctgcaccaagtatcccggatgaatctggtgcaaggaactgtgatgattccccgaagggaaatgtggatgatgaggagctggatctcttcattacagatactattgtaccacttatgcgatctcgcctttgtgtaagattgtgaatcatctccaaggtcacagggttctccttctgaaggcagaaatttcgacacccgaggatcggattcagaggagccatcttccatcggtcatggagacttagttaaacacaacaacatactgcagtgggcccaggcaaaaaaatatggttctttgcaagttgtctgtcaatactaccagttacagtgtcctgctaggggttcaacacttgcttttcatcccttggagcatttgcattctttgagttttcaccggcctggtgaaacagttcttcacattgctggttctactattgagcttaggtcacgtgatacaagcttagaggttgctgagatgcgcaatgcactctttgctgaggaggaatcgactgctttgtccacatgggcagtggcatccatttgtggatgcctcaggttggaacatgtaatgacactttttgctgccgcactcctggagaaacagattgttattgtctgttctaatctgggaatgttatcggcttcagttttgtccatcttacctctaatacgaccgtatcagtggcagagtctcctcatgacggttttgcctaatgacatgatggattttctggatgccccagttccatacatagtgggcgtacaaaacaagacatctgatgtgctcaaccggctaacaaatgccgtagtcattgatgccaacaggaatcagattaagtcctcttcagtcccacaactaccacagcacagagagttgctttctgccttgcgcccgtatcattcaatacttgttggcgaaagttatcttgcaagaaaacgccctgtttatgaatgcacagatgcccaggtggaaggggctaaaggtttcttggcagtgcttagagactaccttgacacactatgctcgaacttgagatctcatacaattaccaatgtgcaatctaacaatgacaaggtttccttacttttaaaagagagctttattggttctttcccaagccgggataggccttttatgaagctttttgtggacacccagttgttctcagtacatacagacctagttctctctttttatcagaaggactaagtgtctggcagacttgaatgtctgcctcgtcttgccaagcctttagatgttgagctaaactgtacatatcggcagctcagtgtttgtgcaaagagctcgaaggagaagccatataccgtcagaaaaaagtggtagattgccaggatccagttatgggtattgaagaagaatgcttgtagctgcttaagttagtctggtgcggtaatccaaggttttgttggctgtagttggtgcccccataagaagccttgtatggattgttcctgcaaatgcctgtgctgtaacggaaccgtgtctgtggcaaaatctccgaacatgaatgcgtccatttggcaaatctaagcgtgcaatgagacatcgaaaaaaatgtaataattcgtggtactccctccaggccgaatcagttgacgctatggtatttaataacggtcgagctttcttattttaaactagatttgtagaaatattaacaatatttgtattattagaaaagtttattactaaaacagattcagagatttatataacaatactagttatgtgctttgagacagtgaaataggggaatgattgattattgagagcaagtctcagtacatataggcaaggaaatgtccactataataggaagcagcccgatcagacagatcggtgtttaatacaatcgactaacc

SEQ ID NO: 6701 - DNA, 840 bp, Zea mays
tgggtccctcgaggccggccgggcgggattcattaccggaagagaaaaaagtaactcggaaaagaaggagacgccgaaaattcgaaaggggaggggaaagcaaagctgatggcggaggcccaggggaaagcaaagcaaatggcggaggccccgagcaagatcgaatccatgaggaagtgggtcgtcgagcacaagctccgagccgtaggttgcctctggctaggtgggatcagcagttcgatcgcctacaactggtcgcggcccaatatgaagcctagcgtcaagatcatccacgcaaggttgcatgctcaagctctaaccctggctgcattagttggttctgcatgcgtggagtactatgaccagaagtatggttcttctgggccaaaggtggacaaatacacaagccaatacctggcccattcgcataaagattaaaggtcgccatgttggttcctgcatgccggattaattttgggctcatctcgggttgctcatgacccgcccatggatgctggatgtttattctttttttgtcttcataattacaaaatggtggtgtacttgccaggcaaatgttaatgagggtataatgcagatattgtcgtcataatttggcctcatgttgcattatctaacctcactttgttgactgtcagcgactcagcgtctctgatttttttattattttttgagaaaaggaaaagaaatcccggtttgtgcctaaaatttgagttctatgtgccccgtgtaacttctgttctgtgttcctgtgcttgtatgaatacaagggaaatgcaaaaatgtttttaagtcgaaaggcccctagggaccgcggcc

SEQ ID NO: 6702 - DNA, 755 bp, Zea mays
gtcgctggggccctcgaggccggccggggtctcagccaaaaaaaaaagaataaatcggaaaagcaagagacgccgaaaattcgaagggggaagaggagaagaggggaaagaagcaaatggcggagtccccgagcaagatcgaatccatgaggaagtgggtcgtcgagcacaagctccgagccgtaggttgcctctggctaggtgggatcagcagttcgatcgcatacaactggtcgcggcccaatatgaagactagcgtcaagatcatccacgcaaggttgcatgcgcaggctctaaccctagctgcattagttggttctgcatgcgtggagtactacgaccagaagtatggttcttctgggccaaaggtggacaagtacacaagccaatatctggcccattcgcataaagattaaggtccccatgttggttcatctcttggtgctcatgacccgcccgtggatgctggatgtttattctttttgtcttcttactttaaaaatggtgtacttgccagagaaatgataatgggggatataatgcagatattatcatcataatttagcgttatgttgcattgtctaaccgctctgttgactctcagcatcttcgaatattctttttatattttttgagaaaaggaaagaagatcctgatttgttgttagattattgtgtgtattagtgatgtaacgggccttggtctagcccaggtactcttatagatgaatgcactaacaaattgctgtgctacag

SEQ ID NO: 6703 - DNA, 2360 bp, Zea mays
ttgggtacctcgaggccggccgggaacggtccctgatttttttgcaacctctgtcctaaacgcagccggtggccgcagccggtaactatcactcgcccctcctcaatcctcctccggtcggaaccctagcccttcctgccagcggtgggcggcgcttggccatgtacccgtcaggggccatggtgggggcggcgcccgcggcgcgcccgagcgcgtcgtcgcgggtggagaaggccacgagccacctgctcatggggcccgactgggccgtcaacctcgaaatctgcgacatcctcaacgccgacgtatggcaaacaaaggatgtggtgaaggcagtgaaaaagagattgcagaacaaggacccaaaggttcagttttttgctttaacgcttttggagacaatgatgaagaactgtggtgaatatgttcagtttgaagttgctgaacaacatgttctgcaagaaatggttaaaattatccagaagaagaatgatatgcaggtaagggacaaaatattattgcttttggactcctggcaagaggcatttggaggacctggaagtaaatacccacaatatcattgggcataccttgaagtaaagacgacaggtgtggtgttcccaaaacgtcctatggatgccccaccaatatttactcctccagctacacataattctgagacctatggttcacccagatattctgcgggaagtctaagtgacagaatgtcctcagatgttgagactctgagtttaggagatttgaataagattcgaaatgtgacagacctactgaatgatatggtgtatgctttaaacccatctgatcgaatggctattaacgatgaaattatcacagatcttgtgacccagtgtcgctcaaatcaacaaaagcttctgcagtttgtcagttcatcagggaacgaacagttactaaagcaaggactggagacaaatgatctcttacaaagcgtactttcaaagtatgatgctgtggcctctggtgctcctttggcggttgaagcatctgtgagagaggcaatcgaggctcctgcagtaaagtcatatgcaccccctgaacataatgataatgttaacgaagaggaagatgagtttgcccagctagctcaaaggaaaaacaaatccgtcgtaagtagtagcgacgatgcatcatccagcactttgggggaccttgcccttgtacccattgatcaagcagtttcagaatcgccatcttctgttgcaagcaatgcgctggttcttcttgatcctgctcccagtactagcactgaatcaaaagagctggacatgatcgaccttctaagcctcaccttgtgcagccctactcctgaaacttcaacagattcttcagcacaggatcaaaatggaccccagcaacctgcagttacacataatcaaaaagggcttcaggaacctacagttacaaatgggcaacaatatccttctagtgtgccacagtatccttcaaactaccagcctcacactgcaaaccaggcatatgctccacagaccagcaactatgtggcaccttgggcccagaccggagcatatccacctcagcctccggcatatgcatctggctatgcctaccctgcaccgccatgggtggcgcctacacatcctgttgattctaacccttttctttcggtcaattaccaagatccacgccctgctgccacttctgttgctcaaacagcaacatatgcacctcccccagcttcatatcccccttcaatatcttatgcacagtttgcaaccccccagtcaattcagcatagcaattctgtggcttcaccgagcaatggtcagattgcaaatcaagcacaaatgaatgtgaatcaacaaccaaaagattcttcggcagcatctagcagaccatactacatacctgataatctattcagtgatttgatcgatgcaaaaagttttggcggtggaaacaagatgggcgggcccactacaatgggtagctcaaatggtggccagcctatgattggtggaaagaaatagggttatttgtctatatatatacagctgatggtgatcggtagctgccttgttatttattatgattactttgtctggtgtacatttgtacttgtatatcgccattcccccttttgacagatttggctgcattggttgattcgtgggtgcaactgttaagtttaacagagatatggacaattgctcatgtacataaatgattagcatttgctccactgaggtggatggttgtgatgaaatctgttggtatcgaaaaaaaaaaaaaaaaagggcggccgccgactagtgagctcgtcgacccgggaattaattccggaccggtacctgcaggcg

SEQ ID NO: 6704 - DNA, 1756 bp, Zea mays
  misc_feature (1176)..(1176): n is a, c, g, or t
  misc_feature (1179)..(1179): n is a, c, g, or t
atccgtaatctctcctgcagataaacaccctatcaacgcaaatccccagctcttccaacctctcctctccctccccatcagcgcacagatctatcgatcactacggttccatctcgcacccaactaggcctccgattattccgatcgccagcggatcagatttatgcagtcttactgccgccagctccagccatgccgcgcggcagcagcttggaccagagcctgagcgacgaggagcggtcggcaggtactggggcggtttggatccggcgtcgccggcaatgtccgggatgtccgactccgcgggcggcgggcgcgcgggcgcagagctgatggtggagcagttccacctcaaggtgctccacgccgtcctcgccgtgcgcacgccgcgcccgctcgccaccgccgccgctgccgcgtcgtcgtcgtcgtcgttcaggcggagggacaggtgattccatctcccgctccacgacccgccgccgcccgaggcggccggtcgcctcgacgagctggcccccggggagccgcgtgtggtggacgtcctcctgtgtcctgccaccgccagtggtgtgggagcccgaggggaggtggtggagaggtggaccgtggcgtgcgagccctggccagacgccgcgagcggcgaggaggttgccgtgaaccgggcgtacaagcactgcttcacgctgctcaggtccgtttacgccgcgctccgcgtcctcccggcctaccgcgtcttccgcctcctctgcgccaacgcctcctacaactatgagatgggacaccacgttgacaccttcgccgagcccttctcgcgccctcaggaggccgccatgcgttcccaacgcttcgttcccgtcgaaacccagctcggtcgcctcgtcgtttccggccactacctccccagcctcgccggcgtcgccgccttcaacctcgagatcacccccctttcgccctccatgataatcccagactacgtcggcagcccagccgctgagcccatgcgcaccttcccggcctcgcttacagaagccacgggctccggcttcccaccgtcctatgagcagcagcgtccacacagctgggctgcgcctgcgttctggccgcacacgccggcacaccaggccaggttctcgccacctccagtgttctatgcgtcaccgacgccatcgcctnccnactttccgcccggcctcatgaggtgggagtctgcgccaatgcccataccacaggtgagcgagaggaggagccccccacacctccagaatatgctgccaccgccttcgccgagaagagcagacacgggggcagcaggcgctctagagtttccatctgagagtggccggctgattgggaggatggaggaatcttcggctagctgatctacatgcgacctcgtcacccagacacaagggcaaggacaataaagatgaatctggcagattctctgcactctcctcatgtgattcaccacggcaagatgatctggatgatgtggattaccattttgatgttgatgatgttgataccccagtctctcaacctcggagcactagcgggaaggaaacaggtgatcaggttggttcattgccccacaaatctcaagacgcacaggtcggttatctagtcaacctgctgagaaacgcccgcccgctgcgaaatcctagcaatccatcacaaacaccaagggctcagtccaccagagtaacctcagcaagctcggtcaccacatctgacgcgctggaggtgctccagt

SEQ ID NO: 6705 - DNA, 2093 bp, Zea mays
tgttatcttggatatgctctaatccatgtaaactgtctgtagtgacagcccttagggtctgcatgcagcagtaacttctgaaatacaaatgtaagcatatacattatatgcaaagatgaaaaaagctataaccgtcttcattttgcaagtttgttattctattttgagtggaaggcattgtgtttgttgaatttcatctgggaccaagtacttcattgtgttctagtgaagtggccgtatcgttttgtatttttttggctaactgtgaaaaaacatttaatttcatccatatgtcacattacgtatgttgctattaagttcactttaacaattcattgagttatatatatttttaaataaatttcacttatgttattgctagtcatcttgatctgtgactatgtagtggcaaattttgcaagtgtgtactatgtggtatgcaggcaacacttgttgctcaatagcttgtggtttatatttattcttagcaaggttactgagtggactttatagcatcggtcagttccttttggccttttgataactccctacaacagcaatacatataatcttgttggaatacaagtgaattgtccacctctccccatcaatttaagcttttgggttgaacttattggtacatgttagccggaggtctcgagttcgaatcctggttagcataatcaaataaaataattgttgcccgctcttatttcacggctgccgtgagggagctttcgggtcgggttgaactggttggtacatgtaacttaacaaatctattgagaaaattgcttttttgtttatggaccacctcgtatggatattatttgcattgttgaatatattaggaatctaattatatctatgtggagtctcccaacctcggagaattgatgggaaggaaacaggtgatcaggttggttcatcatcccataaatctcaagacgcacaagtaggttctctagtcaacctgctgagaaatgccagcccgctgcgaaatcctagcaattcatcacagacatcaagggccgagtccagcgaagtagcctcagcaagctcggtcacgtcccgcaggacatctgacgcccttgaggagctccagtccttcaaggagataagggagcgactgctgttccggagcagcgcaaaacatcaagagccaccaggaaaaccataaggccattctttgctttgtttctcttaacgtgatcgctgatagactcccaaccgggaaaccatatgcacagcgaactatagttgctgtgttcatgtatatacgagtgctaaagttgatgcttttgattgaagagaaggcaccggcttccatttatttcagcggaacaatcactcgtcgttctcaagagtgatgccgctgttgatactcttttgtatatgggaagcgaaaccgatacacgtaggtgggagcgagggagcctgtgaattgtgatggatgaaagcaggtctcattgtgtgcgtgtgtttgtaaattatgtaactgctggaaatcaaatgttcattagacgtcaacctttgaagagttgctcgcacttcgcaagactagttttatttgctcttgctatttgatctggtaatttgtggattggcgacctgcaggctgcagttgtaaaaataactgtcagttttaaattataagatgttttgactttttatgcatatattgttagataaagtgtatatttgagcctacagtaaaaaatatacatctagaaaagccgagtcatcttataatttgaaagagtatatgtgtattgtattttgatttggtattgtttttaactatctgttgtgcaatacgcattagagcgtctcgctggttcgattgttgctgctactgttcagagtttccagcatttctcaacttctttgagcctcgagactaagggtgaaaacggtcggaaaaaacctcaccgttttcacgtgcatatttttttgttcggtcggaagcggtaaacaggaaagtcggaaacggataacggccggtaaattccggtatattgaaaacgcataaatttgagcaaaatagctcgaaattgatcgggaaacggtaactataatcggaaaagctcaca

SEQ ID NO: 6706 - DNA, 2196 bp, Zea mays
gcttccacatagcaccgtcagacagttcatctcccggtgtttagcacccaggttgacgccaacacaagggttgctttcaacccctcttgagtgatcacatgatcgaacttgagtaccacagtcttccttatcgatatgtatccctttggcaagaaatcttcacaaattgaagtcttttgcagagtcgtacacgaatccaagttacaatctcgagcacaagaaaggaggagagactacaaatacaaaagcaaacgccataatacaacgttataaaaaaaagatcacaagaacgcaaacacaaatgtctaaagaaaacggctcaaaaccacgatcgggtctcactagaatcacaaaactgcgttatcacagagtatcggagttgtgtacgctcttggagtgatttggggctgaaggaggtcgctaaggcgatgacgtcactgacgcgtaaaactccattcccattatcgtccagggtgctgaaccaaacagcagcttagttctggataattgatgacagattagaattttgaatgtcacatttaccagagactaaaaatcacttgtgttcgtcttcaccgcgataataattccatcatgataacaccaacagcgacgtattaacccaaaatcctccctgcagataaacacccgggcccctcgccgccggcccggagcccaatccccaactcttccaccgctcctccgccgttagcgtgcagatctaacgatcgctccgatcccaagcacaacaacttctccaattccaatcaccagccgatcagatttatgcagtcttactgccgcgagcgccagtcatgccgcgcggcagcagcttggaccagagcttgagcgacgacgagggctcggcaggtgttggggcggtttgggttcggcgtcgctggcaatgtccgggatgtccgactccgctgggggtgtgcgcgcgggcgcggagctgatggtgcagcagttccacctcaaggtgctccacgccgtcctcgccgtgcgcacgccgcgcccgcacgccttcgcggcgccagcggcggcgtcgttcaggcggagggacaggtggttccatctcccgctccacgacccgccgccgccgcccgaggcggctgaccgcctggacgacctggtccccggggagccgctggtggtggacgtcctcctgagccccgccggtagtgtgggagcccgaggggaggtggtggagaggtggactgtggcgtgcgagccctggccggacgccgcgggcggcgaggaggttgccgtgaaccgggcgtacaagcactgcttcacgctgctcaggtccgtctacgccgtgctccgcgtcctcccggcgtaccgcatcttccgcctcctctgcgccaatccctcctacaactacgagatgggccaccgcgtcgacaccttcgccgagcccttctcgcgcccccaggaggccgccatgcgttcccaacgctttgttcccgtcgaaacccagcacaaaagcctcgtcgtttccgtccagtaccttcccagcctcgccgccttcaacctcgagatcacctccctttcgccctccaagataatcccagactacgtcggcagcccagccgctgagcccatgcgcgccttcccggcctcgcttacagaagccacgggctccggcttcccaccatctaatcagcagcagcgcccgcacagctgggcttcgcctgtgttctggtcgcacacgccggcacaccaggccaggttctcgccgcctccagtgttttacgcgtcaccgacgccatcgcctccccactttccaccccgtctcatgaggtgggagtctgcaccaatgcccataccacaggtgagcgagaggaggagccctgcacaccgccagaatatgctaccaccaccttcgacgagaagaggagacatgagggcagcaggtgctctacagtctccatctgagagtggccggttgattgggaggatggaggaacttcggatagctgatccatatgtgacctcgtcacccagacataaggtgcttcatgactctacttatatgttcagctgtcatacttgtgtgtgaacttcaattcttcgagtgcaagattggatctttttgacatggagagcttggacagtaggatacctgatgtcctgatcaactagaatgatctgtatatatgtattggctctgagttagctatgggataagtaatc

SEQ ID NO: 6707 - DNA, 3798 bp, Zea mays
ggacagacctagagtgcgtggtgtacgcccataaagcactttaaaaggagtagtccccaatgatgaatgaaacgaagtattgtaccaatactctgccagcggtaaccattttacccaatgagtaggatgagaactgacaaaacagcgcaggaatgtttcgagacactgatttactcgttctgtttgaccatcagactgtggatggtatgaagtgctcatgtgcaaagttgtgccggacagcttgaataactcttgccataaggtgctggtgaagatacggtcacgatccgagacgatggttttaggtaggccatgaagacgatacaccaaatcaataaacacttgagctactttcagagctgtgaatggatgggaaagggcaatgaagtgactgaactttgagaatgtgtccactaccaccaaaatgcagtctgacttgccagacttgggtaagccttcaataaaatccatggagataacttgccaagcgtgtgatggaaccttgagtggctgtaataaaccagggtaccgagaccgatctggtttggcgcgggagcagatttcacatgaacggacaaaatcccgaacaacagactttatggatggccaggcaaacaactgtttaacgcgttgataagtaactgggaagccggaatggccaccaacagcactgtcgtggagcgaagatattaccttctgttggagagccaagttattgcccaaccatagtctgcctttgtacttaataagcccatgctgcagagtataattgcccgaggtgcccgtgcctgcagtcaactcagttaaaagcttcattgcctgggagtcttgttggtaacactgttgtatgtcagtcagccagcgcggagaactcacggtgatagcagcaaattcaacagaatcatgggggcgccgagagagagcatctgccgcgctattatcagagccttttttgtaaaccacctgatactggagtccaaggagcttggtgaagactttctgttgccatggagttttcaatttttgctcattgaggtgggagagactccgatgatcagtgtaaataatgaagggggcgtgttgaaggtatgatcgccagtggtcgacggcgagcaacacagcaagatactccttctcatacacagacaagcccatatgtttaattcccaacggtttgctgacaaaggcaagagggtgactgtcctgtagcaatacagcacctactccaaaaccagaagcatcagtttccagagcaaaaggcttgtcaaaattgggaagagccaacactggggcagcagataaagcttgctgcagccgagtgaaggcagaagcgtgttcagaagtccagacaaacactgagtttttcttgagtaagttggtgagaggcttagcaatcacaccgaaatttctgacgaacttccggtaatatccggccaaccccaaaaatccccgtaattccttacagttacgtggttgtggccaggaagatactgctgccacttttgcaggatctgtggcgacgccagctttgctaatcacatgcccaaggtaggcaatattttgttgagcccatgagcacttggacaatttaatctgccactggtcttgtttcaacagctgcaagacccactccaaatgaatgagatgattatcccaagtgtcgctgtacactaatatatcgtcgaaaaatacaaggacacacttgcgtaacaagggttgcaaggttttgttcatagctccttggaaggtggcgggtgcgcctgtgagtccgaatgccatcacacgaaattcaaagtgaccatgatgggtctagaatgctgttttatattgatcctgaggtgccatgcgtatttggtggaagccagctcggaggtccagagtagaaaaccacgcagcaccgtgtaattcatccaaaaactcgtcgatgacaggaacaggaaattttgttttggcagtcaaggcgttgagatgtcgataatccacacagaaacggtatgtattatctttcttgcgcaccaaaattactgaagaagcaaacagactcttactgtgttgaatgatatctgattctagcatctcagtgacttgtttctcaatctctgtcttgagggctggagcgtaccgataaggacgcatttgcacgggacgagcatctggaactagaggaatgtggtgatcacagtctcttgcgggcggaaggcctttaggtaattcaaacactgaagagtactggtccaataatgcttgtaagccggctggaagtgattggatcatgtcttgttcctttgttgagaagtcactgagactgcacagttggataaacgagccttgactgtctgatgtcttcaccccatagagcttgatgtaagaatttcccaccggaatagagacccacttgtccagccaatgcaccatcattgggctatttgttgccaaccaatccatgccaagcactacgtcgtactgagttaaatccaatacccggaatgtagcggtgaactggtaaccttgaagggaccacactgtgtcaaccaatgcagattcacaagtcatctgggcgccatttgccacacggaccaccaatggttggggctaaggaagtaagattggaacattgatttgcaatggtggagctaataaatgaaattgagctgccggaatcaagcaggatgagcaccgagagaccacaagcttcgcccacaaaacgcattgttttcatttgaggcacctgagcaattgctgaatacgataactgaaaactattgagctgaatgtcctcaagcttttcagaaagggcctcttcagatggttctggaaattgatcccaaagttcttccacaaggtgcagctggactgaatctgggcattgatgaccgcgggtatatggtgacccacacttgtagcataacccttgagccttccgatacgcatagactgaagcgagtcgatcaccactcccaggtggctgaacagagtgcagagacttgtgttcttgtggccgaacaggagttgtagcaccagccttgggtggagaaggtagaggtaggggacctctattgtaagaccttcccagtggtatataatccatcttcttatactccggcttcttggctgtggcgccgatttcctcctgcaattgcgcaagaacgtaggcagtatccaaatccttgggtcgctgaatcatgaccatagatttaatgtcaaaacgaagaccatctagaaacctcatggtgtaatacagggggtctgacatggtttgataactatttaactgatcgaccagctgggcaaattgatccacatactcaactactgttccctgttgcttgatatgaaatagctggcgaactaatagagcgtgttgatccttcccaaaacgttctctcaacatgtggacaaagtcgacccacgaagcagtgctcaactggtgctctacagattgccaccagcgagcagctgctccagagaaatgcatggtggctaccttaatccaaactgaggaactcactgcatacataacaaaataatcctcacaacggcgctgccagagcttagggttttcgccgtcgaaacatgggaagttcaatctaggcagtttacccaaatcagaatgcagtggtgactcatgagctacatgttcagagctatcatgccatggatccatgtgcgaatatggaagggaaaaacagcaatcagccgtaccattgtgcaggagatgggtttgagcaaatacatgcccaaatccatgctcccgacgttgatgatccacgcggtgcccttgagggccgtctgctgcag

SEQ ID NO: 6708 - DNA, 1099 bp, Zea mays
ttcggcctggagccgatggtggtgaccgcgggtgccgccgcggcagccgccgccgccgcgtcgacatcagctgcgacacccgtgggctcgctcggctacgtcgcccccgacgcggccgcggccgggcaggccacggcgcgaggcgacgtgtacagcttcggcatcgtgctgctggagctcctgacgggccggcgccccggcatcttcgccggggaggtggaggacatcgtgaagtgggtgatgcggcagctgcagcgcggcgccgtggcggagctgctggagcccggcctgctggagctggacccggagtcctccgagtgggaggagttcctgctgggcatcaaggtcgggctgctctgcaccgcgtcggacccgctggaccgcccggccatgggcgacgtggtgttcatgctggagggctgccgcgtcggcccggacatcccgtcctccgccgaccccacctcccagccgtcgccggcctgatgtcccgtcggcccacggccggcactgccgcctgtcagattcaattcggtagcttgttccatttttttctctctctttcgatgattgtttttttccccttgattagttcagataattagtggtagtgtcatctatgcctgccggcgtgcggccgtcgacggacgaactgatccgtgaggccgggaaccgtttcccgccaaggaaggaactagccgttgggcgtctcgtttggttagcggaggtgtagggcaccgggcatgggggggagcaaggaaccatgtggcgcactgctgcagaggcgcttggcacggcctgatggcaggcccctgccatgccaagcccaaagcgtgtcgtggtgctgcgcatgtggggtttccctcctggccaggcatcggcaacggctactgatgccggacatggctgtcgcctcctggccactgatctcggccgatctgtaccacgaccacgacccatgtactctctagaggggcctgcttggcttcctgggatcctgtctttaatcttgtttcaccaaagcaacaaaaaaaaaaaaaagccatgtgctgtccaaaaaaaaaaaaaaaaaaaaaaaaactcgagggggggccgggtaccc

SEQ ID NO: 6709 - DNA, 1542 bp, Zea mays
aaaaggggatctcagggtcagagcgcatcagcacacagacagcgcggtgctctccagtccccaccaattaagctcagggtctagtgagcagccagagagcctcgtcccgttcccacccccattgcttgctctgactgctccgccgtgcgtgcgtcacccgcgctcgggaggtgagtggtttggttgcgcagccaactgccggcccggcaccgtaccgcttgttcgcttctgaggttgtgcggagtggttgctggcctggccgtggccggcataccgataaaggcgagagacaaccccgtggctcgccgggatccgtcgtccgtctcgtctcggctttctcgcctcctcggcggcagcggtgttccactcccatcgcgtcgggacatagaaagggggagcgcgggcgacacgcgagcgttagttgccatggacgcgcccttcttccacgagctcaggcggcaggcctcctcctacctcaccggcaagatccgctccgcgcggctggcgctcaccgacgtcaccccgacgcagctcatgacggaggaggcgacgaacggggacgcgtcgccgccgaacgtcaagacgatgggcctcatagcccggcaggcgttcgaggtcgacgagtacgtcaggatcacggacatcctgcacaggcgcttcgcgagcttcgaccccaggcaggggcaggggcagtggcagtggcgggaggcgtacaaggcgctgctcctcctggaccacctcctcacgcacgggccccgcagcgtcgcggtcgagttccagaaggacagggaggccatcgagcggatggccaccttccaacacatcgacgagagaggcttcaactggggacggacggtgacgagcaagtcggagcgcgtgctcaagctgctggagcgcggcccgttcctggaggaggagcgcgagcgggcacgcaagatcgcgcgcgagatcaagggcttcggcagcttcaacctcagcagcgcctcccacgccgcgccacagccaccaccaggtgacgagggaagccgcggctacggccggagcaactcgcagttcgagcagcggtggaggcacaaggacggcgacgacagcgacaaggagaatctgatccagagcccggagccagcacgggtcgcgcgggaagtcgaggccgagccggaggagccgcaccaccacccgttccacgggctcgggcaaaaacagcggccggaggcgatgctgctcctgagccagtgacgggatcagtcggttcgtgtcatggtgatatgaaaaagaaccgtgtgctctgctcgactcaactagcttttctccattcctcaaggctgcaggggtcggaggcagtgatgggatcagtcagtactttactgacactgcttggtgcaccatgcatgagaactttgatgtctcatgtagtagtcatgtctgcttcgccttgtaaataattctatgcttcagttcggatgccaggatgtaatacgagtctacgactctacgagacaacataaggctgtctccaacaatagcccgtaaattgttctgtcc

SEQ ID NO: 6710 - DNA, 1894 bp, Zea mays
gtacccctgcaaaacagatgttctcctttttctttttgatgccgaagtcgatactacggcagggggtacttgaccggagcaaacccgtttcttcgcgtttcattacgcacgcgaggggcggagtcctgatcctgactgcccatgcccctcatggcctcatctcatctcatctcatctcatccggtccgtcggcacacttggagcgcgccaggcgcaggcaggacgcgccacgtgacatcagccgcgcgcccaccaccaaccgcgcccgctgactcctgcctcccgtgctgggcctgactgcgggccgattcaaaattcaaatgtccgttctccctgttgacgatttgtcacggacgccgtcgcccttttgaacgtttcaaaggatctcagagcgcaacagcagcatcagctcagcgcggtgctctccccgccaattaagctcgtccagtgagcagcagcaagagagcctcgtcccattcccaccccgttgctctgactgctccgccgtgcgtgcgttacccgcgctcgagacaaggcgttgtctcactctcatcatccgtgcagtgctggacgatcgcttcttgtccccgtctcggcttctcgcctcttcggcggcagcggggcatcgattgcaatggacgcgcccttcttccacgagctcaggcggcaggcctcctcctacctgaccggcaagatccgctccgcgcggctggcgctcaccgacgtcaccccgacgcagctcttgacggaggaggcgacgaacggggacgcgtcgccgccgaacgtcaggacgatggggcgcatagcccggcaggcgttcgacgtcgacgagtacgtcaggatcacgggcgtcctgcacgggcgcctcgcgagcttcgaccgcaggcagtggcgggaggcgtacaaggcgctcctcctcctcgagcacctcctcacgcacgggccccgcagcgtcgcggtggagttccacaaggacagggaggccatcgaccggatggccaccttccaacacgtcgacgagaaaggcttcaactggggcctgacggtgaggagcaagtcggagcgcgtgctcaagctgctggagcgcggcccgttcctggaggaggagcgcgagcgggcgcgcaagatcgcgcgcgagatcacgggcttcggcagcttcagcctcagcgcaggcgcctcccaccacgccgtgtcgcagtcgcagccacccggtgacgacgggaaccgcggcgacggccggagcagctccaagcgcgaggagcggcagaggcacgacgacggcggccgattcgggcggagccactcgcagttcgaggagcggtggtggaagcacaaggacggtgacgacggcgacaaggagaatctgatacagagcccggagccgacagcacgggtcgcgccgcgggaagtggatgcggaggcggaggaggaggagctgcaccaccaccagctccatccgttccacgggttggggcaaaaacagcggccggaggcgacgctgctcctgagccagtgacgggatcagtcggttcgtgtcatggtgacgtgaaaagaaccgtgtgcttttctcccttcctccaaggctgcagggtcagtattttactgacactgcttggtgcatcaggcatctcatgcgccatgaatggccgcttgcttggcctcgtaaaatttctttccttcagttcggaacttcggatgccagaatgtactagagaccaccacatacaggcatgtctcaagcttccagtaactctctagaaaccacgtattctaggagtgcgagaatgggatcctcctgcccaagtgcagctgtgctaatcttttactctgaacctgtgaaccatctactgaaggaaagcaaaaggcagtagttattccaaaaaaaaaaaaaaaa

SEQ ID NO: 6711 - DNA, 4481 bp, Zea mays
tgctgctggtggagggcggcttcacgagtgaggatgcgtgcttggcgctgatgctggtactcctcttggttggggggcttctttgtcccctcctccgttgtcgtttcatggcggcgttgccacaaaggaagccctctttggcaccttgttggcgtcggagttagcctcggttgagacgcggcagcaacacgatgagccacgctgaggcccagactacggaggccaggggttagtatggcaagaggtagtaacgatgacgctagagccccgcgtcgcacacatattttattgatattattcacttcaaaccatttttaaaaaatatgtattacggcgtctacaggcttcaacgatagtgcaagctcatctacgaccatgctagagtaatcccgctatgagtaacgatgagttcattcaatatagatgtaatctactatgtgaatatacttttaacttctatacgtggtttatccgctgttcatgcatcgatagctttaggaattaattaaatataaattttatagctgcatgaccagttttttttttttgtttggtttcgttagtattcgtgtgtgaccaacatgatgaatcgattaatcacttgcttctaagctgcacgggggtcgggggaatgggtagttaaaaccatgcatacatctgacaggcacgtcaacggtcaaaatggcattctggcatcccagttgcaacctagctgaacaacaaatgctactgcatcacactaacaatcagtcaaaagaacactagaacatccttcgaccagcaacaaagatctagccgctgatgtaactgcagagcaccctgcacttgagcagcctgtcctggacgtagaacccaggcaccaccatgagtttcacccgcgccgatggcggcggctcatggtcctgcgaccgctgcatgtcgagcagcacgtcctccatgtacgtctgctcgaacgccctgccctcctcgacgcgcaggatcgccagcggcgggctgaaggagaaggccagcaggtggagcagccagacgcacttgcacgccacgaagaagcactgcagcagcggctcggcccaacacggccgcgaccagttcatcagggccgacgccacgcagcccatcttctggtcgcagaagcggctgagctccttgcagtggtgcctggtgcccttcctcaggacctcgctccagctcaggttgcgcagcgccacgaacgacgcgaagctctcctgccgctcctgcctaggctcggggcccctgcgcggcccgttcttctggaacgcgcagttctcgaagtcctggtacatcgcctggttcatcagagcctccaggtggtacagcaccagcttcgggcgcctgtcgccgagcgtgatctggtacggctgcaggagcagatttaacttctctgatagcccgttgtcggcgtcttcttcgacctgctgtatcaacgccttgcagaactgttttacggagaggcgggcctcggacacgacctgcacaaacccttccaccataacctcgtgactgacgggcaagggactcccgctaaccgacctgctcgacgatctcttcgagtgatgagactgcatgctcttcgcgcttgtcgcttgctttagagccttcttcagctccgaacagtacgcttccaggctcgctatcttggtggtcagttctccgagtgatagtttcatctctgatacttcttgcagggcggcgtccctgtgctcgttggcctcgacaacctctttcttcagggagtccagcgagaacacgccccagtccttgagaagctgcgacatgttctcacattccacggtggtcggcgacacatctggcctcggcttcctctttgactttggtagcaaccaggagaggatatgttgtggtcctttgtgccttgtccggggaaaggcggcgacagtggggtggtagtttgacagcggcacggtgcaatcaaggttcttcaaggacttggcgtcgtccccacgattgatcgtcgcaggcttgcaggtattgcacgtcgtaacgaccttgaattcagtcaagtcagtcatcctgctggttgacctgatcaaaccgtcagcagcaagggcggtgggttgaaggaaggacggatggtttctgcacgcccttctgttccgcaggtgctcgttcgacgaagagagatggagctcgctgttcgacgaagagaaggtgttgtggttgtcgaaatccgagaaggccacctcgtcgtcctctaggccatcatggtccaaaccgacgccgctccagttctcggacaggctcctgttatcttgacgaatgcagttcgttccgcccaagggctcctcatcatacatcggggcaaacacggggtagtcctcggcggccggggcagggggccgccctccagctcgcgtggagcgaaaaatgctgtaccagcaggcaacacatttaacagaaccatttaatgtttcataatttcagtggaggagtgatgctaccatactgatgattcttcaagtttacagcgagagccagacagcatactctacttgtatgctggcatccccagccagttctgctgatccctttgtggccatactctcttgttgtactacgctttcttaaaagcagagttctgcctaattttttcttattaaaagagcaactgattatgcacatcgtttggggtccaggagactctgaattttcaaattctgatgtaatggtgtcccactatgcagcaaaacaacctttacagagaacctgacagcttaaataaagctcagtctaatgctgaggaaatggctcatcacattccgccaaagcgtgcgagtagaaaaatcatccctcggcaactgtaagtacaaaaaaatgacgagattcatgtcgacaaatccttggtttttctctatctagttgggagttactgaaaacacctagacggcagatccaccaggttaatcgacctacatctttgcttcagtgaaatagaacgcaatcaagtatactgttctcggcttcttctagcttgactccaaccaaattccatctattgaacccggaaacccaagctaccctctctgaaaagaacattgtcggtcgcggcgagaagaacagtcgacgccagcactaacttagcatcaaacagccacgaaatttgctaaaaacattagcgtggaaggcgggacatgcgaatcgagcaacaaaagaggcaccttttgacagacgcgaacccttgctcgtggtaccaacaaaacaaacgaacgaacgtgggcgcgagaagtttcagaggcctgccggcaagcttaccggggcaaacacggggtagtcctcggcggccgtgggcaggggggccggcctggcgagcgccggcggcaggcggatgacggcggggctccggctagcgctggcgtaggtcccggaattggaggcgccgccgccctggaggagcgcggcgtggagcgcgcgcagctcggcggcctcggcgacggcggcctggatgtccaggcgcgaggtcgggagcggtggcgggaggtaggaggaggagggggaagcggtggcgtccgcggccatggcgccggcgcggggtcaaaggccgcacctttggctggtgcctggtggtggtggcttgggctgcgctgcaattactgcggctggccggagccggaggcgtggaggcgggggactggagactatagttgagacttgagactgtgtgtgtggtgccgtgccggaggcagataggcgagggaaggaatcggaacgctttttcaggctactactaaagtttaataatgtagcccatagtacactctatgatattaacattatcacatgtagctaattaaaattatacttatataattactctattgtaatgtatatttaatacttgcgtcatctctattctacggaatgtcttggagtccatgagtggctcactcacagttggttactaacgagcaatccgttattttctctattttcacttctatttttatatgtttacagcatgagtattatttttgtccaggctcatgaagattttgaggggtctcaagggtaaagtgagataaaagtggcgagaaaagacatctctcttgctctcctgacccctctccatcatgtgttaattagatgtatggatggctttctatattcatgcgctaaaacttgggcattttcttggtgcgaatcagtacacctataaccgtccggtgaaatctaaggctgtctccagcaacgtcccctaaattccaccccctaaaggaatattccttatcctttacagcacactctaaaagattctgtcctctatatcttcttcatctccaacaacgtccactaaattcggtcctctatatctacagtgctaccagatttcacaatacatattagtttttcaccgcttaaaaaacagtttatatgtcgcgaaattaaaatacgctatacagtacatattgattttgtggtgaaaataaaattattacataataagc

SEQ ID NO: 6712 - DNA, 2110 bp, Zea mays
  misc_feature (552)..(552): n is a, c, g, or t
gactaatatggaaaatccattttcccgagggatttcaattttcctagggaaaatgaactaattttccttatgaaaatggaaatcccttgaaaaatgaggttctcaaactagccctaatggaagaattcttcgcggagaatcgggaatcgggtcacattgatctttccatactccatatttctgctaaaatttatataacactaggtgtatgtgaatggaataaagtgaaatgtaaggctatcttcaacagtttacctatattcatatctatattcaaactccaatctgcaaatagtacaaaacagtattttgcgtgactatatagatgaaatgttagatatggtctaatgcgtcgatagatgttatgaatttgctagatttttcgtagtggttaaagcatagcctgttaaacaagtatttggatgtgtgatcacgatgtaatacgaaagaaaataaatgggatcgttatcagcttactctattcacaggagtagttttatgagacgttttatatattagagtgtcgcatcacactttttatgatataacacnatatttgttagagttaattagaaatatgtcacttaaattttggaaagaaagatagaaactaatttattttaataccacttcgtagcatcaaaatgaactaatcatctaatttgtaaaagtcgtgtgacacatgaaatttatcatatttattataaagtattgtatatgaaatcatgccaactcaattccaaggcatgggaaaactcatgaaatcatcattgaaagtaatttttttatctccatttattttatacatttctattaatcatttagatgtattttttattgtcattgtagtctatttatttttccaatttttataacctttttcaaagtttcaaagttttggataatttcttttttaaaaaacagctagaaaatcgatatcgatctggtccgttaacaagaaactagatcggtttaccggttttcgaccggttttgtaatgcctgctgccacccaaaccctgtactcaacagtcgatcaccaacactcaatcaaatattttctctttggaattctttgtaaccacacacttggaatgaacctctcgaattccttttgcgataatacagttgaatccattttgataatgcactttgtagtcgatggctctccattccatggagtatttggttgtttatttgcaagtgtccctaactaatgtgcctaactatttcactgaacgacaatatactgttcctaggatttcacgagagcaaatccctccgtatcacgcacagagaaggtcgtcggtggccttcgctaaatccaatagctagcctggtctggcagcactggcaacttagtagtagttccggttgaggaaccgcctgacagctccgacaatggcgcccagcgccaagaagagaatgagtgtgtcgaagccaccgccgaccccgacggccacgctcggaccgggggcgaacaagaacggcgaccacccgtagccgtattcgtagccgccgaagaacgacccctcgtagccgtatccgcctcccaaaggcagcgccaccggcggtgggttgatgtagatgttcgtcctgcgcatgcatcgaacaaggtaacattttgcattcagcggacacagcatgcatgtcagctgattcgagttgcatctctttcttcctacgctagattcttgtagacgattgaaatttcagtctgaactagtgagctgaactgtcgggaaatatgtaggatctatttaggtatcatttgattcacatatttataaagtaatagttaattgataacgttaaatcatgttcgtttaagtcaggatcggacataggggtgtgcgaccgatgcgcttgtatagggcccctagtttctaagggccccaaaatatttcctacgcagcgcaaggtcataactctattatggggtgtgcggccggtgcgcttgtatagggcccctaatttctaagggccccaaaatatttcctacgcagcgcaaggtcataactctattatctagcccacatcgtgtcttgtcttccgttcaaacgtcttagtgtcaaacaaccagtataagttatttattaaatttttattca

SEQ ID NO: 6713 - DNA, 3516 bp, Zea mays
agcagccaaagcaaagatacaagaaacatagtattatgtatgtgtaacttattcgagtacttaaacctcatattttagtagctttatccagagttgaacttttaaccttctaattcaacacatttggacttattgtctccaatttgcttttactccacctgtgctcattctcatataaagagtgatagttcaaagtggcgtgttgattatttaatcgccaaaacaataagaaatggcctaatggcacattttcctttcatcaatatctacgctcacgtgtatattgtacattagtattgcccattttacccttcttcctcgctgctcttctccctacccattaagtgtgttccacgtccaccccactgtgctcgagtctgagctgacgctgagctgctggtgggcgcggggaggcgaccccccgatggaggggtcaccatcggggtcaacccagtagaggagtagtgcatggagctagatgtcatggcggtgcaagcgcatggaggtgcaagtggcaagcaacttggaggtgtgcacggaaagggggagcatgcacgggtagagtagagcaccacatggcagtcctccgtgtggaggaggcgcatatcatggcggtgtaggacacgacgtatgggcgcgatatttcgtcgaacaccctggtggcattgttctagtcctcacagtcggtgtagaagcgaagagggagcaagcgaggatgggttggatttggtcaaggcacgacgacacgcttgggtgtgtatctggtacacgaggcggcggtcacgacacaggagcagggcatggccagagacgttggcagtcgcgtggcgtcgttgcgaccagagcacatgtggtcaacggcggcggttgcctatgaggaggcgatccccgtggcactccccagtttgacgcccatcatcagggccactgtttctgcttgaagagaggggaagattagagtagatcgatatgaccgtgcgatggagaagatgtgaggtagaaggaagccaataagggcatttccatcttctcagagagtcttgtatgcgcaaaacgtagataataggcatgaaccaattttttggttgaataatggcaaccatcaggtatcacgaataataatgacatctttagaatactcgattttcataacgatatgtatctgaaaaaccctttactataaacttgcctttgaggccgaggagatgaacatggtcttaaacatgacaaatgtgtgcaggccttacaaagaagcatgttgtgccatactgccatcccgccggaaaatgaccagtggtccacgattcatcattcagaccggtccactatgtacagctagctccggcccggccccgacgtagcttcgttgccctcccgggtgccaaaaacaagaagcccagaaaacaaaaggagcagcttcgattcgagatcgcggcgccatcgaccatgcagctcaagaatcgccgcgaagccgtgacggcgacagtgctcgtggccgtatcagtcctggcgaccctggcgcgcaccgacggcgccctctgcgacaagtccgacaaggcagccttgcttgccgtgaagtcggcgctgggcaacccactggcgctctccggctggaactccaccgtggcctgctgctcctgggagggcatctcctgcaacgccaccaccggccgcgtcaccgacctgaccgtcttcgcgctcaacatctcggcgccggtcccggccgccatcgccaacctcaccgcgctgcagagcgtcaacctggcctacaaccagctgtacggcagcatcccggcgttcctgggcccgcgcgcgctgccggacctcaccttcctccgcctcgacggcaaccggctctcgggcgccatcccgcccacggcgaccgtcttcaacctcctcctcgtcggcaaccgcctcacggggccgatcccggccgccttcgccggcgcggcgttcggcgacgtggagctctcggacaaccagctcacgggcgacgcgtcggcgctgttcggcgccgagaagccgctgaacgcgctgtccctgtcgcgcaaccggttcaggttcgacctcggccgcgtggagctgccggaggcgatggacatcctggagatcgaccacaacatggtgtacgggagcatcccggccgccgcggcggagaggaagtggctggcgttcgacgtcagctacaaccagctgtgcgggcccataccgcaggggcggtacacgcaccggttcggggccaagcacttcgctggcaacaagtgcctctgcggccgcccgctcccgccgtgcgcttattagaagaaggccggaacagtacattcatactagtataatagctttattattggaataatgatcctccgtgctgctgtactcgaacgttttgtaatcttgaagcgagccattattaagatatcctgtggcgaaaaaaaaaaaaaaaatctatatgtaattgtactcctatgaacacttctgcttattcaccccatgcatgcagctggcaagtggcaattgttagtgtggctaaaactttttagtcagcgagccctcagtgtggaactacacatccagtaaggtttgagatagttaggtgggacgccattgtcgtagaagatatggctgatgaaacgaattgcccatccactgttgagtatatctaattgttgggcacctagccacccatgaacagggcgcccaaagaaagcacaagagactcttcaaaagcagcccatcgaccaagtccatgacgaacaaactcgcgaggcaaagcggacaaccaagcctctcccaagcaaacttgccaagcggagcggtagaccaagtctttgccgagcaaactcgtgaggcggagcggacaaccaaatccctgccgagcaaactcgcgaggtgaagcgggcgaccaaatccctgccgagcaacctggtgaggcggagcgggcgaccaagtccctgtagagcaaacttgcgaggcggaacgagtgaccaagtccctcccgagcaacctcgcgaggcggagtggactaccaagtccatgacgagcaaccccgcgaggaggggcgagcaaccgggtcccgcgctagtctgactggcgtaagaagcgaaagggtctctagcctagtggttaaggacctccgagtagcacctccaagtcctaggtttgattcccctcgggagcgaattttcaggcttggttaaaaaaatcccctcgttgtgcctcatccgctctcgggttacgatgtcttgtgcgccaccctccggttgggccgttgcagagtggacagttgacgtcggcccgttagtgatggggggccagggttcggggattttctcggccgggaccattgtttcggtctcttcttaatataataccggggagggcggtctttccctccccggccgagttttttttctgactggcgtaagaaaaggggtcgacccatgatgtggggccacaccaatgagaccagacgggtctttcacaactacatccaggccctcgggtacgatgtcaaaa

SEQ ID NO: 6714 - DNA, 1118 bp, Zea mays
gaaccgtgtcattcaagagcccggataatattgacaatggttatcgccatcgtgacactcttggacgatattttcgattctttcgcgaccccacaagaatgtgaaatactcactaattgcatcgaaagctgggatcccaaaggggctcaagaccttccaggttgcatgaaatttgctctagagaagatattggatagctaccagaccattacaaatatgctccaccgagaggacaagtatcgaatgacgtatctaagacactttacagaagatctagtgagaatcttcaacatggaggtaaaaatgcttcaaaaaggttacatcccagattctgttgaagagcatcttaaggtttcactcagaactggtgggtgtcccatcttatcatgtgcttgctttgtcgggatggatgatatagcaacaaaggatttctttgattggatttctagcgtacccaaaatggtgcgcgcactttctataattctgagactagcagacgatctccactcgtatgagcgggagcagctaatccctcatgtagcttccacaatcgacacctacatgaaaaagcacaatgtctcaattgaagtggcgcaggaaaacatacacaaactaaaagaagagtcatggaaagatttaaatagcgagtggctaaatccatgcaatgatgtgtatccaaagcaactattggagaggatattcaacttggcaaggacgatggagttcatgtacaaccaagaggacaatttcaccaactgccacaaccttaaggataccattcgctgcttgttggtagagccatatacgatccacatttagtttttggcaacaaactaatgaattacattgtccagttaatgtaatgcagagttatctgtcatccttatatgtgtcaatatgttttctctagtgtatgtaatatggtgtcatctcatcctcatgtgtgtcaatcttcttttcatgtatagtgtcaatatgtacacatatatgtggcatcatttttgttttcaccctagagtttgctcttgttgtatcatttgcccttccttttggactttttatgttgaaaggaccttatcgtggtttcggaaaccggaaacacagtaaaaaaacaaacc

SEQ ID NO: 6715 - DNA, 7363 bp, Zea mays
cactcggcaaatagcttccttgacgagtgcccaaaaaaacactcggcaaaatatttgacactcagcaaagagccgaattccgatagtgattcaaactacattctgcgaatagtgcagtctacactgcaaaatagtgttttaggtgaccatatggggaactgctggagacggtcttataccctgtcttgcgttataggaaagaggagggaaaaacatgaattctaagtgctagtttgacaactctatttttctaaggaattctcactttatcaaaaaaataactaattttctttagaaaaatagagttgtcaattcatatacatttgccggatctagctagctagggatcggacaaacaaacagttgattcgttgtaataactgataagatttgtcgtcatgtcagaaaaaaaaaagcggggcaaagcgtgttacgtgcggtagctgtaaagagaattgctttagcctgatgattgttctgagctgcgatcgatcttttcgaacgagattattacttgtcctgtaaaccgcgtccgcatccagcgaaaaagctcttaaaacaggcaacatagaacatgaacttaatctgaaaagaactgctccagaaagggtccatatagcaagagctggcttgctttttctagaaattctcactgcacaatcggaaaacaatctcgattacactatcagcagctgtaaagcgtatatataataattggacgactcagcgtctgatagctggtgcgtgtttagttttagctaatgctaaaagggaaggggacggcggttcagctgattctgtcttctgagttagcctgaaccgaaacagtacaaactcttgtccaaacagaaagctttggatgcgcgttacggcatctatgcgtttgggtacacgcattcgctagctcgcgtatagtatagccgtatcgtatccatgcatgcatgtgagcccgcgataatatataatgtgctgcatgctcgccgctcgcgtcgagcccgtatgtttctgaacttcccggccgccaactggcaaattgattggtcagagcacggcaccgataaacagataccctatcgacagttgtccacttgtgcttgcggattcccggtgctggcccggcattcctgtagaagagaattgactaatacgtatatgtatataacacgtacaacgtggggggttttgactttgaacgacaacagccatgcatgttttcgcttctctgcatatgagcaagaaaccactgtgaaatgccgaaaccatcagcgtccgtttcgacaaagtcttcggcagcagtgcaggtgaagcttactcggccgacgcagacgcagcagtgcccgggctggggaagtggagagaaatgaacgcggcccggataacgccggggtgcaccttcggttatttttatcccaggtagatcggataggattgagaaaaattataatggcccgtttgtttcgttgaaattgaattctattttaataattataatttagacaaaaactaattaagtttatatatttatatatataatatatttgtatattatcctaaattatatcagagagatagttatatactatatttatgttatagcgaagcaagtagaatagtatgctataagttgtacattggaaaaatagcatgtaaatctataaaatcaattttcatctctcaccccatgaatttgaaataggcttatatatgataactttggaaagtagtggaatgtcacattctaaaaaaatagcctattccattagtaagattttaatttctcaaaatgaaaggaaacaaacgggacataaaagattttgacttgttcgaaatcgaaactcactcaatctcacacaatccatatggattgagagcaaaacgaacaagacctgggtacgtcaacttgtcttgaggtcgatttgtattataaggtcttattcgtttattcctattacatatggattagatgtgattagaaaaaaaaaataagaagaagtttgacttttttgggatttaaactcatttaattccactcaatctacttgaattgagagcgaaccgaaagcactggaagaaatactcttcttattttattattgaaagaaatactccatataatgtgcccataagcttatcttcatcttatagtcctgcatagaaatactccactggaagtttattatctgataaaatatatgttcataatatgtttgtctaattttcattacaaggttgctgatggtgttttgagtatgtagatttatatatactaatattttcaccatcaacacttgctcttcacaaaaccatggatactcgtgtgaataatttccaaagagagactacttcaaagttgcttttttttaatttcgaattacgacttgctgtcaaaaggcacgtcgatcgtctaaccactagatcgaaaataaatgcgagcaaccacatcaaatcgagggcttgaacttgggtgagtaggtagtttctacgataagaaatccaatcctatatgctcagttcgttactacaaagttggttttattcgaagaagaggacctattattgctctatgtgcttaatctcctttttttgtattaaaagtagacgaaagtctacgtgagccttgctctgcccagcagccttgatgtgacccaggcacccagctgggcgatcactttcgaggcagtttcaggtttaaacttgaatgcctcaatgtaaacacctgcttccctttataaattgtcccctaacgcgtgttgtttgaatggaaataaaaaattacgattgaacaggtcacttggttgctaccaaatcagaaagaaacaaagctgctactagcctactagtatatatatgtgtgtacatatgcaacacaggcataacagcacctctcgagtctcgacacatagcagctgcttgcctctgcacacgcgctcagtcaggcacccccataagtcatatcataggatcgagctcctgcgcggctccacactgcgtggatccggccatgggctgtccaccgcggctcctctgctgcctcttcctgtcgctgtcgctggcagcggtggtcgcgcgcgccgccacgcggcaccaggagtgggagatcagctaccagttcaagagccccgactgcgtgcggaagctggcggtgaccatcaacggggagacgcccgggccgacgatccgcgcgacgcagggggacaccgtggtggtccgggtgaagaactccctgctgaccgagaacgtggccatccactggcacggcatccggcagcgcggcacgccgtgggccgacggcacggagggcgtgacgcagtgccccatcctccccggggacaccttcacctacgccttcgtggtggaccgcccgggcacgtacatgtaccacgcgcactacgggatgcagcgctccgcggggctcaacgggctcatcgtggtggccgcggcgcccggcgggcccgacgccgagccgttccgctacgacggcgagcacgacgtgctgctcaacgactggtggcacaagagcacctacgagcaggccgccgggctcgcgtccgcgccgctcgtctgggtcggggagccgcagtcgctgctcatcaacggccgcggcaggttcgtcaactgctcggccgccggggcctgcgacgccgcgcacccggagtgcgccacgcccgtgttcgccgtcgtgcccggcaggacctacaggttccgcatcgccagcgtcacctcgctgtcggcgctcaactttgagatcgaggtgcgcacgttatttagtttctctctccttctcgatgtctcgatttatttgtttctccgcgtccttttattttttgtatataacatttcaattcgtcaacagttacaaaagcaggtgtcaagatctaaaacaatgtagcactaattgaaaaacaactacacgggtaggagtagttatttttttgttttttgaaaaacacggtaggagtagttgaatagaagaaaaatgcatatggcaaccatgcagctatccattatactcctacattagaagctattcacaattcagaatacaactctgatacgatatgtacaactctgaggtatctcttaaaggagtgtttaggttgttaattgaaaaaaagaacaagagaggcggactcttctcttagctgtctcgtgtacttgatccacgatagcagattattggcgtgtttgtttctctcttaaattatataaattagattacgatgaaatgatagaaacgtaaaaatatcattttgggataacaaataagtttaaataagctaccgtcttacttttttaatttattagtggttttaaagtgatattttaccctcccaatctttctaatgtaacttatatgatctgggcccggaccgtatccccgggcgaccccgcgtccgctgattgcatggccagcattgggtgcacatttcccatggcgggaagtgacgacaacagtacaatcccctgcaatctcgcgctagaatctagggcaatgccgtgttttggggaagcccgacgcgcacatgcatgctgctcctacgtactggaccatctccacgaccacaaagctagccgtgtgaccgtgcatcgaggcaacaggcaacaactctcggccgtccgtctctgcctctctggtcttggcccacgtaaactaagtgtatatatacgtacattgtttggatgcgatccgatacttggattaaagtaataaagtagtctagcgttagacggcagtcagggaatatgtgcttaccgttcttggctcatgcatgatagtctgctaccttactaaactattttgtacactagtacggttcagttggtgcaccaacctgtgtgcgcaattgcctagcaacagcaagcaacgtgcgcgcgcgacgaccaagtcaatagtccaacaagttgtaggtccaaatgctatatgcactgcacccgttattaacagctcttgcgaatggcagtataacgtatatgctctcgatctgcaagctgcaactcttgtttaatttatttattagttgagtcaatgtttcgtttagtttccctactaattggcttcctttcagacgacgcatgcatgcatgtagagccattttcgcaatgccatataccccatctctcccaaccgtccgatcctttatgtacttgtaccggagtaatgatccatccacggcatgaatggtttcagggccacgaaatgacggcggcgcgggcggacgggcactacgtgaagccgttcgtggtgaagaacctcaacatctactcgggcgagacctactccgtgctggtcaaggcggaccaggaccccaaccgcaacgtactggctcgcctccaacgtggtcagccgcgagccgcgcacgccggcgggcaccgccgtgctgcagctactacggcgggcgcagcagcccgcgcaggtcgccgccgacggcgcctcccgcggggcccgcctggaacgacaccgcgtaccggttccggcagagcgtggcgacggtggcgcacccggcccacgtcgagcctccgccgccgcgcgccgaccgcaccatcctcctgctcaacacaccccgcgtcctcgacgcgcacatcaagtgggcgctcaacggcgtgtccttcacgctgccgcacacgccctacctggtggccatgaagcgggggctcctggacaccttcgaccagagcccgccgccggagacgtacgcgcaccgggggtacgacgtctacgccgtcccgcccaaccccaacgccaccaccagcgacgggctctaccgcctgcggttcggctccgtcgtcgacgtggtgctgcagaacgccaacatgctggcgcccaacaagagcgagacgcacccgtggcacctgcacggccacgacttctgggtgctgggctacggcatcggccgcttcgacccggcggtgcacccggcgtcctacaacctcagggaccccattctcaagaacaccgtcgcggtgcacccctacggctggacggcgctgcggttcagggccgacaaccccggcgtctgggcgttccattgccacatcgagtcccatttcttcatggggatgggcatcgccttcgaggaaggcgtcgaccgcgtcgctccgctcccgccacagatcatggggtgcgggaaaaccaggggtggccactaactgatgttgttcagaatctgaactcaaccaccgttgatccatttcgttcttttgtttcttattattacagtccatctaataagatttgtatgggcattttttttatcacaatcctatacgattcgggaacaatgccatgtgcatctttttacaggcactgcacggtactcgaccggtgatctttatcggggttagaaaaaaaaagtgcagctggcctgccagttttactggatcatcgagaggctgatgagctgcgttatctagagacagcttttgaagctgtaaaacaatcggatctcacggcttttgatcttcgcaccgcccagctttgattttccagtcattttgtcagatacggtcgggaatcatttacatgtgtgcgcacgacacatcaacgactgtgtcaaacatggcagatagtagtgcctaattaagcttgttttgagctccagcactaatctaaacagctccacaccctcctggacaaaagagcggcagcacacggattgcaagcgactcaaatcaaagctgaccaactaacgtcacctctccgcctccgcgtatcaagaccccggatcgtttaggatgtgtttggttgcctgatccagcctgagcctggcccagtcagaggaccagggtcaggggagcccgcatgtaaagagccaacaaacaatgtttggttgcctggtcaaaatgaaccaggcccatattatacattgtttggttctctttttttttgcttggcccaattgggttgccgacagttttcacatgtaaaatgaagctcccgccaaatttcaaaattttaaacgctattaaacaaattacaacagatttgaactaaaaatatgattttgacccataaaatgaactaattgcaatcatctaaatatgatttacaatcatttgaattacaatcatatgaactatagtatttgaataaacaaaaacagacaaatatggtacatcttgcctatcccctacagactgtttccatcttcaaataccagacgaacaccagctatttgaagttaaggtatgataccagacgaataccagacgaataaacagacgaatactagacgaataaacagacgaataacaatcatatgaacaccaaacaaataccagacgaataaatataaacagacaaatttggttctctgtttgcaggcgtttgaaacaccaatatagacggacaccactgcccaaaagg

SEQ ID NO: 6716 - DNA, 2086 bp, Zea mays
ccctcgggaccttccgggacaaatactagcaaggtcatctcaatcacgggggacagctattagcttttagccgctggcagacaaattcgacagagcagctcgcctgctggccgcaatccgtccgaccatggcattgctgccgggggcggcgcggcgcctcctctgcagcctcttcctctgtctctggctgtccacgctcgcgcgtgccgcgacgcgccgctacgagtgggaggtcagctaccagttcaaatcgccggactgcgtgcggaagctctccgccaccatcaacgggcagacgcccggcccgaccatccgcgccacgcagggcgacaccgtggaggtgaaggtcaggaactcgctgctgacggagaacctggcgatccactggcacggcatccggcagatcggcacgccgtgggcggacggcacggagggggtgacgcagtgcccgatcctccccggggacaccctcacctacgccttcgtggtggaccgcccggggacgtacatgtaccacgcgcactacggcatgcagcgctcggcggggctgtacggagtcgtcgtcgtcgtcgtcgcggcggcgcccggagccaaggccgacgacgcggagccgttcgcctacgacgacgagcaccacgtgctgctcaacgactggtggcacaacagcacctacgagctggccgtcgggctcgcgtccgtgccaatggtctgggtcggggagccgcactcgctcctcatcaatggccgtgggaggttcaattgctcggcggcggccgtgccggggacctgcaacgccaccagcccggagtgtgacacgccggtgttcgccgtcgtgccgggacagacctaccggtttcgcatcgccagcgtcgcatccttgtccgctctcaactttgagatcgagggccacgaaatgacggtggtggaggcggacgggcactacgtgaagccgttcgtggtgaagaacatcaacatctactccggcgagacctactccgtgctgatcaaggcagaccaagaccccaaccgcaactactggctcgcctccaacgtcgtcagccgccagcctgccacgcccaccggcactgccattctcagctacagcggtgaccgcgcaccgccatcgacgaccccgcccacgggcccggcctggaacgacaccatgtaccggttccagcaaagcgtggcgacggtggcgcacccggcctacgtcgagcctccgccgccgcgcgccgaccgcaccatcctcctgctgaacacacagaacaagatcgacgcgcacaccaagtgggcgctcaacggcgtgtccttcacgctgccgcacacgccctacctggtggccatgaagcgggggctcctggacaccttcgaccagcggccaccgccggagacgtacgcctaccaggggtacgacgtgtacgctccgccgcagaacccgaacgcgacgaccagcgacgggctgtaccgcctgcggttcggctccgtcgtcgacgtggtgctgcagaacgccaacatgctggcgcccaacaagagcgagacgcacccgtggcacctgcacggccacgacttctgggtgctgggctacggtatcggccgcttcgacccggcggtgcacccggcgtcgtacaaccttaaggacccggtactgaagaacacggtggcggtgcatccatatggctggacggcgctgcggttcaaggccgacaaccctggagtgtgggcgttccattgccacatcgaggcccatttcttcatgggaatggggatcgtcttcgaggaaggcattcaacgtgtcgccagtctcccgccggagatcatgggatgcggggaaactaacggtggacaccgatgattatatcatgtattgtagctatgagtgtagtaaacactttctttcctctaatgatatcgtttgtcaaatgttcagtgctctgccgatagcaaaatgtcatacactcgacattactttaccgagtctccctctcaccaaacaagaacactcggaaaacaccctttttactgagatgtgaaaactcggcataaaaatgcactcggcaaatacatctttgccaagcgccgacaccag

SEQ ID NO: 6717 - DNA, 1308 bp, Zea mays
aggctcggctcgggcaagctcgtaagtctctccgagccaagcctaagcgagcctactctgagtttttttttctagccctacttggcacgacctgtgctattgtcagattaggtcaaggtcatatcgtcgatcgttttgcactgcctgtattgtcgtatcgtctgacctgtgactagtgtcggatcaggttgtgttggctcatgcttctctattagatgtgttgggtggagttttttttttttggttgggtcggtttttttttcagattagataaaaaatcatgactcgtgctttgcgaataaaaaactgtgaccgtatccgttacattaattgagtcgggtgtcgggtggctatgctcaagtctaactgtggttccctccaaaatccacgaataaagaggataagccgcagccttcactgtccatcgtctccctctgtactccttcctcagcctcatcctatccaagaacgcagaaccgagacccacgaactcgcagcaggccagcagccatggccgcccccgcaacgagctccctgctgagcacgctgctgcagctaccgctcgctccgttctcggggaagagctcgccgccgtccgtggtgcacgtggcgcgccgggcgccgacggcggtggtggcggccaaggggttcaatgtgcagatcctggtggacgagaacgagggggaggagtccatctttcgcaggttccggcgggaggtgatgcgcgccggcgtgctgcaggagatcaagcgccgccggaggtacgagagcaagacagacgagaagaagcgcaaggcgcgcgaggccggacgccgcaaccgtcgcaggcgtatgatggacgagccgaggttcccagaagaagacgccgacgcgacctccaaggctcgggacgaggacaacgacaactgggaggtcgacggcatcctgtgaaacaaaaggaacgcatgcagtccacagttcaatttcacagcgtccagatgatgcacagcacagacccgtcaaattcgagttctttttgaggcccccccgtaagacgcaatccaaaccgtatatttgcgttttggccgcgttcgtttccacttcagtgtccaatggttacagctgcaattgcacaactaacgttcgcaaatgtagcgtcctccgatcccttctcgttccctgagctcttcttgtgtccatggtgtttgaaaccctactcttgtgtctgttccaacatctatcctttgtgtagcttgcgctcatgaaagttcagaaactgatgaagataaaaaaatgtctctgaaaatgaacaaccaggaatcgcatgcc

SEQ ID NO: 6718 - DNA, 917 bp, Zea mays
tcgggtcaagtctaactgtggttccctccaaatcccaaataacattgggtaccgggagcctccgccggcgatcgtctccctctgtactccttcctcagcctcatcctatccaagaacgcagaaccgagacccacgaactcgcagcagaccagcagccatggccgcccccgcaacgagctccctgctgagcacgctgctgcagctaccgctcgctccgttctcggggaagagctcgccgccgtccgtggcgcacgtggcgcgccgggcgccgacggcggtggtggcggccaaggggtacaatgtgcagattctagtggacgagaacgagggggaggagtccatcttccgtaggttccggcgggaggtgatgcgcgccggcgtgctgcaggagatcaagcgccgccggaggtacgagagcaagacggacgagaagaaacgcaaggcgcgcgaggccggacgccgcaaccgtcgcaggcgtatgatggacgagccgaggttcccagaagaagacgccgacgcgacctccaaggctcgggacgaggacaacgacaactgggaggtcgacggcatcctgtgaaacaaaaggaacgcagtccacagttcaatttcacagcgtccatatgatgcacagcacagacccgtcaaattcgagttctttttggccgcgttcgtttccacttcagtccaatggttacagttgcaattgcacaactaacgttcgcaaatgtagcgtcctccgaccccttctcgttccttgagctcttcttgtgtccatggtgtttgagaccctactggctactactactcttgtgtctgttccaacatctatcctttgtgtagcttgcgctcatgaaagtttcagaaactgatgaagataaaaaaaaaaaaaaaaaaccccactaaaaaaaggcccctag

SEQ ID NO: 6719 - DNA, 2258 bp, Zea mays
gcggaaaaagctgaagctcatctttataccataattaaggtagctcgagatgaggatttgaaggaacaaattggaaagggtatatattttgatttggtggaccatgaaaaggtccataatttccgtatacagaaacaaatgccttttagttgtttcaaggaggaagtagccaaggaatatggcatccctgttcagtttcagcgcttctggttgtgggcaaagaggcaaaaccatacataccgccctaatcgtccattgaccgttcatgaggaaacacaatctgtggggcaactgagagaaatatcaaataaggcacacaatgttgagttgaagctgtttttggaagtagaacttgggctggatttgcggcctctccctcctcctgagaagggcaaggaagatattcttcttttcttcaaattctacaacccagaaaaggaagaactctgtttcatggggaggctctttgtgaaggccttgggaaaaccttcagaaatcctggcaaaactaaacgaaatggctggatttccccctgatcaagaaattgagctttttgaggaaattaagtttgagccaaacgtgatgtgtgaaactatagacaagaaactcacttttcattatagtcagcttgaagatggggacattatttgtttccaaaaatcaccaggagcagaatatgatgcacccgtgcgatatccggatgttccttcatttttggagtatgtccataataggcaggttgtacatttccggtctttggagcccccgcgtccggatgatttttctttggaattgtcaaagcttcatacctatgatgatgttgttgagagagttgctcgccaacttgaattggacgatccagcgaaaattcggcttacaccccacaattgctactctcagcaacctaaaccacagcccgtcaaatatcgaggagtggtgcatctgtcggacatgctcatccactacaatcagacgtctgacatcttgtattatgaagtgttggatataccactgccagaattgcagttcctaaaaaccctgaaagttgcatttcaccatcctacgaaggatgaggttgttattcatagcatcaggcttccaaaaaatagcaccattgctgatgtaataaatgacttgaaaactaaggttgaactgtccagtcctaatgctgaactacgtgtactagaagtcttctaccacaagatctataagatctttccactacatgagaagatagagaatataaacgaccaatattggacactacgtgctgaggagattccagaagaggaaaaaaatataggcccaaatgatcggctaattcatgtttatcacttcaagaaagatattaatcagactcagcagattcagaacttcggagaccctttcgttttggtcgttcatgaaggtgagactttagcagaagtcaagaagcgcatacagagtaaactgcaagtctctgctgatgaattttccaagtggaaatttgcatttatatcaatgaatcggccagactacctccaggattcagatgttgtacctactggctttcagaggagagaggtctacggagcttgggagcaatatcttgggatagagcacgctgatactgcaccaaaaagggtctatacagtgaatcagaaccgtcacgcatacgaaaagccggtcaaaatttacaattgagatttctaactaacatggccgcacggtgaaggcctccatacgagaggagcggccagaaaagggaggacagggaatttatactgtcagggggaaaacctcatagttagcgagccattcggtgtggcacggccatgtattccagcgctagaggccagccactgttatttcatctgtagcagccagcagctcctatagcaatgattttctttttgtacaagattttccttctttgccttagggtgatggcgcgagcgcattggtgtccgtttcggttgggcaattgcttcattcttagagcaaagctgggtacataagattttggtaggaagcgtgtatacaggcaggctgtatagttgtggctctctcggcttgatccctcgtatcttgtcttgtgctattgttaatgcagtgacaggggctgactgtaaatcgtggttccaattttcaggtcccatctcatgcacgacgctttgggggagctttcagaaacttgcggtatttgttggggttgggccttcatgttgatttaatgatgtacggttgaaatgtaatatggtaaagtttctggtcaaatg

SEQ ID NO: 6720 - DNA, 1570 bp, Zea mays
  misc_feature (1553)..(1553): n is a, c, g, or t
tgggtaccccggggcccgcccggggacacagcacaagaacactcctagctgaagatctcgagtgcaacgcaacgttggcgcttggcggccagtagtagcagctaatttagcgtcgctccttcctactagacgagagatcgagaaaccatggccaagctccaagtcactcctggcgccgcgttcaccgagtgcaatgaactcaacttccagggcctgtacatgtaccacacgcccctgggtcccaaggccaaccaagctgcgatcctagagagcaaggccaagatcggcatcggtgccaccgtggttaacaactgggcagtgtatgacgggccagggccaggcgctaagctggtcggccgtgcgcagggcttgcacatcctagccggaaactgggtcaactcattcaccctggtgttcgaggatgaaaggttcagtgggtccacgcttgaagtgaggggcataacggtcgaaactggcgagtgggctgttgttgggggcaccggccagtttgctatggcgaacggcatcatctccaagaagttccacgagcagagaagcgacgggaacgtcatagagcttagtgtccatgctttctgcccgctgctcaaagggaaaaggggcggtgctgtgacaaaggttgggccatggggcggaagcggagggtctccaatggagctgacagagacggagacgcccatgcgtctggagagcatcaccgtccgcagcggcgtggccgtcaactccatctcattctcctacgtcgactctgccggccacaagcgctctgctggtccctggggtggttccggtggacagcctgatcaggtccagctcgccgagtctgaggtggtcacacaagtgtccggaacatacggcaccatcgacgacgacgaccgcaccgtgataacctccattaagttcgtcacgaaccttgacaagacctacgggcctttcggagcgtacggggacggcgacgacacctcctttaccgtccccgtgcagccggggagtggcgccatcgtgggcttcttcgcgcgcgttggcggggccggggactacctggacgccattggcgtctacgtgcgccccctctaaaaagctttgttttgtgatgtgaatgaagcagctgcatgcatgctgctctactccacacagagtcgagtccatcaccaccagctgcttgaatgcgtgcgtgcggccggcttccagttgctttatttcgtacctgagtgttgtgttgtggtgtgtttgctcatgtacttcggtacgttgcttggtaaactctggtcagtgttgtgtgtgtttgcctttgtcatgaatttcgacggaataataaagacctcgtgtagaagaggtcagggttttatcactaaaaaaaaaaaaaaaaaaaacagtaaacgcggtaaagtactacaacaaccaaaaaaaaaaaaaaaaaaaaaaaaaaaaaaaaaaaaaaaaaaaaaaaaaaaaaaaaaagggggggccgcttttaaggaacccaagttttacttcccggtggcttggcaaagtaataactttttttttggggngcccctaaaattaaatt

SEQ ID NO: 6721 - DNA, 1428 bp, Zea mays
agaaaatcgacgccggccgggccgagaacaaaaaaaatagagagagggagagagaggaaacaagggaggagacatggaggaggaaggccatggcatcgtcattgtcggcggcggcatctgcggcctcgccactgctcttgcccttcaccggaaagggattgctagtgtagtgctggagaagtccgagaccttacgatcagacggagccgcgattggtgttcacgccaacggatggagagccctggagcagcttggagtagctgcagagctcagggaaactgcagaccttatcaccgggactcatgacgtgtggcagggggcaaacaagacagcccagcaggtaccagtcaggaaggaactccggtgcttgaaaaggaaggatctcatggagacgatggcgaagaacatacctgcaggatcgatccgcttcggctgccacgtggttgcgatccagcaggatcctggtaccaatggagccattcttactacagtcgatggtggcacgatcagggccaaggttctgatcggctgcgatggcgggagctcggcggtagccaagtacctcggactgtctgagccgaaagcgatccctcgcacggttctgcgtggcttcactgggtatccgcatgggcatccgttcgggaccgagttcctgcggataagatcaggaggggagttcgccgtcggcagattgcctgtcacccgcaacctagttcatttcttcgtaaccgggcctaatcctccaacaggaatggtcaccaataaagacgtgagcgccacgaaggatttcatgctggagaagctgcgaggctgcgctcccgagatcgtcgagatggtccaggactcggacccagagtccctcaacgtcgtgaacagcatccggtaccggcctccgtggcaggtcgcgctcggcaccttccacaggggcgccgtcacggtcgccggcgacgccatgcacgccatgggcccgttcatcggccagggcggctcgtcggcgctcgaggacgccgtcgtgctcgcccgctcgctgtcacgggccgccgccggcgccggcggtcacggtgccgctgttcgggagtacgtccgggagaggaggcccagggtggcgctgctgtctctagagagctttctcgccgggacgctgctgcgcgccaggtcgctggtggggaagcttgcctgtttggctgtcctggcactcctaggcaccaggtcgcttcggcatgccgactacgactgcggtcgcctctaataagccatgcaatttccttgtggatcatggcatggcatctgtatgccgaacaaaaattgtctccatccttcatcccagatgtgctgaaacgatgcatctatttcttttttcctttttaactttgcatgttgaccactacactgaaagcaaatgaacaacattgctggtcagtttgtttc

SEQ ID NO: 6722 - DNA, 1358 bp, Zea mays
acccacgcatccgcggacgcgtgggcggacgcgtgggctagaggagaaagcaagaagtttacgtagggagatagtgaatcattggatcagtaaagaactccagaggctagaaagattttttgacagggcgagtgagaaaggttggcgcaaggaaaagtttgaataccttgataagaaacaactcttgcgcaagccatctgaacaacaacgtttacttgaagaggtgcctcaagttattccagagacagaagataataaagatactgaatttcaagttacaggacaagacaaacctattcaaaagagtactgtcgctttacaaggtaccaatggagagagcattgtttctttgaaaaaaggctcagaagaaaaatgtacatatgtgacaagggcttcttttttgaagagccacacagggaaaaaatccaaaggtactgatggggagagagatctttccttggaaagtttatcggaagaaaaacctgaagttaataaggcccacaccgatggtggtacagctgtaatacacaatcaaaatcggagcactacagctgctattgctgcgctaccaaagtatttgcatcgccatgctgccactgaagccaataatgctggtgatatttcatctgttcaggagctggatggtgaaggtgttaaagctagcacggatgttgatacaactggaacagatgtccagcacgggagcattgaagctactaaagccaacgctgctggtgatgcacctggagcattttttcaaaagcagtgtgctaaagctgctgatgttattaccattgacgacgatgacgaggacaacagtcatcgttgttataaagaagaacaaacagcagtagttgatcttgaagctgattatgctggggataaccatcccgtgcagcttgaggcaaatagtcgaggccataaacacgtgaaggtgaaggagcgcatttggtattacattgatcctcagggtgatgagcaagggccatttacaatgcagcatctgagcatctggtggagcaatggcttcttccccggcgacttcagggtctggagaacaggccaaactagtaatgacgccatcttgctcgtggacgcactgcagatgactaggtaggctagttaggagcctcgaagactagatgtatttatgttctgctggggtgtacatcctttatatgatatgatgatgacatcctatccccaccatcacctcacccaccaatcaaaaacatcttgccaaacaaaacaatggttgtttgatggcaaagacgatttgttgggatgaaatatttgtggactattcagtatccctgtgctgtgacaatgctattgaaaatctggttctttggcatgtt

SEQ ID NO: 6723 - DNA, 3007 bp, Zea mays
cggacggtggacgagacgcgtgggcacgggagcaagcgcccgcggcgggccgaggaggaggcacaggaggaagcggaaatggaaccgctggtgggggaggaggaggaggtggcggcgctggagggggaggactattgcttcgtctgcaaggacggcggtgacctccgcgtctgcgatttcaggggctgccagaaagcttaccatcctgcttgcgtggggaaagatagcggcttcctcaattcagatgaagaattcatctgtgaatggcatacttgctttatttgtaaagggcgttcacgttattattgcttttgctgtccgtggcaagccttttgtcaaaattgcgtgaaacaagcagaattcgtcccagtcttgaggaagacaaagggattctgcaccaactgtttaaggatggcaatcatgattgagaagaatgttgatgttgactccgatggggagagggttgatttcaatgacagggcaacttatgaatttttattcaaggagtattgggaggagatagttaaaggcaaggagagcatgactctggataagcttgaaaaagcatatgcttttctgaaagaaaaactaaactgcaaacaagatctagatttagaaaaggttcatgatgaagaacacagttcagatgatgattttgtgggcaatagtgatgacgacgatgacaacaagccatcttccacaaccaaatttaatggaacatcgaatacaatgaaattcttcctgagggaagataggccaatgaagaatggctatgtgggctggggttcaaaagagctcatggagttcctttcctctataggcaaagatacattgaattccctagatcaacatggtgctactgaagttgtgaaggtgtacattcaacaaaaaggtctcttagcaagagataagaaaaaacttgtcatatgtgatgacaagctcaagattttgtttaggagatcaaaagtgaggtacaacaggatatatagcttgttaggtaagcatattgctgtgaatatgacatcagaggatgaaacttttgctaactctgatgataacaatgaaacatttgtgagaaagaaagctcgtattgggaactacagttccagtactccaaagtgtactccagaaataaacaagagatgttttgctgctcttgttcgccataacattgatttaatctacttgaagaaatctttggttgtggatctactaagggagccggatacatttggcagcaaagttattggctgttttgtgagaataaagattgatctcaacgattatagtttctacatgcataaaaaggtgcaccaacatagaaagttgtatcagcttggactagtaacaggcaccagtaaatcccctgaagaatacaagataaatgatgtatcaacagatattcttttatgtatttccagcatacctgacatcaaaatttcaagtttgtcagatgaagaatacgaagaggaagaatgtcaagaccttcggctgctggccaagaatgaatcctttaaaaggcctactgttggggatctagaggagaaagcaagaagtttacgtagggagatagtgaatcattggatcagtaaagaactccagaggctagaaagattaattgacagggcgagtgagaaaggttggcgcaaggaaaagtttgaataccttgataagaaacaactcttgcgcaagccatctgaacaacaacgtttacttgaagaggtgcctcaagttattccagagacagaagataataaagatactgaatttcaagttacaggacaagacaaacctattcaaaagagtactgtcgctttacaaggtaccaatggagagagcattgtttctttgaaaaaaggctcagaagaaaaatgtaaacatttgcttctatagtatgtgttaaaaaaaaatccatgcaaggcgaacattgtgatgttttttcttccgcgcgtccggaaaaatgtacatatgtgacaagggcttcttttttgaagagccacacagggaaaaaatccaaaggtactgatggggagagagatctttccttggaaagtttatcggaagaaaaacctgaagttaataaggcccacaccgatggtggtacagctgtaatacacaatcaaaatcggagcactacagctgctattgctgcgctaccaaagtatttgcatcgccatgctgccactgaagccaataatgctggtgatatttcatctgttcaggagctggatggtgaaggtgttaaagctagcacggatgttgatacaactggaacagatgttcagcacgggagcattgaagctactaaagccaacgctgctggtgatgcacctggagcattttttcaaaagcagtgtgctaaagctgctgatgttattaccattgacgacgatgacgaggacaacagtcatcgttgttataaagaagaacaaacagcagtagttgatcttgaagctgattatgctggggataaccatcccgtgcagcttgaggcaaatagtcgaggccataaacacgtgaaggtgaaggagcgcatttggtattacattgatcctcagggtgatgagcaagggccatttacaatgcagcatctgagcatctggtggagcaatggcttcttccccggcgacttcagggtctggagaacaggccaaactagtaatgacgccatcttgctcgtggacgcactgcagatgactaggtaggctagttaggagcctcgtagaagactagatgtatttatgtatcgcggaaaaagcgggggggcttcgaggcagatatatgtgttctgctggggtgtacatccttctgtgttatatgatatgatgatgacatcctatccccaccatcacctcacccaccaatcaaaaacatcttgccaaacaaaacaatggttgtttgatggcaaagaggatttgttgggatgaaatatttgtggactattcagtatccctgtgctgtgacaatgctactgaaaatctggttctttggcatgttaggctgtttt

SEQ ID NO: 6724 - DNA, 2615 bp, Zea mays
caaaccgacggagacggatcaccagcattcggatgctcaagctccccccggccgttctgtcgtttttaagcgagcgctcttctcgtgtgcccaactgctggacccgtgctctgctcgtctgccgccggcacacaggcatgcgttttctggctctcagtcttccccgccaatctgttacctgtaccggacgcaagatctgacagagcagttcgcagaagcaacgctcaaggggcagtagctatcgaacagtccagaagcaaagcaaccctgggacctgaagtcgaccgctggtatgtgtatgatgatggcttatgagtaattagcttggttgattcttccttctttagaataagaccgctggtatgtatgatgatggctgcggtgatgcagcttgcagagggtagaatgcgcttccctcttgagtcttgaccacagtcgcaacatcaaagtggagactataggagagagacctttatagcttgtagccacgtgttgtcgcacattgccgcggttcaagttgacgacgcaattttttttttttttttgtacttagcagctgtagtgtagtattatactgtacaaaatagaagcacgcgcacacctggcccttcccttatctgaaactgtaacaattcactctcacggacggactagtccgcatcggccaagctagcatgcgggatcatgccgagccacgcccccacccccaccccgtatggaagcgccgctcacaatcacatatcgtggcgtggggagtgggactggggacacggccgcgttggacttggacccctagcactcgccacacccacacacctgtatgtacagcacgcccacgcatcacgtgcgacagacccctggatcatcattcatcggttcaccggtggctgctgctgctgctgctgggcgccggtgccggcgcggccagcggccagaggcgggagaaggtggacgagacggcgatgccggccatgttgagccccttgctgccgccccagtccggcacgggcacccaccgccactcgcgccgcgcgcggtcgtacgacagccacaccaggttccacgcgccgcggcagttggagatgagcaccagccggaccacgccctcccgctccgccagcagccccgtcatcacggcgtacggcttccggaacccctccaccagcccgcccggcacgctggccaccagctcccagtcgccccccacggccccgaccccgtacagctccacgcccgtcaccaccttgccccggctccggctcgtcgggtcctcgcccgccgccgccgccgccgaccgcaccacggccgcgctcccgtcgccgtacacgtgcagccgctccccgtgtcccgctcccgcggcgccggcgttcgggaaccgggggcggaagaagaccgggcgctcgtccgtgcgcggcccggcgtacaccatcacgcagtccgccccggcgtgcgccgcgcagaggtaggtgccgccgtctccgtctccgtctgggtcggccgcctctgctgccccctccgccaccaggaccgcctccgactcctgccacgtgtccgtctccgaccggtactcgaagaggaacggcgtgttgttcaccagctcagcgaacagaaaccttgcagggaaaagcagcaaccgccggcgtcagatcgatcgagaagcgacattggtggattcgtatcgagttttactgtgcgttgtcaaaattgttgcttcggcactgctaattactagtcgtctgaacataaaaattagtgctggcagcagtgatgacgaatactgtctgtaactgaggaggagagagagaaggtcagggatgcttgcaagtttttttttccttctttttcttgcgtgagcaacacaaagaccctctccgtaagaaaaggacgggtacctaaaccggttccatccggggggatcggcgacgagcttgaggccgaagcgacgccaggaggaggtgccgcgggggccgagcggggacggcgggaggcggcgcgcggcgcgcgcggtgaggtcgacgacgacgagctcgcggcggccgttggcggcgaacaggaaggagctgccggacgcggccaggaagtagaggtcctcgccgggcggcacggcgggggcgaggatcgccgagacggggatgcggaaccagcggcccgagggcccgtggaagcccctgatggcggcgtcgcggggcgggagcttcttgaagaggagcacccacgcggcggccgggccgggcccggaggacgccgacgagaggtggtagaggcgccggaagtccggcgaggagatgaggctggagagcggccgcgccacggagcgcacgcggaggagctccgggacggccaggaggagcaggatctcgtggaggagctccgacgggagcagcagcagcgcgcccagggccgtggcggccgaagggtggtggtgctccccggcgaccgggtggtcgcccatggggttaggtgaggtttaattctgcttggggatcggagtatggcctggggggcttcgcttgtctgggtcgctggggttgtgccgccgcccggtcttacgcaccacacatgtccgaattttttgtattttagccatttttcggaaaaaaattcacgtttagatc

SEQ ID NO: 6725 - DNA, 668 bp, Zea mays
gcacgaggggatcctcaagttacaatgggtagttcaatggtagtggatggctcatttgtatcatctatgtcctctgataactcagtcgaagaaccccgctttcaacgtcgcctggctgctgttagtcagctggatgtgcaaaccaaattgtgcatcagggatggtttataccgattggcacgaagtgcgcaacatagacaagtttttccaaatacgatgaacagcaatggtggtagcgaggacggaaaggaactggagaacgcagaaacttcgtgcaagttcatggaccctcggagcatcgagacgcagacaaacccgatcgatcggtctatagctctgctacttttccgcgagtcatctggcggccatgtccatgtggctgtagcagccgacgatgcctcgtcactgaaatcccctgctggtgtatgatttcctgcctgccacatctcagttccagggccctgctgctaacccaggatgtttctaggcatgtatgtaaaaaaaaaaacaagcgtattgtgtagccaatagtctgtactctgtagtcacattaattttgtcatgcttgtatcctattgctagacggccgatgtgctaacctagtgctgttgactcaaattttatgcgtaatctaaaaaaaattatttctaaaaaaaaaaaaaaaaaaa

SEQ ID NO: 6726 - DNA, 595 bp, Zea mays
  misc_feature (16)..(16): n is a, c, g, or t
ccgggctcagtcgaanaagttgctttcacagctgcaggagctgttagtcagctggatgtgcaaaccaaattgtgcatcagggatggtttataccgattggcacgaagtgcgcaacatagacaagtttttccaaatacgatgaacagcagtggtggtagcgaggacggaaaggaactggagaacgcagaaacttcgtgcaagttcatggaccctcggagcatcgagacgcagacaaacccgatcgatcggtctatagctctgctacttttccgcgagtcatctggcggccatgtccctgtggctgtagcagccgacgatgcctcgtcactgaaatcccctcctggtatatgatttcctgcctgccacatctcacagttccaaggcccctgctgctaacccaggatgtttctaggcatgtatgtaaaaaaaacaagcgtattgtgtagccaatagtctgtactctgtagtcacattaattttgtcatgcttgtatcctattgctagacggccgatgtgctaacctagtggtgttgactcacattttatgcgtaatctaaaaaattatttcttttaagaaagaaaaagaaggggccgc

SEQ ID NO: 6727 - DNA, 1548 bp, Zea mays
cccagcgtccggcccgagccacttacaataatccttgcccaatcccgtctttagccgctagggttacgcgtccacggcgacgacctctgcgcagagcgtgctgcgattggccggccttcctgggatcctccccgcgcccgacacccggaaacgcgcgcgcgcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgctaaaaaaaaaaaaaaaa

SEQ ID NO: 6728 - DNA, 830 bp, Zea mays
gtaccccgcccgccgccccgacgcggaaaaagaagaaaaaggctcgattcgctgttgcctcattgcctgccacagctcgccgccgacgccgtcgccgctcaagtgaagtccggagtgggggcttgcgatctccgctgcgggcgcggaagatggctgatccagagttggaagctatcaggcagagacggatgcgagaactacaacacggtgcggcaaatcagcaaaatgcgggccaagaaaaggctcaggaagacgcgaaacaggaagctgaggaacgccggcaaatgatgcttgctcagatattatcttctgaagcaagagaaaggctttcccgcatagctttggtcaaacctgacaaagcaagaggggtggaggatgttttgctgagagctgctcaaactggtggaatatctgagaaggtgtctgaagaaagactcatctcccttctagagcaaattaacagccacacaagcaagcaaaccaaagttacgattcagaggcgtcggaatgtccttgacgacgatgattagatgcaacctgcaagtctctgcttcgagtgtactattggctggtgataaattaaaagtggtaccgaactgtttagacaatgatctcatgcgactatcagcagcaatgaaaacttggtacttggtagactatttcattggatattcagctgtatatgatccgatgtcttattttggtgtgtgtgcccccatcgaggacagtcgatattggctgtgtttatccccgaaacactgttcttccttgagtcatggcattattaatgggtgcgttttgcactcattttatttctgccaaaaaaaaaa

SEQ ID NO: 6729 - DNA, 917 bp, Zea mays
aagggatgtcgatgttccgatcggacggcgtggagaagggacttcagatcggatggttgagataagacgttggggttcggcgttgcacacacgcggaaaagaagaagctcgattcgctgttttctgccagagcacaccgtggacgccgtccccgctcaagtgaggttcggagctcagagccttgcgatctctcggctgcgcgcgcgcaagatggctgacccagaattggaagctatcaggaagagaaggatggaagaactaatggcaaaacacggtggcggtggggcaaatcaacaaaatgcaagccaacaaaaagctcaggaagacgcgaaacaggaagctgaggaacgccgacagatgatgcttgctcagatattatcttctgaagccagagaaaggatctcccgcatagctttggtcaaacctgacaaagcaagaggggtggaggatgttctgctgagagctgctcaaactggtggaatatctgaaaaggtgtccgaagaaagacttatctcccttctagagcaaattaacacccacacaagcaagcaaaccaaagttacgattcagaggcgtcgaagtgtccttgacgacgacgattagacgcgacctgcaagctttgcctctgagtgcatgatgatgggctggtgattgattgattataagctgtaccgaacttgtttgcttaaagacaatgatctgatgcgactgcaaacagccatcaaaacttggttgtatatgatccgatgtcttgttggtgtaccccccgttgaggacagtcgatgtattggctgtgattatccctgaaacactgttcttccttgagttatagtatttattaatgggtgttcgatctccgaccaaacagcaacaaaacctcttctcgagcagagcggcagcttcggcgcgcgccggcg

SEQ ID NO: 6730 - DNA, 859 bp, Zea mays
cctcgaggccggccggggcccgacacgcggaaaaaaaggaaaaaggctagattcgctgttgcctcattgcctgccacagctcgccgcggacgccgtcgccgctcaagtgaagtccggagtgggggcttgcgatctccgctgcgggcgcggaagatggctgacccagagttggaagctatcaggcagagacggatgcgagaactacaacacggtgcggcaaatcagcaaaatgcgggccaacaaaaggctcaggaagacgcgaaacaggaagctgaggaacgccggcagatgatgcttgctcagatattatcttctgaagcaagagaaaggctttcccgcatagctttggtcaaacctgacaaagcaagaggggtggaggatgttttgctgagagctgctcaaactggtggaatatctgagaaggtgtctgaagaaagactcatctcccttctagagcaaattaacagccacacaagcaagcaaaccaaagttacgattcagaggcgtcggaatgtccttgacgacgatgattagatgcaacctgcaagtctctgcttcgagtgtactattggctggtgataaattaaaagtggtaccgaactgtttagacaatgatctcatgcgactatcagcagcaatgaaaacttggtacttggtacttggtagactatttcattggatattcggctgtatatgatccgatgtcttattttggggtgtgtgtgtgtatgcccccatcgaggacagtcgatattggctgtgtttatccccgaaacactattcttccttgagtcatggcattattaatgggtgctttttgcactcattgagtccagctaaaaaaaaaaaaaggccccta

SEQ ID NO: 6731 - DNA, 5971 bp, Zea mays
tagcgcggccgcggccgcgccccccccacacgcggaaaaagaagaaaaaggctcgattcgctgttgcctcattgcctgccacagctcgccgccgacgccgtcgccgctcaagtgaagtccggagtgggggcttgcgatctccgctgcgggcgcggaagatggctgatccagagttggaagctatcaggcagagacggatgcgagaactacaacacggtgcggcaaatcagcaaaatgcgggccaagaaaaggctcaggaagacgcgaaacaggaagctgaggaacgccggcaaatgatgcttgctcagatattatcttctgaagcaagagaaaggctttcccgcatagctttggtcaaacctgacaaagcaagaggggtggaggatgttttgctgagagctgctcaaactggtggaatatctgagaaggtgtctgaagaaagactcatctcccttctagagcaaattaacagccacacaagcaagcaaaccaaagttacgattcagaggcgtcggaatgtccttgacgacgatgattagatgcaacctgcaagtctctgcttcgagtgtactattggctggtgataaattaaaagtggtaccgaactgtttagacaatgatctcatgcgactatcagcagcaatgaaaacttggtacttggtacttggtagactatttcattggatattcggctgtgtgcagattcagaggcgtcgaagtgtccttgacgacgacgattagacgcgacctgcaagctttgcctctgagtgcatgatgatgggctggtgattgattgattataagctgtaccgaacttgtttgcttaaagacaatgatctgatgcgactgcaaacagccatcaaaacttggttgtatatgatccgatgtcttgttggtgtacccccgttgaggacagtcgatgtattggctgtgattatccctgaaacactgttcttccttgagttatagtatttattaatgggtgttctatctccacgccggccctgtcaacccatttttcagctctggttgctttgcttgcgaaacaaaaaaaaatggcatgtcatggtcatggtacggtgctgcatggatccatcatcatcctgatgttacaggcagtcaggcacaagcatccaacgagagcacctagaagcgtccagaccacagaccagagcggccggccggccacccccacaggccacagcccagggggacgagtgggcgacgccaatcccctgccgcgcgcgtcgctcgaagcgcacgccgcatgcgtccaggccccaccgcccatgccggcgcggcgccacccgcgggccacgggaaggccagcggcgtgggtggcgtcccagtcccagtcccagtcccacccgcgcgcgcatgctcatcgtcatcgcagtcgcgggccaacaaagcgccagcggttttttttttttttgttggagcacgagtgaatggattgcattgcaattgcaacagaaaccatagcctcaaatggaccgttgctaacaattaaccagttacccaattactggtacacgaaaaaatatatatatgtatttatgcatgcatgtatacgacgacagcagctcccggaccgtacggcttcattccctccctgctcgcttcgcttgcgactgaccatggcatccttgtccttccacctccacgcaccgccgcatccacaccacctccacgacgcgcgcaccgacttggagccccaagtctcgcggcggcgcttggcggtggtggacgccttggattggactacatcggtggcgagccagaaccaccgtggagttgcgacggcctgctggttgcattgcaggcggaaaataggaatttatgctagttagtaacatatatatatatatatatatatatatatatatatatatatatatatatatatatatatactccctctgtcttaattcataattggtttgacttttaatcctacttttattttttaccaaaaaaataaaaactaaaagtattatataaaataaagggagaaagcatttaatttttttccaaaacataaaatagtgctggtcaaatatcacggccgaatggagtggggcgcctttgcaacgatacgatatgattgcattgcacggcgaaggaccaggcaggaaaggtccatatacataggacgtgcagatcgtgtaacagtggcgaaggcaaaggcaattggtttgccatcaaggccgaaatggcccacgcagacacagatcttggcacgcgtggtacatcatctgagtggatttatgggcgcgcactccgtacggcaggacgacggcatcaatgcgacacgcgcaaagaagcacggcagcgcgcggcagcagaggccagtgcatgcatgcatgctctagctctactagctagaccagagtacagtgcactgctcttgtgtcttgtgcaatgttctacttgaagctttagatcgtacacctgctagctagctagctagcatccgaatagaaatgctactaaactgaacacgaagtatttccgacgcgacatgctgacacagcagggttaagtgcttagctgtttccttcgttaaatcatcaacactttgaactcagtgctagccaaaggcttcggaaaccaagaaccatcagcatctaatctagctagctatccatgagcgcttcttttgctatatagcagtaagatatgcttctgctaccttgtgcatgtgttgacacaatgcaggaaagaactatagttctagtatattcagcgctgttataaaaaagccattttttgtagaaagctagctagtacattcgatctacatgcgcatgcatctaataagtctttgctctaagtcaacaaaaacaataagaactcataactagccaaattatagattcatagtacattctacatgcgcattcaaacatttgttctagttagcaaaaaaaaaaaaacaagaagaacttgtgttctaaagaactcatagccaaatcatagatccctccacagtccacaccatgcatgatgagaagtaaacgaatatctgcaacagaacaggccggataacagaagcagggacgagtaagtacgtaactgacctgctggtctccccgccgacgccgagcccacggatgtccgggggcaactcggcggcctcgcctcccttgtccaccaccggcattgctgtcgtcgtctctccttgcaggcgccctggcgggcttggggcttccaaaggagcagcgagagaggaagcaggctccaaaccgcggaggagaaatgggagcaattaagctgtggagtgaccgagtgagtgagtgagtgaggacagatagagagggagagcggaggaggctcgtgtgccgctttactggtagctctgtacgacgcagtagcagtacgcaaggaaaggagccaaaggataaaggaaacgcaagggagcaatggctgtgtgtcagctattatttctgctttttctccggcctgcacagtacatctttgtatgcttgctgccacggcgcaccggctctctctctctgtctgtctggaactgcgagtgtttttggacaacgtagtagcttggtttgatttgagccggcgctgtcagtcttatcaagcggacgcaactgcaaaagcacgccatcgtgtcacatcaccagtcagtcgccagacgacggcgagggcccactcaccatggtgggggaccacctgccagagacaagagaatcttcttcgtccgctgcccgccggaactgaactcggctgggctcggtccagtccaggactgtttagcttagcgttgctcctgattgcattgccgcagccgctgctatgctactgctagctcttcgtctccttcgtccaccatctcagttcaggcaggctgctcgcgctctgcgcgatggcagttccgatccagtagtgcgtgctctacagctcacaagcatggccacgcacgcacacgacccgaccgcgtgcgtacctgtccgtgcaccattggcttgcattgcatggatggtccgtagtatctcactgtttcaggaccacgcagtattagcgaaagaagctcctctttccggtttgtttgcctgactgtctttgaacgtgaggcatgcgatgcgcgcatgcacggtgtgtgtctgtctgccatgcctgcgcttgcgctgtgcgtgatgaccgagcggcacgcagacaacagtcacagagtcggaatggctttggctctgcctgtctgtcctcctcctggcgcctgccggcggcagcggctcgctttaatcgtgcgtgtctcaggaaacgggcaaaggaccgcgaaaccggagagagagagagagcgaaagatacgcctgcttcccttcctttgaattttggctccgtctctgcagcggttttgaaccgtccttgggtctctcgtgtactgtatgctgtgacgctacacttgcgacgggtcccacgggggacaagtgaggccgtctcccacctcttgtatttcggtctcgtcttatttcaaactttactttataaataatattgtctacaatataaaacagtactactttacactcatatacacaatccactatagacatccttaaatttagttagagatcaaacgatttaagagggaaatgaactaatttctctctcaataccttctaaacccaaagataatttgtagtggattagaggcaaaatcaattcattttttctttcgatcccctacaatacctaagaagatttgaattttcaaactaacccttagagctcgttcgattagaagtgggctgaagtagattaaatccgtcactagttaaattgaatataaaagaatttaatctcatctgatgatccctgtgcaaaccgaataagactttagatttgttgataaccaaaagtatgctaacataaaaatccgattcttccaataggtttatggcatcaagaaaatattgggagagaaaaatagtgccacgacatcaaagcttaagcgaaaagaacaaagaaaaatattcggtgtcttgggctgctggcctagaaactctgtgatatatatatatgtgcattgtctacaaagtcccacaatcatttaccttacatcgtattttaaaaatgaggcagaaggaaatttgcatttctcctaagattgcattgtcttcagaaattatgatagatggagggagtaactaactcattattcactaacgttcaaatacgtgctgcgtgattcgcaagaataaaaaacgtttgctctagttggagagaaaaatcgatctaccgcggaatccatgggtgtgggagacgatgactttcgatatactgttatatatctctactaagcatcaataaccattatttccaccgtcaacatttttgaaaaaaaaaatcattttttctttagttaacccgcggtcaataatgtcaggaagtggggccaaacggtacttcgaacttggaacgagcatgaagagattaacgagacatttttcttttgagttttttttgggggattggtcgcgcaagatctttggtcttcccccggataccgatgaaaaagtgggtcgtttcttatagactcgctcagaatgattcttctctatctatagttcgtggcctattagaagtagattgcagtcgggttgataataattgaatgtcattacttcgtcggtccaaaccaaggaatccgtttgaaatgttttaaaatagatattgttctctctttgattagggatgctatatgaaaagaagtggattttgaaaaaaggaacgaaatggctaaaccggaactgctagaggaacgcattttcaatagcataacttgggctcctagaatatggggcccttgggacaatctatttgattgcagggacatgtacgctgaatatgactggggatttttctatgggtattggagcgggtccaagcagattaaagaggatgagttgtcagagactgctatttatttgaattatttctagtatatttatcagct

SEQ ID NO: 6732 - DNA, 784 bp, Zea mays
agagccaccgtggacgccgtccccgctcagtgaggttcggagctcagagccttgcgatctctcggctgcgcgcgcgcaagatggctgacccagagttggaagctatcaggaagagaaggatggaagaactaatggcaaaacacggtggggcaaatcaacaaaatgcaagccaacaaaaagctcaggaagacgcgaaacaggaagcgcaggggcgccgacggatgatgcttgctcagatattatcttctgaagccagagaaaggatctcccgcatagctttggtcaaacctgacaaagcaagaggggtggaggatgttctgctgagagctgctcaaactggtggaatatctgaaaaggtgtccgaagaaagacttatctcccttctagagcaaattaacacccacacaagcaagcaaaccaaagttacgattcagaggcgtcgaagtgtccttgacgacgacgattagacgcgacctgcaagctttgcctctgagtgcgtgatgatgggctggtgattgattgattataagcggtaccgaacttgtttgcttaaagacaatgatctgatgcgactgcaaacagccatcaaaacttggttgtatatgatccgatgtcttgttggtgtaccccccgttgaggacagtcgatgtattggctgtgattatccctgaaaccctgttcttccttgagttatagtacttattaatgggtgttcgatctccaaaaaaaaaaaaaaaaaaaaaaaaaaaaaaaaaaaaaaggactctgcgttgttaccactgct

SEQ ID NO: 6733 - DNA, 2466 bp, Zea mays
  misc_feature (994)..(994): n is a, c, g, or t
  misc_feature (1241)..(1241): n is a, c, g, or t
  misc_feature (1318)..(1318): n is a, c, g, or t
tcatgttctcaatgaatcactaattccctaggaatagcacaagatgaagcccgaatggtagaatctcgtcgtaatggattggatctatgccggggtcccggcccaggtactctcctagttgggttgtccgtcttcaacattcctccataagacagatttcctcgattccttgctatattctattctcgaacagaggtcagtcccgcttcctcctcttttttgagtgagtggctttctctttttagaagtcgaagtctagacctggctaagtctggcacctttcttgtagcagggctacgtcctaatggattgtttcacgctcgaggcacctagaatgtcatctttgtccagagcagaggaatgaggactttctttcactgaaaagcaaagcgggcgggctggtgttggtcaacctctaccttggcctatgagaagctgtagtgtaggttgttctacaaaggcggcttgtccctcatcaatcttgtggatgagtctctctgctccaaaccattgggatgaatcgattccatagcacaggcgcgtgcgctgaggaagagcggtatggatggagtcgagatccattgctgccgcagtcataggttcgttagtcagctcagaagcaagcatgagcacgctgtgacaaagaagtcctgttcctgttctatttgaagttgaaggtgctctggtgcaatccttaccgacagaaaaagattgcagtcgggttgataataatcgagtgccattacttcgtcggtccgaaccaaggaaaggaatccgttagaaatgttttgaaatggatattgttctctctttgattagggatgctatatgaaaagaagtggagtttgaaaaagggaacggaatggtcaaaccggaactgctagaggaacgaattttcaatagcataacttgggctcctagaatatgggtggggcccttgggacaatctatttgattgcagggacaggtacgctgaatatgactggggattttnctatgggtattggagcgggtccaagcagattaaagaggatgagttgtcagagactgctatttattcgaattatttatggtatatttatcataaaaagggggaggtgcaagagactgattcggacttcttgcagagtggaacaatgcagtaccagacacgagatatatctttcaaagaagaaggcttttttcgaataagccaattgatttgggaccttcggatccattctttttcctattcaaagatnaggcctttgtctctgtgttttcacgtcgagaattctttgcagatgaagatgaagagatggcaaagcggcttagtacnagtacctggagaaaaaagcctcctaaacatatggctagcaactggttcaccaggagtacgcaagaaaggcaaaagcactacgaattattgatttaggaatgggaatgggctagaaccctgggctcttccttatataattaatggtcttttcattctaatactctatccgagagttctcagtatttagcaaagctgttcctatctaacggaaggctcctggatcaaatgacaaagacattgtttgtggagaaagaggtggcttttcccggatgaaatgaaacatttcatttgtgtaacaggagaaagatttcccactccttagccgtaaagatatgtggccatgaaaaagggaggggattcagtggaacaggattggccgggcggtagagtcgtggaaacacttgttgattcctattttggaccctagctccatggaacaatatgctactgcggaaacatggaagaattgcaatcttagatcaaaacactatgtatgggatgatatgaactgcctaaataagaattcttgagcgtcgaataacctgattactaactacatcaaacaatttgcattaatgaaactgtgtaaatccaccggataatcaaaaatacgcatgtctgatgaaatggttgttgctatctgtttccataacgaatccttggtttaactgaataagtaaagaaaatggaccctttctcttcgtctcagatcgatggatcttctcgattggaagatctcccatatggataatacacattccagttgaccgagcctaatgctaattgttttgttccgaagcaaagatatccgcggaggccggttcgttcgtcctattctgatattcaggaccaagaggtcctggattctctttcggataggccctgaaaggagaagagaagctgaaatgccaacggacctctgtctattctctaattcacccgatccgatagtgcccgtttttggaacgtccagtgcccaagtcactgaaatgggtaagtcacaaatccaatccccttgacaaatcgggtgtcatattagatatcatattctatatatatagaaatatcctaggatagacatatagaaatttttggttgggaaattcgaaatgatcattgagtggaaaaggagcaagaatgacaaaaga

SEQ ID NO: 6734 - DNA, 1468 bp, Zea mays
gcagggaattttttccacagacccagggcgacggcgccagaccacgtgctgggtcgacccgaccccgagcttggttcgagttcagttcagtgtacctgtccactttcctcgccgaaaccaaggcggtaggaggaggacgaaggccgctgcggaccttcgtctcaccctcgctgcaccttccttccccccctaccggcccaccccacgccgcgattaattaagcgcgcaccggacctgagtacctgacctcacgcatccatcgaccaaaacggcagctccttttctcccgcggcgttgccgtcgcactcgcacgcacgcactcaccgccggcctgagcctaatcctaatcctaatcctaatccacataccgggacaatccagacgaacgagcgaaccaacgcacggacggccaccagccgctgcgtgcgttcgctttcccccgaaacgtgacccgagcctagctgcagtcatcgcggcgcccgcgcccgctccgggccgcgccacgatgctccaagcccaacgacgccgagccctcgccgtccccaccgtccaccgcggccgccggcggcgtccggcgccaggtgctctcgcccgagggccgcgcgaagctggacccgcggccggaccgcgacttctacgcgctcccgcgcctggtgacgcacgtggacgacggcttcatcgccacgctcacgggcctctaccgggagcgcctccgcgccgggtgggacgtgctggacctcatgagctcctgggtcagccacctgccgccggaggtccggttccggcgcgtcgtcggccacgggctgaacgcgcaggagctcgccaggaacccgcgcctggacctcttcttcgtcaaggacctcaacaaggagcagcggctggagctggagagcggcaccttcgatgccgtgctctgcaccgtcagcgtgcagtacctgcagtcccctgaaaaggttttcgcggagatcttccgggtgctgaagccagggggcgtgtgcatcgtcagcttcagcaaccggatgttctacgagaaggccatcagcgcgtggcgggacgggaccgcgtacagccgcgtgcagctcgtcacgcagtacttccagtgcgtggaggggttcacgcagcccgaggtgatcaggaagctgccgtcggccggcggatcgccgtcctcgccgctggacgccgtgctgaggctgttcggcgtggcaggctccgacccgttctacgcagttatctcgtacaggaacttcaagccaatgtgacaccctgattgacagaacccgtgcagcattgcgatatgcagtgcatacgatctatagaatcactactggtgcaaagctagtttgtacttgtacatgcacacttcagcattagctgtctagctcagcggcgggcagatgcaagttcgttcagaagctcaaaacatcatccaccgaccatctgattcagaaacatgctagcgatccttctt

SEQ ID NO: 6735 - DNA, 4243 bp, Zea mays
ctgccaaactagcccttagcctacctttgcccctcccagccgtgggacgcgccacccttactccttactcccagctgccgcacacgtggaggctccacgcgaccacgcggcagcggcacgccggcacgcgcgccacccggcgcccctcagcctcgcgcctcagtctcgcgctctcgccgcgttaagccggtcagccttgcgggttgcggtctcgccgccgacgccgggcgccggggattgccgcctgcccgccttgctggagacgggagacgccatgtccttgctgctcctgcccctctgtcgaacctccgcggaccgcgccgttccctggttgtcgtaggacgtcggcaggagcccctccgccgtcacccgtcagacgcgccaccgcggcgccgcctccccaggctcccctgctctgctccacagcttcagtgctccgtgcaagagcaggaagactcttccagtaatcatgggtgcatgtgcctcttcatctcgtggtcgacccaaccatggcaagaaccagaaatcagcaaaggtcgcggcaattccatgtactccggcagcgcaggtaggtcgtggtgctgcctcttctgaaatggaagagaagagcagcttcatttggcaaatcgatggcttctcctcgcttcttgacaagcaagaaggatggaccaactccggatattttaagatcaaggaccttaattggtacttgcagttgaacctgaaggaccggaagagtggcgacgaaagagaatacgtctctcttatcctcgtgctgtcaaaaacttctggtctggaacccgacaccattgtcgaagcatcgttcaagctcttgatatacgatcaagcatacggacgacatagcgaacatgaatttagccacagattccagactacagagagcagcaggagctccgggatctcatgcatgatcctcgtctacacactcaaggaaccctcctccggtttcatcgttggtgacagctgtgtcttcggagtggagctcatcaagttcaccactgctaaagtcaaggacggttcaggaacgctgcatgttcagaagagaattggcttctgtagtgcccgggaggcctacacctggatcatcaatgacttcttaagcctgaaggggcggtgctactcaccggagtttgagatcggtggacacaaatggtacctgaccatgtacccttctggcactggcatcgacggtgataaggaaattctctccctctacctgcatatggccaagccaaacggagacgcttccctccagaactctggggtgcttgtagaagtcagtctgtccatcaaagacaaggtgaccagcaatcgcaaaacaatgacaggccggtgccagctccaagcgacggagggcgaaggctggggatggtcaaatttcatggcgacgaagtctgtgaaggactggtaccttgtgaagggcagctgcttaatcgaggcagatgttgccattcttggatcgtccaagatgaattagggatcatacgactctctacttttgtgcgtgtgccgagccaataatggaattgtgcagcgttagaccttatctgtttcatccctaaatcatagtgattaggaaggattggagaggattgaggagaattttgactgttaggaaatttaatccccttaatccctcctaacacccttgctttagggggtaacaaaaaggatttgactactatacttttagggtataatataccagtaactattttatgtgaagcatgcacaaaaacgtaagtgatttagtggtattgtgtcatttacccggtgtgtagagtggatcataggtagtgcttggttttggagtaggtagtgtttggttttagagtatggtgggatagagccactttattcataatttgttgttatttggattggttccatttggaacagagtgattctaaaaaaaaagaaaattataatcaaatggtgaaccatccggctacataaaatctacccacttcatctcaactggctcagaaccaaacactatagtgaggaattgagtggaaagatccataaagtccccgcgttgagtttgtgttctgcccttacggccttacctgtgctttggcggcggccttctcatccctagcgcccctctcttccccgtcgatggctgtgacctagctagtgtcgaaggccatgatgaaaacttctgcctaaccttctcatgaagctgagtagtggtagagaaagttgcatgatgcttgcttctagttgttggacataaagactgagagttcctctcttgctcctagactcctagctgtgatcaaaagtaagttatgttattcggtgtcccatcttgcttctcccgaggttggctttttctcagttgtgtcttttggttgctattacaggttaagctatgtcccaacttagtttctcatccttcaagccaccattggtggttctacgaaggattttgaagttgttcttctcgctacttgagtgttttggttttcatatcgccaagctgtgttcttttgtttgttcttccttcaaagtctacttcattccatctctagagtaacggaggtcctcattggtttcaagaatggaacacttaattattggaagatgaaacttcatggacaagttgtctcacatctccaatctggttaggccaagtttttttttgctgatgtggtaaaaaaattaaccccttactagccacaaccgaattcgcttgctaccgtgaaatttgagaaaaaaagtgattttatgagatactttttttttcaagaggatcgtgattctcaccactgacaatatccaacgttgtacccaaggccgcaacaaccctccttgaggtccatgtaataggttacttgctctcaccggacggccaatgactctaaaatttagaagttgaagtctaaaattcaaattttaatgtttttacatataaaaaggaaaaaagttacctcaggtctcatcctagcatttagcccaactagagcccacaccaagcccaacatcaagcccaaacccacgtttccagtccacttcgtcatgcgcgtcaacctccgtcccgaattccccgttcgctcacctagctgaacgccgatccacggtacgccgcgtcatgcctgccgccgcaccgcacccaccgccggcgagcctggacgcgcgcacgggcggccgcatcctgcgccgcgcggcggggcatctccttcacccagcatccctcccgccactcctcctcgcagcgctcctcctccttctcttccgctccgctctcctggccggcacgctccgcctcgcctccttcgcggaccgtgacccggccctccgctcccttctcgcccgcctctcccctcccaacacgccgtcgccgccgcctcccccgcaccacctcccacggcgccgctcgccgttcacctccccctcgtcctccctctccgacgacgatatcctagtcagcccccttgatcccgctgcctcagccccctcccgccgccgcaacgcctcctactaccatgtgctagtcacctcctactccgccgcgcccaaaccctatccgttgccgctccccaacccgctcccggcctccgcttcccccttcttccttgccgtctacaatgagacggcgcctccgaagcccgcctcgccgctgggcagagaattcggttttcttgccctgaccaggcgcgacgcagcggccatcgtcaacctcctcgcgctgctctcctccgcacatatcttcgcgatccttggctacatcgccgtgcactccgccgcgctgggcgcagtgtttgcgtccgtggcggggcaccacgtacctgggcggcgtctagtgttcctcctcacctgtgctgcgaggggcgctaagagactcacagggttcacgttcctgcggtgggccacgcgggacgccgttgtgcagatgctctgcctctggttctttgcggatgtgcacgatcaggcccagctgttcaggctctttgtggtcgccaaactgatgccattctccacatccgttaacccgtggcttggtgcagtcgttgcaggcccagagctcgatggtttctttgttgcctgggctgttcttgatgcagtggtgtcagttttgttcactgtggtgccttgggtggttgtcatggaccgtgatccacggccgcctgggcacaatgctgtgaaggaagggtgctatcttgtgtctctgatggcaactgatgccacatttctcaagtgctgggaaacagttgtg

SEQ ID NO: 6736 - DNA, 1230 bp, Zea mays
gcccgattccccattcgctcctcacctctctgaacgccgatccacgctagaacgcgccatgccggccgatgccgctgccgctgccgccgcgcccgcccccgcaccgcatccacctccggcgatcctggacgctcgcacgggcggccgcatcctacgccgcgcggcggggcatctcgtccacccagcctctctcccgccgctcctcctcgcggcgctcctcctcctcctcttccgctccgctctcctggctggcacgctccgtctcgcctcctttgctgaccacgacccggccctccgctcccttctcgcccgcctctcctctcccaatccgccatcgccgccgcctcccccacaccacctcccgcgacgccgctcgccgttcacctccccctcgtcctctctctccgacgatgatatcctggtcagccccctcgatcccaccgcctcaactccctcccgccgccgcaactcctcctaccaccatgtccaattcacctcctactccaccgtgcccaaaccctatacgttgccgctcccggcctccgcttcccccttcttcatcgccgtctataatgagacggcgcctccgaagcccgcctcgcggcggggcagcgagcttggcctgcttgacttgaccaggcgggacgcagcggccatcgtcaacctcctcgcgctgctgtcgtccgcacatatcttcgcgatcctcgggtacatcgccgtgcactccattgcgctgggcgcagtgtttgcgtccgtggcggggcaccacagacctgggcagcgtctagtgttcctcctcaccggtgctgccaagggcgctaagagactcacagggttcgcgttcctccggtgggccacgagggacgccgttgtgcagatgctctgcctctggttctttgccgatgtgcacgaccaggcccagctgttcaggctctttgtggtcgccaaactcatgccattctccgcgtctgttaatccgtggcttggtgcagcggttgcaggcccagagctcggtggtttctttgttgcctgggctgtttttgatgcagttgtatcggttttgttcactgtggtgccttgggtggttgtcatggaccgtgatccacggccgcctgggcgcaatgctgtgaaggaagggtgctatcttggtatctctgatggcaactgatgccactatgctcaagtgctggggaaacagttgtttgtggcagcagggggcggctcatcatg

SEQ ID NO: 6737 - DNA, 2673 bp, Zea mays
  misc_feature (38)..(38): n is a, c, g, or t
  misc_feature (47)..(49): n is a, c, g, or t
  misc_feature (81)..(82): n is a, c, g, or t
  misc_feature (94)..(94): n is a, c, g, or t
  misc_feature (99)..(102): n is a, c, g, or t
  misc_feature (116)..(118): n is a, c, g, or t
  misc_feature (129)..(129): n is a, c, g, or t
  misc_feature (132)..(135): n is a, c, g, or t
  misc_feature (137)..(141): n is a, c, g, or t
  misc_feature (143)..(143): n is a, c, g, or t
  misc_feature (149)..(193): n is a, c, g, or t
gggggccccggccggggggccccggggggccgccgccngggggcggnnncgccccccgggcggggccccgggcggcggggnngccccggcgcgncgccnnnncggggggccccccnnnccccccccccnccnnnncnnnnncncccccnnnnnnnnnnnnnnnnnnnnnnnnnnnnnnnnnnnnnnnnnnnnncccccccccccccctgagatcgagccacagaggttagataaaagatcaacactaaaggcagtaattacatgatgccatgatcatataagcaaagattaatttaatctactatgaagcagcaaaaacgagtgtttattccaagaatttgtagggaggtattaaaaaatacataaaatatatatgcttagtcgataaagaagctttttatacttataaaatatttatacctagattggttttgtctaggtttgtcctcagccaaacctttttagcttttactgtcgacatctaaaattttacatagattgacaatacaagcaaggttgttgacattcctaaattcattgtgaaaactacttttatgatatataactcttccattgaatataatatatttttatggatgctgccagacaaaattagagtagctagtttgagtttggacaaacttagatggacctacatctgtgatcggatgaagtaatttattcaatctttacattgaatttcacttattatttcaactatagctgagttggactccttttcttttttttaaaaaaaaacattgactaaatttggatttcacctttttattctattaacttatatgtaccaaatattacagctcctggatgacagagcagataagaagcgtgcaggcttcatcgttctcatttcggatggtctagacggccagttcaaatggggagatgagagtatcacccccacggatcccatccgaggcctcctccgaaagtacccagtccacacctttggtttgggcaaggctcacgacccaagggcactgcactatatcgctaacatatcctacggaatctattcctccatcaccgacaacctcgagaacaagatcatagaggcatttgccgtctgcttagctgggttcaagaccgtagtagccgtcgacgtctgtgttgacatcaggtcaagcagtttgctgataacaaagatcgactctgggggttacatactccgggggagtaccggaggcatcttggttggcacactctatgctggggaggtgaaggacttcattgtctacttttcatatcataccgggagttggtcgagtggttaccatacaactttgaatgggattgctgctagtgtcacgtacaaggaagcgccgggcaggcagtcaactgccactgactcttgctcagtgtcactcccgattcacgtgaccgacaccgtgtatcctcctgaaaacccctgcccaccctaccccatggtcctgcagcagatggtgcggttcaaggtgctagacttgcttataagcgtcctgaaagaattcctggtcctgaagggggaggctgctagtgccgtccacgggaaggaaggaggagatgacccggtcttgcaggccatcgcagcgagcttgctgcagaggaagtggaaagagttcaagcagtccgatgaatcctggaaagaagccccgaggaacttccttgacctgggaggcatcgacaaggacatcaacaccatggtggatatcctggagcagggcttgggtgttggatgcatccactcatggctgtcgagctatcagatgcagcgcgcgacaattacaggcttgccaggatctcacatggttgcaaccggccaattccgcacgccagcgatgaacgcaatggtccaggaggcccataggcatttggccaaggaagcatctgcccaagatgcggggacgtcaattgtctgcaagcgcgccgttgagcttctagatggggtcaacaagcgattcgacctctggtgcaagctggaccatgacttgccgcgcactaaccaaccgtcatcgcaccaagaagaaggccatgagtcccgcgacatcaccgacgtcctgcatgggaacatcaaccgagcgaggcagcatgacatatacatggtacgtatatacatatctatggatctgaattcattaaggtcccattctgtgtttgtcttggatgcaggctgccgatcacgcgatcaagcaatggcggagcttcctcacatccgtggagaagacacatggccatgggccggacaagtaggcgcatgatgaggccaccggcagctaccacaaaccccagaacacagcgtgagtggtgttgtgtcgatgcagactcagacatactacaccatataaataaataaatttaatgagcgagaggccctgacaccagtgcctccgccgactccctccgatcctgagaataatatttgtgcgtactgtccctccgtcctcatggccattatattggtcatttgatttcccgtgtgttcactactgttgttctctaattactagtcctgatcagttccggacgactaagctgtaataatgtatcttttattttcttttttatattaatataaaagaccatatgtgtatgcgtcggtcaaaaaaaaaaaaaaaaaaaactcgagggggggcccggtacccaattctgtttaaacacaataaagtgggaacg

SEQ ID NO: 6738 - DNA, 1194 bp, Zea mays
ctatagtgtcacctaaatccccagtcgaccactactgacacttgctcggtgtcgctcccaattcacgtggccaacagctcatctcctcctgcaaacccctgcccaccctaccccatggtcctgcagcagatggtccggttgaaggtgctagacttgcttataagcgtcctgaaagaattcctggtcctgaagggggaggctgctagtgccgtccacgggaaggaaggaggagatgacccggtcttgcaggccatcgcagcgagcttgctgcagaggaagtggaaagagttcaagcagtccgatgaatcctggaaagaagccccgaggaacttcgttaacctgggaggcatcgacgaggacatcagcgccatggtgggtatcctgaagcggggcttgggtgttggatgcatccactcatggctgtcgagcaatcagatgcagcgcgcgacagctacaggcggcttgccaggggctcacatggttgcaacaggcccaattccgcacgccagcgatgaacgcaatggtgcaggaggcccataggcatttggccaggggagcattctgcccatgatgcggggacatcaattgtttgcaagcgcgccgtcgagcttctagatgggataaacaagcgattcgatctctggtgcaagctggaccaggaattgccgcgcacgaaccaaccgtcaccacaccaggaagaaggccatgagtcccgtgacctcaccgccgtcctacggggggacatcaaccgagcgaggcagcatgacatatacctggctgccgatcacgcgatcaagcaatggcgcagcttcctcacatccgtggagaagacgcatggccacgggcatatatgatgaggccactggcaacccccacagcgtgagtggcgttcagtcgatgcagactcagacatacccaattaatataagtaaataaataaatttaatgagcgagaggccgtgacaccagtccctccgatcctgagaataattaatatttgtgcgtactatcctcatcgtcaatatattggtcctttgatttcccgtgtgttcacttactattgttctctaattactagtcctgatcagttccggacgactaagctgtaataatgtatcttttcttttcttttttattaataaaagcccatatgtatatatatgcgtcagtcaagcgcctatgggtagtaaacac

SEQ ID NO: 6739 - DNA, 1866 bp, Zea mays
cccccccaaaaaaaaagcgaagagagggttttaatacgattccactcttctcaacaaatttgacgtttttgttcttcgaaattcaaattcacccagaaaaaatctcaatccgcgatggttgaagaatcagcttctgcgtcggaagcttcggtgatacaaaccctaaccgagccggcgacggagattgcgcaaaccctagaacctaacctagcctcaatcgaagccaccgtcgaatcggttgttcagggaggcactgaatcgacttgtaacaacgacgctaataacaacaacgccgctgacagtgctgctactgaggtttgtgatgaggagcgtgagaagacgcttgagttcgctgaggaattgacggagaaaggctctgtgtttttgaaagagaacgatttcgctgaagccgtcgattgcttcagccgtgctctcgaaatcagggttgcacattatggtgaacttgatgctgagtgtataaacgcatactatcgatatggattcgctctcctggcaaaggctcaagctgaagctgatccacttgggaacatgcctaagaaagaaggtgaagttcagcaagagtccagcaatggtgaatcgctggctccttctgttgtttcaggtgacccagagagacaagggagttcaagtgggcaagaaggttctggtggtaaagaccaaggagaggatggtgaagattgtcaagatgatgacctatctgatgctgatggtgatgctgatgaagatgagtctgatttggatatggcctggaaaatgctggacattgctagggttattactgacaaacagtctactgagacaatggaaaaagtggatatactctgttcgcttgctgaagtgtccttggaaagagaggacattgagtcttccctgtctgactacaagaatgcattatccatcttagagagactggttgagcccgacagtcgacgcacagctgaattaaacttccgcatctgcatttgtcttgagactggatgtcagcctaaggaagcaataccatattgtcaaaaagctttgttaatatgcaaagctcggatggagaggctcagtaatgaaatcaaaggtgcatctggttcagcaacttcctcaaccgtctctgaaatagatgaaggcatccaacaatcatccaatgttccttacattgataaatctgcttcagacaaagaagttgagatcggagacttagctggtctcgctgaagatctagaaaagaagcttgaggatttaaaacaacaagcagagaacccaaagcaggttcttgctgagctaatgggcatggtatcagctaagccaaatgccagtgacaaggttgttcctgctgctgctgaaatgagctcttctaggatgggaactgtgaacaccaatttcggtaaagatttagagtcgcctacagtctcaaccgctcataccggtgcagcaggaggaggagcagcatcaggtgttactcacttgggtgttgttggaagaggagtgaagagagttttgatgaatacaacctcgattgaatcaagtgcatcaaagaaaccagctctagagttttcagacaaagcagatggcaactcctcttgaaaccggaaaaggtataaaaattcctgttactagtgaagtatctaacctaagaaaactgagaaaaacatttggtatcttcctcatgaatcttccaagactagattttcaggttcatgttttgtaatggagtccgtacttgctacttttttaaatcgctgagatattttttactttttattgttgtttaatcagtcttattttttcaaaaaaaaaaaaaaaaaaaactcgagggggggcccggtacaacacaataaagttggaactggagggggg

SEQ ID NO: 6740 - DNA, 862 bp, Zea mays
attaaaaaccatatacgaggccacccagggtacggcggcgctcggttccgtggcggggagtgttttccaggcggcggcgcggtagcgtgaaaccgggcgaccgagcaagcgacggccatggcgttctggcagacgcgcgattttctcttctgtggcatatgcggcaccctcctcaccttcgactccgtccgctccgcctcctgccctctatgcggcttcaagcgcgatgccaaagaaattgaagggaaagaaatacagtacacgatgaccgccgaggatattcgaagagggttaaagacacaaacggaggacgttgttgggcaaagaccagtgacaaataaagcctgtccaaaatgcgaccatccaaaagctgaattttacaacatacaggttagcaactaatccttcagcattggatgaccaatccttccaggttttacgtatccaattattgctcttgacaccggaaattgcagatgcgttcagcagatgagggagagacgacgttctacatgtgtaaaggatgcggctgtaatttcaaagacgaatgaggagttatcctaccacttctacggatatatggcattggtgccgaagaaatttccagcgttgacagactagtactccctccgccctttttttatttatcatcgtctagttcaaaaatgaacggccgataaatattcgagaattgcaatctactccttgacattgttacattacatggatgcgcagatccatgcgttgtgcaaactttcttttgatggaacctgttttgtattttattcgagtgtgtagatgtctacttgcaacctttttacatctattccaaactataagacgtttaaaacaaaaaaaaaaa

SEQ ID NO: 6741 - DNA, 7080 bp, Zea mays
ccaagtaaattgtgtacggtgaattcttgctctctgccatgccacgcagctttatcgaacacttccaaccttcggaactctagtgctcaaggccatagcccatagcggcaagcagttggagtgttatatatatgcatctgctgtagtagactagctactagtagtgctccgcccgtgcacacaaagggcaggaccgcaggagcacacacctcagtgcgccagcgttctgcacctcgctagctcgtcgtcttgcctgcgctgtcgtcgctgatccttgagatctgcagactccatggagcctgcagcagcgacgacggcggcggcgcttcttcctcccgctcggaaggtgttcatcctgcccctgcttctcctcctggctgcatcgtcgctggttccacgagcttcgtctggtgagctagagtcccacgggaaaagactctgcatgcgtctaacctttgcttggctgacaatggatcgattcattaattccgtgttgcgtgcttgcagatggagcgcaatatgattatagagcttacactgaggtgtgcaaatgcatcgtatctctctctctctctctctctctctgtacatgtgttgctggcttgctgctgaacttttgccccctttttttttccagtgcaaacctcaccctgagccagctctgtacaacggtggcgtcctgcgctgggcgagcaaaataacggacttcagaacggaggacgaaggcaactactccccggcatttgtgctctacaacatgtcggcggcgactgcgtacagcttctcttgtaagctcgccgtttcatcctcatgcgtatctctcttcttattagcggtaccgtagttcgacttcgacggtgggtgtgggttcgctctgttcggtcatcgccggtgacgaagttactaacaaaatttctgagcataactaatcagttacgatttttatttcttttccaagggagcgaaacacacggtacagtgtatattatagttgtagcaattgttataataaaacggaggaaatattgactgtaggggtgtttgaatcaactggagctaatagttagcggctaaaattagctggagacatctaaacgccctaactaatagtttagctattacttatttatagtaaatagatagctaactaatttcactaatttttttagtcgacttgctattagctctagtacatttaaactaagcggcaattatgatccatgaaattctaatgagtctttagtataaaagattattaatagaggtctatataatcgaaaagactagcgtgccagaatgaagataaatattctagccgcacctattgtctcaattcctactgttgcaggtatttaagccattcctgtccttcctctcggtaagtgtgtagtactagcacattagtgtcataccattttatttccgcacatgtgaataatttggacacgatgctattattatggtggttatcaacaacgaatttgaggatcacatgtgaaagcgttgttgatgctggtacacaaggtccacgacgtatgaccacttccactacattgttgtactacgcatctagtgataataatgtagtcgcatgttatcttggtcgaacgtggtatatatactagtgtataacgtacctattttttctttagtggtactagagacattcatatgtaaatttttatctgaatggtttacgtataagcgatatatctaatagattagatctaattttgcttggttataacatggattagaacgaaccaggtagttgtcagtatagtggcacaacttgtttacctctaccaacttgaatcaccatcagagcataaggtcagtttgcattctctcctgatcacttgtagaacttgcccataatgacgggtatcaccatcggggctaacaacatacggatgacgtagttgtcgttaaagtggcacaacttgtttacctctaccaacttgaatcaccatcagagcataaggtcagtttgcattctctcctgatcacttgtagaacttgcccataatgacgggtatcaccatcggggctaacaacatacggatgacgtagttgtcgttaaagtggcacaacttgtttacctctaccaacttgaatcaccatcagagcataaggtcagtttgcattctctcctgatcacttgtagaacttgcccataatgacgggtatcaccatcggggctaacaacatacggatgacgtagttgtcgttaaagtggcacaacttgtgtgttattttcattccacctcacacaatcgtcaatatggctgatggtgaaaatagatacatttataataccttagaattggctcgatttgatcaaattcgatgtgatatagcgatttcatttatatgatcgatgaaatacagagaggtttaattttaaggtgctgcccctaagatccacgtaagctcccccccccctccatgcctgccccactgaaaggtcaacgggattgccatctgcatattaacatgtaaattgttaggacaatcccttttcatatgacaaagtagtgtttggttctctgtgtagcttggttttgcgagaatgttgtgaatggtttggttgttgaaatgtatatgtgatgtctggtgttttcatgcctttttttcttcttttttttagcctgcaattcacacttgttttagaaaaaaaaaacgagtacgtgggagagaacggacgggataagcttattagttattactaagtttgcaagtatcacttgcaagtcgcaactacagccttgggcactcaatacgagctctcgtaaaccaggttttactgtccatggttattactcttacccactactggtacattccaagcacgaagtgcgtgcacagctgcatcgcgctgcctgtagtagagtagcgtgcatacgaacaaggaagaagaaacgcacgtcccagtcagaataggtgagaagcatctcgtccaaatccagagaaagcgacacggaggaattaaaggctgcagaaaccgacctcacacctcagcccgccagcgtccagtgatctagtagtcacgggtaagaggaggtacagtagcaagcagcagccagccaagcggtggaaacaaacgcacgcaccacgccgcggtgaccgccaggaatcaaggcggcaggagagctggatccgccggcgcatgttccgtcggcccagcccagtggtgccgactttccggagggtaggaggggggcgtccgggccaccgggattcgcacgcggacatgggcgaaacggtgcgtgcgtccgtgagagaccatcgtgccagtgcggtgcgggggcggcctcgccagagtagcgtaggggtccgcgagagaccatctcgatcgatcccttccgtgttccgtgtggggggcaacgtcttttcagtagtattttatatataaaaacattcaactcgcatataaactaatcatgatttagcttcgttgcttcactgtttacatctatccaggctgggtgaaaatcgacgggccagaaagcgcacacgtgaaggcgaagatactgaccgtggagaacgcagcgtcgcagtgcgtcggcaccgctatcgcgcgcaacgactgctggtcttttctcaagggtggctttactctcaactccacgtctcaaacctcggtgctctatttgcaggggtgcccgatctgacgttgaaacacttgacgtacgtttttttatcaaattttccgccatgcatcagtaggtttcacaagacatgacctgaagaaatgcactttattttgcagtcttaaatatatttattagatattgtaactatatattttctaataaaatttgtaaatcctctagcaaagtaccgttaaagctcaagaaaaaatttatatcgtacatcaaaagctgatgctgctgactccaaccatattctcggctagattcgtcattgttaccgagataactactaataatgaagcaattttgttctcacgtgtacgtacgtgttttgtctaccacgcagactgcgagcccaaatgcttctacgatctcaatcagaagcccctccttgcagccattctcacccgatcagtggaatcagcacagggaggagcgtatccaacaggtgaaactattttatttacataataatcgctcgcacagtagcagcatatatgcagcgagattaaaatatggaagctggtctggcgacgtaacgggtagcagattcggaagcgtttcgtgaacctgcatgtctccgacggcaacggctgccgcctggtcggggcggacgtggccgtgcaccagatcaccagagacttccccttcggctccgccatcagcaagagcatcctcgggaacaggccgtaccaggactggttcaacgcgcggttcaacgcggcggtgttcgagaacgagctcaagtggtacgcgacggagccgtcgcctgggaaggaggagtacgcggcggcggaccagctgctgcggttcgtgcagtccaacgacgtgacggcgcgcgggcacaacatcttctgggaggaccccaggtacacgccggcgtgggtgaagaacctgacgggcccggagctgcgcgccgcggtggcaggccgcgtccagagcctgctgtcgcggtacaagggcgacttcgtgcactgggacgtgagcaacgagatgctgcacttcgacttctacgaggaccggctgggcggcaacgccacggccgacttcttcagcacggccaggcgcgccgacccgctggccacgctcttcctcaacgacttcaacgtggtggaggcgtgcgacgacctcagctccagcgccgactcctacgtgtccaggcttcgccagctcgccgacgacgccggggtcaccttcgagggcatcgggctggagggccacttcgccaagcccaacgtcccctacgtgcgcgccgtgctcgacaagctgggcacgctccgcctgcccgtctggctcaccgaggtcgacgtcagcgccgccttcgaccacgccacgcaggccgcgtacctagaggacgtcctccgcgaaggcttcgcgcacccggccgtcgacggcatcgtgctgtggacggccatgggcgccaacgccacctgctaccagatgtgcctcacggacgccgacttcaccaacctcccggccggagacgtcgtcgacaggctgctgggggagtggcagaccaaggaggtgctgggcgccaccgatgaccgcggctccttcaacttcagcgccttctacggcgagtacagactctccgtcacctatctcaaccgcactgccgacgccaccttctcgctgcctcgcagcgacgacactaagcacatcaacatccgcctaccgcctggacctgcagcctgatctcatgcatgggatcggtccgtcgagtagaaatgtactactagaatttaagaactaaatatattgtggtgcctcagctgtgttaattggtacgtgtcactaaaaaataagtccgtggactgatacaactactactatacgcgcgcaactatctcctgcttgacctcttatgatgaaactagtgcaatgagtgtgttgtgatggtacacaaattattcgtgttagtgcacctagcgcgtagtatctttaaaaactctgttgtagtcaaccatgcttgtatatgaaagaacgcaagaaacgaaggatgatgtttaagtaccaatttgttcgtactctcaggaaaaagaagtgaagaaatccaacctaacaagggagtggaaaccaatcatcacaaaacatcttgataatcgatagttggtggaagatgatttaatacactacttgataatcgatactaactgggagtgtgtgatcatatatatatatatatatatatatatatatatatatatatatatatatatatatatatatccaagggacacgacagcacaaacctagctaaacgtaattggcaggggagcaaaggatgagacaattaggaacttgttttttgattgtcgttttgctcgaatgatttggagcttaattcatttggctctaggtatccctaaaccctccggtgtttccgatatgtttggaattgctatacaggcatattcacttatgtattcattaataaactatatttatagacacttcattatataatagaaagatgcactaaacaataaaatagtgtgcgcaaaaataaggaacagtgagtaccctacggagagaccaatgctcaagacaccgatggctccattcacacgagacatctcgtgtatatgttcgatgtagtcgatcggaattcaatgcagaacgatgttcatattgcagtcccgcgaacagccaccggaaacaagacgaataggttcccgcgaacaaggcgattgtggaggatagatatccctcgggtcctcatgaacaaagaaacatgtcatgggccgcttgatgggcctcccgatggtttgctttgcgggacagaccaatgggccacaatcagattgggcgaacttgatccaagaaaacgaagactgggcgtccgagttatgcgctgaccgaagcgctgatatctcgggtaaggaagttgcacacacctgaagagctatacattcggcgttaactcgactgaggaagtgatcaaaattcggataagtgggactacaggccacgataaagaaggagatatgtagaatagatagtgatcacaacttgtaaagggataactctttggtcgtgtatataaggccaagggaacccctacaaaaaggtatctcatctcatcacatcacacaccagccctcatcacaacacctgagcaccatcacaactcaattttaatcctcgtacccctgagaaattccagtacatagcctccataggaagtagggagttacgcattctagcggcccaaacctgtataaatcctcgtgcaagtctgatatgctcctgcacgtactatcgagtcacagtcaacgacaccgtcctacccaaaagcatcacgtgggtagccctgtggtgcgtagtcgtgtcacaaacacagatagttgacacgctaggtagggggtgcgacgttgatctatgacaactccatggctatcgtcttcaacatcgcggtcacctc

SEQ ID NO: 6742 - DNA, 1954 bp, Zea mays
tgcagtagtatatatcttactggacagcgtggcaacaagtttagcttgacagcaaatcaaagaaagaaccaaaaaaacaaacgcattcccaaatgaaacggcgccccgcccgaaagggagatgctcaggtcatgggtttctcgagcagcgctgacacgtaccactcgttcctctcggcgccgaggtcgagcttccggccggctttccaccgcagccggcggaagccgacgcggtcgaagatgggcacgtaggtggcgttgagctgcggcccgaggcagaagaagtggtcgagccagaagaggccgccgggcctgagcacccggtagatgtcgaagagcgtggactcgagcacggcgtcgggcacccagttgctgagcacgttcatggagtgcacgatgtccagcacgccgtccgcgaaggggagccgctgcatcagcgtgagctgcagcggcacgaggccccgggaggccacgaagcggttgaagggcgcgtcgaggtccagcgtcgtggtcaccaccgtcacgttccgctcccgcatgcgcgccgcgaaggtgcccgtgccgccgccgatgtccagcccgatccgcaccgtgcccggggcccgggaccgcagcacgctgtcgacgctgaaccccggtccgccattgtcggcctgccaccgccgccgctccttcccctccaggtcgaagcagtccttgcagaagtagggcccgcccctggtgcgcgcgcgctgcacgaggcaggtgtagttcttgcacgtgtacggcgcccagcgcacggtggtgtccggcgggacggcccaaaggctccgcgggagcggcgcgggctccgcgtacctcgccggctccctcggcctgcagcggcggcggggaagcggctcgcaccccttgtccgccccctgcagcgccagggcgtcgtcctcggggcactcgccgctgacgttgtacgtcatgtactgcgccagctcctcctggaagttgcggcaggcgaaccccagccccgggaacagctcgtcggtgccgaagttggcgtggaagccgagcggcagccggtggggctcgatggcgagcttgagctcgccctggggctcctcgggccagccgccgaagtccttggcctccggcgtgtccccgtgcacggcgccgaggcccgcgagcacggactcgaggaggtacgacgacgcgttgcactgcgcccgcagcgccgcgagctcggcgcgggcgccggcgagcgcggcgcgcgtggcgttgaggtcccgcagcagcgcggccgagtcccacaggtggatccgcggcgcggacgccggaatgtgcacggacagcgacgcgccggagaagaggtacacggagacgaggctggtggcgatgacgagaagcaggaccttgagcttggcgcgccgaggcgccggccgtgctcggtgcccgtggccattggcggcaccacccatcccctcgtcggtagtgtggtgctgctgcgatgagtggccccggtgcttgggcgcgtacatggcggccgcgcgcaccgccgatcggcgacagctagctagcagcgccgatcgatcagtttactagctctacgccgatcaattcgacatttcggtatgcactgcgggatggttttcccagacgtgaagtgcagcggtgccccgcgcgcgtttgacttgggatgtgtgtttgcatgtgttcgtggattgcagattacacatcggcttgctttgctttgcgaggagaaaagcggacatttttgctacgcaagtcaaagctgtgctaccgactagagagtagagactagctatcgctcggagagcgagctgtgccaccgacttgtgggccctccagcgcatccattatttagcggataggccttgggcgtacgcgtcctcgggcactgctctgcggcatagaaaaggaaacttgacatgcgaggtaaaacaggggagtagtgtagggtgtgt

SEQ ID NO: 6743 - DNA, 1740 bp, Zea mays
ttgggtacctcgaggccggccgggttttattattcatggattgatgaccagagtaagaaaattaatgtcatcacagagttgttcacgtctggaagcctcaggcattaccgtcagaaacatccacgtgttggctcgagggcaatgaaagaattgggccaaggccagattcttcatgggattggattacctgccatagccaccaacctccgattatccatagagacttgaagtgtgataatatttttgttaatggaaaccatggagaagttaagattggagatcttggactagctacagtaatgcaaacacctagggtgaggagtgttattggtaccccagaattcatggcacctgaactttatgatgaaaattatgatgagcgtgttgatatttactcatttggaatgtgtttgttggagatctttactcttgaatatccatacagtgaatgtacgaatccagctcagatttttaagaaagtatccacaggtgttaaacctgctgcattggctagaatttctgatcttcaagtaaagcagtttattgagaaatgtttagttcctgcttctgagaggtcgtctgccaaagaacttctgcaagacacatttctttgtcctgacaatacacatgaacctgctgtcactaagtttatatctccagcacctaaaaaaacagtagatatctctctggcgtctttgcatatggatgttgacactttggaatctagccatactgattcaggcaaggaaaatggatctgttgctccacatacaccagttttggagttcacaagaaccaacaaaaatacagagctaaagctaaagggcgagaaacttgataacaactccgtgtcactggttttgcgaattgctgatttctctggtcatgcaagaaatatccatttcctcttctacttggactctgatacagctatgtctgtagctgctgaaatggttgaacaattggagttagcggactgcgacgttactttcattgctgattttattgaccttttgatagtgaatcttattccgggttggagacctgtaaatgatgcagcagcgaactcgtataggcgatctgaaagtgaacttgcagtcaattcccatcagaacatctcaaagttggtacctgattatgcattaattgatggtgtgatgcgcccaaaagatgtgaatgcatcaactagttgccttgactctgtctcaagtgcaaccaacctaggaggatcacaaggttctgaaggttcggtcatttctgtacagcttgctgagagttccaaaagtgtgagtgactatggggccgaggattatggcactatggactgtggtgggtacaaagacagaatcagcacattagattgcagccatgttttagataatggatcgaggtcgattttccatatagatcaagcatcacctttcttggagttggcaagctgtggttcatcaacttcaactgataaccaggatgtgatgaacggggagcttgttttcacctgaagctcagtacaagcacttggttgatgagttgacaaggatgcgagaagaggctagggaaggagctcgaaaaaactggttgccagatacatgatgtttttgttcaaatttggcatttcctctaaacatcttaaactatgttcgatttcatgttcgaagtgtgagaaatgttaataatctgttttagttaaaaaaaaaaaaaaaaaaaaaaaaaaaagaacactcgagggggccccaaaga

SEQ ID NO: 6744 - DNA, 1883 bp, Zea mays
cgactacagagagagccttttcagctatgaaatttgtgaagacacgtcttcgaagcaaaatgggagatgcctatttacgagattatctggtcgtttatattgaaagggaattagcggcaatgatttgttctgatgatattatcaagggctatgatctagctaatacacgtagagctaaattcaaaataactgagatgtaattttattttgtttgacaaaatagatgttgttttattatactgtttttaatgaagattatatatcaatatatacattgtgattggttctcttgctatttttatattgtgttcttactggtttggtcgcttggaggctaagtctgccccctctatcttcggatcctgtcttcgcccctgattccgaacgcccaactactagtatctcttctgtcttctccggttctccctatcccacctttccctccccaccacctacctaccgcttattcaccgtcgcctaccacctccccctcctccacgtgccgacttccgctccgcaccgccaatccgtcgtaaccctagcctagcccagcctggcctcacctgactccgatccgtccatgttcgccgcgaggaattttcctcccatgggttccgcatacgccgccgagaggacgccgatcgatggagaatgaggtgctgcgtctgccgcgtatcctccgccgggtgccgggccatgggcgttgcgggacgggccaatccgacgtcgtcgctgcgcagccgacgctgcctccgcatgcggccgtcttacgccccgttctccgagcccttcactgaacccccggcacccgccgcaccatcataccctgctgccgcgcacagtgcgtaggagccgcgggcggaccaccgacatctccggcgatctccattcctctttgcttcctctctccgacagcaacgcctcccccctctctcgctcgtagagtcatttgcttgtcggggccgatccggaatggaggtgtttggttgtgggacccacaacgatgcggtcgatgctgaatacgcggaagtagatccaaccgggcgatacatgcgctataatttgattctggggagaggagctttcaagactgtttacaaggcatttgatgaggtcgaaggcattgaggtcgcctggaatcaaatcaacatagatgaggtgatgcagtgtccagataatcttgataggctctacacagaagttcatcttctgaagtcactcaagcatgaaaatgttatgaagttttattattcatggattgatgaccagagtaagaaaattaatgtcatcacagagttgttcacgtctggaagtctcaggcattaccgtcagaaacatccacgtgttaacttgaaggcaataaagaattgggcaaggcagattcttcatggattggattacctgcatagccaccaacctccgattatccatagagacttgaagtgtgataatattttttgttaatggaaaccatggagaagttaagattggagatcttggactagctacagtaatgcaaacacctagggtgaggagtgttattggtaatgatcttgtcactttatggcttcagattctcgatttactatcaataaatctcttgttatctaatgtccttcagtcgagagataaaaaaaactcgacctacagggggtaagacagccccgggattttttttaagaagaagaccttctcacacaagtcgagaaaaatctcaaacccctgtcccacccatacacagcggctctgaagccccttagacctgtgctttggcgtgggacagatgaggggattttttttaaccacagcctgaaattcgctcccacggagagtcgaacccaggacctaaggagtgctactcagaccacctagccaactcggct

SEQ ID NO: 6745 - DNA, 2905 bp, Zea mays
gccggccggtccgggacgtccaaatcacaaacagacagaacatccccacgcaaggcccaagcgcccaactatcatttctcccactctcccacctttccctccccaccaccacctacctccctctttattcgccgtcgcctaccacctccccctcctctccgtgcagacctccgctccgcaccaccaatccgtcgtaaccctagcccagcctggtctcggctggccccgctccgttcatgtgcggcaccaccgcctccccgtgttcgtagtagccgccgcggggaatttccctcccatgggttccgcatacgcccctgagaggacgccgatcgagggagaatgaggtgctgcatctgccgcgtatcctccgccgggtgccgggccatgggcgttgcgggacgggcgaacccgacgtcgtcgctgcgcagccgacgctgcctccgcatgcggccgtcgtacgccccgttctccgagcccttcactgaacgcccggcacccgccgccccgtcctccccttcatccccctgctgctgcgcctagggcgtaggagccgcgggcggaccgccgatatctccgtcgatctcgctggctcctctctctctctctctgcttcctctctctctccctctcgctcgtagagtcagttgattgtcggggctgatccggaatggaggtgtttggttgtgggaatggggtggtcgatgctgaattcgcggaagtagatccaactgggcgatacatgcgctataatttgattttggggaggggagctttcaagactgtttacaaggcatttgatgaggtcgaaggtattgaagttgcatggaatcaaatcaacgtagatgaggtgatgcagtgtccagataatctagacaggctctacagagaagttcatcttttgaagtctctcaagcatggaaatggtatgaagttttattattcgtggattgatgaccagaataagactattaatgtcatcacagagctgttcacgtctggaagtctcaggctttaccgtcagaaacatccacatgttaacttgaaggcaataaagaattgggcaaggcagattcttcatgggttggattacctgcatagccaccaacctccaattatccatagagacttgaagtgtgataatatttttgttaacggaaaccatggggaagttaagattggagatcttggactagctacggtaatgcaaacacctagggctaggagtgttattggtactccagaattcatggcacctgaactttatgatgaaagttatgatgaactagttgatatatactcatttggaatgtgcttgttggagatctttactcttgaatatccatacagtgaatgtacaaatccagctcagatttttaaaaaagtatccacaggtgttaaacctgctgcattggctaagatttctgatcctcaagtaaagcagttcattgagaaatgtttagttcctgcttctgagaggtcgtctgccaaagaactcttgcaagacccatttctttgtcctgacaatgcacatgattctgctggcactaagtttacatctccagcacctaataaaacagtagatatggtgtctttgcatatggaagttgacacttttgaatccagccctactaattcaggcaaggaaaatggttgtgttgctccacatacacctgtcctggagttcacaagaaccaacaaaaatacagagctaaagctgaagggtgagaaacttgataacaactctgtctcactggttttgcgaatagctgatttgtctggtcatgcaagaaatattcatttcctcttctacttggactctgatacagctttgtctgtagctgctgaaatggttgaacaattggagttagcagactgcgatgttaccttcattgctgattttattgatcttttgatagtgaatcttattccgggttggagacctgtaaatgatgcggcaacaaactcgtatacgcaatctgaaagtgaacttgcaatcacttcccataacaatctatcgaagttggtgcctgattatgcattaattgatggtatgatgcatccaaaagatgtgaatgtatcaactggttttcttgattctgtatcaagtgcaactaatctaggaggatcaccatgctctgaaggttcggtcattttctgtacagcgtgctgagagtttcaaaagtgtgagtgactatgagcctgaggattatggtactatggactgtggtgggtacaaagagggaatcagtaaagaaaattgcagccatgttgtagatgatggatcgaggttaattttccatacagatcaagatcacttctcttggagttggccaatggccagcagtgcttcgatcatctactcctgataatcaggatgtgctgaatggggagcttgtcttgattgaacctcagtttggttgagatgaattgacaagggtgcgagaagaggctatggaaggagctcgaaataagtgggttgccagataaatgatgtttttgttcaaatctggcatttcatctgaacaatcataagctatgttcgatttatgttagaagtgtaagaaactatactgatcttttttagttaaaacataatatataggtagattgtcgtgaaatcttgtttttttgcaatcgctgacaatcagactaataaaaagtcgtgaaaatcaaaaaaaaaaaaaaaatatatttaattatttactttatttttatttcaaatttaaatttatcatattttaaagaaaagaaaagaagaaatatttactattgttaatcttttatattgaatatttttatatatatttaaaaatagaataaataataacttaaaactattcaatagagtaaacaataaagtatattttgatgtttctaattttttttagtttaatgatcttgattt

SEQ ID NO: 6746 - DNA, 1449 bp, Zea mays
tccgtgtcactggttttgcgaattgctgatttctctggtatgccttacttggatacatttctttgaagctcagtttttgcatattgttggtgccttaacagctaatgcctttctgattccaggtcatgcaagaaatatccatttcctcttttacttggactctgatacagctatgtctgtagctgctgaaatggttgaacaatgggagttagcgggactgcgacgttacgttcattgctgattttattgaccttttgatagtgaatcttattccgggttggagacctgtaaatgatgcagcagcgaactcgtataggcgatctgaaagtgaacttgcagtcaattcccatcagaacatctcaaagttggtacctgattatgcattaattgatggtgtgatgcgcccaaaagatgtgaatgcatcaactagttgccttgactctgtctcaagtgcaaccaacctaggaggatcacaaggttctgaaggttcggtcatttctgtacagcttgctgagagttccaaaagtgtgagtgactatggggccgaggattatggcactatggactgtggtgggtacaaagacggaatcagcacattagattgcagccatgttttagataatggatcgaggtcgattttccatatagatcaagcatcacctttcttggagttggccagctgtggttcatcaacttcaactgataaccaggatgtgatgaacggggagcttgtttttattgaagctcagtacaagcacttggttgatgagttgacaaggatgcgagaagaggctagggaaggagctcgaaaaaactggttgccagatacatgatgtttttgttcaaatttggcatttcctctaaacatcataaactatgttcgatttcatgttcgaagtgtgagaaatgttaataatctgttttagttaaagcattgatgtagtttgcaagtcacagcaaacttcgtgcccgtcccccgagcgggggcccgttctctcgttgagggcggagcaggaccagattttcccagagcacagaaccaccttaacactccctacaaaaaaaataattgtatgatcgttctcctgggagccattcctccgttcttccctcaattcatgtcgctgtatgaaagcagggtgatgataagacggggtgcagaattgcaggtttgacaaggtagtatgcgtttgggggcggtctgccgtactaggcataacgtcaatcaacgaatacaacttgcctgactatgagcttgcttattctaagcctgtaaagtaaattgcgcaatgttttgaactccaaataaacactctaacgtcaatcaacgaatacaacttgcctgactatgagcttgcttattctaagcctgtaacgtaaattgcgcaatgttttgaactccaaataaacactcaaatacagttcatacttccatagaaatattttgtt

SEQ ID NO: 6747 - DNA, 1781 bp, Zea mays
tgatgaccagaataagacaattaatgtcatcacagagctgttcacgtctggaagtcttaggctttaccgtcagaaacatccacatgttaacttgaaggcaataaagaattgggcaaggcagattcttcatgggttggattacctgcatagccaccaacctccaattatccatagagacttgaagtgtgataatatttttgttaacggaaaccatggggaagttaagattggagatcttggactagctacggtaatgcaaacacctagggctaggagtgttattggtactccagaattcatggcacccgaactttatgatgaaagttatgatgaactagttgatatatactcatttggaatgtgcttgttggagatctttactcttgaatatccatacagtgaatgtacaaatccagctcagatttttaaaaaagtatccacaggtgttaaacctgctgcattggctaagatttctgatcctcaagtaaagcagttcattgagaaatgtttagttcctgcttctgagaggtcgtctgccaaagaactcttgcaagacccatttctttgtcttgacaatgcacatgatcctgctggcactaagtttacatctccagcacctaataaaacagtagatatggtgtctttgcatatggaagttgacacttttgaatccagccctactaattcaggcaaggaaaatggttgtgttgctccacatacacctgtcctggagttcacaagaaccaacaaaaatacagagctaaagctgaagggcgagaaacttgataacaactctgtctcactggttttgcgaatagctgatttgtctggtcatgcaagaaatattcatttcctcttctacttggactctgatacagctttgtctgtagctgctgaaatggttgaacaattggagttagcagacggcgcccttcccgtccggccgggttttattgatcttttgatagtgaatcttattccgggttggagacctgtaaatgatgcggcaacaaactcgtatacgcaatctgaaagtgaacttgcaatcacttcccataacaatctatcgaagttggtgcctgattatgcattaattgatggtatgatgcatccaaaagatgtgaatgtatcaactggttttcttgattctgtatcaagtgcaactaatctaggaggatcaccatgctctgaaggttcggtcatttctgtacagcgtgctgagagtttcaaaagtgtgagtgactatgggcctgaggattatggtactatggactgtggtgggtacaaagagggaatcagtaaagaaaattgcagccatgttgtagatgatggatcgaggttaattttccatatagatcaagatcacttctcttggagttggccaatggtcagcagtgcttcaatcatctactactgataatcaggatgtgctgaacggggagcttgtcttgattgaacctcagtttggttgagatgaattgacaagggtgcacggggagcttatcttgattgaacctcagtttggttgagatgaattgacaagggtgcgggaagaggctatggaaggagctcgaaataagtgggttgccagataaatgatgtttttgttcaaatctggcatttcatgtgaacaatcataagctatgttcgatttatgttagaagtgtaagaaactatactgatcttttttagttaaaacataatatatgggtagattgtcgtgaaaaaaagaaaataataagcaacacccgccaatccccgaaaaaaaaaagggcggccgc

SEQ ID NO: 6748 - DNA, 846 bp, Zea mays
attgggacctcgcgccgaggccggccggccggggaaacaggcaccacagctgagagacgatagaagcacgcagcagctgaaagggaggggaactaggaatgaaggggagcaaggtccacgagcacgaggcagacgtccccgcctccgacctctgggcgatctacggctccctccgcgccgcggaactcctgccggagctgctcccgcacgtgctcgccaaggtggagctcgtcagcggcgacggcggtgttggtaccatcttgcagctaatatttcctcccgggattcctgggctacagagttacaaggagaagttcatcaaagttgacaacgagaactatatcaaggaggcagaagccattgatggcgacattttgaagctggggttcgaggcatacatgatacggtttgagatcattccaaaaggggccaattcgtctgtcatcaggtcgactatcgagtatgtgattgctgatgcgcacccggagctcgaagctatggtgagcacagcaactttggctgaaactgctcagaaattttccgagtttgctaaggcgaagtaggtcccataaggaatgtcttgaaatatatatatatatatctcgagagcggagtttatgtttatcatgaaacaagtgaaatacagtttcagcgctttcgtgttgcgcctcaaaaaaaaaaaaaaaaaagggaccgagcgccgccgagaaaaaaaaaaaaaaaaaagcggccaaaaaaaaaaatgagaacatttttttccccctccttcatcttttccacactccacagcccaatctcatctgcacgtgttcttatcgcaacttcgcaagtggaatcgaaatcatt

SEQ ID NO: 6749 - DNA, 1785 bp, Zea mays
  misc_feature (639)..(639): n is a, c, g, or t
  misc_feature (754)..(754): n is a, c, g, or t
  misc_feature (763)..(763): n is a, c, g, or t
ccgagaggccgccatggagctcgctggggaccacctccctgggggcacaccagatctggccttgggcacgccggattcggccatgggctcgccggatatacacggttgtacgcgcatttggccatgggcccacaacgacgacatagttgtacgcggcagccacgccaccgccgtgatttttgcgtggccattagcacaaccaccatctccctgcatgtgaccaacacgacctcgaactgacgacgacaaccacggacacagcaaaatgtggccaccctgaccacgaatctactcacctcgaccacaaatccaaccacagcggcagcgacccgaaggaacgacaacctctttcgacctcttctcgtgccacgtgcgtgcctcccgacctcaggaaggagataaagcctcgccaaccgcacgactctccggtgactcgctctggcggtggtgtgggaggggaaggggtgcaaagggtgtggcggcgcaggggtcacccacgtgtcgcccaggagagagcgagggtggtgaatattcaaactagtattgacaaattcagtttaataaaaacaaaatacttgttaaacttaaaaatcaataaagaaatcagttgcgacatgtcaagaggctgcagataagatngtgctatcaagattgcctccaacaaacacagactgtgtgtccaaacaatcgtgtcgtcccaaacctgtcaagatagctaaaaaacaaataaaggcggccaagtgactgactacanaagaactanaatgttcggccaatcggccggcagaggttgttaatatctcatccctgcggcctgcccatcacgcgataattctttatttcgtctcgaggggcaacaccaagacgctccgcaaatgcagccaaatgacagacagcgttgctctggccacatcacctcttggagatcctaagcatctttttcagtatactggcttgtctatatatgcacgcagaccgggagcacacctaacacaggcaccacagctgagagacgatagaagcacgcagcagctgaaagggaggggaactaggaatgaaggggagcaaggtccacgagcacgaggcagacgtccccgcctccgacctctgggcgatctacggctccctccgcgccgcgagactcctgccggagctgctcccgcacgtgctcgccaaggtggagctcgtcagcggcgacggcggtgttggtaccatcttgcagctaatatttcctcccggtgagtataagatacgtgtgtatgctgccataatatctttgatgttggatatgctaagatactagtagtaaagttttaattgctctgctccgctccgctcctagggattcctgggctacagagttacaaggagaagttcatcaaagttgacaacgagaactatatcaaggaggcagaagccattgatggcgacattttgaagctggggttcgaggcatacatgatacggtttgagatcattccaaaaggggccaattcgtctgtcatcaggtcgactatcgagtatgtgattgctgatgcgcacccggagctcgaagctatggtgagcacagcaactttggctgaaactgctcagaaattttccgagtttgctaaggcgaagtaggtcccataaggaatgtcttgaaatatatatatatatatctcgagagcggagtttatgtttatcatgaaacaagtgaaatacagtttcagcgctttcgtgttgcgcctcaaaaaaaaaaaaaaaaattgcggtctcatgggaatctgatcccacaaatcacaa

SEQ ID NO: 6750 - DNA, 1877 bp, Zea mays
cattgggaccctcgagcccggccgggacactgaccgcaacttcccaacaatctcggtccctccctccctcctccctaaactccccagcaacccgcggccgagccccgtagtccgtgcaccagttgtctcgcgtcgtcgtcgtcgccggggctgcagcctgcaggcagcgacctagctaggaacgggtgacatggcgcgtgcggcggcgtcggtggccgcggcgctgctcgtcgtgctcggcgtggcagcgtcggtggcgacggcgcagatggagacctgcagcggcgacctcccacccgtgctcgccgccaactactccggcctggcctgccagccggtctggaacaacttcgtgctccggtaccaccaggacaaggacaacgtgctgcgggtggtgctgtccacgatgtacagcacggggtgggtgggcatggggttctccagggacggcctcatggtcggctccagcgccatggtggggtggatcggcaagaaggggctcccccacgtccggcagttcgcgctgcggggcaagagcagctccaaggtggtggtcgaccgtggcttcctcgtttccaacgaccacgaccacactgtcgtggtgcagcaggccaagatctacctcgccttccagctcaggttctcctaccgcctcacccaccagcacatcgtcatggccttcggcaacagcatccccgtcaagaacaggctcaccaggcaccaggacaagacctccttcaccttcgatttcacaacgggcagagcttcggtggacgggtccttcccatacggcctgcggcgtgcgcacggcgcgctgaacgtgttcgcgtggggagtcctgctgcccatcggcgccatcctggcgcgctacttccggcggatggacccgctctggttctacctccacgtgggcgtccagctcgccggcttcatcatcggcctggccggcgtcgtcgccggggtggcgctgtacaacaagatccaggccgacatccccgcgcacagggggctcggcgtcttcgtcctcttcctcggcatcctgcaggtgctggccttcttcctgcgccccagcgccgactccaagtaccgcaagtactggaactggtaccaccactgggcgggcaggctggcgctcttcttcgccgccgtcaacatcgtgctcgggatccacgtcggcggcgccgacagctcatggaagatcggatacggcttcagcctggccgtcctcctcgtcgccgtcgccgcgctcgagttcatgctgtggacgaggtggtccaagaacagcaccgccaccccgacgtactaggaacctgctgctgcacgtaccttgttgtttttccggggtcggatgatgttttgtgtttgcctttgaccttgttttttttttgttgttggtggtggtggtgtatctatatgatatatcctttggaactgcctgcaatcgcgtcagcgtgcgttcaggcaagtgcactgccactgcccgtagttacttcgttcagcacgcctggtggtgtagtggtttctctatgattctttatttgccgaggcatgttatagccgtgtctgatatttggcgacctcttcatgactgccgcctttgcagagtggattttctccacacatgtacatgtggccatatataaagacttgccctcaactatcaaaaaaaaaaaaaaaagcggccgcctagaaggagagagagctggaaatcagcggttgagattccttgtgtggccatgtaaaatatcataggcactaaaagctaagcaacaatgtccaaacttgaatgtatagtgtgtcttgaactcttgttgttttgtgtattgcatactcgaaggcatgtatatatatatgttcggtagcctgaattacatctc

SEQ ID NO: 6751 - DNA, 1550 bp, Zea mays
  misc_feature (1507)..(1507): n is a, c, g, or t
cactcctatgggcgattgggtacctcgaggccggccgggatagcgtcgcgtcgtagtcgtagtcaccgcgttcgcttcccgagcacgcaaccatggctcgactgtcagccaccgccgcgctcctcctcctcgtcctctccctcctcgccgtcgcgcactgcggtgccctcgcagtcgcagcagagcacgacaccgagcccgaatcaaccgccgccgtggccgtcagcgacgacaacgtgctatccgaccccacggtccacgctgaggcgggcaccgccagcgccactgaagaggaggccatcccggcggagcagcagcagcatgggttcgaactcctccgcctgccttctcaccggctccaccaccaccaccacctctggttgaaacgccaccacgggatctaccgtgacgcgtcgcacaagttcccttgttctggccacggcgcgaggcgcgagcaggcagtgagccaccttgccatcttgcccgcatccgcagaggtggccagggaggcgggggaggagatgcccgtggccgagccggacccggatcgctctctcccggacagcgacggagagggggaggtggctattacaagcgagcagccgtcgccgttcgccgacgccgacgggcacgacgacgagagcgcggcggcagtcagggcgtggaagcacgagatgctgcggaggtggttccgcttccacttccaccacgacatgcgccgccaccgtctccaccacgtccaacacgaggagggaggaggaggaggctaccaccgccccagagacgacagggagcatgggcatgaagcggcaccggttccacttccaccaccacgacgacgaggacgaggagaagaatatggcggcgaggaagcggctccgccacgctgatgagcacgacgaggacagcgacgacgaggaggatgagcaagtggaagagatggtccggcggttcaggaaggcgatcatgaggaggaggttcggccacggccacggccatggacgccggttcccgcttcttccaccacatcgtccaccgccacgccgaggaggccaagagccccgcagatgttgaagaagaggagagcggtgtcctggcctggatcaagggcctcatgaaccggttctagagctgcctcattcgagcgatccgtccactcagtcactcacagccatggctgcttgcctttttactatttgccatcggccatcccgcgtgcatactgcagtgtcttggcacggctgaatttacttggtgttattagtgtgttttctatccacggtgtgtcgtcttatatacgcacttgtattgctaagggctagtttgagagtcataaaaccgaaggggattgtaggagcacaaatacttttcttattaattttaaataagaaggggattttcttcactccaatttcctccggtattttagctcccaaactgctagccctaagagttccaaaaccatctcctctcaactctgatgctagatgtttgttttgcctgccanaaaaaaaaaaaaaaaaaaaaaaaaaaaaaaaaaaaaaaaaaaa

SEQ ID NO: 6752 - DNA, 1423 bp, Zea mays
gcacgagacattgggtacctcgaggccggccgggattgcgtcgtagtcgtagtcaccgcgttcgcatcccgagcacgcaaccatggctcgactgtcagccaccgccgcgctcctcctcgtcgtcctctccctcctcgccgtcgcgcactgcggtgtcctcgcagtcgcagcagagcacgacaccgagcccgaatcaaccgccgccgtggccgtcagcgacgacaacgtgctatccgaccccacagtccacgctgaggcgggcaccgccagcgccactgaagaggaggccatcccggcggagcagcagcagcatgggttcgaactcctccgcctgccgtctcaccggctccaccaccaccaccacctctggttgaaacgccaccacgggatctaccgtgacgcgtcgcgcaagttcccttgttctggccacggcgcgaggcgcgagcaggcagtgagccaccttgccatcttgcccgcatccgcagaggtggccagggaggcgggggaggagatgcccgtggccgagccggacccggatcgctccctcccggacagcgacggagaggggggaggtggctattacaagcgagcagccgtcgccgttcaccgacgccgacgggcacgacgacgagagctcggcggcagtcagggcgtggaagcacgagatgctgcggaggtggttccacttccaccacgacatgcgccgccaccgtctccaccacgtccaacacgaggagggaggaggaggaggctaccaccgccccagagacgacagggagcatgggcatgaagcggcaccggttccacttccaccaccacgacgacgaggacgaggagaagaatatggcggcgaggaagcggctccgccacgctgatgagcacgacgaggacagcgacgacgaggaggatgagcaagtggaagagatggtccggcggttcaggaaggcgatcatgaggaggaggttcggccacggccacggccatggacgccgttcccgcttcttccaccacatccaccgccacgccgaggaggccaagaagcaggcagatgttgaagaagaggagatcggtgtcctggcctggatcaagggcctcatgaaccggttctagagctgcctcattcgagcgatccgtccactcacagtcacagccatggctgcttgcctttttactatttgccatcggccatcccgcgtgcatactgcaggcacggctgaatttacttggtgttattagtgtgtttctatccacggtgtgtcgtcttatatacgcacttgtatcacagattcacagtacgtactacctgcttgtgtgcttgacattgtgttgtttcatgtaattctgtgcagttatatatgtgccttttgttcttccagataaaaaaaaaaaaagttcagcgcccaccaaaaaaaaaaaaaaaaag

SEQ ID NO: 6753 - DNA, 1944 bp, Zea mays
ccctgaacggccggagtttccataagctattggcatcgatcgctccgtcgaccagaacgccacgtggcaatggacgcaaccaaagcctgcctgtataaataggcacctgcctcctccgttgcaaactcccccgggtagcccaggcccagctacactttcacaatggtaaccactcgacgagtgtaacttacaagagaattcatagagaccgtatcttgtgcgcaaggagcgctggtgctcccatgagcaaaatcaatccagaccacaccttccacatccaacggtgctgcgtcagggggttttataaaatgttctttgcaactctgtacattttacaaaaacccccctaacacagcaccgttggatgtggagggtgtgatctggattgattttgctaatgggagcagcaggactccttgctcataagatacggtgtcgaattcataagcagcaagcagctcgtgcctggttagtttagagagccatgggctccctgtactgcgacgtcgccccctcgccgtcgccgtccttctccagcaccggaagcagcaacggcaatgccatcgccggcggcgtcagtatatacgcgtgcttcgccctcggcagctccaacagcctggagtgctacgagcctggcgccaacacgtggcgccgcgtgggcgcgctcccgggcgtccccgacggccacatactgaaggggttcgccgtggcggcgctgggcgagtccgtgtacgtcatcggcggccggctctgccggagggagcgtggcgccgcggccggcgagtgccaggacaccgacgtcgccgtgcgggcggacgtgctgcggtacgacgcgcgccggggcgagtggcaccactgcgcgccgctcctggtcccgcggttcgacttcgcgtgcgcgccgtgccggggcccggatctgcgtggccggcgggcagtgctcgctgtccggcgcccggggcacggcggcggccgaggtgtacgacgcggagaaggggcagtggtcggcgctccccgacatgagcacgctgcgctacaggtgcgtcggcgtcacgtggcagggcagcttccacgtcgtggggggcttcgcggagaccacgctgacggccgccagcagcgacgccagcgtcgccaccaccgtgctgcagtcgtcggcgctggagcggagctcggccgaggtgttccactgcgccaggggcacgtgggagatcctcccggggatgtggcagctcgacgtgcccccgaaccagatcgtggcggtggccgacaggctgttcagctccggcgactgcctcaactgctggaagggacacgtcgaggtctacgacggcgagctcaacatctggagcatcatggaccactccgccctgcccgacctgtcgctgctcgccagcctcccatcttcagcccagcggctctacctcaccatggccgccgtcggcacgcagctctacttcctcgccgggtaccaggtgccgtcggccgatgacagcttcagaacagtctcgctggtgcacagcttcgacaccggcgctgcaccggggctggtgccggcgtggaggagcttccggcccgagatgagtcaggaggaccccgaggtcggcggcaaggagctcttcagccagtgctgctcggtgcagctctccagctgatcacatttacagtctcagtcctccaatccaatccaatcacagcatatgcatcatggtcctgaacttttctgatcagagcatcatgcattgcgtctcgtctacagacttgctatcaatctcgtacttgtgctcctgcggtgaatctgtttgatccatacaacacaatctgcatgagaagatgtgccctgtcttctttacttctttctgatctgaaatggactggtaattcatatgtaggaagccatttataataataaacgctagtttggcaaaaaaaaaaaaaaaaaaaaaaaaa

SEQ ID NO: 6754 - DNA, 1519 bp, Zea mays
cattgggtacctcgaggccggccggggtagcggcgagacgagccgtttaaataggtgtcaagtggaagtgcagtgatgtatgcagctgaggcatcctaacgaacgaacgatttgaattgcgtcgtagtcgtagtcaccgcgttcgcttcccgagcacgcaaccatggctcgactgtcagccaccgccgcgctcctcctcctcgtcctctccctcctcgccgtcgcgcactgcggtgccctcgcagtcgcagcagagcacgacaccgagcccgaatcaaccgccgccgtggccgtcagcgacgacaacgtgctatccgaccccacggtccacgctgaggcgggcaccgccagcgccactgaagaggaggccatcccggcggagcagcagcagcatgggttcgaactcctccgcctgccgtctcaccggctccaccaccaccaccacctctggtggaagcgccaccacgggatctaccgtgacgcgtcgcgcaagttcccttgttctggccacggcgcgaggcgcgagcaggcagtgagccaccttgccatcttgcccgcatccgcagaggtggccagggaggcgggggaggagatgcccgtggccgagccggacccggatcgctccctcccggacagcgacggagagggggaggtggctattacaagcgagcagccgtcgccgttcaccgacgccgacgggcacgacgacgagagctcggcggcagtcagggcgtggaagcacgagatgctgcggaggtggttccacttccaccacgacatgcgccgccaccgtctccaccacgtccaacacgaggtggaggaggaggctaccaccgccccagagacgacagggagtatgggcatgaagcggcaccggttccacttccaccaccacgacgacgaggacgaggagaagaatatggcggcgaggaagcggctccgccacgctgatgagcacgacgaggacagcgacgacgaggaggatgagcaagtggaagagatggtccggcgcttcaggaaggcgatcatgaggaggaggttcggccacggccacggccatggacgccgttcccgcttcttccaccacatccaccgccacgccgaggaggccaagaagcaggcagatgttgaagaagaggagagcggtgtcctggcctggatcaagggcctcatgaaccggttctagagctgcctcattcgagcgatccgtccactcagtcactcacagccatggctgcttgcctttttactatttgccatcggccatcccgcgtgcatactgcagtgtcttggcacggctgaatttacttggtgttattagtgtgttttctatccacggtgtgtcgtcttatatacgcacttgtatcacagattcacagtacgtactacctgcttgtgtgtgcttcacattgtgttgtttcatgtaattctgtgcagttatgtgccttttgttcttccagatattcgtgatgcttgttcagtacgtactacccatacctagtgattttaattatttatt

SEQ ID NO: 6755 - DNA, 1596 bp, Zea mays
aaacctgccgcagggccttcaccgtctcccccagctctctctcccgctccttcgccctcgcacgtcgtctctttcctcgcgagcgacgcgcgcttctcacccgcatcgccgatggagacgccgctgtccaccaggaggatcactcgctcgctggccgccgcatccgcccagaagagcgccgccgcagggatggactccgccgccctcttctccctgtccaagaacgccgccgcgggtgagacacacgcacagacgcgcgcggcccttcacgacatcaccaacgactcccccgtcgtcggcctcgccgcgggcagcctccacgccaccgacaccacccccgccaagacccgccgcagggccccgcgctgcacgccaggctccggggaggcgctcctgcgcggccaggtcaaggcgctcctgcacaaggtcgacgaggagcagggctgcgccgccgccggcgccctcgtcaggcccaagcgcatccaggcgctgctcggggtctccaggtccccggcccagcttcttgcgcccacgccggccaacacgccgcagatcggccccgtctccgcgcccagggaaggcgtcgggctgcatgacggcgccaccgtcgtgccctgcggcaccggccgcgtggtacggctggtccctgggctgcaggtcattgcaggttccctccctccacctcagccagaggagaagctgggcgagtgccagctgaaccgtgcgctggtgttcgacgactcccccgacaattccgacgagtccagcggatcagccgtcccgtcatccgtctccctccaggagggcagcgccgggaagacatcgtcacctgaggagggtgacagctcctcagcctggtccactcaggtccatgccagctccgagaagggcgatcaagaagagctggacgtggaggagctggcggcagattacactgaagaagaggaggagttcgaggaggaggatgactgggaagaagacagcgatgacggctgctacgatgatctgtgcgatgagatgagccggatgaccgtgttggatgaaggggagaagaagaccgggctgccgcagttcgaggggaagcacaccaggttcatctacaacagtgacgacgagatcgagcgggaggaggtggccgatgcggctgaagctagggcggagctcggcgcactgatgctcagggggctgccggtgccggaggggaggcacctacgcttccacgacgacgaggatgacgaggaataagaatgttcagattgggtatcggcagtggttgtctttccctgacaccagccagccaaaattcttcttttgagggggctttgtttctacaatcgggttcagagagcaaatagctcttttgcccattcacaactcaactctttacgaaacatagtactatttcctggttactcagttaggttatttcaattttacgtggattggagtgtatttgaataggttaaaatatattttaatttgctatagatttaaaccgactcattgaaacaaacaacccgtataaaaaccatttttggcaaaaccatttcagatctcgtccatttccaagtagttcagatacagttatgagctgca

SEQ ID NO: 6756 - DNA, 826 bp, Zea mays
tacctcgaggccggccgggcccagctctctctcccgctccttcgccctcacgtcgtctctttcctcgcgagcgacgcgcgcttctcacccgcatcgccgatggagacgccgctgtccaccaggaggatcactcgctcgctggccgccgcatccgcccagaagagcgccgccgcagggatggactccgccgccctcttctccctgtccaagaacgccgccgcgggtgagacacacgcacagacgcgcgcggcccttcacgacatcaccaacgactcccccgtcgtcggcctcgccgcgggcagcctccacgccaccgacaccacccccgccaagacccgccgcaggccccgcgctgcacgccaggctccggggaggcgctcctgcgcggccaggtcaaggcgctcctgcacaaggtcgacgaggagcagggctgcgcgccgccggcgccctcgtcaggcccaagcgcatcccaggcgctgctcggggtctccaggtccccggcccagcttcttgcgcccacgccggccaacacgccgcagatcggccccgtctccgcgcccagggaaggcgtcgggctgcatgacggcgccaccgtcgtgccctgcgtcatcgacgaagaggaactgctgattcctaagcttcaggtaatgtaattgtcaattagcaataaatgtaatgtaattgaaatcttcctactcgtcgaggacgaatagtctgcaattcgacatgtgccttgtacacgtttgattcactgtttccattccgagtagtggggtttccaatttcagtctggactctggaacgtaccatttcatctagtatcttc

SEQ ID NO: 6757 - DNA, 570 bp, Zea mays
ttttttttttttttttggcaaaagaaacaaaagtatgcctagtttccattaaagggtctttcatgtctacaacataaaaactcgacctgcagggataagacaaccctcgagtattgtattaagaaaaatactttctcacacctcccccgaacctctacccttcccatacacagcggcatcgaagcccatgtgagaacgaccgcaaccgatgccgggccttaggcctgtgctttagcgtgggacagacgaccaccttcgtcggtggctttatcatcggattcattagaggctggatgctggcccttgttatgctcgcgtgcatacctccaagcattttatcctttgcaacagtctcccggttgcgagctcaaatatctttcgtgcgccgaggtcccctttggtcgtcatgatccaaccgacgctagcctagacttgacgttacgaaggtaacggtgcccactggcgcggccaccatatctggctgctcgcttcctttccgctccccaccagcgaagacacgccgccgccgttccatagctacgccgccgcgccgcgtgcttttcccattct

SEQ ID NO: 6758 - DNA, 1972 bp, Zea mays
gggacctcaggcggcggagacaacccaagttccaccagacccacacgtttctttaccctaaccttttcgctgctccagcgaagaacacagccaccgccgtttcttcgtcttcctcgcagcgccggcgcgccatctcggtacgaaggcgacggcggcggtgacggcggcgttcaggatcgggatctcagcgacgacgtcagaggcttcccatcccgacccccgccagtcgcctcgcgccctcgactccggactccggtcctccgcacaccggccggttaccctgcgtttgaacctgctatagaaattataaaatggccgcggttgatgcgacaaccaaggagatggatgcactgcatgttggacaaaatgatgaaacaaaagagagactgattaaagaagacaaagctgcaaacagcaatcattctgttgttgcagctcagtccttgccaccagaggacgacgatgatgatgaagcacaagctgatggtccatctcaagatggagcagcagcagctgtaaagaagaaaaagaagaaaaacaaatccaaaaagaagaagggcccccttcaacagacagatcctccatcaatacctgttgatgagcttttcccctcaggagaatttccagagggcgaaatccaacaatacaaggatgacaatctgtggagaacaactagtgaggaaaagagggacctggaacgactgcaaaagccaatatacaactctgttcgccaagcagcagaagttcatagacaggtgcggaaatatatgaggagcatcataaaacctggaatgttaatggttgatctatgtgagacattggaaaacatggtccggaaacttatcaaggagaatggactgcaagctggcattgcttttccgactggatgctccttgaattgggttgcagctcactggactccaaatgcgggcgacaaaactgtgctacaatatgatgatgtgatgaagcttgattttggaacacatatagatggttacattgttgattgtgcatttactgttgcattcaatcctatgtttgatccattgcttcaagcaacgagagatgccacaaataccggaatcaaggaagctgggatagatgcacggcttggtgatgtcggtgctgcaatccaagaagttatggaatcctatgaggttgaaatcaatgggaaagttttccaagttaaaagtgttcggaacctcaatggacacagcatcgggccatatcaaatccatgctgggaaatcagttccaatagtgaaaggtggagagcaaacaaaaatggaggaaggggagttttatgccattgaaacttttggatctacgggaaagggatttgtcagggaggacttggaatgcagtcattacatgaagaactttgatgtcggacatgtgcctttaaggttagcaaaggccaagcaactgcttgggaccatcaaccacaacttcggaacgctcgccttttgccggcggtacttggaccgccttggtgagaccaagtacctcatggctctgaagaatctttgtgacaatggcatcgttcagccgtaccctcccctgtgcgatgtgagagggagctacgtctcgcagtttgagcacacaatcttactccggccaacttgcaaagaggtcatttccagaggcgatgactactgattgcggctggaggaggctccctgtaccaggttgtgtgtgtggagcgccatccgtttatggatggactataggacgtgtcacactcggataaatggtttggtcctccagagttcaggatgttgtatgagttttataataactcgctaaagattgtggatgtacaagtagcagtaatacgttttctgggaacatggacattgttaggctatttccagcggggatttcgtccgagtttcaatctcgattaaatgtgttgccacataagaaaatatgataatatggcaagaatttaataagagagtgagttttattgg

SEQ ID NO: 6759 - DNA, 925 bp, Zea mays
cacaaataccggaatcaaggaagctgttatagtttcactgcttggtgatgtcggttgtgcaagccaagaagttatggaatcctatgaggttgaaatcaatggcaaagttttccaagctaaaactgttctgaacctcaatggacacagcatccggccatatcaaatccatgctgggaaatcagctccaatactgaaaggtggacagcaaacaaaaatggaggaaggggagttttatgccattgaaacttttggatctacgggaaagggatttgtcagggaggacttggaatgcagtcattacatgaagaactttgatgtcggacatgtgcctttaaggttagcaaaggccaagcaactgcttgggaccatcaaccacaacttcggaacgctcgccttttgccggcggtacttggaccgccttggtgagaccaagtacctcatggctctgaagaatctttgtgacaatggcatcgttcagccgtaccctcccctgtgcgatgtgagagggagctacgtctcacagtttgagcacacaatcttactccggccaacttgcaaagaggtcatttccagaggcgatgactactgattgcggctggaggaggctccttgtaccaggttgtgtgtgtggagcgccatccgtttatggatcacactcggataaatggtttggtcctccagagttcaggatgttgtatgagttttataataactcgctaaagattgtggatgtacaagtagcagtaatacgttttctgggaacatggacattgttaggctatttccagcggggatttcgtccgagtttcaatctcgattaaatgtgttgccacataagaaaatatgataatatggcaataatttaataagagagtgagttttattggaaaaaaaaaaaaacaaaaaaaaaaaaaaaaaagcggcc

SEQ ID NO: 6760 - DNA, 1188 bp, Zea mays
  misc_feature (1058)..(1058): n is a, c, g, or t
  misc_feature (1079)..(1079): n is a, c, g, or t
accagaccccacgtttctttaccctaaccttttcgctgctccagcgaagaacacagccaccgccgtttcttcgtcttcctcgcagcgccggcgcgccatctcggtacgaaggcgacggcggcgttcaggatcgggatctcagcgacgacgtcagaggcttcccatcccgacccccgccagtcgcctcgcgccctcgactccggactccggtcctccgcacaccggccggtgaccctgcgtttgaacctgctatagaaatttataaaatggccgcggttgatgcgacaaccaaggagatggatgcactgcatgttggacaaaatgatgaaacaaaagagactctgattaaagaagacaaagctgcaaacagcaatcattctgttgttgcagctcagtccttgctaccagaggacgacgatgatgatgaagcacaagctgatggtccatctcaagatggagcagcagcagctgtaaagaagaaaaagaagaaaaacaaatccaaaaagaagaagggcccccttcaacagacagatcctccatcaatacctgttgatgagcttttcccctcaggagaatttccagagggcccacgcctgcgatgcaaggatgacaatctgtggagaacaactagtgaggaaaagagggacctggaacgactgcgaaagccaatatacaactctgtgcgccaagcagcagaagttcatagacaggggcgggaaatatatgaggagcatcataaaacctgggatgggaatgggggatctatgtgagacattggaaaacatgggccggaaacttatcaaggagaatggactgcgagctgggattgcttttccgactgggtgctccttgagttgggttgcggctcactgggctccaaatgcgggcgagaaaactgtgctacaatatgatgatgtgatgaagcttgattttggaacacatatagatggggtacattgtggattgtgcgtttactgtggcgttcaatcctatgggtgatccgttgcgtcaagcgacgagagatgccacaaatactgggatcaagggagctgtgatanatgcgcggcttggtgatgtcngggctgcaatccaagaaggtatggggtcctatgagggggagatcaaggggaaagggtccaaggtgaaaggggcgggacctcaatgggcacaggatgggggcatatcaaa

SEQ ID NO: 6761 - DNA, 3801 bp, Zea mays
cccggtcgcccagcgtcccagactagacagctccgtttcccctccccgtcctgcatccatctcgaccgcgcaccaaacccgaaaacgcagccacattccctcctgcagccacccccccccccccctccgctctcgcgcccctccgctgcgcgtcactccgagcggcggcggcggcggcggcgcccgcccccacagggcagtggcggcggcgaacgagggagggtttgttccccggaagagggagggaggctctggcgggagtgtgttacgggcttacggccgcctcgtgctggtgacaggcgcggcgcgagatccgggctggaagggctggcgggtcccgttggtggcgccgtggcgtcggcgtgatctgagatgagattggacccggctgcgcggtattcgctgcggaggtagacggccatgacgaccaacaccaagcgcgcctacaagctccaggagtttgtggcgcactcgtccaatgttaactgcctcaagattgggaggaagacctcgcgggttcttgtcacaggaggagaggaccataaggtcaatctttgggctattgggaagcccaattcaatactgagcttatcaggtcacacaagtgctgtggagtcggttggttttgattccacggaagtgtttgtggctgcaggagcagccagtggaacaataaagctatgggatttggaggaggcaaagattgtccgcactcttactggacatagatcaaactgcatgtcagttgattttcatccgtttggggaattctttgcctctgggtcactggacactaatctgaagatatgggatataagaaggaagaattgcatccatacatacaaaggtcacacacgaggggtgaacactattagatttacacccgatgggcggtgggttgtgtctggtggcgaagataatatagtaaagctctgggatctgacagctggaaagttattacatgaattcaagtgtcatgagggtcagatcctgtgcatagatttccacccccacgagttccttctggcgacaggttcagctgataaaactgtcaaattctgggatttggagacatttgaattgattggatctacaggacctgagacaacaggtgtccgatccatgacattcaatcctgatggaagatctttgttatgtgggctgcacgaaagcttaaaggttttctcttgggagccaataagatgccatgatactgtggacgtgggatggtctagacttgccgatttgaatgtccatgagggaaaacttcttggttgttctttcaatcaaagttgtgttggaatatgggttgttgatctgacgcgtcttgagccatatacaatgggtacttcaacaaaagtaaatggtcattctgaattgaagactgtttctagcggcactttgcctttacaaaatgatagtggttcaagggctaacatagggcgatcatcagtcttgcaaaatacagagaacaaccttaaaactacttcaggaagactgtcggcttcacagaactcagattctgcacccaaagaaactaactcggcaccttcaagcgggttgatcccaagcacaccacatagggctggagttggctcccataatagatctgttggaaattcagcttttcaatctggtggtaccaccttgaagagaagttcgttgaggaataacagtgcctctaatgttcacaatttcagtaaagctgatgtagtgcctgtcattgttcccagaactagctccggaggggagttggctactgattctagaagcgatgctgctgatgtggcacccgtttttccgaaggtaaccagaagggttgaacctgctaccgattctagaaaagaaagtaatgatgtggaacttgttgttcctagagcaagctcaagaatggaaatagccgatttagcacccatttctagttccaagtcaggcagaaggttggagtctgcccctgattcgaaagaagaaagtgctgatacagcacctgttgttgtttccaatcccagggctaatgtaagaatggaaatagtctctgattctgcgcccgctctttcaaagtcaaacagaaagctagattctggcactaattcaaagaaagaaagtgctgatgcagtcattgtacccagaacaaattctagaatggaaatgatttctgattctaggagagaaccctctgctggaagaatatcaccattcagaatccagtcaagatatgctgagccacggaagctagcccatgccagaagctgattcaaacaaagttgatagcagaagtaaaattactgaaacagaagacttcaattgccaaatatttcttccccgtagaaacggtgtttttcaaacaataagttctgaagaacctcgtgaagatgtaaagtgtggtccagttgacagggtgggattttcaaattcatcagaaccaaatgcgagtgtccgcaatgagaattatgttcctagaatgcgcaaaccaggagacaactgctatatcgaagtttcaagagccgggagagcaaggtcaagtgtctctaattgggaagggagggatcagccccctagtcatgaagaaccaacaacaagcagttctacactggctcctaccggccatccatattcatctagaggaagcaatcaagcttctgaagctccaatcatagctagtgatgaagatgttctatctcttatcatggagcgacatgatctatttttaagctcaactaagtctcggctgatgaaattgcagattattcatcaaatgtgggaaagaaatgacatcaggggtgtgctctctgcgatggacaggatgggtgatcatgctgtctgtgctgatatggctagcgttctcatggagaaaagtgaaacaatcacactagatttgtgtacctctatcctgcctgtcgtcactgatcttctggagagcaaaattgacagacacttagtcgtcgcattggaattgttggtgaagcttgtaaggacttttggtccaatgatacattcaacagtatcgtcaggtccttgtgttggtgtagaccttgaggcagagcaaaggagggagcgctgcaacttatgcttcatcgaattggagaaggccaaaaataagcttccatctctaacaagaagaaaaggggcggttgcaaatgctgcacaagaacttgctcttgtcttccaggaaatcatgagttgactgacgacacactagatatacacaattagatgggacatgcttcggcctctgatggcaacaagattggatatcagctgccatggagggtgctagctattcagtcttagcgacgtcatcaagctccaaggccacagcaccaacaaatgcattttgttgctgctgttcgtgccttttgtacacatgctaacacataatccatgtcatttgtgaagagaagctgccatggacagtgacttcatccacaatattatgtggatggcggcagctggagatgttaggccccgatcgaatggtgatcagcagatgagacttgcttgggcttttctggcactcgtagttctttgctgtctgtaacatctttctcatgtaccgttatcatgtgcatgtgcaacagtcaagtggttgcatttggtagtttatggttgtgctgtgtgttggtcgatttagtggtcgttgatgagtgaagcgagccatgtacatcatttttttttaagatttgatatcttctttttccttgatgactcctctcgttatacttgagtgaaaatgatatcttgtgtacttgccttgacagctttcggaaaaaaaaaaaaaaaaaactcgaggggggggcccgg

SEQ ID NO: 6762 - DNA, 824 bp, Zea mays
gcccagtcggcccacgcagttcatcctagggttttgtctccgctacacactcctcctcttttatataagcctccgccgccgctaccaggcccttcccctcgcgcaccgctcctgtccaccctgccaccgccgccgccgccccgccgcatcaactgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctctatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctttctctgaagaccgagagggaaaagaagcgtgagaagtacttccccatgaggaagtatgctatcaaggcctaggtcagaactgtgagatgctgtgcttagcatatcatccgctgtgttttaatttttggtttgtatggacatttgttgtgggtcggaagtacgatgtattcctctgtttccataaatggctagattggtttgactggcaattcgtattggcgatcatatttggtggcaacttctctttgtattcagctaaactagatgtttgctgttcattatatctgtgtgatcgtttggcctaaaaaaaaaaaaaaaaaacccgccaaaaaaagtactctgcgttgttaccactgct

SEQ ID NO: 6763 - DNA, 3091 bp, Zea mays
caaaatattgcattaattcaatctccatctggatgcgtgtgtgtgaccggtgagcgagacagattccacagcaatttgctcctcttccacgcacaggcaagactgctccccagaaaagattgtagttttcatcgatttagccggtttctgcccggggggatcgctgctggagatctcagagaaccgggaggctccgagcttttgctccgtttgcgtcgaatctgcctcgggagcggagaaaggagcggccttccgagctcgtaggggccgtccctgagaaggcgagaggggacgcggcggcggcggagtcagctctagggcgctcgtggaagtcggtgatgccggtggtttgaggacgaggcggcctcggtggttttgaggaagccagcctctgccgcggcaaggatggactccagcggggaggaactcctgaagaagatccgggaactggaggttgggcaggcgcagctcaagcaggagatgtctaagctaatacccggcgctggggagcgtcggcgctcgcaatccgtctcgccgcggcgcggcgtgccggtgccgccgccaccgccggccaaggcgaaggcgggggcgccaggtaggcggctgtccggggggtttgagggcgggcagcgcgcgtgggcccgtgggtcggcgtctttcccgcactcatcaccgctgcagcgggagggccgcgcaacgggcgctggagacgctagcaccagcgctaggctgccggagaggcagtactccagggtgcttcagtcaatggggcagtccgtccacattcttgacctcgacgggaggatcatatactggaatcagtctgcggagaatctgtttggctatcctgcatcagaagcccttggtcaggatgccctcatgcttctggttgattcccatgaccacaatgcggtaaataacatcttccaacgtatttctatgggtgaaagttggactgggaagtttccagttaagaacaagcaaggacatagattttcagttgttgccaccaatacacctttctatgatgaagatggcagtttgatgggtttcatttgtgtttcaagtgattcccgccaattggagcagatattttgtaagcctccgacctctgcaaggtcccagtcagaatcatctatgacatcttgtgatgggagttgcagcaacactagtcacagaatcaattcgttgaatagaagttcttttgattctaatctacccctgcaaagcactttagcatccaagataacgaatttggctaccaaggtcacaaataaagttcgttctcgggtcaggacagacgagaatggcgatggtggcagtggtgagagccattgcttggatcgtggtgcaaaggaagagccaacatctagcggaacaagcacaccaagaggggatgcaccacatggtccctttgctacagaagagaactcacctgggaaatcaacgaacccaaacagcgacgaatcagaaggaaaagtaggtctgcacaagattttgggttctaaggcagaggcactattgaacaagaaagggatatcatggccttggaaagggcgcgagaatgagggacctgatgaaagaaaccatgtgatattgccgtggttgcatggtggccaagagaatggtgtgaatcatcagaaggtttctgattctagtatatctccagacgcccaaggcgctgaacacaaccaacctagcaaaaatgaggcatcaggttcctggtcctctttcaacaataacagcacaggcagtgcaagcagcacgggaagcactaatagcagtgctctctacaaagtagatcatgaagcagattgtctggattatgagatcctgtgggaagaccttgtcattggagaacaaataggtcaaggctcttgtgggacagtatatcatgctttgtggtatggttcggatgtggctgttaaagttttctccaagcaagaatattcagaagaagtgatactgacctttcgacaagaggtatcccttatgaagaaattgcgccatcctaacatactgctcttcatgggtgcggttatgtctccacaacgcctttgtattgtatcagagtttctcccccgtggaagcttgtttcgcttacttcaaaggagcgctaccaagttggatgtgagacggcgtgtccacatggctttagatattgtaaggggcatgaattatcttcaccattccagcccgcctatcattcatcgagatttaaaatcatctaaccttttggtcgacaagaactggattgtgaaggtggcagactttggtctttcacgtctcaagcgtgaaactttcttgacaacaaaaacaggaaaaggaacaccccaatggatggcgcccgaggtgttgcgcaatgaaccttccgatgagaagtctgatgtgtacagttacggggttatcctgtgggaacttgttactcagaagataccctgggaaaatctgaactcgatgcaggtcattggtgcagtgggttttatgaaccaaaggttggatatcccaagtgaagtagatcctcagtggaaatcaattatcctgagctgctgggaaagcgacccgcagcaacggccgtcgttccaggagcttcttgagaggctccgggagctgcagaggcactacgccatccagcaccggaacacaaagaacagcatcgaggagtgaagaacacaatgcgactctcagagcgctgtggcttgcttcgaagcattttgcgagcgaacgaacgaagaaccaggtctctagaagggcctggaccctcctgtactgtatggttttgctttggcggaacagccaaggctggaagaagtttgttgtacagacgggggtacgttcttctttgtttgacagggcaattgtgactgtaatctctgggtcctaacacccaagggtagggtagagactatagagtgagtagtgactgagctccggattgctggcgcatttgggttcttctgattcgtggcaatgcaaatgcgtggttaacaataacatccaatccggggcttgtgtttctggaaaagggcatgatgatgtgtagattgtttgctctgacaagagtggtgcgtacatgtgattggttgtgatc

SEQ ID NO: 6764 - DNA, 896 bp, Zea mays
ccggccggggaaaagcaagaaaaagagaggagtgcggtgcgcgacgccgggccgggccggcccctcgcgcaccgctcctgagtcctgtccaccctgccaccgccgacgccgcgccgccgcagcaattgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtacttccccatgaggaagtatgctatcaaggcctaggtcagaactgtgagatgctgcgcttagcatatcatcggctgtgttttaatttttggtttgtatggacatttgctgtgggtcggaagtacgatgtattcctccatttccataaatggctaaattggtttgactggcaaaaaaaaaaaaaaaaaatatttggtggcaacttttctttgtattcttctaaactagatgtttgctgttcattatatttgtgtgaccgttgctcatggtatgtactccgtcccagaaacagaagttgagccgaggctcgacagtactgggagtgtttggtttgaggcatgatgtagtccatcatcttctcccccattttttgtttggtttgtagaatggagtgagttaatccatcaccaccctcattctc

SEQ ID NO: 6765 - DNA, 1535 bp, Zea mays
gacactttatatctaatccctctaggcgtactcaaccattcacgagattaatgaggaaaggtgtaccattccattgggatgagcaatgccaaaatgcgcttgatagtctaaagaggtacttacttaatcctccagtattggctgcacctgtaaaaggtcgccccttattttatatattgccacacagccagcctcaatcggcgcgcttctcgcacaacataacgatgaagggaaggaggtggcttgtaactacttgagtcgcaccctcgggccccctgagaacaattactctccaatagagaagttgtgcttggccctagtcttttccttaaagaagttgcgacactatatgttggcacatccaatacagctcgtggcaagagcagaccctgtaaggtatgtgctaaatcaaccggccctcatgggacgccttggtaaatgggcagtaatcatgatggaatttgacattacttatgtgccgcaaaaagcaattaaaggtcaagccttggctgattttcttgctgctcatcccgtgccagatgattcgccgttggtgatagacttgcccgacgaggatgtttttaccatcgacatagagtcaccatgggagctttattttgatggagcgtctcgtatagagactggtcctgatggttctcaaaggagaagggctggcgcagggatagtattcaagacaccacaaggtgaaacaatttatcattccttctctctgatgaaggaggaatgctcgaataatgaagcagagtatgaagccctcatatgtggtctcttgcttgcactttctatggacattcgacatttgctagcatatggtgactcacagcttgttgttcgacaagttagtaatatttatgaggtacgtaagcctgggttggtgccttattacaaagcaacacgagggctcatggaaaaatttgataatattcatatctctcacattacgcgaggtaaaaattcttcagctgatgctttagctaaacttgcagcggcgctggtgcgccccggccggcagcccgctcaaataaaaattgaagaaaggtggcttctaccagccgtcttagaattagtcccacaagaatatgaagtcaaccatattctcgttatggttgttgatgaaagtgattggcataaaccattcttggattattttaatcatggcattctcccaaaagatcttgtggaaaggcgtcgtttacaacaatgtctgcctatttatacctacaaggctggggtattgtaccgacggtcttttggtcaagaaattctttcacgatgtgtgtgagtgtgtcaagggaagaagccaatcagatattacaagaaatgcataagggtgtgtgtggtggacaccaaagtggagctaaaatgtatcacagcatcaggctgataggttacttttggcctggaattatggcagactgtctcaagatcgccaagtcttgtcatagttgtcaagtgcatgataattttaaacatctactgccagtacctcttcatcctacagttccttcatggcc

SEQ ID NO: 6766 - DNA, 3948 bp, Zea mays
cgtgaaagaacgaagatagaaatttttaattagttttggtgcagatttatacctaagaattcataacaccgacgactttcaaaattactagcccgtgtaatagcaagatgcaacgggaaaaatttatcacatgcttgattcatcctagatctcccacggctagacgtggcctaggggcaaacttagcctatagatgaagaaacttggatggtttctatggacagcttcagggatacatgaaacattggaacatgttgcgactggcgagagttcaaggactaactactaaggttattctgctgaattctattgttgctaacgatgaatcttgccctcaacaaacaagtagtagagctctgcaatgtcgtgggttcgtgtgagagaacaagggagagaaaccggatggaaagcacgagatgattccttatctgttcgtaccagcttgagtgagaccaccacaggtgtcgaggcttatcccgagaggggccatggtgactcatcgttttccatcgagtggcagtggggcacctcctgctttgtcgctttggatgcggatgcatgtactcttgtccacttctccacctctccttttctctcttttttgcagtgttcagactaaattatggtgatggttgacaccgataattggtcgtactcgagtgatgacatgataatactagtatattatcttgggatttgtgactgttaacttgattctctttctcgttcttttgttgttttcgatacatcctctgatcctcatgtgccgccttgtcttggtctttcgcttttgtttctgcaattctgttcatataccgtacggggttgcttcctgctttgatcctttgctagctactcgtactgtaccaccgtgcccagcgagaaaccagagatgaacaagcgattcaattcaatcctagacgagcttgtctcgtagtctaccgtgctgtcaaggctcaatatgaggatcagccaggactgcctttctgcttctgaaagaagcgcacatacgtacgtagccgtttgtttatctttcgaacaaatttacatgtcagattttagcttttgtagcttcagacgagcatccatccaatccatgaacacgaggttccgtagaggagtctcggagctcagtgagaagccgagaacagtagcaggtgttgtcggccacttagcaacctccaaggcacagtcagttgtagacctgccctgcggcactagccacctctgccgcggcttcagagcttagctcggtccccagcagctgaggaacatgatcatccttagcgactcctcggcgccgccgccgccgccgatcttgccggccgccgacaaccgcaacgcgccccgcttcgcggccgaggagcaaggcttggccacctgctccttgagctcgatggcggcgcccagcgtcaccgcaatgtacgccttgttcgccaccgcaaacctcatcctcttttttttccctgcgttccgaagaaactacgactctgcctggactctcaagaacgtcagtgcgcatgtggcatgtagagtgagccgagcagaagcttgattatatacgtgtgttgaggtgccgtgcgttcatgtcaacttgtctcagtggccaacggtttcgcaggcagctcggaaaacaggtggccgagcggaccactggttccgtcaaacagggagctcgtgcaggcaccgaatccatggtatggttcctgatgaggccatctgatttggaggatatgcactggtttgtcttatctacgacattcagttcatatcttgtctgaaattgtcacttgctttgcttgcatcatctttactcattgctgttctgcacttcatcagtttctgaaattagtgaacgtctctgtcggttcatcctggtcgcagtttcgagtccgtctgcaacggcatgtctgcaacgcagcgcaggcggccacgcagcaagtgtctgtgggaacaatgtgaatcctgtggatttcctataacattttttacattcctatatgggactctagatcttgagaggaaggcggttctttggttcttcggataaaaatatatatgcagatggaacgccacaaactacaaaggaagcgccatctactgacatgtagctatactactatattaaggctctaagggtagcctgcctcctctggttctgcctcccgttaatctacgccgtccacgcgcgttaatctgcaccgtccgtcatgcgtacgttttcgaccgtcgcccccgtgaatcactccctgccccacaacccccaagcaaccctagctctccctccccctccgcgtcctacagccatcgtcgctctgccttccgcccccgccgtcgccgcagacgcagccggccacccaccactcgcgcctcccccaccgcgtcgcgtgtgggccacagctacagctgcctcctcgagcaacccacactcctttcttcccctgcctgtcgtctctcttccaccttccaccacaagcgccgtcgcagccggtgcctgctccttcccgatccccgaggcaaagctgcgactccgcaactgccgccatggcgttcgagaagatcaaggtctccaacccaatcatcgagatggacggtgagatcccatcgcttgccgatcataaatcaatcgcaccttcgcgtcgcactgctgaatttttaaatttaaagccgggttttggggtgcgccgagatctgtacggttgaatcttgttgcgctgctatccttgtgctccctctgatttgtctggtcaagttttggtggttgggttcacgaagacgctaactgaggtttttggcgaggaacctttgtgtaatctgtagtcgagtcgccgcggcgcatgtccgcggaagcgcgggaggcgacttcttgccgttcgcctccctgttgtttgagattaaattcaggtatacaagcgggtgcacggatgatctaactacggatgaatgtgtagaaatttagacgaagcctgtctaaaattgaaaaaaaaacaaaattaggcgaagtttgcgtaaaatggagaaaaaggaggtggtttagatgtcaccggtcaccagtacttccctggtggcagtggggaagctacagtaaattggaggagtgtatgtttgccttgttggttcatgtacttgtactataaggactgcatacatggtgaaattacagttaaattcactgttttttatttttaagtggtgcagtgcacccctaaattatattgtatgtagcttcgcctctgcctgagtgcctggtggtgcaccggtagtggaatagttttggtggatgtataatatttcatctcacttagttatatatacttaagctgcaacttttgtggtttttggatgcaataaatagtcatgctttgtggtcagtcatcattttctctgcttgtattgaatattgacccatgttctgacttcttcatgttgcaattagaaaaaataaacaaacaagatagcactctcccatctttaaataaaaaacaagaatattccattgtagtgataagtttgtattttttattttccaacctgaaatgtacaaacctaaactaattttcttaaacacactgtagctgataccttgtgccattgtcctattataggcgatgagatgaccagggtattctggcagtctatcaaggacaaggtaatgaatacctcatgtgttccgagtcgtcagattaaactgctttacttgctcctattttttgcctgatttcattaggcatttaggctagatgatgacaacatattttttcagcttatcttcccatttctggacctggacatcaagtactatgatttggggatactgcacggtgaagcaactgatgacaaggtcacagtggaggctgcagaggctactctcaagtaagagtttgttaagtattttgaggttggatgcaagggtgtgcttgtatcacagaatcttatgaatttgtcgaa

SEQ ID NO: 6767 - DNA, 885 bp, Zea mays
cggccgctcaggcgcccccccacctccccgagtcccacagccgccgcctaccccaccaacctgccccgacccgctcccgacctccgaggcaatcagcgtccgccgcggccgccatggcgttcgagaagatcaaggtcgccaaccctatcgtcgagatggacggcgatgagatgaccagagtattctggcagtctatcaaggacaagcttatcttcccatttttggacttggacattaagtactttgacttgggagttctacaccgtgatgcaactgatgacaaggttacagtggaggctgcagaggctactctcaagtacaatgtggctattaaatgtgcaaccattactccagatgaagatcgggttaaggagttcaacctaaaacaaatgtggaggagcccaaatggcacaattaggaacattataaatggcaccgtgttcagagagccaattatatgcaagaatgtcccaaagcttgttccaggatggactaagcccatctgcattggaaggcatgctttcggtgatcagtacagagcaactgatgccgttctcaagggacctggcaaactcagactagttttcgagggaaaagacgagacggttgaccttgaggtttttaacttcactggtgctggaggagtcgccatggctatgtacaacacagatgagtcaattcgaggttttgctgaagcttctatggcaatcgcttatgagaagaaatggccattgtaccttagcacaaaaaacacaatccttaagaaatatgatggcaggttcaaggacattttccaggagatctatgaagctggctggaaatccaaatatgaggctgctgggatatggtatgaacatcgtctcatcgatgacatggttgcctatg

SEQ ID NO: 6768 - DNA, 1652 bp, Zea mays
aaataagcccgcttgggggccccgcgcggccgcgggccctgccgtctctttccccctccaccacaagcgccgccgcagccggtgcctgctccttcccgatccccgaggcaaagctgcgactccgcaaccgccgccatggcgttcgagaagatcaaggtctccaacccaatcgtcgagatggacggtgatgagatgaccagggtattctggcagtctatcaaggacaagcttatcctcccatttctggacctggacatcaagtactatgatttggggatactgcaccgtgaagcaactgatgacaaggtcacagtggaggctgcagaggctactctcaagtacaacgtggctattaagtgtgcgaccattactccagatgaaactcgggttaaggagttcaatctgaaacacatgtggaagagcccaaatggcacaattaggaacattataaatggcactgtgttcagagagcctattatatgcaaaaacgttccaagacttgttccaggatggactaagcccatctgcattggaaggcatgccttcggtgatcaataccgagctaccgatgcagttctgaaggggcctgggaagctgaagctagtttttgagggaaaagaagaacagattgatctggaggtattcaacttcactggtgctggaggagttgccttgtctatgtacaacaccgacgagtcaatccgagcttttgctgaggcttctatgacaactgcttatgagaagaaatggccactctaccttagcaccaaaaacacaatcctgaaaaaatatgatggcaggtttaaggacattttccaggaggtctatgaagctgactggaagtccaaatttgaggctgctggaatatggtatgagcatcgtcttattgatgacatggttgcgtacgcgcttaagagcgaaggaggctatgtgtgggcttgcaagaactacgatggagatgtgcagagtgatttcttagctcaaggttttggatctttgggtttgatgacatcagtgttggtgtgccctgatggaaaaaccatcgaagctgaagctgcccatggcacggttacccgtcatttccgtgtccaccagaaaggaggcgaaaccagcacgaacagcattgcttcgatctttgcatggacaagaggacttgcccacagggcaaagctcgacgacaacgctagactactcgacttcgctctcaaactcgaggctgcttgcgttgagaccgtggagtccgggaagatgactaaagatctggcgattcttgtccatggatcttccagcgtcacgagaagccattacctgaacaccgaggagttcatcgacgcagtcgctactgagctccgatcaagactgggagccaactgagcctacaagaaactttgcatggcgactttgaatgcttcgtcaccgtcaccgatctgctagtcgtcttttctgttatgaagaagtgaatgtgcgtcaccgcagtttcgatgcaagctaattatagatgtggtgtcacgtgagcgctcaaaataaaggatacacatgattaaattgtttttatgtcagtactaagctcagtcatccccccccccccaaaaaaaaaaaacaaaacgaaaaaaaaaaaaaaaaaagcggccaaaaaaaaaaaaaaaaaaaaa

SEQ ID NO: 6769 - DNA, 2168 bp, Zea mays
gacgctctcatcgcgaacgaggccagggacgcgttccagcgcgtcatgagccagggaatgcggaggcccatccactccgtccagggactggtgtccgtggtgcaggaggaggagggactggcgtccgagcagaggctcgtcgtcgacgctgtggcgcggaccgcaaccgtcgtctcgacgctcatcaacgacgtcatggagatgtccgcggccgccagccaggagcgcttcccgctggagacgcggccgttccgcctgcgctccatggtgagggacgccgcctgcgtggccaggtgtctctgtgacctgagcgggcggtttggtttcgcggtgcacgtggagaacgtgctgccggaccttgtcatcggcgatgagcggaggatcttccacgtcctgctgcacatggtaggcaatctgatcggtcgggtcgacgagggggacgtcacgttccgggtgcgcgccgatgatgaggcgacggaggaccagaggtgggatccgtggaggccgagctactccggtgggcactcgtcggtcaggtttgtggtcggggtgaagaggcagcagaacgcaggcgactcgcttccgcggttcttgcggcggccaaggacccatgacgggttggatctcaggctcagcttcagcatgtgcaggaagcttgtgcaggtacctgcgtgcgtgcgtgccctttgcttttttttttggtcttgttgtgtgatgtgctctctctctctctctctcgacagacgatgcaagggaacatctgggcagttctcgacggccaaggactcccggagagcatgaccctggtcctgaggttccagctccaaccatcgctggcgagctccaacctcctcggagggtcgtttgatcaggagcactactcatcattgccatctaaccaaatagccgggctgaaggttctgctcatcgatgacgacgagatcaacctggtggtggcccggaagctcctggagaggctaggctgcaccgtttcctcaggctcgggactcatggactcttcctctgcctgtgcctcgttccagctcgtcatggttaacctcgagatgtcagcgatagatcccctggatgctgcctcgaggatcaggcagcagtacaggagctcgcactggcccctggtgatggccatgacgtcggagcagaacgtgtgggagaagtgcgcgcagtccgggatcaacggcgtcctgaagaagccgcttgttctgctggaagtgaaagaagagctcgagcggatccttcagaacacatgatgcctgccatgacccatgagctactaccatgatgaatacgacccccgtccgtccgtctagcatactacatagcagaggggaggggacatggatctcgagttgagaagtggatgcaagtctcctacgctgctgtagttgagtgactgctgtgaggacggaggtggtgacgacgacggatttggcaggcaagcacgagggccgcgttatccgatccatgcccatgccgcgtaaggaggcttcacctcgattcaccaactacataatcacctcgattcacacacgtcaggctttcagtcgataaattcattagtttcatcagaaacggaatgcagttgccagttataatgttggcgtcagtcgcaggggatcttcggccatcgtcgccgcatcagaagcaatgcgcagctccagtggcctcgaccgaacaggacaagaaataggtctagttggatttcttttcgcctttgggtttttgttttaaaagaaagagaacttgattttccttaaactagaattctctgtcttccattatagtgcacccttttttatactcagattcaaaaccaaaatataaaagaattaagtagatctcaacttgtcatacttctcagcatatttgttatctatccacacttgttaaggctcattagtttcttaattatattattatcattgtgccaaacagtgccgggccggcataatgcaagttaatctcgtttattaacaatgactacggcttttatatatatctctacaactattaagagcgaactgtagattgcccccgctcgagcagcccgcacgacgcaaatcccctcccacaaccggcaacgcccgcggcgaatcccgccgcgcgaaccgcccgcccccgccgcgaatcctccctcccgcaacccgacc

SEQ ID NO: 6770 - DNA, 2568 bp, Zea mays
  misc_feature (769)..(769): n is a, c, g, or t
  misc_feature (1848)..(1849): n is a, c, g, or t
cttcgggctcgtgtacagaaggaaacgccgtcgccgccggaggcaccccgccgatgaggtcgtcgccgaggacgaggacggcagcaggaggtttgggatagtatacaccaggaggaagggcaagcgatcgaaggtcagccctctcctggtcccgcaagagccagaggtcccctgtgacatcgccgccgccataccatgctcctcctcccgggagtttgcgtcaagaactggtttcttggatgcccatttctcggccctggtagatgatgccgtcacttactctggggctcagatgctcgtcatccttgtcgatacgtcttgttctgggagctctcaccggctcactggccttcttgtacccatgctgcggtggatgcgccgcagttggcagcgggggaagttccggaaccttgcgacattcatcttctcttcgggtatagctgctgcgtttgcatcccacggggtgcactttgtcaagctccagtgccagagcgctgtaagctttcaacagccttcatctgatctattttagtttctggtacaatcggtgtaacatttatgcttcttgctgcagtctgcattgttacacaggcctcttgcgcattgtgggtggtgtgtgcttcatggttccaagaaatctgaaccgctgctctcagtcgatttctcagcacttccttcatacttttcgagcttgcattatgctgtagctcttgattcgatgtatctgccagctatgattcagcacagcaggctgctggttgagggatcntgaagaaatctatcctcgctctcctttatatttggaatctggggctcagagcagtggttttgccgctacggccgcgggtaacaatgaaccttgcagagttgttccgaactacatgcccctcgaacaagttgctggactagtggcacatggtctgaggttgaagaagcatcaaaggcggagaactatgagacatccccgaaatcggcggcgacttattatagctagattacctgacaatggaattgggatgaagcacagtacaacttccatgcaaacagaagaaaatgtgcgatcaagtaggcaaggacctcctgtggagcctgtctatcctaaagcagcattagaaatttctcttgatttgcttgaaaacatggatgaaagtgatgtttcgactcccatcggatcagctaggagaaagagatcttctttgaagagccctgttgagagaatgaatgaaaaggtggccttggctgaggtgagacagaacatagattctgttcaaagcaaagcgaatcttctaaatcttcaagctgataggtgctggagggaagaaggtgctgaagttatgctagaactatcagataccaataagtggtgtatagttgtgaagatacaaggtattactaggtattcacttaaaccttcagatgttaggtcatatgtcattaatcgtcattctcaagcctacatgtgggcagttgatgatgcatggaaacttgagttcactgataagtgggactggctgttattcaaagagctgcatgttgtgggccgtgagcgtaattcccaggggaagacaatcccaattcctggggtacatgaagtttctgatggcatggaagggattgttacagatcctttctcacgccctgtgccagactatattaggatggtggatgatgaagttggacgagctatctcaagagattctatttatgacatggactcagaggatgaacaatggctcattcagttgaatcctgcagattcagattcaaacagctctcaaaggaatcatctctcttacgaagactttgagaggataataagcatatttgaaaaggatgcctacaacaatnngcccaaggaaaaaatgatttgagtgagtttttttatagatatcctgctttaggaaaggatgataacgtgcatgctgtgtataaatattggacaagtaagaggtccaagagagctgcaccattgcttagggtatttcagggtgcacccataaggcgagggcatttatcacaaaagtctgccatgaagcgaaagagatctttcaagagacaaaaaagccaagctggtcgtggaaagcctgaagctttattgcaatacaatgctgaagaggacgcagctttgcacagagttgcccaagctgaacgtgcggcaaaacaggctgtagaaagagctattcgactgcgcaacagagcccagtctctcatgacaaacgcagagctcgcagcatacaaatccgtcatggctctcaggattgccgaggctgctaggatatctgactcgtcccgagatattgtttgtactatcctcgactaaagaaaaatatgggttgttcattgatttgtgtggagagcatggaaaatactcttcatcgcccatgatattggcttttcgacaagctgtggggttatatcccccccccccccttctgttaactcactttgtcaagtcaattttgaggcgaatgcttgaactgaaaactgtaatttcttgtataaattgaagtagttagctagattttgtaaaaaaaaaaaaaaaaaactagagggggggcccggtaccca

SEQ ID NO: 6771 - DNA, 1129 bp, Zea mays
agttggtggtgcctgggagcctggggtccccggttggggggactggctgttattcaaagagttgcatgttgtgggctgtgagcgtaattctcagggaaaggcaatcccaattcctggggtacatgaagtttctggtgagatggaagggattgttacagatcctttcttacgccctgtgccagactatatcaggatggtggatgatgaagttgggcgagctctctcaagggattctatttatgacatggactcagaagatgaacaatggctcattcagttgaaccattcagattctgatccaaacagctctcaaaggaatcatatctcttacgaagactttgaagtgttaataagcatatttgaaaaggatgcctacaacaatccccaagggaaaaatgatttgagcgagcttctttccagatatcctgctttactaaaggatgataacgtgcatgctgtgtatgggtattggacgagtaagaggtccaagagagctacaccattgctaagggtatttcagggcgcacccataaggcgaggacatctaccacaaaagtctgccatgaagcgaaagagatctttcaagagacaaaaaaggcgagctggccgtggaaagcatgaagctttattgcaagacaatgctgaagatgaggcagctttgcagagagttgcccaagctgatcgtgcagcaaaacgggctctagaaacagctattcaactgcgcaacagagcccagtctctcatgacaaacgcagagctcgcagcatacaaatccatcatggctctcaggatcgctgaggctgctaggatatctgactcttcccgagatattgtttgtacaatcctcgactaaagatggatatgggctgatcgatttgtgtggagggcatggggaatactctttttttttctttggttgcatcattgcccatgatgttggcttttcgacaagctgtggggctattttttcgccctcccctcgggttgtcaactttgtcaagccaattttgaggtgaatgcttgaactgaaaactgtaattccttgtataaatcaaagtagctagctaggttctgtatcttatgggttctgatatgttggcatgatgaagcgtatacttgtattggataa

SEQ ID NO: 6772 - DNA, 1025 bp, Zea mays
tttctcgcggcgaccgcgacgcccgcggtcacccgtcagaccgacacggaggtaggggacgagggaggggaaaagagagatggtggaggcatcgccggagtccggcgccgcggcgaccggaggtgcctctagtacggcggcggtgcggaaggggaagtcatgcaagggctgcctctactactcgtcagtgctcaagtcccgcggttacaacccaatctgcgttgggatcccccgctccatcccccaagttcctaactacgtggtggatgaacctaaggaggaggcgacggcgcaggggcatgacctcaggcggttcaggtacgggtgcgcgggttactccatgttcgtggacaacagggacggccagggtggtgagagcgagggcaagacgttgttgccatattgcaggggcctcgagttattggtggacagcagattggtcgagagaaagccatcggcaactgaacaagctccagcacatgttgcaaaggatgcagcagctaccatccgctctcaccaacaaggacaacagagacctcagaacttgtcgaggcaggaattcttggacaggtttaagaggagcgctggactggtcgcttcaggtgttgcgaagaatctaaacaaaacagccaattatatcaaagaaaatattcaggacatgtacaccgatcgtcgtccaccaaagtagcaaccatgccgagtgattgtcgtcaagagctgaagaaatcgcttgctactggaaactttacatcaggactacctggaaactttactccactctcctcacttgttaaacgaaatggagcttttctgggataccaacttccttttctttacctgcataatcttgtaattttgcggctgtatatgtacatgcaaacaacttctttgaagcgaaaaatcagatctcgtttggtgtattgatcaaaaaaaaaaaaaaataaacctgcaattctgcggctgtatatgtacatgcaaacaacttctttgaagcgaaaaaaaaaaaaaaaaaaaaaaaaaaaaaa

SEQ ID NO: 6773 - DNA, 786 bp, Zea mays
ccggccccgggacagtttctctctctcgcttcgatagctaatttcgccgtcacccgccggacagacacggaggtacaggagcgagggggaaagtgggatggtagtgggggcatcatcggtgtccggcgccgcggcttccggaggtacctctggtacggctccgccgcggaaggggaagtcgtgcaagggctgcctttactactcgtcagtgctcaagtcccgcggctacaacccaatctgcgttgggatcccccgttccatcccccaagttcctaactacgtggtggatgagcctaaggaggacgcgacagcgcaggggcatgatctcaggcggttcaggtacgggtgcgcgggttactccatattcgtgaacagggacggccaaggtggtgagggcgagggcaagacgttgttgccgtattgcaggggcctcgagttattggtggacagcagattggtcgagagaaaaccatccgcagctgaacaagctccagcacatgttacaaaggatgcagctaccacccgctctcaccaacaaggacaacagagacctgcgaacttgtcgaggcaggaattcttggagaggtttaagaagagtgctggactggtcgcttcaggggtcgcgaagaatctaaacaaaacggccaattatatcaaggaaaatattcatgacatattgtaccacgatcgtcgcccaccaaagtagtagccatgccgacttgctgagtcccagaacgaagcacagcagccccagctccgtcactgattatgcaaatggagccttcc

SEQ ID NO: 6774 - DNA, 2878 bp, Zea mays
tttatttctccgcatgaacgtgtcacccgtgaaacccagatcagacaactcacaatcttctagatttgtcgaaacttgtccatgcaaatttgtggtcgttgtttccccccttgtttctcacgttgcgtgagaatctcgttgaaatcaccacacattaaccatggcctccttgtgtgagtatccaatattctcattgatctccacgtcaaatctttcttgtcagaccgtggttcaccatagatgcccaagagtctctagataaaacgatcattctccaccacatctgcatcaacaaaggtaccacagagcaagttgactctcaggtcaatgttcttctaacaaaataatgccaaacctccactccgaccctcacaatccttgacaacaagatttgtcaagcctaatttccatcgaaaaggtttcatcctcctcccattgatttttgtttcagataggaaaagaatgttggggtccacctccttttggagtgccagaaggcctttcgctgccgggtcattccccaaccccgggcagttccatgccacgatcttcattgggtcttgcggagctgtttcgacagccccgctttcaattcaaaatcgatatggccatttccaatagtaatttccttctcctctctcctcatttcttcacccaattccacaataggatcaacctcctatgtctccaaacgactcctcttccctactacctgaatttcctggctgtcatccgcacgggtgctttctcgacgaggttgccttttaaatttgcgtagctgttgctctgactgaggaagtgccttttgggaattctcactctccaccatcatcttcctgaggcattttatatttgtggcaccatcagaaagatccttcactgttggcaccataggaacctgtgcaatttggttatgaacattaccccctccccctccatggtactgaacttgtgcctctgttcatcttctttgcttccttgatttgcatctttcctccaagatggtgcatcacttctcctctcactctggtaaggaactggaacattcttacgcccctatcctccactacttgacgcgcacttcctatcgcccatgaatttgttgggaacccaccacagagtttatcaagtggcaccatctcgtccttactgaacttcatagaacaacttttctgagtgtgtccgattagaccacacatataacaaaaatctggtatgaattcatagaaaatcggacaccacttctttccatctgcttccagctgcaccgtgactcccctcatcaaaggcttccgaatgtcaagcatgatcttaattcagaagactcccacctcattgccaatagcctctgcagcttctttagtgaacaacctaatcggaagttttgtgacgcggatccagatcgagattgcattgaactcaacctcgccaatagactttgtgtcatccataccagccatcaccaacagttcatttgaaaagctccagggtatttcctccaatgccttccgctttcctgccgcctggttgaacgtgaataggaatttattgtgccccaaacttctgcattcggttcctcggatcggacaccaactgttcctagagcacgttcaattgcatctggatgagacagtttctccgagagtaattttcccagcgcctgatgaacaactgtgttcgaccttttcatccctccgatctgcacctgacttctttccgcctctgacagttgcatactctccaagagcctttccactgccttcacacttcttccgtccatcacaacacccagactaacgaaccaaaggctatagcgaagaacaaaggttaccatactatatcaagaaagaaatgaatcactcccagaaaagaagcgatcaaaaatcacgttgaaaaaggaagaaacatgaaagaaatgaaacggttgccccgagccacctaggaaagtcctagacgccggcgagtttttttcggtggagttaattgaaccgtctcgggatcgtccttgtttgtggcggtgcggcgtggtaagagagaacttgggctagcggatcaataacatgttgcctcgttatgttctgtgaaagagagccgcgatttgggcctccctctattttggcccatgagcaaataacccacccggcctctctctcacacacacttgcctaatccagccacccgactcctatcggttaccggcgacctcaccggcggctaaaaggatttgacttgcggccgccgccgcgcgtcttcgaccgtgctctcccaccccaatctccgggttgattactaccagagactaactcgaatcgtcgatgagcgctcgatcgatcccgtgacggagcggctcggttgctccaaagctccgttctacgccatgctcgccgccgccgccgccatggcggtgaccgtccctcgggcggcttctcattgttttccagcaaatacggccaggtacggcgggttgttcttgaaccagactttttttttccctcagggagatgtccctcgatgaaaattcgtctgtaattattatgtcacaggaaatgtaggacttgctggagctgtcgtgcggcaagagtcgaggctgggcactcccgattggaggtgcgcatttgcctattttcctggccttattttaattctgtttagagttggggtgctaccaattcgtaggaaccagtgacgcattcaggtatgctgagtttggtgtgactgagtgggctggtgtttatttatcttccagagattaccaagttgtggagtgtaggcgagctttggatctccagtttaaccaaatatccagccgtacacagatttgtattaattttacaacgaccttgggattttaaggataggtgtgccagttatattactc

SEQ ID NO: 6775 - DNA, 2134 bp, Zea mays
ctctctcacacacacttgcctaatccagccacccgactcctatcggttaccggcgacctcaccggcggctaaaaggatttgacttgcggccgccgccgcgcgtcttcgaccgtgctctcccaccccaatctccgggttgattactaccagagactaactcgaatcgtcgatgagcgctcgatcgatcccgtgacggagcggctcggttgctccaaagctccgttctacgccatgctcgccgccgccgccgccatggcggtgaccgtccctcgggcggcttctcattgttttccagcaaatacggccaggaaatgtaggacttgctggagctgtcgtgcggcaagagtcgaggctgggcactcccgattggaggtgagaaaagtcacctatcgacctcctggaactgaacagaacttgttgaatgaaattaacctctctcttcaggaaaaaagttttggtttgatatttggacggagtgggagtggaaagacaacccttttgcagctgttggctggtctatcagaacctacctctgggtctatttgcattcagaagtatgatgatactgggaatcctattggcttgcctgaactgctaacttctcaacgagttggaattgtatttcagtttcctgagaggtatttcttagcggatactgtacttgaagaagttacttttggatggcctaggcaaaaggcagacctcctattaaaagaacagctcgctttaaatcttcaaaatgcttttaactcggttggtctgacaaccatctcattagatgaaaatccgcaagctctaagtggtggatttaagaggcgacttgctttggcaattcaactggttcaaattcctgatctgttgctgcttgatgagccacttgctggtctagattggaaggctcgagctgatgttgtgaatctcctaaaggacctgaagaaacatcatactatactggttgtaagtcacgatctaagggaactatatccactagtggatcgctcatggcgaatggaaatggggggaagtttgaaggaggaagctttgcctgtctaaacatgtgcttgtcagtatagctgtcagacagcatgtacatattggtcatccaaatctagtcacatcaactacttttacaaacttagattatgtcggctgggaaatttcttcaagatacaatggagtcagagatggttgtgaacagtcatttggtaatgcgtggtaacttccgagcacgaaaaaatgctagaaaaaatcagcagagatcgtgaatgttagcacggagctttgactactgctggaacggggaacagtctgacgcagacattgttgagctaccatgaacgttgaacattccattgaagtttaggttcaggaatcaggatccagcgatagctccttgttgcaaacatgaggattgcagaaggcctgtacactttgaaaggtggggggtcaagtttcaaaatggtgcggatgatggtttggaaatggtttcctttgttgaagtttcccactggagagattcagagaacatcatttacttgcactatcgatagtctgcatcattcacaatttgctgttccttacgaactcatttgtctggattctggaagaatatgttgtgcacatgagtagattcttgtttcctccaaagatctttgacctgctgttatcaccacttctggcatgcgaggagcaatctcagtcatgcagttatgtatatgaatgtgcacctctgtttgaaacggtgagcaaattctctcccccttttgtgtccagtcattcattttgtgattagcacgatactctgcttcagcttcagcttgaccccagtcttcttatcttatgtactcactccgctcttttttatttgtcgcggtttagttcaaaaatgaactagtgggtgacaaatattcgagaacggaggtagtatatacaatattcacaaggcgtgctgtaaatatgtatccacttttacaaacgaagtaacctactgagagttacttgtgccacatagctacctacatcaatgtgtgcatgttcaaagcacgaaacttttctttgtcttctagactcctgttgtcgctttcagcttgctcatcttttttttccaaccattgtaaaccccacgtgttcaagt

SEQ ID NO: 6776 - DNA, 2689 bp, Zea mays
aattcggcacgagggaaaatccaaatttctgcaccaccgcggcggaaccaaccgtggcaggggacggccaagggcggtcgctgccttgcctggcgttgacagtttgatgcgaccgcgggagcgtccgcccgaccgccaccgcgtccgcctcagctcccctcgcttccctctaatttccagcccagtagtagggagactagaatcgtcggcgcgacgccttggcagattcgtccgccccgatcccaccaccaccgtgccccgcgggtgacgtcggaccggcggcgatggcaacgtcggcggcggcgggatcgcgcaggaaggcgccgagccctccgaagcaccgccacgacggtacctcgccgctgcctctcggcatggactggagccctcccccgaagagatgggagggaaggaacaccatatggccacacaaccctcaaacaggttggagttactgtgtgatgatgccttcttggatcacccaaacacctgaaactggtgtcacagccgatagctttttgaaatctgtcgttttttacaggatacatgttggtatacaatcttcagaaggctttagctctatccatggaatcctcagaaggtttagtgactttctgaagctatcttctgatcttaagagcgcgtttcccagaaaagatgtcccatcggctcctccgaagcatgctttcttaagaataaattcaagcaggttgcttctagaagagagaaggcatgcattggaggagtggatgcagaagttactttctgacattgacttgtcaagaagtgctcctgttgctgcttttcttgagcttgaagctgctgcgcgttcatatttccaagaacggaatgggcgtccttctgaagtaggtccttctgcaaaaagcagtactaaatcttcctcacattctgatggacctgcttccggttctcttgctgagtccaatgaaataaatcaaggtcttactcgcggtagcagtctgacaggagcaactggtaatggtgtgcttggagaagctatcttagatcagtctgatgagcatgttagcagtgccttgaatcacaggaaagggaaccttgtattggaacatgatggtagaaatggttcggtagcgtcttataggggagttctttcagaagaggaccgtgattcttatcccggccatgctcggaaggactctgctgaaagtattgggagtgatttgagttctttaagaggaagtgaattatctgttccaggggctagtaattccctttgggatggtgctgtggtggatggacatgttagtcaaacagaacatcttactggtttagatatgcatcttttgtatgatatggatgcgcaagtcatccttccaaatgataaaaaacagaagttgactagacttttgatcacaatgcaacgaagaatagggacagcaaaaactgatatggaggatctcatagcacgattaaatcaggaaggagctgttaaagaatatcttactacaaaggttaaagatttagaggttgaattggaagccacaaagcaaaaaggtagagagacactgcaacaagctatcctggctgaaagagagaggattacccagatgcagtgggatatggatgagctccgtaggaagtactctgagatggagtcaaacctgaagaccgaacataatgagaaaactcgtgcggagtcagaaagaacaactgctagtggtgaaaatgaaacattacttgaagaattagaaatcaaacaaaaagaagttgagagtttgaaacagcaacttgtagaagctgaggcaaagtccaaagctgataagaaagttcttgtcaaagaggtcaagtctcttagaaactcccaaactgagatgaagaaagtgttgaatcagtatcttgaggagaagactgatttagagagagttattaatagagagaaacagagatcagcacgtacaaagttatcccgagtaaaaattcttcatgagtgtcgactgctgcgggagcggctacaagaatgcagtgctaaatttctagcagaagaacaagacaactttactattgatccatcatccttgcctgatgcattagatcttctagcaacatcagacaatagaatacgcctactcgttgctgaggctcaacttctagcacgagatgatgaacaaggctcttctgatggtggcgacgattctgatagtagatcctcattaactatgagcagtgaagatgcaaaagttactgatgaagatactactaagatgctttctgatctgctcattgacagtgcgcagctgaggctacgcctcaatgctgtcatccgccatgctgtaaatacttccgtgaagccagagaaagaaggtagtggcgaggttctccccaaaaagacagtccttaactggttgttggacagatgagagaacaccaatgtatatttatgtggattagttcttcaaacttacgcggcttgaccaaaattatatgatgagcgtacctatagtgccagggtagcatcaggaattcaggataaaaccttccctccatggagggaaggggagcctggaagcctttgtttctgttgcacgattttttatccacgcatggaagtcacggaggatggtatattacgggccacggctttggctcctaaaaaatgactgtctggcttctcttccagaaactctataaaagctagtgtttttttccc

SEQ ID NO: 6777 - DNA, 2037 bp, Zea mays
gcacgagaccattacctagaacatcctaatcgaaaagccctggctggcgttgacagttagatgcgaccgcgggagcgtccgtccaaccgccaccgcgtctgcctcagctccgcgcctccgcctagcctcctctaatctccagcccagtagtggcagactagaatcgtgggcgcgacgcctcggctgattcgtccgccccgatcccaccaccaccgtactccgcgggcgacgtcggccgctagcgatggcgacgtcgtcgtcggcgggggcgcgcaagaaggcccccagccccccgaagcaccgccacgatggcacctcgccgctgccgctcggcatggactggagccctcccccgaagagatgggagggaaggaacaccatatggccacataatcctcaaacaggttggagttactgtgtgatgataccttcttggatcactcaaacacctgaaactggtgtgaccgctgatagctttttgaaatctgtcgttgacagttttacaggatacatgtcggtatacaatctccagaaggctttagctctagccatggaattctcagaaggtttagtgactttctgaatctattttctgatcttaagagcgcatttcccagaaaagatgccccgtcggctcctccgaagcatgctttcttaagaataaattcaagcaggttgcttctagaagagagaaggcatgcattggaggagtggatgcaaaagttactttctgacattgacttgtcaagaagtgctcctgttgctgctttttttgagcttgaagctgctgcacgttcatgttaaggatttggaggttgaattggaagccgcaaagcaaaagggtagagagacactgcaacaagctatcctgactgaaagagagaggattacccagatgcagtgggatatggatgagctccgtaggaagtattctgagatggagtcaaacctgaaggctgaacaaaatgagaaaactcgtgcagagtcagagaaaacaaccgctagtgataaaaatgaaacattacttgaagaattagaaatcaaacgaaaagaagtcgagactttgaaacatcatcttgtagaagctgaggcaaagtctaaagcagataagaaagttcttgtaaaagaggtcaagtctcttagaaactcccaaacagagatgaagaaagtgttgaatcagtatcttgaacagaagactggtttagagagagttattattagagataaacagaggtcagcacgtgcaaagttatgccgagtgaaatttcttcatgagtctcgactgctgcatgagcgtctactggaatgtagtgctaaatttctagcagaagaacaaggcaattttactattgatccttcgtccttgcctgatcattagatcttctagcaacatcagacaatagagtacgcttactcattgctgaggctcaacttttagcacgagatgatgaacaaggctcttctgatgatggcgacaattctgatagcatatcgtcattaactatgagctgggaagatgcaaaagttacagatgaagatgcaacgaaaatactttctgatctacttattgacaacgcgcagctgaggctgcgtcttaatgctgtcatccgcaacgctgtaaatactgccgtgaagccagagaaagaaggtagtggcgaggttcttcccaaaaagacagtccttaactggttgttagacagatgagaacacctatgtatattcctgtgatttaggtttcaaacttacgcggcttgaccaaaattatatgatgagcatacctatatagtgccagggcagcatcaggataaaagtttccggccatggggggaggagatcctggagaagcgtgtgttgctgctgtacggttgtttatttacacatggaaatctccgaggatagtatatttaggcccgtttggtttagtgttactaaactttagttatttttagtctctaaagaaacaaacagagtgatcgaaaggaggtgactaaagtttagtcatttagtcactaaatgggtgactaaagtaggattttt

SEQ ID NO: 6778 - DNA, 915 bp, Zea mays
cgcaaacgattaaaaccctcccgggccccccgggcccggccgggagcggaaggtcccggcgctctcatccggtgaaaataaagaggggaaacggacaggagccgcctcaaatggacagcggaagcgattccgacggcgctcccgaggagctcacggctgtgcagggtgttgcgaagcacgaagagatcagtaaagtcgagaaagacagtgttctcagagtaacacgggaaggaaaggaacggaggaaacgttgggcccaacgaagaacatcctctaaaccagataagaaggcgccaaaggaagtagaagatgaagatactaaaaaaagtgaggagcatgaggagacaaatactatgcctggcatgctccccactagtgtaattgaaattctagcagctcgtgagaagcaaaccttcgcatcagattccgaggaagaaaatgtaaagcagaaggtccagaggagaaagaagagaatgaaaactgatgggcctgaaactattctgctgaaagatgtccgttcaacgcaacacgtgaagaatgcccttgatttcttggagcataggaaaaatcgtgtcccaaggtcaaatgcagttttgaagaatgccagtaaggctttgcgtctcctgtcttcgaaaggtaattttctaagttaagcgtgtggtagaatagcacattttctgaatctgtgcttagaccatcctctcgacatcagacatggtcaagagacttaggaccaatgtgttggaatggaatctacctggcatgtgaaatgtaatgcagcatatccttttgtgtgaatgtgatgattagcacacatgttccttgtaagaaatccaaggtttgtaatcattgaatatatttgagtttgagttatctatttatatgtttgagttttggtcaaaaaaaaaaaaaaaa

SEQ ID NO: 6779 - DNA, 939 bp, Zea mays
tttggccggggttgtgtcaacgcttaaaaagtaaaaaccctccggcggcggcggggttcctgttcctccggtggaagctcccggcgctcaaatccggcgaaagaaaagaggggaaagaggcaggagccggctcaaatggacagcggaagcgattccgacggcgctcccgaggagctcaccgccgtccagggtgttgagaagcacgaagagatcagtcaagttgagaaggatagtgccatcagagtaacacgggaaggaaaggagaggaggaaacgctgggcccaacgaagaacatcctctaaaccagataagaaggcaccaaaggaagtagaagatgaaagtaccaaacaaagcgaggagacagatactatgcctggaatgctccccactagtgtaattgaaattatagcagctcgtgagaagcaaaccttcgcatcagattctgaggaagaaaatgtaaagcagaaggttcagaaaaggaacaagaggacgaaaactgctgggcccgaaactattctgctgaaagatgtccggtcaacacagcacgtgaagaacgcccttgatttcttggagcaaaggaaaaaacaggttccgagatcaaatgcagttttgaagaatgccagtaaggctttgcgtctcctgtcgtcaagaggtaattttctaagttaggcgtgtggtaggatagcgcagtttttctgaatttgtgtttagaccaccatctcaacagcagatatggtcgagatactttggaccgatgtatttgaatggaatcgatctggcacgtgagatgtgatgcagtatatcctttggtgtggaagtgtgatgattagcacacgtgtgagttttagttatctatttttgtggatttgcgctgcaaatttctgaagaaaactctgaaagatctccaaattttgatagccatgtggcacttcttgtatc

SEQ ID NO: 6780 - DNA, 1549 bp, Zea mays
aacgacgacttcttccctgccgcctcctcacctgacccgagcagtgaccaacagggggcggacgacagccggcctcccgcagccgcggccagaagcccacggcggagggggagcccacggcgaagagggagaagtccgtggagacgtacgcgatggggctggtcagcaacgtccgcgacggcgtgatggcttctgctgcctgttcctcggctgccgacgcgctctggcgccgttggaagacttctccttcctcacgcgtccaagctcgagctccagtggcggtgccggcgatctagagtgggagcaactggcgcgttagaggaccttgtcaacaccgctgggatgaaattgataatctgaatacaccaagggtaattttctgatttactgcataattgtactcggctgcctgttcctcggctgccgacgcgctctggcgccgttggaagacttctccttcctcacgcgtccaagctcgagctccagtggcggtgccggcggtaggaaaggccaaccctagctccgtatacctatactatattgaatattttggtgtgtctcttacacatcaccaccccacactcactatatttcaccactttacaagtatacccttacacttgttctatttacacaaataggtatgtcacctatagaaaaaacataactatgttttattaacatgcacagatctagagtgggagcaactgcgcgttagaggaccttgtcaacaccgctgggatgaaattgataatctgaatacaccaagggaagagagggatccagaatctttttgtactttcaaagagcgtttgtgttatttacagaaaacagagcatggtagagtatgctttggtagatcagggattcataggtggggtctttttgctcggagagacattcaagaaggagaaatggtccttgagtatcgcggtgagctggtcagatgaagtgtagctgacttacgggaagaaaaataccgtgtgcaaggcgaggattgctatcttttcaagatcagtgaggaagtggttgttgatgccacagacaaaggaaacatggcacgactgatcaatcattcttgcacaccaaactgctatgcgaggattatgagtgttggacatgatgaaagtcgtattgttctaatagccaagaaaaatgtttgtgctggtgatgagctaacgtatgactacctgtttgatccagatgagggtgatgaacgcgaagtgccatgcctttgccagactgctaactgccggaaattcatgaattagtttacttagatgttagaggatcactgacagtctttctttcttatttacccccgtttttggtatatattgatccttccctattttttgtttacattcattttagaataagtttagttagagctcaaaagtcgagcttccattcctgttaataccacagttgtattcactacggccagttcattctttaaataaatttttttgtaccatgtttagcttgatcatgcacgttagcaggcattgacatgtccatattctttaatatacttctgtatcaaaaa

SEQ ID NO: 6781 - DNA, 1498 bp, Zea mays
tgctcggaattcggctcgagccgggatggtttgggtgtggggggtagcaagactttacttcatgggtttgtcgggcttgtgaaaaacctgagcaaaagagggagtgctgtctttgccctgtaaaaggtggtgctttgaagccaacaaatgttgataacttgtgggttcacgtgacatgtgcatggtttcagtcacaggttgcttttgctagtgatgagctcatggaacctgctattgggatattgaacattcaacctttgttatttatgaagatgtgtgtgatttgtaagcaaatacatggttcatgtactcaatgctacaggtgctctacttactaccatgccatttgtgcatcaagggcaggctatcgaatggagcttcactgcttggaaaaaaatggcagacagacaacaaagaagatttcttactgtgcccaacatcggagccctaaccctgataatgttttgataattcaaactcctgctgggactttctcatcaaaaaagcttgttcatagcaatggcaaggtagctgcatcgaggctgatcaggaaagatattcccttggatttgccatcagaagttaaaatttcagagaacttatcagcggcgagatgtcgggtttatgttaggaaagatctaaagagatctagagagggaacaattgtacatcatgttagaggaccttgtcaacaccgctgggaagaaattgataatctgaatccaccaagggaagagagggatccagaatctttttgtactttcaaggagcgtttgtgttacttacagaaaacagagcatggtagagtatgctttggtagatcaggaattcataggtggggactttttgctcggagggacattcaagaaggagaaatggtccttgagtatcgtggtgagcaggtcagacgaagtgtagctgatttacgtgaagaaaaatatcgtgtgcagggcaaagattgctatcttttcaaaatcagcgaggaagtggttgttgatgccacagacaaaggaaacgtggcacgactgatcaatcattcctgcacaccaaactgctatgcaaggattatgagtgttggacatgatgaaagtcgtattgttctaatagcgaagaaaaaagtttgcgctggtgatgagctaacgtatgactacctgttcgatccagacgaggccgatgaacgcaaagtgccatgcctttgtcagactgctaactgccggaagttcatgaattagttcgcttagatgtcagaggatcactgatataattttttcccccttatttacccccgggttttctccctctcgatgattcatttcctggtatatgttagagctcaatttttgcttacattcgtttttagaataagtatagttagagctctcaaaaagtggagcttccattcctgtaaataccacagctgtaatcactagggacagttcatttttcaaataaaacatttttgtgctaaaaaaagaaaaaaagggcggcagggggggcc

SEQ ID NO: 6782 - DNA, 2417 bp, Zea mays
cgcctccgggttggccgcgagccgggaaagcgaccgcccctcctcttctcctccctttctctcgtctcgtcggctcctagctcctcctcctcgctcgccaagggagacgcacccggtccattcgtcctctcctcctatcgcctccccctctcctccccggagatccccgctaccgaaggattatcccgtgcagaggcccactagtatatcagcttggagttgaggagaatggctgttggtgggactcaaccagtccttaggaagtacctaggcgccctcaaggacacgacgactgtgagcttggcaaaagtgaacagtgattataaggaattggacattgcaatcgtcaaggccacaaaccatgttgagcgcccatcgaaggagaagtacataagagaaattttccattccatttctgctgctaggccacgggcagatgtagcctattgcattcatgcccttgctagacgtctttcgaagacgcgcaactgggcggttgcgctcaagacattgattgtcattcatcgcgcccttcgggaagttgatcccacttttcgtgaagagcttattagttatggcagatctaggtcccatatgttgaacatggcctactttaaggatgactctagtgcagaagcttgggattattctgcatgggtgcgcatttatgctttatatttagaggagaggctcgaatgtttccgagtgttgaagtatgatgtagaaacagatcctccgagaactaaggatcttgatactgttgctttgcttgatcatctaccatcattgcagcaactccttttccgtcttcttgcttgccagccacaaggagcgtcgtcttacaatgttataatccagcatgcactctcaatggttgctttagagagtattaagatctacactgcgattagtgatggaacaatcaatctagttgacaagttcttcgagatgcaaagaaatgatgctgttagggcacttgatgtatacaaaagagcaactaaccaggctgaacgactttcagagttttatgaagtgtgcaaaactatacacattgggcgtggtgagaaattcctgaaaatcgagcagcctccagcatcattcctgaataccatggaggagtatgttagagatgctccaacaggtcaaaaagagaaggctatactagcgatagaatacaaaaaagagccagaggaggaagaaaaaccgtcctcacctcctgcggctccagaaccagaaccggaacaagtgcctgagccagaacccgagccagtgaaagaggaagcaccagaagctgaaccagatttgctgggtctgaacgaacccaaccctgctgcaactgcgatagaagagcagaatgctttggcgctagccattgttccgatagatgatgctccgaaagctgctcccacttttggaaatggagtcactggctgggaactggcccttgtgacagcaccaagttcaaatgagaccgccgttgccccaagcaagaaactggccggtggtctggacttgctgacccttgacagcctgtacgacgaggcgaaccggagagcgagccagccagcaagctacaacccctgggaggcgacccccgccgcgcctgccccgatgatgaccatggcgccggtgatgcacgacccgttctacgcctcgaacgggtacgctgcgccgcacggcgtgcagatggcggcgatggcgcagcagcagcaggccttcatgctgcagcagcagcagatgatgacgatggccccggcgcagccggtggtccaccacccgatgcagatgcagcagaaccccgcgaacccgttcggcaaccccttcgcggccgccggcatgccgctccacgccgggcccggcaacgtgtacacggggctgatctgatccggtccggcggtcgatttcttggtctgcattagcgctgctgttaccacatcattcattcttttttgcccaagttttcttgttgccattgtgagaaggaaatttgtagcacagacacagacacaggtagagtgtattatagcgtcggtcggagtgtatagcaagcagggggtcgtcatcagtggtatcccgtacgtagaaggtgattgcatgtatattatacacacagagtttggtcacctgttcatgtgcagttgagagtccattcttgcggcgaggagacgcggcacggcgctacgtcgagattgagattggattattcttagtgaacataacactggatacggttgaataatgcagcagctattctttttagcagatgacactgttcgatgggcccctacggcccggttgagatcgacattgatacgaccgtccgtgtgcgcacccagagcgctcgcgatcaccgatcactcaaccaactgcccgccggcaccacctcccatgtcccacccacgatgagatcctctgca

SEQ ID NO: 6783 - DNA, 494 bp, Zea mays
gcggccgccggcgcgcatccctacggcgccgctggcatgccgctccacgccgggcccggcaacgtctaccggccgcccgcccgggcaggtaccccacgcggccacgcccggtggccagtttcttggttgcgttagcgctactgttgccccaccattcattctttttgtccaagttttcttggtgccattgtgagaaggaaatttgtagcacagacaggaaggccggtagaggcggtcacggttggttatttataaatagcagcgtcgggtggggggtgttagcaagcaggaggcggtcagtggtgtcctgtacctcggccgcgaccacgctaatattatacacatagagtttggccacttgttcgtgtgcacatgagagtcgattctcgtggcggcgagactcgtcacgacggcccgtcgagattgagattggattattcttggtgaacatacgctggatacggttgaataatacaggcattcttttttttagc

SEQ ID NO: 6784 - DNA, 2210 bp, Zea mays
ccggccgggagcctccgggttggccgagccaggaaagctaccgctcctcctcttcttctcctccctccctggctccctccctccctctcgtctcctcgccaagaacgcactgagtccattcctcctcttcccctcctatcgcctctctctgcccctctcctccccggagattcctgctcctcccgactcccaagggttatcctattcactctgcctgctgccaaggccaactaggatatcaactaggaggagttgaggaggaatggctgttggcggaactcaaccggtcctcaggaagtacctaggtgccctcaaggacacaacgactgtgagcctggcaaaagtgaacagtgattataaggaattggatattgcaattgtcaaggccacaaaccatgttgagcgtccatcaaaggagaagtacataagagaaattttccattccatttctgctgctaggccacgggcagatgtagcttattgcattcatgcccttgctagacgtctttcgaagacgcgcaattgggcggttgcgccaaagacattgatcgtcattcatcgtgcccttcgggaagttgatcccacttttcgtgaagagcttcttaattatggcagatctaggtcacatatgttgaacatggcctactttaaggatgactctagtgcagaagcttgggactattctgcatgggtgcgcatttatgctttatatttagaggagagactcgaatgtttccgagtgttgaagtatgatgtagaaacagattcctccgaggactaaggatcttgatactgttgatttgcttgatcatctgccacaattgcagcaactcctttttcgtcttcttgcttgccagccacaaggagcgtcatcttacaatgttataatccagcatgcactctcaatggttgctttagagagtgttaagatctacactgcaattagcgatggaacaatcaatctagttgacaagttcttcgagatgcaaaggaatgatgctgttagggcacttgatgtatacaaaagagcaactaaccaggctgaacgactttcagaatttcatgaagtgtgtaaaactatacacattgggcgtggtgagaaattcctgaaaatcgagcagcctccagcatcattcctgcagactatggaggactatgttagagatgctccaacaggtcaaaaacaaaagactatactagcgatagaatacaaaaaagagccagaggaggaagaaaaaccggcctcccctcctcctgctccagaacaggaaccggaacaagagcctgagccagaacccgaaccagtgaaagaggaagcaccagaagccgagccggacttgctgggtctgaacgaaccgagccctgctgcgaccgcgatagaagagcagaatgctttggcgctagcaattgtcccgatagatgatgttccgggagctgctcctacttttgagaacggagtcacaggctgggaactggccctggtgacagcaccgagttcgaccgagaccgccgttgccccaagcaagaaactggccggtggtctggacttgctgacccttgatagcctgtacgacgaggcgaaccggagagcgagccagccggcgagctacaacccctgggatgcaaccgcgtctgccccgatgatgaccaccatggcgccggcgatgcacgatccgttctacgcctcgaacgggtacgcggcgccgcacggcgtgcagatggcggcgatggctcaccaccagcagcagcagcaggttttcatgctgcagcagcagatgatggcgccggcgccggcggtccaccacccgatgcagatgcagcagaaccccgcgaaccctttcggcaaccccttcgcggccgccgccgccgctccctacggcgccgccggcatgccgctccacgccgggcccggcaacgtctacacggggctgatctgatctagtaccccacgcggccacgcccggtggccagtttcttggttgcgttagcgctactgttgccccaccattcattctttttgtccaagttttcttggtgccattgtgagaaggaaatttgtagcacagacaggcaggcaggcaggtagaggcggtcacggttggttatttataaatagcagcgtcgggtggtgtcctgtacgtacgaggtgagtgcatgcatattatacaacatagagtttggccataaaaaaaaaaaacaaccccgcggtc

SEQ ID NO: 6785 - DNA, 870 bp, Zea mays
atttccagctcgacaagttggacttgttacagtccggtccgtggcggcccctgacccccctcccctttccatcggaggaggacgagagatccgtcctgcggtgtgcgatggactcccccagctgccggctgttcggtgcccagagatcgccgcacgatctcctcggcggcggcgccgttgcggatgtggtgctgtggaggaagaaggaggtggccaccgggacgctggcggccgtggtggcctcatgggcgctcttctactgcgtgcccggctacactctgctctccttcctggcccaggtgctcatgatcctgctcaccgtcctcttcgtctgggccaaggctgcgcagctgctcaacagggcacctccgcctatcccattgatgaaaatttctgacgagtcaatgagtgaagcagcagaaatggttggtagcttcatcaacaaggtgctcaaggatttcgaaaacattgcacttgggaaggataacagcctcttctacaaggtggcttttgtgctgttgctggcctccatagttggacgactgaccgatcttatcactttagtatatacaagtgctattattgctctcacggtccctgcattgctggagaaatccgaagaacacattgccagattcttcaagaaaacttcgatatatgttcaggcatttggcagagcatgcaaagagtataaatgtaagatgacgaatatgatatcggaaacgaagaaactgcgttgatgtcaatgtgtattcactagcaaattttgacttgtgagattgcttcttcggaagcgaaatagttgtgacttttggcatcaatcacaatcgtgatcttaccatcatcacaatcgtctagccttcgagctgg

SEQ ID NO: 6786 - DNA, 919 bp, Zea mays
  misc_feature (589)..(590): n is a, c, g, or t
  misc_feature (910)..(910): n is a, c, g, or t
acacagcgcaacattttgccaagatccaagagatttctctgtgttttcacgcacaaggatcgtgccccggccagccccagctggtagcgttgcttctcgatcttgcgattgttagctagcttgcaaggtcaaggacgggccggcgatggtgaacctggtggaggcgcagaaaccgctgctgcacttcctggtcaggagggccgggctgcggcagcacgccgtcgacgtcgatggcgccggcacggtgatgaccttctgggtgcccaaggacaaggttcccaaggagaagggcaccgtgcaggacatcacgggctccggtccagctacggccgaggccgccgccagcaaggtaccggccgctccggcggcggcgaaggagggcagcagcagcagcagcaggcccgccgtggtgctcgtgcatggcttcgccgccgagggcatcgtaacctggcagttccaggtcggcgtgctggcgaagcagtacgacgtgtacgtgccggacctgctcttcttcgggggctcgacgacgccgtcgacggaccggtccccggggttccaggcggagtgcctggcggccgcgctgcggaannctgggcgtgggggcgtgcacggtggtggggttcagctacggcgggatggtgtcgttcaagatggcggaggcgcacccggacctggtccggtcgctggtggtgtcggggtccgtggtggccatgaccgactccctcagcgaggcgacgctggaggggatcggcgtgaagtcgtcggccgagctgctgctgccggagtccgtcaaggggctcaaggcgctgctctccgtcgctacctaccggaagctctggttccccgaccgcctccacagggactacctcgaggtgatgttcaccaaccgcaaggagagaggcgagctgcnggaggtttg

SEQ ID NO: 6787 - DNA, 5724 bp, Zea mays
  misc_feature (5242)..(5242): n is a, c, g, or t
ctgtaaaggacggatatagagtatatagagaacgttgctggagacagtcttatccagcttgggctcgggtatcccgtatttctgtcgcgtactaccgtactcgcgtcctcattaaaaaaatcttcaggaaaaaaagagaaaatcttcaatatctgcctgctcctcgtctccacctggaccgctggacctcacgccaccggcaaacatgctgatttctccaagacttgcagcaccggccccctcccggccctccccctccccctctctccccaccaccacgcccacacgtccaggtatccgcggtcggaggcgaagcggtttcgacgcaccggtcgacgcggcatcccttcgccacggcgaccgtacccgcccggcgctccgcttcacataccccgcaccctccgcctctgtcacgactaccagctcaccggagcccatcgattgccgattggacagcgatgagctcggacggctgtaccgagaacacaaccctgaggccgccgttagcttactcgacgaaatgctccaacgaggcagcgccgaacaactcgagccggaggaacaggccgcactcctccaggcctgcgccgacacgcggtcgctgccctcgctcaggcgcgcccaccgcctgctcacttccacgtcggggtccgcgattcccgcgcccgtcctgcacaggatcgccacgctgtacctcaagctcggcgcccgcggcgacgcgcggcgggtcctcgaggagcgtacaaggcggcgtccggcgagggaggacgacgcggcggtccaggccaagcggcgagaggcgtacactaaggtgcgggagctccacgcgcagatccgtgcggcagggtacgtgccggacacgcgctacgtgctccacgacatcgacgaggacgccaaggcccgcgcgctcatgtaccacagcgagcgcctggccatcgccttcgggctggtgagcacgccgcccgggacgccgctccgcgtcatgaagaacctccgcatctgcggcgactgccacaacgccgtcaagctcattgccaaggtcgccggccgcgagatcgtcgtcagggacaacaagcgcttccaccatttcaaggacggcgcctgctcctgcggagactactggtgaggaagccttcacagctagcacgcacaaaggttacattatccataaaatgtttgtaaattcgtaacacttgttagtggcgagagaaggatcaaagaattggttgagccaacttgtagaagcattggccagcaacatcaccgacttccaagtacgatttgtgcgctgcaactgcaaactgcaaatatgcaattgaatgatcgaacatggaaaaggacacaataactgcgcaggccgcaggggaaactcagggaatttttcacaaatccaaggaaagaatcaagagaacagaacaatgaactcgaagctaggatgtgcaatggctaagaactcaggggctctgctcaatgcgtggccggcgagtccgtgccaccaccgtccgctgctgcgactggcagacctgcgccgggaacttgcacccgaaccgcttcgtcactatcgcgccccacctcccatccgccggcggcacagacggcgctcccctatccaccggtgccccgcctcgccggtccatcttgtcgatggctttcctcatgctcgtgcactcgcgctcgagctcctgcacgcggttccgcatgctgtccatgtcgagccgcagcatctggttgccccgtgccgccacgcgccatgtaccgccgccgtcgctctcaccgccttcctcccctgacccggctgcgccgccttcgttcgccatgatcgtctgagcgatggcccggcgcagctggagctgctcgaagaagagcacctgcacgaccgtccgcagcggcagccgttcgttctgcgccgcgtgcgtgcaggcctccagcgtgagcttccgcccgtccaccacgccgctcaccttctccttctcttcttcactcagacccggatgagcctgcagagagacgagccaaaacaaaacaagcattcatcactcgtcagcaccggcattgtttcacaagctagcgagccagaagataacaagaacgcgctgctccctcgccttgaggtagatgtcgacagctcggtaaaggccatcatcgtacacgcgggcgccgtccggcaacgcccaggcgaggtcgcagaatttgtccggcttcaggttggcatctgtcgcgatctcccccaagtaggcatccaccaatctccccacggacagcatggctcgtcggctagcctctctgcctggcgtctccgcctcgctgccctcctcttcgttgccctcgtcagcgacgtcacgaccttcgaggaaataccgcacgatgcgctcgacgccgtccacgtcgtagagcgtctccacgaggtacgagtagctcgggatgagcaggtcatcgacggccgcgtcgggcagccgcgcggcgatgcgccgctcaagcatgtcccgtgacgcctccgacgcgtggaggatgctcgccgtgcgcaggagaccgaagaggacgcgcgccgtggtggcgcccacggccgtgccggtgtgggcggtgctcttgatggtttcctctgggaggttggcaatgacggtctcgagaagcgccttctgctcctccacatcggacgaaggcggcgcagcggcagtgcccccgccgccgccgacatgcctgccggtgcgcgacagcccggggatggaccgcttagcgtacgcaatgagagccccctcaatgacctcagggccgacgccgcgctccttcatggcggcaatgacacgggtgaacgtggccaaggacaggccagcgaggtcgtcggaccaggtggccccggcggcggcggcggcgttcttgcggcgctggcgttcgccggccctgtcgtcgtcggcgatgggccagccgaagagtgccgtgggcgttgacgcggcggccttggcggcgactgcgtccacgcagcgcgacacgaggccgaggtcgtcggcgagggggagcaggccctcgcaggacttgagggcgcggatggcatccctggggttcctcagcacggtctgcgatatgaaccggtcggcgcgggagacgaggttgtcgtccgagtggtcgtcagacatgccgaggcgctcggcggcgcagcgcagcggcgcggccgtggccggcgtgaggtcgagcttcacgccgtagcagaacttggcggccagctcgaacgcctccgcgccgccggggaactccaggaggtggatgcggtgcacgcccgcctcctcgtcctcctccagcacaaggtccgcttcctcctctctgatctcccccacatcctcttcttgctctgctcctctgcctctccggctggcctcgcgcgactccttgttcgtaatgaggtcgtgaagcttcttgctcctcgacattaacgggaactgcacgaaaggcaccggattcagcaaacttttgggatcaaatcaaagagtgccgaaatttccccgcttttgacagctcgagactaggaaatggggccacaccaacgaactcacggcagagacattgacagcatatggagatggggtagagattgagttgttcaaaaaaaaaagaattgaagaactggaggcaagattcaccaaccttgtggagatgaaaggtcatgtctcccacctcgatcactacatcgctgggcaatcctgtggtgcagaacctgacgagcacagacttgcagatgagagatcacgcagcaacaaatcgccacacaggcaaaaggacacgggagcaattgctttgcttaccatgcttggcctttggagctggccgccgacgccgccgccgctgccaccggcggcggttgcggatgctcccgagccatctcccgtgtgttcttcctcctcccctgcatcatggaacgatcctctccctcaggaaccgcaccagacaggcatttcttgggaggagcaggcgagcagcaggaccgtggcccgtgggagtcagggaaggggaagctcgctgcactcgcaataatggtgtccgacctatcccggtgttttgttttaggtggggaggagtaaaggattcctccaacttccaagtgggggaagacgaagacaagatggcgtttttggttttttttgaacgctgttgggcttgcctcaaaagcacctatcctccatcaccatcagccctttgtttatccaccccctccgtccgtactcgctttcccccttgtttaactaaccactggtttagtacagttcctccctgtaagatcatctctaatgatcctggcttgctgcgggaccaattcacgcgtttggtgtgccctgacctggccaaatccgtgaaaatgttccaaacatctcatgcaaaccatcgattcaaaacagctgatctcgcggcctcgccagtcgccaccagtcttgcctgtgtgcctgcaggccggcataataaatgaggaggcgtgatgcggtcatgaatgccggaggtggctgtcgctgcctttcatgtccatggtgcccaccgccgccgcgcatgagatgagagaggacatgtctacaggaggggatcacaaaggcaacagctctggaaggtgagccccagatctccgtctcccgcctgaaaaaaacgaggggcttctgtgccgctaccagcaggcactcgtgcctgtggacgctggtggcatgcgtgtcaggctagtgcgtgggcgtgccgcgtgccctgcggctcctggtgatgggcctgtgcgcctggccgtggcccgtggcatggcaggtacacagtgttggaaaacttaaaaggtacatactccatcaaaggtagaactatatataaataaatatatactcccacgtaacaaaaaagatattattatagatctatttacgccttcatcttttacgtgtttttatagtattatctaataagtgaaaccggctctccatatctcctcacgtcactacttttttcgtgaaggttagaatatcatatcagggatccgacgtgtattagtttttaacatattattagcatgctctaccacaaactcagatctaactaacatagtgacatcaactctccatcacgcctaaagacgacaatgggtacaaaatacctctatggccataaacaatagacccgatggataaggatacatgtgtgtggatctgctcgtgggcactgacgtgggtacatctaacctcactgctatcaactagcgcgagagggaaatgttatacgtgcaccnacaaatacgacatgcccgctccatcccccacccatttccgcttccatacaccctcgtcggtatctagaggcattttgttcgttgccatatatagtcacattgttaggatctaggtcttgttgaactattctacacaacatgctttattgtttttgaatcatcaacaacaattgactatgatatagattgattgtgacgattttacataatctagtacaatgaatggcttgcactataatgaccttatagtaagaaaattatgtttgttgttttctcgtgtgattcttatgatgtttagatttattatagaacttcgtattgttgctctttacttttgagatgcaaaatgtcagcctattacccaacattgttgctgcaagacgttacccaacattgttgctgcaagacgttactgtcgttgcttgccaatgcactagttacaatatgtcatcccaccgcatgcccaagggcaccaccgccgc

SEQ ID NO: 6788 - DNA, 1755 bp, Zea mays
  misc_feature (1748)..(1748): n is a, c, g, or t
gatcttctgagtcgacctgcagtgcacacgtttacccgccgctgcggcggcttcacaaccacgtttggcgctttgctacgtaactaggagaggcggacccaagattttcaacttgggcattcgaaatctaaatctctactacttattaagttagcaatagtagactgccttttttgtgttctgccgtgtagtctctgacaggtagggcccgcttgctcctgcgtgcatgctcccggtttattccataacatatttttttacaaaaaatagaactactgcacatgtcacgtgcacaggaagacacatacaccgtgtgataacaatcgtactactatatgcacaggaagacatataagcaggtttcaacaccaatcggtgggcaatgtggtattaattttaccttgcaaaaaaatgaagacagccacatactacgccgtgtgaggcccatctgccgatttctgttctgcgaggcccatctgccgatttgtgttctgcgaggcccatctccatgaaaccctagccccgcccgcggcatccagccctgcgcggctgcgcccccgcccgcttgctcgcctccagccgcggtcgcggcctccagtgcccagcgccaccgccgccgccgacatgcctgccagtgcgcgacagcctggggatggctcgcttagcgtacgcaatgagagccccctcaatgacctcagggccgacgccgcgctccttcatgacgccgcgctccaaggacaggccagcgaggtcgtcggaccaggtggcccccgcggcggtggcggcgttcttggcggcgctggcgttcgccggccctgtcgtcgtcggcgatgggccagccgaagagtgccgtgggcgtggacgcggcggccttggcggcgactgcgtccacgcagcgcgacacgaggccgaggtcgtcggcgagggggagcaggccctcgcaggacttgagggcgcggatggcatccctggggttcctcagcacggtctgcgatatgaaccggtcggcgcgggagacgaggttgtcgtccgagtggtcgtcagacatgccgaggcgctcggcggcgcagcgcagcggcgcggccgtggccggcgtgaggtcgagcttcacgccgtagcagaacttggcggccagctcgaacgcctccgcgccgccggggaactccaggaggcggatgcggtgcacgtccgcctcctcgtcctcctccagcacaaggtccgcttcctcctctctgatctcccccacatcctcttcttgctctgctcctctgcctctccggctggcctcgcgcgactccttgttcgtaatgaggtcgtgaagcttcttgctcctcgacattaacgggaacttgtggagatgaaaggtcatgtctcccacctcgatcactacatcgctgggcaatcctgtggtgcagaaccatgcttggcctttggagctggccgccgacgccgccgccgctgccaccggcggcggttgcggatgctcccgagccatctcccgtgtgttcttcctcctcccctgcatcatggaacgatcgtctccctcaggaaccgcaccaggcaggcatttcttgggaggagcaggcgagcagcaggaccgtggcccgtgggagtcagggaaggggaagctcgctgcactcgcaataatggtgtccgacctatcccggtgttttgttttaggtggggaggagtaaaggattcctccaacttccaagtgggggaagacgaagacaagatgccggtttttncccggcc

SEQ ID NO: 6789 - DNA, 3317 bp, Zea mays
  misc_feature (398)..(398): n is a, c, g, or t
cactagacgtagggtgctaacctaaactagtataaaccccctcgagtcacacgattcaccattcggagcgagtccgtgctagcctcccccgcggaacacaaattttaatgtgtccccagtttccgaaaccacgacactatggtcttcctgctttttaattatgtacatgagaccatgggtttttagagttttggtgaagaaaggcaccatgcaactataaagaatcaacttgagacatttttgcttcttgtaagaagagtgtatgactctattagttgccatgatctcgaaagtttagctattaaaatggttaaagttgaaagacatgtagcattttcattggtctaccgcctcatcgagtcttactagtgacaataacatatgtagagagagcattntcagctaggaatataatcaagaccgttttgtgcaataagataggcgatggatggctcaattactcgatgatttgctataccgagagagtggtatttagatgacttgatgaaacaattatgaagcgatcccaagctataacgaaaaaaaaatcaaaggatgcaattgaccaaatctcatagtcaaatgtagcatcgtttataagatacgtcaccagattttttttaatttagcgatgtccgtatggacatatttcatcatgctcgttatatatgtaagatttaaattttgagagcttcatcataggtaatttaaatcctagatcggtcgctggcacatgagtcatttaataggtggatgttatatgtaaaattgatgttctaaaaataacgctattgtaatatcttatcatcgtggcattattttttcaatgtaacgcatgagtatttatcaagtaatggaaaaagatatacagagagagatcaagcgataaaagtagagaaaagtaggtaacataaacctttactacggcctcatgtcgagaaacgaagtccattagaccacgcagccacggccaagttggctggccgctgccgtgcatttgaaaatgataatcgacttaagatccgctaataatggattaagaaatgggcccagtaatcattccggcccacgcgcagctgccgtcgccgcgaccacatctcccaaatcccaatccatggcggatggctaatgggtcagcgccgctacccaagatacccatgcgccaccataaagcccggcgcctgtgtcgtgtgagggagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgaagatggtgtcccaccccaacatcgtggagctgcacgaggtgatggccacccgctccaagatctacctcgcgctcgagctcgtccgcggcggggagctcttctcccgcatcgcgcgcgcggggcgggtccgggaggacgtggcgcgctgttacttccggcagctcgtcgccgcggtcgacttctgccacggccgcggggtgttccaccgagacctgaagctcgagaacctgctcctcgacgaggtaggcaacctcaaagtggcggactttgggctcagcgcgctcgccgggcacgcgcgctccgacgggctgctccataccgcctgtggcacgccgtcatacgtcgcccccgaggtgctcggcgggaagggctacgacggcgccaaggcggacctctggtcctgtggcgtcatcctctacgtgctcctcgttggcagcttgccattccacgaggacaacctcatggtcatgtaccggaagatgcagcgcggcgagttcctctgcccgccgtgggtctcagcggacgcccggaagctcatcggcgagctgctcgaccccgacccgagcacgcgcatcaccgtcgctcgcctcgtcgagacgccgtggtaccggaagccgttgcccgtcctgccgccgctcaacctcaaggagccaaccccggacgcgcgccgcgccacctctgacaaggaagagcccgaggtgctgaacgcgttccacctcatctctttctcggagggcttcgacctgtccccgctcttcgaccagggccgtggcggcggcgtagggaggtctagcgcgggcggcatccgtttcgtgacgcgcgaggccgccagcagcgtggtctcccgtctggagtcgctggtcaccggccgcggagccaacatgcgcgtgacaaagagcggctcgcggggcgttcgtttggaggccgtgtcgcgcgggcgctcgggggcgcggctggcagtggccgcggagatcttcagcgtggcgccgtcggtgctcctggtggacgtgaagaaggacggcggcgacacgatggagtaccggtcgttctgtagcgaggagctccggccggcgctcaaggacatcgtctgggcctccagccaggacacaccgggcgccgcttgatgtcgtcgctgtcgctcctgccaccattattgtccttgcccatcaattgctgttggtgtccgtgtagggggggtcgtgctcgtgcattattgtttggtgacgaagtgatgtttgtttgtcgtttgccactctcgtagttggtttctgctgtggtgcagcggctgctggcagttgcagttgggctgttgcccgcggggcgcgagcaaagcagaatcagcgggaactagcattcgtatcctgcatgcacgcccataccgtgtcagctctgaagtgggaagaactgtaacaagtagtagtacgaatgtaccagggtgatgtgctttcgagtcacttgtgtatatattcatttttttatcaaaaaaaaaaaaaaaaaaacccggaggctgctgggttgtggagtaatgtccacaattacatcttcatatgtatatagaaaaaaaatgcttataaaaataattagacaaactagattatccctcattaaagtatctagcctaaacaatatccatctcatcttaaaagattctatcc

SEQ ID NO: 6790 - DNA, 871 bp, Zea mays
cattgggtaccctcgaggccggccggggtcgccacccaaaagccaccgcgatcccgtgcttccttctcgcacctgcggatctactctccgcacctgcggatctaccccccggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagactcgtccatccttccttcctcctgttagtggtcgtagggtagtttgcactttgcagatagctagctagtagttaggggatcaggcatgggtgagggcgaggcggaggtgaagggcggggtgctgcagggccgctacgagctcggccgcgtgctgggtcacggcaacttcgggcgcgtccacgcggcgcgggacctgcgcaccgggcgggccgtggcggtgaaggtgctcgacaaggacaagatgctgcgcacgggcatgatggagcagatcaagcgcgagatcgccgtcatgaagcgcgtgtcccaccccaacatcgtggagctccacgaggtgatggccacgcgctccaagatctacctcgcgctggagctcgtccgcggaggggagctcttcgcgcggatcgtgcgcgccgggcgcgtcaaggaggacgtggcgcggcgctacttccggcagctcatccacgccgtggacttctgccacgcgcggggcgtgtaccaccgcgacctgaagctcgagaacctcctcctggacgacgcggggaaccctcaggtcgtcgactttggcctcagcgcgctgggccgacacgcgcgcagcgacgggctgctgcacacgctctgcggcacgcccgg

SEQ ID NO: 6791 - DNA, 1284 bp, Zea mays
aaataaagagttaaaaatagggaccctcgcggccggcctcgccggcggacaacaaacaagcaggagagaagaatcagtgatctgtgctgtgagtacctgacctcttccagacagcctctgaaatccccttcgacccttcctgctccagcgggagcgcaccagcaatgtcgtcggcggggccaccgccgccgctgccgccgtggagcaggctggaggggcaggtggtgctggtgacgggcgcttcctccggcatcggacgcgacttctgcctcgacctggcgcgcgccggctgccgcgtcgtcgccgccgcccgccgcgccgatcgtctccgctcgctctgcgacgagatcaacccctccgctgcctcccgagccccccgcgcggtggctgtggaggtcgacgtcgccgccggtggttcggccctggaggcggcggtgcagaaggcctgggacgcctttggccgtatcgacgccttggtcaacaacgccggcatacgaggtgcagtgcattctccattagattggcccgaggatgagtgggacagaatcatcaagacgaaccttaccggatcatggctcgtggccaaacatgtctgtcgacgcatgcgtgatgccaagctgaagggttcagtggttaacatcacctctattgctggccttaaccgtgggcatctgcctggctccacgggatacgcatcctcaaaggctgctgtgcattatgccaccaagattatggctttggaattgggcgcggatcgcatcagagtgaactcgattgcacctggactcttcaaatcagagataactgctcctctgtttcaaaagaggtggttgagcaccgttgcttcaaagatagtgccgcttaaggagcatggcgctactgatcctgcattgacgtcgctggtccgttttctgatccatgaagcatcgtcgtatgtgactggcaacatcttcattgtagactcaggtgccaccatacctggtgttccgatattctcatccctgtaatccccccccttaaggtttagttcattgtaccttagtttcatatggttgcataaagcagacagttaaagactccatggaggaagcactgctggctgtatagttcattcccgacaatattccatcatttttgctgtccactattgttttaatgtattttctccagagacgcgtagtttggtacttgtatagaatgacaatctttaagatactcctttattgtctatcttttcaaaacaccaatcaggatgaataaattgcctaaaagtgtcatttaagc

SEQ ID NO: 6792 - DNA, 1674 bp, Zea mays
atgggaaatgttgtcgtcagatcaacctgaatctgaggctgaatttgtagattctactgaacaattcatgatattgctatccactgaagcagcttctaccaagactacctctaaatcatttcgacttcgcggtcaacttcaaggcattgatgtgctgattttattagactctggtagctcccattgcttcctgagtgctaatcatacttctgccttgtccgggttggcgcgtctggacactcccttatccgttaccgtggctaatggtgaagttgtgcaatgtacagtggagctgccacaagctagctggtatatccatggtctggaattctgctgttccttcaaagttatccctctgccatattatgacgtcatattaggcatggattggctggagatgtttagcccaatgacagttgactggaaacataaatggctatcattaccacattcaggttccacagtggtgttacaaggttgccagccattggttcctgcaggcactatactggagatctggccggttacggtaacggaacctgcatcagcccagctgcgttctattgaggagttgtccttgcctgctccagttgtgcagctgctccgcaattacgagagcctgttccagccacccgcgacgttgccgcccagtcggttctgtgaccattctatcccccttattgaaggtgccagaccagtcagcatccgaccctatcggttctctccagcaatgaaggatgaaatagaatctcaagtggctgaaatgttgcagaccgggctcattcagcatagcaccagtgccttttcttcacctgtgcttctggtcaaaaagaaagacaactcatggtgtttttgtgttgattacagacaccttaacgctctaacagttaagtccaagtacccggtgccaatcatcgatgagatgttggatgagttgtttggcgcttcttggttttccatcctggaccttcaagccgggttccaccagattctattgaaacaaggagaggctcacaaaactgcatttcaaacccacatgggccactacgagtttcgggttatggcatttggcctgactggggccccaggtactttccagaaagccatgaaccatactttgtcaccattattgaggaagtgtgcattggtgttctttgacgacatcctggtgtacagtggatccctggatggccatatcaatcatttacaacaagtatttcaattactagctcaagatatgtggaaagtcaaactctccaagtgcaagtttgcccaacagcaagtgtcttatttggggcatgtggttagtgctcaaggagtatccaccgacccaatgaaaatctaggctattgccacttggccagagccctcctgtctcaaagagctacgtagttttttgggcctagcaggttattatcgcaaatttatcaggcattttggagtaatctgccagccgctcacagcactcctgaaaaaaggggctctatttgtttggaccagtgaccatgctgtcgcattccgtacattgcaaactgcactttctcagtcaccagtgttgccaacttttttggattttagccttttttgagttttttttgcacaactatgccctttacagtttcatttcaaaaaatggacctcaacctcggcgccatcatcattggcgccgaggta

SEQ ID NO: 6793 - DNA, 2353 bp, Zea mays
gggagagatgcaggcattcctgactggtactctgtgtccgaaaccaaaactggtggcggtccgacctcaccaaatgttgctacaaaggaaagtgcagcattatgtattgaagacattgagatactccatggggaccttcaaggattaacagatacagtggactttttgaagagcttatctgaacttaatggaaatggtttgaagagccctaagaagcaagacctagagagaactgctgcatctgttctttttgactgggagacagaaatatatgtagcaagggcacctggacgtttggacgtcatgggtggcattgctgattattcagggagtcttgttttgcagatgcctcttcgggaagcttgccatgttgctgttcagagaaaccatcccagcaagcagaagctttggaaacatacaaaagcaagacagcttgttaacggaggcttggtacctgtgatacaaattgtatcatttggttctgatttgagtaaccgtgcaccaactttcgatatggacctgtcagattttatggatgatggtaaaccaatatcctatgagaaagccagggagcttttctgtcaggatccatcccaaaaatgggctgcctatgttgctggaacaattctagttttgatgactgaacttggtgcccagttcactgacagcattagcattctggtttcatctgccgtgccagaaggaaaaggtgtttcatcttctgcatcagtggaggttgctacaatgtctgctatcgccgcagcctatggtttaaacatcataccaagggatcttgctttgctttgtcagaaggttgagaatcatgtagttggagctccttgtggagtaatggatcaaatggcatctgcgtgtggagaagctaacaaactccttgcgatggtttgccagcctgccgaagtgaaggaattggttagcatacctactcatatacggttctggggtctagattcagggatacggcatagtgttggcgggggagattatggatctgtgagggtaggcacttacatgggacgaaagatgatcaagtgtacagcatcagatttagtttcagaatccttgacttcagggtcccctgctcagtctgattgttataaagaaaatggtgtgggcgtactgaaatctgaagctgcactggagtatttgtgcaacctaccacctcacagatatgaagctgtttatgcaaaagacattccagaggtgattagtggagaagcattttcagagaaatatggagatcacgatgacacagtgacagttattgatcctaaaagatcttacagtgtgaaggctcctactagacatcccatatatgagaacttccgtgtcgaggccttcaaaacgttattagaggcaggtaatacagacgagcagctgtcagcccttggagaacttatgtaccagtgccacaacagctacagcgcatgtgacctcggttctgatgggactgacagactagtcaacctggtacgagaagtgcaacacaggaggacatccgaaggcggaagccctagtctgtttggcgcaaagatcaccggcggaggctccggcggcacagtatgtgttgttgggaagaactgcgccaggagcagtgaagagattgcagagattcagcacagatacaaggctgagaccgggtatctgcccattcttttcgacgggtcgtctccaggagctgggaagtttggttacctgaagatccgacgtcgttgtccctagtggctgattgggaaacgaagaacttcagttcgagctttgtcacatatcactcaattgttaagaacctcactccaactctccaagccattgtagaacatagaggcgtattgccacttgcgatgattcgtcgttcacacacaaaatattatcatgtgctacaccaattctggaagctactagaggaaaatgtgaggaatataaagaaactcttgttgagcagatgtagtctagtggtctccgtgtgcttgctgcagtgtaaccaaactccaagtagatgtgctctgggctctggcatgtggtatgtgatgaagtcgaggatggtttcttgccgtttgatgaccagtgtagtcgttggttaacttgtcagtcgtaaactgatgttgtcagttaggagcggataaagtttgtgtgtgttgtcagtgtatctgtgtgtaagtttattggacagaccgaaagatacaccacgaacccagatgaagtaggtaatagtcgtatgtgaagtttttatcattagggttgcgaatgcattacctccctgataaatatatgatgattataaacttccatggataccgcgggattctccccaagagctcaatttattcaaaaataa

SEQ ID NO: 6794 - DNA, 6996 bp, Zea mays
  misc_feature (2035)..(2035): n is a, c, g, or t
  misc_feature (6904)..(6904): n is a, c, g, or t
attagcttgaaatcaaactattcctgtactcaattgtattatagcatttgcatttatgcaaaaccaaatgcttaaggtaccattgagataaaaatgtaatactggacttccgtcataatactaatctttgaaaccaaattatctgtatcctatgaaagttatattatttgtggatcgataggctaatactttgtccgttcaggtggtttcccagattctccaggacactgctattggaaacaaatgtatttctgataaagtaagtgattatgcatgatcgttgaatggtcagcatatttccatacctaccatttctgcctacataactttgttctcatcctgaagttttatagcttttgtgactgatatgaaaaaggaaatgctaatgaaagatctttatcttcttttgaaaattaccactttgaaagctttatatgctttgtgccaagtaaaaccagtatatattaaacatggaaagcccatagaaaaatggaagcaatatatttagaatcctgcttaagatggtaaaatatgagccaacctggctatctttaattgtaggctagtggtgcaagaagattgcaagatgccatggtctcaggatatgtacttcaaagggttcctgggagagatgcaggcattcctgactggtactctgtgtccgaaaccaaaactggtggcggtccgacctcacaaaatgttgctacaaaggaaagtgcagcattgtgagtaccttctcttgttattgtcagacatctcaagttttgcagtgaaatattttgcaactggaattgcatatttgatttcacagatgtattgaagacattgagatactccatggggaccttcaaggattaacagatacagtggactttttgaagagcttatctgaacttaatggaaatgatttgaagagccctaagaagcaagacctagagagaactgctgcatctgttctttttgactgggaggtactaatctagcagtcctctatttcattttagtgaactgtaaccctgtgcattaatgtttcatgtatcatatttggaatgtaggatatctaggtttcatgagtttgaattatgagatgattccttacaatttcaagtagaccaactttcttatgctgtaaagttttatttccaacagctaatctatttgtcctattatagcttttgggtatgaataaacatatggtagctcattttgttgttttgacaagacatatgtgtttccaattaacaagacaatgtaccatgttaggcttcaaccttttatcataaagcacaatatagtggagttctaataagagaagatggattacacagatcctcatgcttcaatttgtatcaaaaaatctattgtataaagttcagaaccattttgttttcaatgaacatttttatttcaccagtctcttttttccttgattcacctctattttttcttgtatttttcatggatacatgtagcttcagttctgataactgattacttgatttgtttcggtagcttgtttctatgtacttgaataactgaaataagtcactcaaaatggtgaataaatgattggtgtgctataatgatttcccttattgttcctttgtagacagaaatatatgtagcaagggcacctggacgtttggacgtcatgggtggcattgctgattattcagggagtcttgttttgcaggtatgttcaatctcaggccaaatagatttctgttacaaagtagtgctataagtttagctaatagctggatactctactcataaatatttgattatatgtgattcccatctttctcgaaatcagtttgctactgttcaatatgtaatggtatagcatgcaagaacctggattttcattgaatcctgatgtctactgtattttctgtattcttgatttcttttttggattccctcagatgacacaagtaaataaataaataaactggaaagaaacatagctgcagttcttttatcatgtatttggcagttgtgattcatattttggatgtaactactagatgcntcttcgggaagcttgccatgttgctgttcagagaaaccatcccagcaagcagaagctttggaaacatacaaaagcaagacagcttgttaacggaggcttggtacctgtgatacaaattgtatgtttgacttgttcaaataattcagatgctttgtcatttattctaaattttttgccacttccatttacttttgagttatccacttgctggggcatgtaggtgctccatattatatgcatgataatagtgtttttgttggctaatttagcgtaatggttaaggcttccgagtaccacctccagatcgtgggttcgatcccctcggggcgaatttcggaattggttaaaaaaaattactagaatcctgggttcgatcccgttgcagagtggacaattgatcggcccattagtgatggagggccagggttcaggggttttctcagccgggaccatgtttcggtctcttcttaatataataccgggagggcggtctttccctcccgaccgagttttttttactttataatcacattttgccaagtagttgttcttttgatctggctattttgcatagcatttgtatggactttcatgacttgtcaatgcttaccatctattatgaacatgattatcgcacaggtatcatttggttctgatttgagtaaccgtgcaccaacttttgatatggacctgtcagattttatggatgatggtaaaccaatatcctatgagaaagccagggagcttttctgtcaggatccatcccaaaagtatgaaaacaagtttttattccagtacaaaatttcaactactgaatatgtttgcatatttgcgatctcaactatcctatctcagatgggctgcctatgttgctggaacaattctagttttgatgactgaacttggtgcccagttcactgacagcattagcattctggtatcaccaagttttcattatcctgcaaatgcgtatgtaaaaacctgtaatcacttaatcagttccttatcttctttccgctctaaaactccaggtttcatctgccgtgccagaaggaaaaggtgtttcatcttctgcatcagtggaggttgctacaatgtctgctatcgccgcagcctatggtttgtagagtggcgttggctatttagcctatcctgaaccctgagacatgtcatctctaagtagcatcgttgatggtttcctttttacttgtctataggtttaaacatcataccaagggatcttgctttgctttgtcagaaggtattatgtttcactgaaatgtggttgtagaatacagatttacaacttttatggctctaatgtttttcaggttgagaatcatgtagttggagctccttgtggagtaatggatcaaatggcatctgcgtgtggagaagctaacaaactccttgcgatggtttgccaggttagtggtgtttattagttccggattacagaagctgatagatcataccttcctccagtcaaaaaaaaaaaacaacgttacttcagtattttatttaatcagttctcctgcagcctgccgaagtgaaggaattggttagcatacctactcatatacggttctggggtctagattcagggatacggcataggtaggaagccttcctaactgagcttgtgttgtggcgattgtagacattacctgtcttattggaaaaattggagctaattgcagaattaatttctgttgatttgttagtgttggcgggggagattatggatctgtgagggtaggcacttacatgggacgaaagatgatcaagtgtacagcatcagatttagtttcagaatccttgacttcagggtcccctgctcagtctgattgttataaagaaaatggtgtgggcgtactgaaatctgaagctgcactggagtatttgtgcaacctaccacctcacaggtcacgtttagcaaattcaacatttatgtttatggttctgatactgcatgaatcacaataaaatcccaatttcagatatgaagctgtttatgcaaaagacattccagaggtgattagtggagaagcattttcagagaaatatggagatcacgatgacacagtgacagttattgatcctaaaagatcttacagtgtgaaggctcctactagacatcccatatatgagaacttccgtgtcgaggttaaatctctcgaccagattatttgtttctacagtaccaaatctattttctgaatatgaaaagcaattgtggtgggaaccatttcaaagtttttgttttttttcctgaaacatgctgcatgcctgcagcaatagcgttgatatggtgtgctcttagtgctatccaaagtggcagaacattgcaaactacccccaagaaactaaaatctgcaactaatggtcccacaaagagtgtcattctcacttcctgagaagtgaaacattttcgactttgacgaagcatatacaagaaactattaatattaatatttatggcgcataataagttgcattaaatgaatcgttgaatatattttcataataagcttatatggagatacaaatgttgctaatattttctatgaacttgatcaaagctacgaaagtttgacctacacaaaaccctaggcgactttctttttgggacagagggagtatttcattgttctctctcttgacatccttttaacttctggtctgtaggccttcaaaacgttattagaggcaggtaatacagacgagcagctgtcagcccttggagaacttatgtaccaggtgaattaatttgggtctctggctctctgctcatcatgatgtatctttctctactcttattgcacaacaaggttcactgtgcaaacattaagttgaggaaattgtgctttgctggtattaacattcttctctttgtactgctacttgcatacctttgacgtgtttgatgtttctctttgattcacatgtttctggcagtgccacaacagctacagcgcatgtggcctcggttctgatgggactgacagactagtcaacctggtacgagaagtgcaacacaggaggacatccgaaggcggaagccctagtctgtttggcgcaaagatcaccggcggaggctccggcggcacagtatgtgttgttgggaagaactgcgccaggagcagtgaagagattgcagaggtagctccacggactagcctttgttcatttggtgtttgggttttatcacgatgacagagaccgataattacctgcacttccagattcagcacagatacaaggctgagaccgggtatctgcccattcttttcgacgggtcgtctccaggagctgggaagtttggttacctgaagatccgacgtcgttgtccctagtggctgattgggaaacgaagaacttcagttcgagctttgtcacatatcactcaattgttaagaacctcactccaactctccaagccattgtagaacatagaggcgtattgccacttgcgatgattcgtcgttcacacacaaaatattatcatgtgctacaccaattctggaagctactagaggaaaatgtgaggaatataaagaaactcttgttgagcagatgtagtctagtggtctccgtgtgcttgctgcagtgtaaccaaactccaagtagatgtgctctgggctctggcatgtggtatgtgatgaagtcgaggatggtttcttgccgtttgatgaccagtgtagtcgttggttaacttgtcagtcgtaaactgatgttgtcagttaggagcggataaagtttgtgtgtgttgtcagtgtatctgtgtgtaagtttattggacagaccgaaagatacaccacgaacccagatgaagtaggtaatagtcgtatgtgaagtttttatcattagggttgcaaatgcattaaatcacttataaatatatgatgattataaacttcctctgcatttatttcctccattctttttttatttaccgtgttttttagttttaaaacgagtggacagaatattcaagaaccgggaacgggaggcagttcatcgtgtgcaaaagttaccgtgaaagaagatactcaacttatacatgtacattcgtgcgtgccgggctgacacggcacgaacacagttaagtacgacaatgttgtgtgccgggcacaacatgatgttggttctgtgttatgtcagcccgcgagcttagcacctggcgcaagcacggcacaaaaataggataatcgggtcgtatcgtgcctatggcccgatcagcccacagagccgggctggtctgaagcatgcaaaagaaaaaaaatcaaatctaactattgcatttcacaattcacacagttaatactttaagtgtcaaactcaaggtaacaagcaggaatagaagctaagtatagcagttcacatggtcacaattcaaagtgatgaaatactcaatcacaaaagagctcagagacaaaagttgatgcaaacaatatattaatggagccttagtgcaatgctgcctcattataaacatttctaggtaaacactcacacctcgtgagaaaaccataagaaggaaaagagtacaaccagctcctataggtttaatgtaagtccagagtttaatagttcatcacaagttataacagagtagtaatagcaacagaattaagaagcaataggacaaatgcaacaaccctcgggcctcaactgctcataatctacccacagttccactagttccacttccaccagatcctccaccagtttctagtttcttgtaggtacattgcttcaaaaacaccttctagttctttggtgtctttctccacatttatgcaggacataacttcaaccatatcaggagttagccgtcgcccgccggtcttcaagcaccttgccagntaaactaaaagtggactctgatgatacagtggaagcaggcacatttagaacatctttagcaagtatagaaagcacatgatagtcaacaaggg

SEQ ID NO: 6795 - DNA, 2154 bp, Zea mays
ggagcttcctcggcacggaaaaaagagataaggaagaaaagtcgtggtattcaagttgatcattggatcacttgaaaggggttgagtgcaaccctcgtccgttgggacgccacaacgtggaagtaggcaagtgttacttggccgaaccacgagataaaatcgcgtgtctcttgtgattgttccttctttgattgtctgtgttcgcaagagctcgtcgcattgacttgattaacctgcactaatatttttataatcaaggttgttggaatttagcgttgaattctacaggatcacatattcacctcctctaggtgctctcaagattagctcacataatataattgaagcttttgatttggtctgtccccgtagagcaaatttaaattaatacaaataaaatcatataagtctctccttctctaaatttatcgtatatacaaaattattttgattgttattgaaaattaatatacaattatatgatgcaagtttctttaattagcttattatctatactatataaaaatcagtatacacatgttttatatatcatatggtacttttttcatattatagtattgatgaatttttcgcccctctatgtcatactcctggcttcaccctagtctactacgtcaatttttttcagtaaatgcatcgcaaaatgattttgcatttttggtgtcctaaatcttaatatatattcttagacaaatagagttaaacagatgttaaacatagatttgacttaagataaaaatagattttagaaaatacagaacagccccagtattctgcattgctaaaaaacactccgtgaaacaatgtggaccgcaaaaagttccttcaaaatcctgccatctgatgctatttttggggccaaactccatcaccaaccaaacacaaccactcccctgtacggcgggggggctcctcgacgccggccggggtcgagggaatacgaacgtcgtacgagaacctttctccctcctccacctttctccttttcttgccacggcaaaacaccttcgccggcgagagcatggcgatggcgtaccgtgtcctggaggtcaccctggtgtcggcaaatgacctcaagaaagtgtcgctcttctcccggactcgcatctacgccgtggcttccatctccggattcgacctccgcatcccttcccacagcacccaagcagaccacagcaacggctgcaacccctgctggaacgccgtggtacacttccccatcccggctgccgctgacacccgcggcctcgcactccacgtgaggctccgcgcccagcgtctatacctgggcgatcgcgacatcggcgaggtgtttgtgcccatcgacgacctcctggccggcgccgacaagggtggcgatccgaggcccgtgagctaccaggtgcgcaggccgcactctggccgcgcccacggcgtcctctacttctgctataagttcaccgaggtccccgccgtctcttgtgtctcggaaccggaaagcaaacaagtccagtacgccaagaagtacgtgcaggactccaagaacacgacggacaagactatggtgccgcccaccgtgtacccaccgccgcaggccatggcgtccgcatacccgccgcaacaatattgttcgccgtacgcggcgtacccgcggcagccttacgggtaccctgctccgccaccgtacgggtacaatgctgcttccccacaaccggcgatgtacaactacgcagcacagccggtagctgcaccggcgaggcatggcggaggtatggggatggggctcggcctagggctcctaggcggtgcggtcggggggatgatgctcggagaggcgatcggtgactatgagaccgacgccgcttatgatgccgggttcaacgatgcattggcattttagatctatgttgtcgtgcagtcatggagattattgtccttgtaaatctctaattaatacgaaacgatgaaatagaatttgcattttgtaaaaaaaaaaaaaaaaaaaaaaaaaaaaaggcaaaccaacctagaatataggttttggtaaaaaatactcagacaacttataatttaattgattatacaaatataatcatcttatatatcggatctctgctagcagtggtggagccggcctgtaattgaaccctagac

SEQ ID NO: 6796 - DNA, 687 bp, Zea mays
aaacagcccagtgtattcctctgcctccacccacatggcgctccaggcgcagcagcagcccaccccgtcgccgacgcgcgacagggtgggcagcggcgagtggctggccgacacggagaagctccccggcgccgccgcgtccccggaggacgtcgtcgtcgcctccacgcaccacgccgccgccgccgccaggtactcggaggccgtcaacgtcgtcggcttcctgtactcggtgttccagttcgtcgcgctcgccgagctcatgaggaggaacacgcatttgattccccatcccaagcgtggtctcttcgacttcaccatggatcaggtgctagcataccttctgatatcgtcatcgtcatcagcaactgctcgagcaagtgatttgactgagaactgggggagcgattccttcccgaacatggcgaacggctccattgccatatctttcgtggcatttgttgtttttgccatctgctccctcatctccgcatacaatctgttccgccgtgacatttagctgatcctgacaacttcatttctgaacaaagttttcggtgcaggcttcatgtgtataaatgtgatgggaactctgaacttctagcgatgatgtatctacatgtcaaatggcaactcacttgtgtggtaaatgaaattcagaagttctcgcgaaaaaaaaaaaaaaaa

SEQ ID NO: 6797 - DNA, 2343 bp, Zea mays
cctcgaggccggccgggactcacctttgctacgctggagagcggatcaatggcgctcactctcctccgcctcgggacagcatttctggtgctcctcctcttctcttgtgccgcagaggcgggcgaggttggtgtgaactatggaatggtggcgaacgacctgccgaaccctgcgtcggtggtgcagctgctcaagcagaacggcatcaccatggtgaagatatatgacgccaacgcaaccgtgctgacgtcgctggccaacacgggcatcaaggcgatggtgatgatgcccaaccagaacctggcccacgcggccagggacgcggtgtacgcggcgcagtgggtgcaggacaacgtgaacaagtacttacccaggacgcagatcaacgccgtcgccgtcgggaacgaggtgttcgacgacccgaacgtggacaagatgaccctcgtccccgccatggacaacgtgcagaaggcgctggcgaagctgggcctcgccaacgccgtcaaggtgtccaccccgatcgccttctcggccgtcagggattcgttcccgccgtccggctccaggttccgggacgacatcgcgcagccggtgatgaagcccatgctgcagctcctgcagcggaccggctcgttcctcaccgtcaacatctacccgtgcttgacccagatgcagcagccggacgacatccccctggactacgccctggggaacgcccagcacgccgtgctcgacggcagcaacaagtactacagcctcctggacgcccagctcgacgccacgcactacgccatggaggccctcgggttcggcaacgtggaggccgttctcggggagaccgggtgccccaacaaagggaagataggaaagcacagaccaccccggcgtggcgtcggaagcagcaggcgccgtctgttggatgacggaggctcagagcctgaggcctcggtcgccaacgcccgagcgtacaacaactacgtcatcaaccgcgtgctgtccggcaacacgggcaccccgcaccgccctcgcgccgacatgcacgtctacatcttcgcgctcttcaacgagaacaacaagagcgccgatccggacgacgtggagaacaacttcggcttgttctaccccaacatgcagaagatctacgacttcaacttccgcggcggcggcggcggcggcggccaaccgccggcaggcccggcggcggcgagctggtgcgtggcgaacgcggccgtcggggacgacaggctgcagcaggcgctggactacgcgtgcggccacggggcggactgcagcgccatccagcccagcgggtcgtgcttcgagccggacaccaagctcgcgcacgcctcgtatgcgttcgacagctactacctgcggaacggccgggccaccagcgcgtgcgatttcagcggcgcggcctccatcgtctaccaggcaccagccgtcacttgcagcagcgcgaagccaagctggtgcgtcgccaagccaggggccgggggcgcacagctgcagcaggcgctggactacgcgtgcggccacggcgcggactgcagcgccatccagtccggcggctcctgcttccagcccgacaccgtggccgcgcacgcctcgtacgcgttcaacagctactaccagcggaacggccgggctagagtggcgtgcgacttctccggcgccggctctattgtttaccagcaacccagcttctgcgccgcgacggcaagctggtgcgtggcgaacccgggtgtcggggacgcgcggctgcaaacggcgctggactacgcgtgcggccatggcgcggactgccgcgccatccagcccgggggagcgtgcttccagccggacaacaaggcctcccatgcctcgtacgcgttcaacggctactaccagcgcaacaaccgggctagagtggcgtgcgacttctccggcgccggctctattgtttaccagcaacccaaggtgggaaactgtgtgcttccatcgaacgccggctgatcaactcgagaaacaaaactacatcacatttagcttgcttgaggcgacgatatgaagatgctaacatatatctcgatcagtatttctgggatgggaataaattttccatcgttctgcgtggcaaactattatctaataaattattaataaaatcctgcgcctgcaaatcgactgtgccgggtgctccctcccctcaaatctttgcaatagtacgtgtaataccacatgtcaacgtgttgtcttcactgctaataatgcatgctattggtacttctgtacaatctcttgatgaaaaataatatgaaataacctttaagtctctagaaaaaaaaaaaaacaccccgcccc

SEQ ID NO: 6798 - DNA, 733 bp, Zea mays
attcggctcgaggtggtggggcgtggtggagcgggagggccccggccgctacgactgggaggcctacgccgagctcgtgcgcatggtggagcgagccggcctccgactccaggccgtcatgtccttccaccagtgcggtggcaacgtcggcgacacctgcaacatcccgttgccgccatgggtgctggaggagatgagcagcaacccggacatcgtgtacacggacaggtccggccgccggaaccccgagtacatctccctcggctgcgacacgctgccggtgcttaagggccggacccccatccaggtctacaccgactacatgcgcagcttccgcgagagattccgtgactacctcggcaatgtcatcgcggagatccaagtgggcatgggtccttgtggagagctgaggtatccttcataccctgaggccaacggaacctggcgtttcccgggcatcggcgagttccaatgctatgataacggcattgtaggtggatgctcatgcctgtgcgtgcacacagacacatgcgccgtgctgttgtataacgtgcaccggagaaggggaactgtatgtatagattcagggccttgcaggttgcagagttttataggctgtaatcgagcaggtcggtaaggaggcaggcatgtcagaacttaggctgtcttcagttcatttgtcccatttggaactgtattgttataagtctaatctctgtagagagaattctat

SEQ ID NO: 6799 - DNA, 1112 bp, Zea mays
  misc_feature (911)..(912): n is a, c, g, or t
ggcacgacccgcttttcatttgctggtttcttgtacgcaaggacttggtatgtctgggtcggcaagcaatcagagcactatacccgaaagagaacagacagagagacgcccctatcacaggaattgaagggagaattgtgcctgatcatcattttgcaaacgtctaatcaagatcacaaattcatcccgttgccgccatgggtgctggaggagatgagcagcaacccggacatcgtgtacacggacaggtccggccgccggaaccccgagtacatctccctcggctgcgacacgctgccggtgcttaagggccggacccccatccaggtctacaccgactacatgcgcagcttccgcgagagattccgtgactacctcggcaatgtcatcgcggagatccaagtgggcatgggtccttgtggagagctgaggtatccttcataccctgaggccaacggaacctggcgtttcccgggcatcggcgagttccaatgctatgataagtacatgcgggcatcgctggaagctgcggcggtggcggcgggtcaccaggagtgggggaggggcggaccccatgacgccggggagtacaagcagatgcccgacgacacgggcttcttccggcgcgagggcacttggagcaccgagtacgggcatttcttcctggcgtggtattcaggcatgctgctggagcacggcgaccgcgtccttgccgcggccgaggccgtgttcggcggcacgggcgcaacgctctccgccaaggtcgccggcatccactggcactaccggacccggtcccatgcggcggagctcacggcagggtactacaacacgcgggaccgcgacgggtacgcgccgatcgcgcgcatgctggccaagcgcggcgccgtgctcaacttcacatgcatggnnagatgaaggacgagcagcagccgaaacacgccagctgctccccggagctgcttgtgcagcaggtcaagaccgcggccagcgccgccggggtggagctcgccggcgagaacgcgctggagcggtacgacgaggcggcgttctcgcaggtggcgtcgacagcgcgcggcgccggcctggccgcgttcacgtacctgcgcatg

SEQ ID NO: 6800 - DNA, 3281 bp, Zea mays
gtccgttgtcatccctactaatatggtagcattattttccgtagtatgcatgccaatgtgtgcatggatagtgatgcaggacaggtgtcaggcagggacaatcagctgcagcctgatgggacaaattaaataaaatgatttggataagatcaccagcggcgtctgtcagccgcagcgggcaacggaacggacagacgggtagataagctgacgcaatgatcagtctccaactagatcgcgtccatttgattatagtcctaatcctagtcgttaataatttgattagggataagcgcccgtgccatccatcgccgtcgctccccggctccaccggcaactctctataaatacagcgcccccccccctgcccggcgctctcaattccccactcatatagtcatatttgctcagccttttgcaaacgagttgaaatcaccttgttcaaatcgtcccctcctctctctctctcgctcgctcgccaagcacaatcttctgcgcgttcgtcttgcggatttgttaattggttggtcagctcctctctgacccagaggcaaagccatggctctcacgctgcgttcctcgacgtcgttcctgtcgcctgtggaccccacgtccaagctcctccacaagcccgccgacgaggcgcagccctgctgcgtcgccgtaccccctgcgcccggccgcaggccgcgcgcgctcagggcggccgcggccgctgcgacctcaccggcgacgggccgcgcgccggcggaggcgggcgagctgctgcacggcggcggcgcggaccagcaccacgggctgccgcgcggcggggtgccggtatacgtgatgctgccgctggacacggtggggccaggcggccagctgtcgcggcagcgcgcgttggcggccagtctgatggcgctgcggggcgccggggtggagggcgtcatggtggacgtgtggtggggcgtggtggagcgggagggccccggccgctacgactgggaggcctacgccgagctcgtgcgcatggtggagcgagccggcctccgactccaggccgtcatgtccttccaccagtgcggtggcaacgtcggcgacacctgcaagtaagcatctccgttccatgaatcaccttgtctgggttatctggtagctgtagcaatcacgctgtttattttgccactagatttgttttgagctgaactattgatgcttgagctgaacacttagaggtgtctggtttaataaattcgtctctgtcatttagtttccatctctataattagttttataattaaaatatacttcatcggtttttttttttttgcagtttagttcaaaaataactagttgtttgttgcggtttagttcaaaaataactagtagatgataaatattcaataacagagataatatttaatatctataattgttattgaaatatttgatgttacactttagctaggtggaatcaaacactcaccttcaaaggcgtctaatctaatctaaaagaatgagggctcctttggttcataggattttcaaaggaaaaatgtaggaaccatgaatcctttggaattagcactgtagagccgtttggttcgtaggaaacaacctgacgaaaatctttggaaattttcctatcctccaacttctataggaaaaccataggaaagaaacaatccactctgacctcttttttttctgcagctcgcataggatcgaggcaaacagctggttatttagtccgtgctgagcaagcaacaacaataaaaaatagcactttgtaaatcaatacatacgtaagctatgatgagttacattaactacatagtatactctaagcattcctatgtttgtcctgtgtcatccaaacgtctctttagggatttttcctttggttttgaatcctctgtttttcatatcaattcctttcctattcctatgtttttcctattcctatgattttggattcctgtgttccaaaggagcccttaaagcataaagcactgtactaactgcataaaaacttagcaatcatgcagaatgcatctttaatgagagcaacaagaagtgttatgccatgatcccatatatgttcttggttcagtgtcagtgtcttcattgataacgcaagaactggtagtacaaatacaggtgtagttgtggcgctaaagcatcgctgcgttcaagcaatgcatttcaaacatgcccttacaatggaatattgctgtgaaagatctcgatttgatggctggaattgttcgctcgctagggttgaaacaagggactgaattgaagaattgcgctatccaaaccaccgacgccgcttgcccgtttgccacaggaagcgatggaatccaaagcagagcgccagagccttcaagaatctgtaaagcattacggcccatgggcctgtttacccgccgggagtgtcggctcccaagcaggctcaatggaccaaggtcgtcgtggactacttcgttggcccttctttcgcctgatctcgcatgtgcaggagagtccagaaatggcgttatgttctctcgattcttattctgacgtactgcagatacatgcgcaagtgcagtatggaagctagaactctctgtcttcttctttctgaatccaaggagaactgaaactctgaaaccaccgggcgtatgcttcagtttgacgatccacatcgagtgtctgcgggaaggaacttctgcatctgcaccagtcctctgtgaaacagtttttttcacacaacacgtgtgccaccgacaaaaggtggtggtgcagtgcaggttggagcacacgaatctaccagtcctcgccattcttcacctaaccctagacaggagtattaacaaacaccgtcatcctaactcacccactagtagtagcgttctcaccttttctctcgccgagattaggatgcagctgttccacgcgagttcttcgtcaaacagaatatcatgggagcgatatataacgcgccatactgaactcgtgatttgaaaccttgatttgatccagcacccggcccggctacgatccaagcacgcaccctctcctctctcttttttccctgcatcgatctggggccagagattcagaggcacggctgtctgaactgactggtgtgaggtctcacccgacgggcacaccagaccagaataatggagctggtcagactgcctgccctggcgccgctccgctccatccacggccgcgccaaggttgcctttgcttgcattcacgggaaggccgatcgacgctcgctttacttactgctgcaaccacctggc

SEQ ID NO: 6801 - DNA, 3049 bp, Zea mays
  misc_feature (1128)..(1128): n is a, c, g, or t
  misc_feature (1135)..(1135): n is a, c, g, or t
  misc_feature (1195)..(1195): n is a, c, g, or t
gttcaaaataactagtagatgataaatattcaataacagagataatatttaatatctataattgttattgaaatatttgatgttacactttagctaggtggaatcaaacactcaccttcaaaggcgtctaatctaatctaaaagaatgagggctcctttggttcataggattttcaaaggaaaaatgtaggaaccatgaatcctttggaattagcactgtagagccgtttggttcgtaggaaacaacctgacgaaaatctttggaaattttcctatcctccaacttctataggaaaaccataggaaagaaacaatccactctgacctcttttttttctgcagctcgcataggatcgaggcaaacagctggttatttagtccgtgctgagcaagcaacaacaataaaaaataacactttgtaaatcaatacatacgtaagctatgatgagttacattaactacatagtatactctaagcattcctatgtttgtcctgtgtcatccaaacgtctctttagggatttttcctttggttttgaatcctctgtttttcatatcaattcctttcctattcctatgtttttcctattcctatgattttggattcctgtgttccaaaggagccctgaagctcaaacaggggtgggggttactgggttcggtagacggttacttcgcttaatctgtagtttcccgcttttcatttgctggtttcttgcacgcaaggacttggtatgtctgggtcggcaagcaatcagagcactatacccgaaagagaacagacagagagacgcccctatcacaggaattgaagggagaattgtgcctgatcatcattttgcaaacgtctaatcaagatcacaaattgtgcgtgagtaaagcttgtagtgttaaactgcgaaccaacaacagcgaattgtgcccaatataagttggcgcaattaattttgcaacagatttaaataaaaacagagtatgcgtaacaaacttggatgaaaagggtgaacgatttctttgttgttggtactcttaattgactgattgacgtttgcagcatcccgttgccgccatgggtgctggaggagatgagcagcaacccggacatcgtgtacacggacaggtccggcngcggaancccgagtacatctccctcggctgcgacacgctgccggtgcttaagggccggacccccatncaggtctacaccgactacatgcgcagcttccgcgagagattccgtgactacctcggcaatgtcatcgcggtaatgaccagttaaaaccacaccgttatcacgatcgattagcattgcgatagcccttgagcataataatttcatgatgctgtgatccttagactaaaccacttgtgtttcactggtacacaggagatccaagtgggcatgggtccttgtggagagctgaggtatccttcataccctgaggccaacggaacctggcgtttcccgggcatcggcgagttccaatgctatgataaggtagggaacaacaaagcgcactttgataataaattgttggaatggtattcagagttgctgccggtgaacgtttgctgaattgttgtgcgtgcttgcgttgttggtacagtacatgcgggcttcgctggaagcggcggcggtggcggcgggtcaccaggagtgggggaggggcggaccccatgacgccggggagtacaagcagatgcccgacgacacgggcttcttccggcgcgagggcacttggagcaccgagtacgggcatttcttcctggcgtggtattcaggcatgctgctggagcacggcgaccgcgtccttgccgcggccgaggccgtgttcggcggcacgggcgcaacgctctccgccaaggtcgccggcatccactggcactaccggactcggtcccatgcggcggagctcacggccgggtactacaacacgcgggaccgcgacgggtacgcgccgatcgcgcgcatgctggccaagcgcggcgccgtgctcaacttcacatgcatggagatgaaggacgagcagcagccgaaacacgccagctgctccccggagctgcttgtgcagcaggtcaagaccgcggccagcgccgccggggtggagctcgccggcgagaacgcgctggagcggtacgacgaggcggcgttctcgcaggtggcgtcgacagcgcgcggcgccggcctggccgcgttcacgtacctgcgcatgaacaagacgctctttgacggcgacaactggcggcagttcgtgtccttcgtcagggccatggccgacggcggcgcgagaccagcactgccacggtgcgacacggggcactcggacctgtacgtcgggttcctcgacgccgccaagaagagcaaggcgccggaggctgagggcgccgccaccgccgcggcattgtaggtggatgctcatgcctgtgcgtgcacacagacacatgcgccgtgctgttgtataacgtgcaccggagaaggggaactgtatgtatagattcagggccttgcaggttgcagagttttataggctgtaatcgagcaggtcggtaaggaggcaggcatgtcagaacttaggctgtcttcagttcatttgtcccatttggaactgtattgttataagtctaatctctgtagagagaattctatatggtgttattttccatactaacataatatacatataataaaatataatataaggatgaaacatatacttttaatagaaagttctatattttttatagatatttaattataaagataaatgcatcggtggcagcggatcttgttaagagatgtcacttaggtcgtgtttgtatcccactggctaattatttgctagtggctaacaattagtcggtaaataattagctagcaacaattacttagggtatgtttgaagtcttggctgatggatgtttttttatatgatctattagcatatattaattggctaatggctaaacattttgccagccctacaactaacaattagtcaatttattagccagcccgtatagaggcccaatatgctaaaattagccgaca

SEQ ID NO: 6802 - DNA, 1134 bp, Zea mays
agcgccgcgcccctttccctttctcgcttctgcccctctgcggctctgctgcctgcggcctgcccctttttttattcccaaaaaaactcccatctcgcggcggaaggagagagagagagaggagaggtgcgagctggtaagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatgagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgctgtggggaggaaggggcagggacgtgctgttggttttattatattggtatttatgttattatatatgtggtagcagcagcgtggaaccgcactaataatggggaccttaacacctctattttactgtcgttgctttgttgtcgcgtgctaggttgtattctgaagtggattcctcaataccgcataccgtactgctacgcctgttgactttgttacattgattgatcgttgtccacttgtaatggaatgccgcaccatgttttctgtcgtgccaaaaaaaaaaaaaaaaagtaccctgcgttgttaccactgctaaggaaaaacaataaaaaaaaaaccaaactata

SEQ ID NO: 6803 - DNA, 1070 bp, Zea mays
taccctcgggcttgccgggacacccgcgccgcgcccctttccctttctcgcttctgcccctctgcggctctgctgcctgcccctttttctattcccaaaactcccatctcgcggcggaaagagaaagagagagagaggagaggtgcgagctggtgagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctgcaatgttgccgatgtcgaacccttcagctaatcccacacagcttacaattttctatggtggatcagtatgtgtgtatgactcggtgccaccagaaaaggctcaggcaatcatgcttatagctgcagctgcggcagccaccaaaggcagtgctgccactgcttttaatcctccaatgagcacatctgtagcagctggacaagctcaggttgttgctgaccctagctcaataagcaagcttcgggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgctgtggggaggaaggggcagggacgtgctgttggttttattatattggtatttatgttattatatatgtggtagcagcagcgtggaaccgcattaataatggggaccttaacacctctattttactgtcgttgctttgttgtcgcgtgctaggttgtattctgaagtggattcctcaataccgcataccgtactgctacgcctgttgactttgttacattgattgatcgttgtccacttgtaatggaatgccgcaccatgttttctgtcgtgccatc

SEQ ID NO: 6804 - DNA, 1050 bp, Zea mays
aggccggccggggctgcctgcccctttttctattcccaaaaaaactcccatctcgcggcggaaagagagagagagagaggagaggtgcgagctggtaagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatggtacatacagccactgtcgccccagcagcagtcttctctcctgtgcttacacggtctccatcactgcagagcacttctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgctgtggggaggaagggacagggacgtgctgttggttttattatattggtatttatgttattatatactgtatgtggtagcagcagcgtggaaccgcactaataatggggaccttaacacctctattttactgtcgttgctttgttgtcgcgtgctaggttgtattctgaagtggattcctcaataccgcataccgtactgctacgcctgttgactttgttacattgattaaaaccaa

SEQ ID NO: 6805 - DNA, 887 bp, Zea mays
gcgccgcgcccctttccctttctcgcttctgcccctctgcggctctgctgcctgcccctttttctattcccaaaactcccatctcgcggcggaaagagaaagagagagagaggagaggtgcgagctggtgagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctgcaatgttgccgatgtcgaacccttcagctaatcccacacagcttacaattttctatggtggatcagtatgtgtgtatgactcggtgccaccagaaaaggctcaggcaatcatgcttatagctgcagctgcggcagccaccaaaggcagtgctgccactgcttttaatcctccaatggtacatacagccactgtcgccccagcagcagtcttctctcctgtgcttacacggtctccatcactgcagagcacatctgtagcagctggacaagctcaggttgttgctgaccctagctcaataagcaagcttcaggctgatctccccattgccaggaggcactctctccagcgcttccttgagaaacgtcgtgacagggtcgtgagcaaagctccgtacagccccgccaagtcgttcgatggcatggagtcagcgggaatggagatgactgcggacggcaagcagggcgcaaggcccagtatcttgaaaggttggggagccgcgaagtctgaagtctgaacggtgaaaggctggctgacgccttggggggggaggaaggggcagggacgttgctgttgggttttattata

SEQ ID NO: 6806 - DNA, 1186 bp, Zea mays
catagatgaaatagataaaataacaaagaaggcagagagtgcaaatgttagtagagatgtatctggagaaggtgttcaacaagcattgttgaaaatcctagaaggaactgttgtcagtattcctgagaaaggatcacgccggaattctcgcaatgacagtatacagatagacacgacagatattctttttatatgtggtggtgcttttgtggacttggaaaagactatttctgaaaggcgccaagattcatccataggatttggggcacccattcgtacgaacatgagaagttctggagctagctgtccaatggttacctcatctttattagaatctgttgaaagtggtgatcttgtaagatatggtctaattccggagttcattggtcgtttgcccattctagtaagtttggcagctctgaatgaaggccagctcgttcaggttctgacagaaccaaagaattcactttccaaacaatacaggaaaatgtttaacctgaacaaagttaggctgcacttcactgatggtgcacttagattgttagctaagaaggcgatagctaaaagcactggtgctcgtggtttaagagccatcttggaaactgttcttttggaggccatgtatgaggttccagacgaaaaaacaggaaatgagcgagttgacgctgttgtggtggatgaggaggcgattggttccgttgataggccaggttgtggggctaaaattctccgaggggatggtgcattggaccagtacataacaagaaccaatgtgatgaatttacaggaaactaacgatggtttggccggggagctcgaggaagcgtacatgctgtctagaattgttagcttgtaatttgaaaggctggggaggaagcgtatatgctgagttctgaccaacttcgtacatcgtgtaacatgtctaccccaacacaggccggctactttttgctcacaaaatcacctgtactctgtctccattcctgttaagctctaacgagcagatagatccggggcaccttttccatgtaaacaggagttgccttttgattgagcaaccgtcctgcggagtaaattgttgcccatttttccccgctgcccccaactgggcagctcgattgtggttgacagagttgtaaagatcatcaatttactgatatgatatgataagaaggagcactttcac

SEQ ID NO: 6807 - DNA, 1654 bp, Zea mays
cctcgaggccggcaaaatagcaaatttctccacacggacacagcagcgagagaagagagtccactgtccaccccaccccaccagaaaaacgcattccgcagacgcgcggcgagggagtaggaggggacggcgggtgccgaggcccgcaggcacggggaagctacctgcttgcgtagccgggcgggctcgcgctgtgctgtcgctccatgtcggtcgccggcgagagcggcggggatccggcggcggcacgccgccggtgggatctctccaacaagggccccgacagcactccaatgttgaaagaggctgtggaaatgtctacagatgaagaatcggatggcgttgttatatgccatccgaatggtaacactgatggatgtgacgaagccattagtggcagtcatgatgatgatagcccagaaggccaggaaactagttccatcaaggaccctgatgtagaaggtgacacacaggaagacaagtgtgtaaatcaagattcactgaagttgattgatcaagagacgtctgctccccccaagtccccagcgaagtccgcgactgcgagttctggaccagagaagcctaaacgtgttgtcacccaaccattgtctctttctactcaacgaaggtcatctggagtaaatggtggtgtgaccaatccatcacccaataaggataaatctggtgataaaagtagcatctctccagcaagcatgacaaagaagtgtacgccgttggcacctaggaagactttgcagcctgagcaagcatttcaccctctggaagaggactcttgttctgtgacttcctcgactacaacatcatcaagagctggcagaactaagacaactgttcctgttgccccatcatttgtgtgtgctaaccgtgctgacaagaggaaggagttctacacaaaattagaggagaaacataaagctttggaagcagagaaggacgaggctgaggccaggaaaaaggaagagcaagacgttgctataaagcaactaaggaagtcattggtgattagagcgaaacccatgccaagcttctatcaagaaggccccccaccaaaggctgaacttaagaaggtgcctcctactcgtgccaaatcaccaaagtttacaagctcaaggagaaagagctgcaatgacacaccacagacacccgagggaaaaaacaccaacgcaacatctaccacccggccacatcgtcacagcatcggggcttctaaagatgccagcagagtacagtgctcgccgaagagcggcgtggcgaccaaaactagatctgtcaagcctgagctgaaggccctctgaagcgcatgcgtagcagccaagtgctgcgattgtctctgtacaaacagaatcgcctgactcttagccgtttccatttccatgcatttttttttgttttgttttgttctatacccagcatctccaccaaaaagaaggctgtagggccaatgacgttgttcgcgctgctggaccttgtctccattttcgtcttgtactcgttaagaactctgttgctgctgggaccatgtgacattcattccatgtaaattacctggggatcccgtgtagggagctcgactggtgttttggtcttgtgaaaaaaaaaaaaaaaaaaaaaaactaaaaaaaaaaaagcggcc

SEQ ID NO: 6808 - DNA, 1668 bp, Zea mays
  misc_feature (10)..(10): n is a, c, g, or t
  misc_feature (1559)..(1559): n is a, c, g, or t
  misc_feature (1583)..(1583): n is a, c, g, or t
  misc_feature (1602)..(1602): n is a, c, g, or t
  misc_feature (1614)..(1614): n is a, c, g, or t
  misc_feature (1617)..(1617): n is a, c, g, or t
  misc_feature (1657)..(1657): n is a, c, g, or t
cgaggccggncgggccgggaactggcctcctacctcgcggctgcctcctcctcgtcgttccccatcttcgccgccacttgccggcgctttgttctactcttcgaagcagccactcgcataagcgccccgcggttatcttctcccccgtacgtgccgtctccggctactccgccatggcggctggttcgccggagcagcagcagcggagcgttgtggtcaaggagactgtggagctcacggagacggaggagcgcatctttcgccgccttctcgaggttgttcgccacttcagtctcggcacgcagctccgcgtcgccggcggatgggtccgtgataagctattagggaaagactccgctgacattgacattgcccttgacaatatgacgggtcagaatttctgtgagaaagtaaatgagtactcaaagttgataggggagcagcagaaaggaatcggtgttatccaatgtaaccccgatcaatccaagcacttggaaactgctaggatgcttattcttgacatctggattgattttgttaacttgcggtctgaaacatatactgaaaacagccgtatccctacaatggagattggtactgccaaggaggacgcataccgcagggacttgacaattaatagcttgttctttaatatcaacaataactcggttgaagatttaactggaagaggtattgaggatctcaagaagggccttattgttactcctttacccgccaaagctaccttccttgatgacccacttagagttcttcgagcaataagattcgctgctagattcaactttacattagatgaagatttgaaggaagctgcatctgatgaaaaggtgaagtcagagcttggcacgaagattagtagagaacgtatcggtcacgagattgatctcatgatgtcagacaaacaccctgttaaagcaatgtgtgacatccgcgatttggggctattttatgttgtattttcttttcctgaaaaatccaaccctcctgtttttgacaagtgtgattggcagtgtgtttcacatattgaagcagcttgggatcttgcatattctattggcagctgtgtgttcagcagtggttctgactccaagtcgcaggatgagcgaagaaggctgtacttgtatagtgcattattcaaccccctccgaagtatgttctacctggacaaaagatctaagaaggctcctgtttctagctttattatcaaggactcgctaaagttgaaaaccagcgatgctgaaacggttgtcaacatacatgctgctagcgaaaagtttgctgagttgattcctctcctcgagtcaaacgctgacgtgtatgctctcaaagagaagctggaagatgagtaccttgagataccaggagacagcgtgaagcgtgtttttgcagggcttatactccgagaaataaaggagttttggcgggtggcgctgcttctatccattctcttctaccgagaaactggaactcctgctggcaccctcgacgagcaggacgagctgcgtcggaggaaagagaaatacatcagagcagagcgntccataaccgacctagatcttganggggtgttgaaactgaaancgatactcgacnggnaatcgattatgggagtcatgcaaggtcaagtccggaagtncaatgataagg

SEQ ID NO: 6809 - DNA, 1684 bp, Zea mays
cctcgtgcccgcgccggccagtaagccacacacagacagtcagacacaggcacacagcgagggagtcctctcctcccccagaaaaggaaaagacgcattccgcacacgcgcggctgggtgtcgaggccgggagacgcggtgaagctagctgctagcgtagccgcgcgcggcgggcgggctcgagctgcgctgtcgctccatgtcggccaccgccgagagcggtggggatctgtcggcggcgcgccgccggtgggatctcaccaacaagggggccgagagcaccccaattttgaaagatgctgtggaaatatctacagatgaagaatcagatggtgttgttacatgccatccgaatggtaacactgatggatgcgaagaaactattagtggcagtcacgatgatgatagcccagaaggccaggaaactagttccattaaggaacctgatgtagaaggtgacacacaggaagacaaacgtgtaaatcaagattcactcaagttgattgatgaagagtctgctcctcccaagtccccagcaaaatccgcgactgcaagttctagatcggagaggcctaaacgtgttgttccccgaccattttctctttctaatcaaagaagtttgtttggagtaaatggtggtgtggccaatccattggccaataaggataaatctggtgataaaagtagcatctctccagcaagcatgacaaagaagagtacgcagatggcacttaggaagactttgcagcctgagaaggcatttcatcctctggaagaggactcttgttctgtgacatcctcacacatcaacaagagctggcagaactaagatgactgttcccgtcgctccttcatttgtgtgtgctaaccgtgctgacaagaggaaggagttctacacaaaattagaggagaaacataaagctttggaagcagagaaggacgaggctgaggccaggaaaaaggatgagcaagacgttgctttaaaacaactaaggaagtcattggtgattagagcgaaacccatgccgagcttctatcaagaagggcccccaccaaaggctgaactgaagaaggtgcctcctacccgtgccaaatcgccaaagtttacaagttcaaggagaaggagctgcagtgatacaccattgacacctggcggggaaaataccaacgcaacatctacccggccacatcgtcacagcatcgggagtcctagagacgctaacagagtacaacaatgctcgccaaagagcggtgtggcaaccaaaacaagatctgtcaaggctgagctgaaggccctctgaagagcatggagcagccgagtgatgtgtttctctgtacaaaccgaattgtctaaccgtttccatttccatgcatttttgcttctattttatacccaacatctccagcaaaagaaggctgtagggccaatgacgttgttcagcgccgctggaccttatccattttcttacattcgccttgtactcgtaagaactcttggtggcaccatgtgacattccatgtaaattacttgaggatccttgtagggagttcgtccggtgttttgctcctgttaagcccttggccttaactaatctgtgagctgaaaagactatcggaatggcactgttccgtttgatgcaaactcatgtttggaagccttttgagtcgcggtggtgtgcctgca

SEQ ID NO: 6810 - DNA, 1292 bp, Zea mays
  misc_feature (1216)..(1216): n is a, c, g, or t
gccggccgggttgggaagcatccccctccatgatagtgcttcctctgagctaaggctctctcacctaaacacccgctcaccccaagtccacgccggcgattgccgcaatgccggcgccggcagcgggcttgtccgtcctggtgctcttcgtcttcgccgccgccctgccggccctttctgccgatgacctcaacaccgacgcgcaggcgctgcaggcgctacgctcggcggtcggccgctccgcgctgccatcgtggaacagcagcacgcccacgtgccagtggcagggcgtcacctgcgagagcggccgcgtcgtcgagctccgcctccccggcgccgggctcatgggcaacctcccttcgggcgtgctcggcaacctgtcggcgctccgcacgctctccctccggtacaacgcgctcacggggcccattccggacgacctctcccgcctgtccgagctccgggccatctacttccagcacaacagcttctccggcgaggtcccggcatcgctgttcgagctcaagaacctcgtgaggctggacatcgcggggaacaagttcagcggcaagatctcgcaagacttcaacaagctgatccgcctcggaacgctgtacctcgacgggaacagcttcaccggcgagatccccaagctgcagctgcctgcattggagcagttcaacgtgtcgtacaaccagctcaacgggtccatccccaacacgctccggaagatgccgaaagactcattcttaggcaacacgggcctctgcggcggtccactcggcctgtgccccggcgagtccgcgcccacgccggccggagcgccggagtcgcagccaggcgcgggcggtgcaggcgacgtcggtggcggcaagaagaagaagctctccggcggcgccatcgctggcattgccatcggctccgtgttcggcgtgctgctcttgctcgccctgcttttcttcctctgccggaagaggtctagcgcgccccggtcggcggcggcggtggagaaggggcgggaactcggcatggggccgatggatgtcgagccaaagggacagagcggctcagcaggcggccacagcagcgttgcggcggccgtcgcagttcctaccgccgccgctgccgctgccgccgctacggctacggcggcagcgaagaccggcgggtcgaccgggtccaagaagctcatcttcttcggccccatggcggtggncccgccgttcgacctggaggacctgctgcgcgcctcggcggaagagcttggcaagggcgcgttcgggacggcgtac

SEQ ID NO: 6811 - DNA, 1095 bp, Zea mays
ccggccgggattccgcctcatcaatgccgaccgtttgggtcgctagacggtcgccacgccagcggtccagcgttggcatccgtcctgcaagcctgcaacccaaccttgaaccttgcctgttcttcttcgatttattagcccagcgttctccctctctcgtgggcgtggcgacgacttggaggccatcgctgccgccctacgccaggtgcccagatcatctgcggccccttcgccggcgacgatcaccatccatcagaaataggatcaagcgcttgaacttacagcgagatggaaaatgatagaaggcaacttggtcagatcgatccaagaagagcccgctttccttgctgcatagtatggactccaataccattcatcacttggttggtgccctttatcggtcacattggcatctgcagagaagacggtgtaattctggacttctctggtccacattttgtatcagttgacaattttgcattcggagctgttgcgcgctacattcaagtaaactgcgatgagtgctataagcttattgaacctgaaggagatgccacgtgggacggcgcgctgaagaaaggcacgcaggagttccaaaacaggaactacaacctgttcacctgcaactgccactcctttgtcgcaaacaatctgaacaggctgttttattccggccacgacgaatggaatgtggtcagcttggctgctgtgatgttcttacgaggccgctgggtgagcacggcatcggtggtgaagaccttattgccatttgcagttgtgctttccatcggtaccttccttggcggcacgaccttcctgaccggccttcttgctttcgccgctgcgatgactgtctggttccttgtgggcacctactgcatcaaaggtctcatagagttgtgattagagtatgttagactcgttgtagggggttcaagggtggcatatttttaagagttcaagcgtggcacatttttatttgtattgcattcctgtataatggattcttgatgttattcatgcacctatatgttccaaattccgaatgaattgatgcacttgtctgttgattcccttcaaaaaaaaaaaaaaaaa

SEQ ID NO: 6812 - DNA, 2543 bp, Zea mays
  misc_feature (108)..(108): n is a, c, g, or t
  misc_feature (462)..(462): n is a, c, g, or t
aaacaccctaactctggagttgcaaactctatggagttttcagagctacagtacaaaattttaaagtacctttttgctgctccgaaatctatagaaaacaacctaganatatggagttatttacctatcagtgcctctggttatgtgaaaacaatcttaactctggagcagagctgctccaccgaaattttagaatagagttgctctgcagtggagtagagccgtgccaaacacgccgtaaattaaagagaactgtttatgggatgcaaaagccttccagctgtataaacactaaacaatcacacatacatcattagttagttgccgtgcatcgctacagttcctatatatatcatataggcatatattgcttagataaggtagttattcaaatacaattcaaacatatacataaggtgagtgcgaataaggagatatgtggtgtggtgtcatataagatgnaagtttttttttcttaaatcagggcgatagagaaggagatatcagatactagactatagataaccaaatagactatgcctacctaaggcttaatctatttaatagtgccacgactcgacccgatataatttaaagtggctcgtgatgtgcctggctatcttctcggcttgcaatgtcgacccgatctaacatgtttttattttaaaactattagtctatatatttataatacataataaaccaacaagtggaaaagtgattagggtaatatttgtttcccttctaaattatataagctagattaaggtgaaagtgtagaggtaaaatatgacttttgaaacataaataagctggaataagttagtattggatagcttatttcagcttatttgtaaccccaaaatgataatttattcttctatctttgtatcataatccaacttatataatcttggagggaagtaaacataccctaattggcggacgtgggttcaaacccgagcccttcgaataagattaatgtttatccataagctctcagtaattcttcatccaagcttttcatgttggtaaaggtactaatcctctgcatctaagacttgcacagctctaaacctgttcaaacgttaagtcagattaggttgtcccatactttcccgttgttgggtcagattttttcaggcagattttttgtctttaggttgagttttatttaggtcaacaatcatagcctgtatccgtgaattgtccgaccgtctcctccgggctcgtcttgctcctgagcccgcacatgcccgcctcggcaccaatcaaacaggccgaaaccgagcccggcccactgaagcccataatcactcgcctccctccatctttgacccagtcctccgtgacgacgtcgtgttttcttccttccccagtcgcatcccacgcgcccgctcctcgtcgccgtcctcttcctccatctcacccgtccctcagcctcgttaatttttcgcccccatctttgaacgcagcggctcaacctccatcgttctctccctcctcctccccccgatcccgtccctataaattgcgcccccgccgccacagcggaccgcaagcacgcaatcacacagctcgctgctgctgccgtctccccgtgtcctgtcgttctcccgtcgccgggggcggaagagttcggcgggcggttggggattgctcgggagccccgtgatggcgaagctgtacgtgcaagcgttcccgcccgcggatctgaacaagaacaccgagtggtttatgtacccgggcgtctggacgacctacatcatcatcgtcttcttctcctggctcctcgtcctctccgtctttggctgcacccctggcaccgcgtggaccgtcgtcaacctcttccacttcgcgatcacataccactttttccattggaagaaaggaacaccttttgccggcctcctagggttcgtgcggccgctcccacttgctgttgaaattttgacccggagtgatttcatggatctgaactcctggagaggctgcacaagcgttaatgcggcggtgctatctgcctatgaagtggcgatgctatctgcgtatgaagcttgcttcgtgctcactcaatcggactaacaggacagtcaaaatataggagttagtttaggtgcgtccacctggcagaattgcatcaccaaattgtgtgcgtaaagatgaacattggcaggtagcttatgtgaatgtcaggtacttcagtatttgagtttagttagttccgttcagagtgtgaccacgtagttaagaacagaaccaaatgtttttgtgtacatcagttgagtaaaaatgctcttcatgtgtacatgatcaaagttggtcgaagcatatcgtttgcaagcaaagttggtaaattcgtaatgtctggacgccaaataacacaaatatcagcattgatgatgttgctacatattttgtcagcttgcctaatagtctgccttgtttaggaacttccaaatatgtacaaatggtactctggaatatcacttttagtattttttttgtcttagatgatgaattccacattataatatgaataa

SEQ ID NO: 6813 - DNA, 1076 bp, Zea mays
gtgttttcttccttccccggtctcattccacgcgcccgctcctcttcgccctcgtcttcctccatcccacggtcccacctgtccctctcaccgcctcgttattttttcgcccccatctttgaacgccgggactccaactccaccgttcctccctcttcgttccctccgatcccgcccctataaatccagtcgcctcagccgccacagcgggccgcaagcacgtaaccacacagctcactgctgctcccgtcttcccgtgtcctgtcgtgctcccgtcgccgggggcggaagggttcgcgaggccggcgggcggttagggatttctccggagtcccgcgatggcgaagctgtacgtgcaggcgttcccgcccgcggatctgaacaagaacaccgagtggttcatgtatccgggcgtctggacgacctacatcctcattgtcttcttctcctggctcctcgtcctctccgtcttcggctgcacccctggcaccgcgtggaccgtcgtcaacctcttccacttcgcgatcacataccactttttccattggaagaaaggaacaccttttgctgatgaccagggaatgtacaacgcattgacttggtgggagcaaatggataatggcaaacagcttactcgtaataggaagttcctcattgttgttcctgttgtcctgtatctgatagctctgcacaccacagactaccaacaacctatgctcttcctcaatacccttgccgtcagtgtgcttgtggtcgcgaaactaccgaatatgcacaaggtccggattttcggaataaatgccgagaactgagcaacgtcatccttcgccagacatttaccctatatgcgcttttcagaacggttttgtgtgttcccccccccttctagtgcctttagttgggctcatcagagcaccagtgttcaaaaagttgttagcaggatgggccttggtcgctgtatagagagatgctcggaggcgtgctgtacatctgatgtgcacggattctgtacactcttaatgttgctatatatacggtttgttgcaagcaaaaaaaaaaaaaaaaaacggcacgag

SEQ ID NO: 6814 - DNA, 1102 bp, Zea mays
gccggccgggtcggcgtgttttcttccttccccagtcgcatcccacgcgcccgctcctcgtcgccgtcctcttcctccatctcacccgtccctcagcctcgttaatttttcgcccccatctttgaacgcagcggctcaacctccatcgttctctccctcctcctccccccgatcccgtccctataaattgcgcccccgccgccacagcggaccgcaagcacgcaatcacacagctcgctgctgctgccgtctccccgtgtcctgtcgttctcccgtcgccgggggcggaagagttcggcgggcggttggggattgctcgggagccccgtgatggcgaagctgtacgtgcaagcgttcccgcccgcggatctgaacaagaacaccgagtggtttatgtacccgggcgtctggacgacctacatcatcatcgtcttcttctcctggctcctcgtcctctccgtctttggctgcacccctggcaccgcgtggaccgtcgtcaacctcttccacttcgcgatcacataccactttttccattggaagaaaggaacaccttttgctgatgaccagggaatgtacaacacattgacttggtgggaacaaatggacaatggcaaacagcttactcgtaataggaagttcctcattgttgttcctgttgtcctgtatctgatagctttgcacaccacagactaccaacaacctatgctcttcctcaatacccttgccgtcagcgtgcttgtggtcgccaaactaccgaatatgcacaaggtcaggatttttggaataaatgctgagagctaaacagcgtcatccttcaccagacattttacctatatgctttttcagaacggtctgtatgttccccttctagtgctttagttgggctcattcatcagagtaccatagtttaaaagttgttagcagatgggccttggtcgttgtatagagagatgctcagaggctggactggacatgtcgctgctgtacatctgatgtgcacagattctgtacacccttaatgttgctatatggtttgttgcgagcaaaaaaaaaaaaaaaaaaaaaaaaaaatagatcattgtgcaaaaaaaaaaaaaaa

SEQ ID NO: 6815 - DNA, 485 bp, Zea mays
tacaacgcattgacttggtgggagcaaatggataatggcaaacagcttactcgtaataggaagttcctcattgttgttcctgttgtcctgtatctgatagctctgcacaccacagactaccaacaacctatgctcttcctcaatacccttgccgtcagtgtgcttgtggtcgcgaaactaccgaatatgcacaaggtccggattttcggaataaatgccgagaactgagcaacgtcatccttcgccagacatttaccctatatgcgcttttcagaacggttttgtgtgttcccccccccttctagtgcctttagttgggctcatcagagcaccagtgttgaaaaagttgttagcaggatgggccttggtcgctgtatagagagatgctcggaggcgtgctgtacatctgatgtgcacggattctgtacactcttaatgttgctatatatacggtttgttgccagcaactggcggtagatacgttt

SEQ ID NO: 6816 - DNA, 3285 bp, Zea mays
  misc_feature (1938)..(1938): n is a, c, g, or t
  misc_feature (3221)..(3221): n is a, c, g, or t
  misc_feature (3253)..(3253): n is a, c, g, or t
  misc_feature (3262)..(3262): n is a, c, g, or t
ctcccaccccgcctcggtgcgtgcggatccgtccctaattcgtttgtcctctcgtctcgccggtgttcttgcgttatcgtttcagtctacccgttggtttggtattggttatgattttggcgtgtccgtcactccgttgtgctggattggatccgggagcaggtgttcgtttaggactctcgcggcggccaaggagtcgtcgccgccgtcgaccagcgtctcgccgacccagcagcagtcccggagtacgatagagggaggcgagatgacggtcgcctcgtccgtcaggctcgccggcggcaatctgacggtatgcgggcggacggtgctgtccggggtgccggacgcggtggtggccacgtcggcggcgacggagggagcggtcgacgggatcttcctcggcgccgacttcgccgagccggccgcccggcacgtcgtctccctcggcgacctgaggtacgtacgtcttgaatcggtggtaatttttccccattcgacccaattgttcgtgttgccacttggcattgatttctcgcgatttggcagggacgttcggttcatggcgtgcttccgattcaagctatggtggatggcgcagcggatgggggagaaaggcagcgacgtcccgcgcgagacccagttcctgctcgtcgagtccaggggcgtcggcgacgaggacgcggcgtacgtcgtgttcctcccgctcgtggagggcgcgttccgggccagcatccagggcggtgccggcgacgcgctggagctctgcgtcgagagcggggacgacgacacgcgcgcggcgtccttcgagcgatccctcttcgtgggcgccgcggagtccgaccccttcgcggccatctccggcgcagtcgccgccgccaagtccgcgctcaggacgttccgggtccgcgccgagaagaagctcccgggcatcgtcgactacttcggctggtgcacctgggacgccttttaccaggacgtcacccaggagggcgtcgaggccgggctccgcagcctcatcgccggcggcgcgccgcccaagttcgtcatcatcgacgacggctggcagtccgtcgccaccgacaccaacgaatcggccggagaggacaagccgcccctcctatctcggctcaccggcatcaaggagaacagcaagttccagaacgcggacgacccggccgccggcatcaagacggtggtgcgcttggcgaaggaggagtaccggctcaagtacgtctacgtgtggcacgccatcaccggctactggggcgggcgtccggcccggcgaggagcactaccgctccagcatgcagttccccaaggtttcgccgggcgtcatggagaacgagcccggcatgaagaccgacgtgctcaccgtgcaggggctcggcctcgtgcacccgcgcgccgtgtaccgcttctacgacgagctccacgcgtacctcgccgccgccggagtcgacggcgtcaaggtggacgtgcagtgcatcctggagacgctcggcgccggccacggcggccgcgtgcagctcaccaggcagtaccaccaggcgctggacgcctccgtcgccaagaacttcccggagaacggcatcatcgcctgcatgagccacaacaccgacgccctttactggtacgcgatccgatctattcgctctcgcaatgctgaccgtggagaattaacatgggaccattaaccgatttgatggtgatgttggtgcggtgcgatgcgaccaacccgcagctccaagcagacggcggtggtgagggcgtcggatgatttctacccaagggaccccgcgtcgcacacgatccatatcgcctcggtggcgtacaacagcgtgttcctcggcgagttcatgctcccggactgggacatgttccactcgctccaccaggccggcgactaccacggctccgcccgcgccatcagcggaggcnctgtctacgtcaggttggtgaattcattgcagcctcgggatcatcagaatcgtcctcgggttcattgcagcggttgctgaactgtgtgtacgttcttggtgatgtttgcagtgacgcacccggcaagcacaacttcgagctgctgaagaagattgtcttgcccgacggttccattctccgcgcgcgtctgcctggccggccgaccaaggattgcctgttcacggacccggcacgggacggcgtaaggtgccatttgcaggcgctgctgtttttttttttttttttggagcaagagcaataagcagtgtgttctaacaccaatgccatgcatgtgcagcctgctcaagatctggaacatgaacaagttcaccggcgtgctgggcgtgtacaactgccagggcgcggcgtggaactccgtggagaagaagaacaccttccaccagaccggcaccgaggccctgacctgcggcgtcaagggcggcgacgtccacctcatctccgaggccgcgacggacaccgaatgggacggcgactgcgccatgtaccggcatgccgacggcgacctcgtcgtcctcccgcacgacgcggcgttgcccgtctccctcaaggtcctggaacatgacatcctcaccgtgtcacccatcaaggtcagtcactcggtgcccgtttagtttagcaacaaatgctgcgaaactgtacgtgcttatgttccctgcaggagttggcgcctggtttcaggttcgccccgatcgggctggtggacatgttcaatagcggcggggcggtggaaggcctgacctatcacctcctcggcggcgacggttccaccttgggctccgaggctgtcgcattggcgtgcatggaggtgaagggctgtggaaggttcggtgcctactcttcggtcaggccaaggaagtccacgctcggttcagctcagattgagctcaagtatgattcttcctcagggctgctgattctgcagctggatgcgatgcccaaggagagggttcacaagattgttattgagttgtagggtggtacaaagatttagtttcattggtaatcagagtaccctctgatgacgagtatgtagggactggagtggcgtatggtttgattgataggcaaatctgattcatgattcaagcttgtctggactctgaacagctggccttcagtatttgattacattcattcaaacacccgtttccaaaaactcgagcccggcccccgaaagaaaagaaggaagaaaagaggaaaaacatatcaaaaaaaacacccanagtaatgggcggccgccctcgcgagtctagtntaccggacnggcgtggggtacgacccaaggga

SEQ ID NO: 6817 - DNA, 1280 bp, Zea mays
gtgcagctcaccaggcagtaccaccaggcgctggacgcctccgtcgccaagaacttcccggagaacggcatcatcgcctgcatgagccacaacaccgacgccctttactgctccaagcagacggcggtggtgagggcgtcggatgatttctacccaagggaccccgcgtcgcacacgatccatatcgcctcggtggcgtacaacagcgtgttcctcggcgagttcatgctcccggactgggacatgttccactcgctccaccaggccggcgactaccacggctccgcccgcgccatcagcggaggccctgtctacgtcagtgacgcacccggcaagcacaacttcgagctgctgaagaagattgtcttgcccgacggttccattctccgcgcgcgtctgcctggccggccgaccaaggattgcctgttcacggacccggcacgggacggcgtaagcctgctcaagatctggaacatgaacaagttcaccggcgtgctgggcgtgtacaactgccagggcgcggcgtggaactccgtggagaagaagaacaccttccaccagaccggcaccgaggccctgacctgcggcgtcaagggcggcgacgtccacctcatctccgaggccgcgacggacgccgaatgggacggcgactgcgccatgtaccggcatgccgacggcgacctcgtcgtcctcccgcacgacgcggcgttgcccgtctccctcaaggtcctggaacatgacatcctcaccgtgtcacccatcaaggagttggcgcctggtttcaggttcgccccgatcgggctggtggacatgttcaatagcggcggggcggtggaaggcctgacctatcacctcctcggcggcgacggttccaccttgggctccgaggctgtcgcattggcgtgcatggaggtgaagggctgtggaaggttcggtgcctactcttcggtcaggccaaggaagtccacgctcggttcagctcagattgagctcaagtatgattcttcctcagggctgctgattctgcagctggatgcgatgcccaaggagagggttcacaagattgttattgagttgtagggtggtacaaagatttagtttcattggtaatcagagtaccctctgatgacgagtatgtagggactggagtggcgtatggtttgattgataggcaaatctgattcatgattcaagcttgtctggactctgaacagctggccttcagtatttgattacattcattcaaacacccgtttccaaaaaaaaagtattgttaccgt

SEQ ID NO: 6818 - DNA, 1567 bp, Zea mays
gggagaatattacaagacaagcctaggattttttcgcagggtcctcacctgtcactttccgggctagcaactggggtggagaagacaagaacaagtgccttaacgaaacagagccgatctacaaaaccggatacaaagctgcaactacagactacagcttgatggccaaagctaagcactactttcgaacattggagccgaaaggcatacatgttcagatactgaacatcaccgagctgtctgactaccgcaaggacgggcatcctacggtgtacaggaaacagtttgctcctctgacgaaagagcaaatcgcagacccagccagttacgcggattgcacgcactggtgcctccccggagttccagatgtctggaacgagtttttatatggctacctcgtgcaaaaatgatgtacaaaactgtcagtcaggttcgttttgccccttatatataatgtacaaatggcatactccatttagattaggatgctcgctcattctcttgtgcagagaatggttggacctcttacatttaccccgtgcagtgcagagacagacagaaggagaaaagcaagggtctgtctgtacatcacttattaatgggatcagtgtactatttgtttacatctaacagggcgacatgattttgcaattttcgaagaaatttgtcatgcaaaaaggaacagtttaagaatgcccctaaaattcagttcagttcaattcaattcagtcataccggcaggcaggcaacaaaagcacattccacatctgattggtgggtaatataggttagggagagaggagcaacctgaatctgctatcgccacaggttccagttgtcgtcggcccgccgcaccgcgtgcaggaccaccccgccatggccaccggacaccctcgccggcgcgtcgcgcagttacaggctacagctactacctggaaggccaggccagccccagcccatgcagtaacacttggatgatgtggcccgacaacggcccaagtttaacggtctcaaagcttagaggcctcacattgccaaaattatgaataaccgaaatggtacaagtttcttatatatgaaacgcggttcaaaacacggcttctagggctatccacgtcgacttttattttttcagccgttagattcacaatcgaaggacaagcaaacgcgatgtcgtttctatcctccacagatgacacgatgtttccagaaatcgcttcttctttccttcctctgggcatctctctcccgaggctacgggcctacggcttcgatgttaagccagtggagttcctccgcagctgacggcgatggcggagaccacctgcttctccgtgttacgccacagatcttggctgccacggtctcgcgcttgccgactgtaatacccaatttgtaaattgtaagaaataatacaaatggagaaaacaatttctccttatgtgagtttaacctttgtgcatcatcacatgtgtacaccctaggtataaacaaataattaataccctaaaagccacaaaaatatgtatcatgttggttttcattttggtgtgcattttgtgacaac

SEQ ID NO: 6819 - DNA, 7709 bp, Zea mays
  misc_feature (3206)..(3206): n is a, c, g, or t
  misc_feature (5368)..(5368): n is a, c, g, or t
acttttagcgatcaaccgtctgtccctaataagggtcgctaaagatcaaccgtcgtatagtgacgtgagacacctgctcggccggcccaccaggcatgcgacccgtgcccgggatacgtgcgatgcgatccacggctcgcaatctcaatcgcatcgcatgcatgccgttgtcgcgtggacggatgccattcgatcggtctcgctcgattccatatatacttgcagaatgcagacgccagatgtgcagtgcagtgcgtggccttcgccggctcaaatagattgatggatagatagatatatagatataataacagtttttattactcggtcattatccgtcgtgcctgtcgtctttatcttcctctttaactaaaaacaattgaaattatggatacaatatgcgagtcaacagcatatatatataccacatcttcccgaccccgaatgtttctgtcccccctgctgcgtaagcgcgtcagacgagacgagggaccaaagaaagattcgcaccatggcaaagtacgacataaattaaattaaattaaattaatctatctagaagcatatgccaaatgaacagtccattttaatttccctggaatattttcaaatgtcaaatatatatatagagtactgtgtagctaaatgcatggtttccgtttgcttataaataaacgagcgccgcaaagcatcttgcatcgcggctacgagtacaacgagcgcgcgcgatcggaacgtttatccggatgcgcgccttcattccgttgctttgccgtaatctatagctaataagtacggtataaattatgtttagacctaacttttttttttcgccgccattggtgattttttttttaaaaaaaacaacgcagctagtgggccgattcttcccttttcttccttctccgagccttctatgccactcaaactcatgcatcctcctttaatttaacggcggcggcggcttgcattgcattggccaaaacatgcaacaaagatcgcggttgcttatcatacaaggacggatgcgtgtagtagagatattatatagcagtaagatatgcagtagactagtagtgcaattgcttggtgagcatgcatgcgtctatatgccgtgcacgtcgttttcagcgaaaagcaaagcgacgatccaaattgaatgggcaactgcgcgcaatgagaagaggtttcgtatcaataataaattgttaacgtgtgcgtgcaccaactagaatagcactattctatggacctggtatagtttaattggttaagtttttttttatggtcgtagtatatacttgctaccctgagttaattaaactcgcgcgtacacttaacacgacgagcgctcatgttttttttttatttctagatttgttgcaagaagaaattattatgttgttcatttagtgatagacaggttttctcttcttattacctgtgccacaaattgtgaatttttccaagcatatgagatgttgatcttggtggcgttaacctgtagctatttgtacgattcatagcgaaaacaagagatgtttcattataaacaataacaaaaatagagagacagagagagatttttttttggatgaaatcgactgaaagcgcgcgcacggctgaagttgtggcccgatcgtcgcgtggtaggagagggttctttttctgactggtgcagctccctccatgcatgactacatcgttttttttcctcttcctcttcaatgaaagagaagcaataattaaaggagatcgagacagtcaaacagatagtaaacagatagtagtagtactcggcatagacactagctgcggtttgctgcggttttaatccggctacgagtacaacttctatttctcaaatttggtgagatgacctcatttctcattttagtatcccattcctcaaaaatagatcaaatgtgagattttgcgaagacacctagtttgaaggacagatattggaagttcgataccctagcttattttggcattgcaagaaagaaattcataaccattgtggaggcgctaacagatacagaatcacctttttctaggagaagcagaacattaattgggactaggttagcggagtggaactaattacgctcacgtgtcgctaacattcagttatacacaagaggatgattcttttcattggaacctgacccaatccggtcagtttttggtgagatcccactatctggctttgattaagactgaagtacccaatttaaacaaaatattatggaaattaaaatctccgcttaagagtaaagtcttcttgtggtaccttaggagaggagtaattctaattaaggacaatctggccaagcgtaattggcatggagacccatcttgttgcttctatcataaaccagagtaattaagcacctattttttgaatgtcatttagctcgtatggtctagggtatatcatacttagccttcgtgatacgtgcaccttctagtgtctctaatatgtttggtagctggttagaggggtttgatcaaatattagaaacaatgttttgctaggagcggcaagcatctattgggttctttggctaactagaaatgattttgtttttaagagaaaaacgattaattacccgttacaggttctatatgccatttcccactggcttcgtatatggacggtgctgcaaaaggtggaacaacaagctacggttgtggaggctatgcgtttcttggcgtaggtggccaaggacttttttcccaggcgcattggtggtgatctagtcgtcggattggttctttgtgttacctttgttcaggttgtgtgcttgttgatgagcagaggccgaaagaaatttcaatcctctgtatcaacttgatgcgatacattgagattaataaagtcttccttataaaaaactaactatgaggaataaggtgatgatggatcaactcaataaattctacaaaccaaacaaaaaagtgaggagtgagaaaatgatgaactagcttatttctcaaaccaaacattctataagtgatgctgattggcttgcttcttcatgcaggtcttctcatggtctaagtgattctgcaacaactgagatgatcgatagcccaagtggaaacgtctgaatttgctaattcggtgataggcagtgctggaaattggaatggaagctagaattataccaaaatttcatggaagatagccaacttagaancgcaggcaagaacataacaacgtaggtaagtctcgaggcattgattcaggcgctcggccaaaacatcgaattgtgggtgatataggcagtgctgcattaaactgagcatccactacatgggaacagttcagtacagaagtggcttgtgaagttccaatcaaggtcacacacgcagcgcaggccatgcaacatgtaaatattgtgtaggaatgcctttgccaccagcccaccactgatactgtgaaaggatggagaggaggcaggaggcacaaaatggccacacgcacttagtgagtaaatcaacgatgaccaagatgcagttgaagttaccagacaaaaggcagaccatattttatgatcattgaagacttattaacgactttcttctgtcattacaaggaaacacgcttttgcaggcatatcttcttatctttgccttgtaccttcattcgctgaaaacatgcttcaacctctgctcatctcagttctcatcgagtttttctttttcccctttcaagatgtaaggaactcatgttgctgacgcaacttaggacttaggagtgcattggttcctttaggccatctctaggagactgtgtatatgagcgtataaaacactgtagactaaaatgtttacagagtgaagtttaaataaggagtgagataacgagtgagatagtgctggagatagtcttaaagctataactccgtaggggcacatatttttgaaacaactaacgtgggccacgacaaattgggccggttgctggacttccgtgcaagcgagtaaactagtatcacacacaattcacagctttagtaggcatttcgtcggtgtataaacagcaggcagtagaaggctagcagtacagagcaacaaacagaacacacatttcttaccttcattcgctcaaaacctagaagcacccgcggcaaatcctacggtgacagcgtgcttcaactacggcgtgaccttcttcatcctgacgtcgaccacctagcggccgatgtttagggatgagcccttttgcagcccacaaaaaagctccaggtttcaattggcttcctaatttgtttaacttggctgtcttgtcaaatactccaaggagtaagtagtaaatgtgagataagtctaatctgacgcttgacttatctacatctacacaggtgggtggtagatagagaatagtatcaactatcaaggtgtatgactatagtgacttggcaaaatagcactgtatatatatatgttggctgatccgttccagtcaatggctgtagtgtggaaaggatgacgactatagtgcagcgctatacaagaaacatcccagaaagtccgcgtcaccaagccgcaaagctagaacccttccaccacagccatggtgccatcccgacacgataattgattgccactgattccagcaaggttctaataaatcttgtagatgcaacctcgctttgcctgccgccgccagtcttccgcctccgccacacacaaatgtccagtttctttgctgtagctgtagctttggtgctctcatctctcatccatggaaccacgatggccacagcgagcagcgaagagagcttcttccagaagtgcccagcgtccagctgcagcgaaggagggccagagatccggttcccgttccgccttgcgaccagccctctgtcatgcggtgcgcccggcatggagctggtgtgctccaaagcagacaccgtcctggttcacccaaaccttggcttgtgtaaggtaactgccatctggtatggcggcagcactataaccatcgtcccactcgcagcagaaccagaacccaagtgccctttccagaagatcatctccaccaatctatcaaccgatgtgtatagacctttcggggatagggcaaccttagtgagctgttcagcagagttcatagtaccaagccatccggccagccttgctggtcccatctcttgccttaccaacgctagccgccggttcgcttacttggtgccgtcttttcgaccaatggatttccttcccttggactgcacggttctttcgaatagcatctcggtaccttaccctgcttctgtcaacgcgggcttcaacggaactgcaagaggagccatcgcatttggcgagacaatgttagaatggagagttcctaacattnaccgatgtctgccgagactgcgaagctgaaggaaggctctgtggatttagctccgagagtaggcaagcattctgtaagagtaagaatcacagtaagtttcttatctcttatagcagcttatattatatgttattatgatattacttatagcgattctaatgttgattttggcatatgacaatccattgcttaagtagcacagtcatgtgtcctattttgttcttaattagttctttggttcagctggcatttctacatactttggttccggagctagttgggatggaggctccatccaaaatattttgatgagctggatggttcaacatttcagcataattttctttttttaagttactctgttacatacgaaacaaatccaaacaacaaattgggagcgaatcggttctgtccaactatactccggaaccgcttcgcacttttgttcttaattaggtttttgaaggcctctttgcaactggtagtcgtgggcgggatgttctgcagtttacctttgtttccttagtaagactcagcctaaaaggaagtcctgatagaatgtaattcacctctttcctgcacgcaggttcacgtctcaaggtcattgcaggtacgtggtttcagtgcacttttgacctattgagtgttatttctatttcttaacaacaaaaccgcagcacgctctcatagtcgtttcatccacaaaagatctgaataatcgattgcaatctaataacagactgattttctcaaaccctgtctgttcagtaacgacgccagtagccgcagtcctggttctttcagcaatggcaggtgctgcattattacacctggccctgaaatctaaatacgacgacgagatacacaggaaagtggagatgttcctcgagacctacaggacgctgaaaccgagaaggtacacattctctgaagtcaggaagatgacaagacggttcagcagcagacttgggcaaggcgggtttgggagcgtgtacaaaggcgagctgccgaacggaggagtgcctgtgcctgtggcagtcaaaatgctggaggactcaacgggggaagaggagttcatcagcgaagtcgcaaccattggaaccatccaccacgccaacgtcgtccggcttctagggttctgctccgagaggtcaaggcgtgctctggtatacgagttcatgcctaacgcgtcgctggagaagtatatacgctgctcctcccaagaacagtcgttaataccaacggccagtaagatgctggaaatagcgacagggatcgcccgaggaatcgagtacctgcaccagggctgcgaccagcgcatcctccatttcgacatcaagccttccaacatcttgctagactacaacctgaacccgaagatctcggatttcgggctggcgaagctgtgcgcgagggaccagagcgtcgtcgcgctgaccgcagcgagaggcaccatgggctacattgcgccggagctatactctcggaacttcgggacagtgtcatgcaagtcggacgtttacagcttcggcatggtggtgctggagatggtggtggtgagtgcaaagaggaggaagtacagcccagcagagaccgaggaccagaacgacgacgtttgcgttccagagtggatatacgaggaaatagtcaccggcggacaagagcccagggaaatggcacgaggagagagagacatggtgaggaagctggctatcgtggctctctggtgcattcagtggaacccaccgaaccgcccgtccatgacaacagtggtgaacatgctgacggatagcttgcagagccttaagataccccctaaaccatttgtttcatcctttgttggccagtaaccatgaagaaaaagctctagagaccacatggtgaccattcagatagatattcgtgtctatcacttgtcggcatatgcatgtatcagcgatgatgccctgtgtctgtcgtagttttgtgtcatacccatataccttttttccttgtaaccactggattgtatacattgcaattttctggtggtttaaccatgttcacgaatttgtaatggcattattagcaggacgttacataaaaaaaattagtaactggaaaggtagaagttacagcttacattaaaatgcggacagaataacgttcttacggtttatctccaattgtgagcattgagacggattggtcgtactccacgaagaactccttcctcctgaacaagctgtccatagccaccgctctttggtctttgctcaacaaattcagacggattaattattgctcagggaggcaactcacttttttaccgatacgtgctgctcgaaggctgtgaattgtg

SEQ ID NO: 6820 - DNA, 1713 bp, Zea mays
aatccccatccggtccatttcttatcccctctcctccggtcctcccccctccccccgatggcgtccctcacgctcccagcactcgctctcgccctctctaaccccggcgccgtccgcctacgcgctgcggccttccgctgctgggcgctccggcggcgcggctgggcggcggcgggcgccctggcctcgcccaactccgtgcttagcgagcatgccttcaagcggctccagctcgggagcgacgacgaggacggggaagggccgtacgggagcgacgccgacgaggggttcgaggcgggggagggggacaacgaggagctcgccattgccaggctcggcctgcccgacgagctcgtcgccacgctcgagaagcgcgggattacgcacctgttccccatccagagggctgtgttgattcccgctctcgagggccgtgacctgattgctagagcaaagactggaactggaaagacactggcctttggcatacccatgatcaagcaattaatcgagcaagacgatggtcggattacaaggagaggtcgtactcctcgggttctggttctagcacctaccagagagttagccaaacaagtcgagaaggaaataaaggaatcagcacccaagctcggcacagtgtgtgtttatggcggtgtctcatataatgtccagcagaatgcactctctcgtggtgtcgatgttgttgttggaacacctggccgcataatcgatttgataaatggcggaagcctccagttgggagaagttcagtatttggtcctggatgaggctgaccaaatgctcgcagtggggtttgaggaagatgtggaaacaatattacaacagcttcctgcaggcaggcaaagcatgttgttctctgcgacgatgcctagctgggtgaagaaactgtccagacggtacttgaacaaccctttgacgattgacttggttggcgatcaagatgaaaagcttgctgaaggaatcaaactctatgctatcccactcacagcaacatcaaagcgtaccgttcttagtgatctaatcacggtttatgcaaagggtgggaaaaccatagttttcactcgtacaaagaaagatgcagatgaggtatcattggcactgacaaacagtattgcttctgaggcacttcatggtgatatttcacagcatcagcgtgagaggacactaaatggattccgtcaagggaaatttactgttctagtagcaacagatgttgctgcccgtggtcttgatataccaaatgttgatctgattatccattacgaattgccaaatgatccagaaacttttgtccatcgttctggacgcactggacgtgctgggaaagcaggaactgcaatcttgatgtttaccagcagccagaaaaggacagttaagtcacttgagcgtgatgttggttgcaactttgagtttataagccctccgtccatagaagaagtgctggagtcatctgctgagcatgtcattgctacattgagaggtgtgcacccagagtcaactaaatactttcttggagctgctgagaaattaacagaagaattgggacctcatgctcttgcttctgcactggcacatctgggtggattttcttaaccaccttcgtcaccttctcttatcagtcatgaacaaggattggtgacgttgcaacttacttgaaaacaaggatttggcaaaggcctttttttttctaaa

SEQ ID NO: 6821 - DNA, 1155 bp, Zea mays
cgcattgctgatcatatcaggtccaatgagcagtcttcgatgtacctgaggaaattgcaaaggacctgcttactatagaggtcccgctggtaacaccccgcccccgggcttccagctgcctgcgttgcaagatgatagtcctgctactgatagctatggtcgcttttcaaacgaccgaggttccaggaacaggcgttccaggggtggaggcgcttcaagaggccggggtggttgggacaccgacagtgaggaccgataccggcgtggtggcaggagcttgaggtctgacaacgatagttggtcagatgatgactggtcaggcggtgggagaaaatcaaaccgttcctcctcatcctttggtggccgctcatcatcctacggcagccgtggctcaccatcaccatccttcggtgtccgctcatcatccttgggcggtagggagagcagcagaagcttcagtggcgcttgtttcaactgcggcgaatccggtcaccgtgcatcggactgcccaaacaagtagatggcgcattcttccctgcccaagcaagtagacagctcgagcatcaggacgcacgcagagcgaaaacccaagcgcgcccctgatcgaccagtatactacgcctgacagccagctacagtttttgtgtggctgtctcgtcaggactgaagattttggcatgctgattccagttatttagatccagaggagtccttactctacagggatatgttgagtctcagtagaattgtgtaaccagtaaccacacacacgaacaatggcggaggactaaaatataaaatcatagctggcatattgaacacgtaacatatattgcagttggcatggctcttttcttttccctccaatttgactccagcgcgcgcgcggggtcgatcgtttttacatgcactactacacatgcagcctcctttgcttgctggcagctatgcatagttgcgtgtgcgacacagcatctccaagctctggcaatcgcttgtcaaatgtctgctcctcagagctgtcctccgtatcaatcctctttctgacttttctagtcttctctagagattttatcttgtatatcttatttctcttcaacattttctaaatcatgtcctctatatgtaaatatctatattagaaacaatttcttc

SEQ ID NO: 6822 - DNA, 1306 bp, Zea mays
  misc_feature (620)..(620): n is a, c, g, or t
ccggccgggaaataatcgtggcgagctgacaaatacccctctcaaaccctcgcccatcccgaagcctgtataaaaagctctgcgttcctccaccctctgtccgccatccgttccctttcttatcccctcccagtcccagccatcgcctcccgatggcgtccctcgtcacgctccccgccatcgccttctctaaccccgccacagcctccggcgctgtccgcctacgcgccgcggccttccgctgctgggcgctccggcggcgcgggtgggcggtggcggctgccgtggcctcgcccaactccgtgctcagcgagcacgccttcaagcggctccagctcggaagtgacgacgaggacgaagaagggccgtacgggagcgacgccgacgaggggttccagggggacgaggaggagctcgccattgccaggctcggcctgcccgacgagctcgtcgccacgctcgagaagcgcgggattacgcacctgttccccatacagagggctgtgttgattcccgctcttgggggccgtgacctgattgctagagcaaagaccggaaccggaaagacacttgcctttggtattcccatgatcaagcaattaatggagcaagacgatggntcggagtacaaggcgagggtcgtactcctcggggttctggtctagcacctaccagagagttagccaaacaagttgagaaggaaataaaggaatcagcacccaagcttggcacggtgtgtgtttatggcggtgtctcatataatgtccagcagaatgcactctcgcgtggtgttgatgttgttgttggcacacctgggcgcataattgatttgataaatggtggaagcctccagttgggagaagttcagtatttagtcctggatgaagctgaccaaatgcttgcagtggggtttgaggaagatgtggaaacaatattacaacagcttcctgcggacaggcaaagcatgctgttctctgcgacgatgcctagctgggtgaagaaactatccaggcggtacttgaataatcctttgacgattgacttggttggagatcaagatgaaaaacttgctgaaggaatcaaacttcatgctatcccactcacagcgacgtctaagcgcaccattcttagtgatctaattacggtttatgcaaagggtgggaaaaccattgttttcactcgcacaaagaaagatgcacatgaggtatccttgccactgacaaccatgattgcttctgaagcacttcatgatgatatttcacagcatcagcgtgaaaggacactacatggatctcgtcatgagaaa

SEQ ID NO: 6823 - DNA, 860 bp, Zea mays
  misc_feature (833)..(833): n is a, c, g, or t
tttcctgaggaaattcaaagggcctgctggctatggagttcccccgggaaacccattaatccaaatttgaaacttcctgcgttgcaagatgatagtcctgctactgatagctatggtcgcttttcaaacgaccgaggttccaggaacaggcgttccaggggtggaggcgcttcaagaggccggggtggttgggacaccgacagtgaggaccgataccggcgtggtggcaggagcttgaggtctgacaacgatagttggtcagatgatgactggtcaggcggtgggagaaaatcaaaccgttcctcctcatcctttggtggccgctcatcatcctacggcagccgtggctcaccatcaccatccttcggtgtccgctcatcatccttgggcggtagggagagcagcagaagcttcagtggcgcttgtttcaactgcggcgaatccggtcaccgtgcatcggactgcccaaacaagtagatggcgcattcttccctgcccaagcaagtagacagctcgaccatcagggcgcacgcagagggaaaacccaacctctcccctgatggaccagtatattacccctgacaaacaagtacagtttttgtgtggctgtctcgtcagggatgaagattttggcatgccgattccagttatttaaatccagaggagtcctttcttttcagggatatcttgagtctcagtaaaatagggtaaccagtaaccccccccccgaacaatggcggaggcctaaaatataaaatcataactggcatattgcgcgcgttaaaaaaaaaaaaaaaaaaaaaaaaaaaaaaagaaaaaaaaaaaaaaaaaanctcgagggggggcccggtacccaattg

SEQ ID NO: 6824 - DNA, 2236 bp, Zea mays
ctggcctttggcatacccatgatcaagcaattaatcgagcaagacgatggtcggcgtggtcgcggccgaggtactcctcgggttctggttctagcacctaccagagagttagccaaacaagtcgagaaggaaataaaggaatcagcacccaagctcggcacagtgtgtgtttatggcggtgtctcatataatgtccagcagaatgcactctctcgtggtgtcgatgttgttgttggaacacctggccgcataatcgatttgataaatggcggaagcctccagttgggagaagttcagtatttggtcctggatgaggctgaccaaatgctcgcagtggggtttgaggaagatgtggaaacaatattacaacagcttcctgcaggcaggcaaagcatgttgttctctgcgacgatgcctagctgggtgaagaaactgtccagacggtacctgcccggcccgccgacgattgacttggttggcgatcaagatgaaaagcttgctgaaggaatcaaactctatgctatcccactcacagcaacatcaaagcgtaccgttcttagtgatctaatcacggtttatgcaaagggtgggaaaaccatagttttcactcgtcctcggggccggccggatgaggtatcattggcactgacaaacagtattgcttctgaggcacttcatggtgatatttcacagcatcagcgtgagaggacactaaatggattccgtcaagggaaatttactgttctagtagcaacagatgttgctgcccgtggtcttgatataccacatgttgatctgattatccattacgaattgccaaatgatccagaaacttttgtccatcgttctggacgcactggacgtgctgggaaagcaggaactgcaatcttgatgtttaccagcagccagaaaaggacagttaagtcacttgagcgtgatgttggttgcaactttgagtttataagccctccgtccatagaagaagtgctggagtcatctgctgagcatgtcattgctacattgagaggtgtgcacccagagtcaactaaatactttcttggagctgctgagaaattaacagaagaattgggacctcatgctcttgcttctgcactggcacatctgagtggattttctcagccaccttcgtcacgttctctcatcagtcatgagcagggatgggtgacgttgcaactaactagagaacagggatttggcagaggcttcttttctcctagatctgttactggttttctatctgatgtttgttcagctgctgcagatgaagttggcaaaatatacctaacagcagatgagaacgtccaaggagcagtcttcgatttacctgaggaaattgcaaaggacctgcttactatggagctccccccaggaaacacattaaccaaaatttccaagctgcctgcgttgcaagacgatggccctgctactgatagctacggtcgcttttcaaacgaccgaggttccaggaacaacaggcgttctaggggtggcggcgcttcaagaggccggggtggttgggacactgacggcgaggaccgattccgccgtggtggtaggagcttgaggtctgacaatgacagttggtcagatgatgactggtcaggcggtgggagaaaatcaaaccgttcctcatcattcggtagccgctcatcatcctacagcagccgtggctcaccatccttcggtggccgctcatcatccttcggcggtagggagagcaacagaagcttcagcggtgcttgtttcaactgcggcgaatccggccaccgcgcaacggactgcccaaacaagtagtaagatggaagagatggcgcggtctcccctgccgcacggggtcgatgatcctgattggccggagcatgcagagcgaaatcccaaagcccactccacctgctgatcggtgtactacgcccgacacccagccgacgttattactggctacagttttgcgtggtcgtctggcgtcggaaaacagaggaaggttttggcatcctgactacagttactacatcaagcggagttccttcagcttattcatgtcacacggacactactctacactacagggatatgttagtatttcttttatataagtatgtatttttttagtggtgctcttgattagaggatctcggtataactgtaaccacacgcactggttacggttgcttctgcgtcacaatcgctggcgacggttggattctttgaatgttat

SEQ ID NO: 6825 - DNA, 2673 bp, Zea mays
  misc_feature (880)..(880): n is a, c, g, or t
ttcggccggggtgtgtttatggcggtgtctcatataccctccggccgcccgccccccccccccccccccccgttgttgttggcacacctgggcgcataattgatttgataaatggtggaagcctccagttgggagaagttcagtatttagtcctggatgaagctgaccaaatgcttgcagtggggtttgaggaagatgtggaaacaatattacaacagcttcctgcggacaggcaaagcatgctgttctctgcgacgatgcctagctgggtgaagaaactatccaggcggtacttgaataatcctttgacgattgacttggttggagatcaagatgaaaaacttgctgaaggaatcaaacttcatgctatcccactcacagcgacgtctaagcgcaccattcttagtgatctaattacggtttatgcaaagggtgggaaaaccattgttttcactcgcacaaagaaagatgcagatgaggtatcattggcactgacaaccagtattgcttctgaggcacttcatggtgatatttcacagcatcagcgtgaaaggacactaaatggatttcgtcaagggaaatttactgttctagtagctacagatgttgctgcccgcggtcttgatataccaaatgttgatttgattatccattacgaattgccaaatgatccagaaacttttgtccatcgttctggacgcactggacgtgctgggaaagcaggaactgcaatcttgatgtttaccagcagccaaaaaaggacagttaagtcacttgagcgtgatgttggttgcaagtttgagtttataagccctccgtccatagaagaagtgctggagtcatctgctgagcatgtcattgctacattgcgaggggtgcnacccagagtcaactcaatactttcttggagcagctgagaaattaacagaagaactaggacctccatgcccttgcttctgcactggcacatctgagtggattttctcagccaccttcttcacgttctctgatcagttatgagcagggatgggtgacgttgcaactaactagagaacagggatttggcagaggcttcttttctcctagatctgttactggttttctatctgatgtttgttcagctgctgcagatgaagttggcaaaatataccgggcacctcgtggccgcccccaaggagcagtcttcgatttacctgaggaaattgcaaaggacctgcttactatggagctccccccaggaaacacattaaccaaaatttccaagctgcctgcgttgcaagatgatggccctgctactgatagctacggtcgcttttcaaacgaccgaggttccaggaacaacaggcgttctaggggtggcggcgcttcaagaggccggggtggttgggacactgacggcgaggaccgattccgccgtggtggtaggagcttgaggtctgacaatgacagttggtcagatgatgactggtcaggcggtgggagaaaatcaaaccgttcctcgtcattcggtagccgttcctcatcatcctacagcagccgtggctcaccatccttcggtggccgctcatcatccttcggcggtagggagagcaacagaagcttcagcggtgcttgtttcaactgcggcgaatccggccaccgcgcaacggactgcccaaacaagtagtaagatggaagagatggcgcggtctccccttgccgcacggggtcgatgatcctgattggccggagcatcaatcaggatgcacgcagagcgaaatcccaaagcccactccacctgctgatcggtgtactacgcccgacacccagccgacgttattactggctacagttttgcgtggtcgtctggcgtcggaaaacagaggaaggttttggcatcctgactacagttactacatcaagcggagttccttcagcttattcatgtcacacggacactactctacactacagggatatgttagtatttctttttttatatgtattttttttgtggtgctcttgatttgaggatctcggtataactgtaaccacacgcactggttacggttgcttctgcttcacaatcgctggcgacggttggattctttgaatgttatagatctgtatgctgtcttgcttcggacgtgaacttccatccctagattagcccccctttcgcttcttttggcacagaaaatactaccagacttcgttgcgttagataaaaaaggggggttggttacgctaccccgacccgggttgctctggcagctcgtcctcctgatctgaccttgcaggaacacgggttagtcaacgcggtcgcagcgcacggcacgactgcagggcgaaagtaaaaataataaaccatccaggggtgcaacatggtagtcggtggttggccgtcgaggcgaaacagccagccagaccccacccacccccggtggatgcgtcgcagcgtggtgtgttgtacatgtactagatggaatgcggggagtttgacagcgtggggagcttctggtattcagaactcacggccgatggagtgggtggcgaatgctataccgaacgatcctgcatgcagatagtatcaaaaaagacctgagcatgagactattcccgtcaggcgtgaggtcaaggtccatgtcccggccaggcctgtgtacatacccgctcccaaaaaaaaaaaaactc

SEQ ID NO: 6826 - DNA, 2258 bp, Zea mays
  misc_feature (2236)..(2237): n is a, c, g, or t
  misc_feature (2243)..(2243): n is a, c, g, or t
  misc_feature (2252)..(2252): n is a, c, g, or t
attcggctcgaggtggtgagctgttcgccctccctcccgcgcgcgcgctctccctctctctctctgctgtgcccgcggctattaagcccgttctggatgagtcggtgagggaggacgacgaggagagccggggtcatcggatcgctgccgagggttctccgtttgtgcgacagagaggtggaggtggtggtgacggtgtcagtgcgtgcgtgcgtgcgtgccaatggcgccgtcgtggtgggggcgggacgcgagggccaacggcgtcgttggcggcggcacgcccgtggtggtcaggatggagaaccccaactggtgcatctccgaggtcgccgccgcggcgtcggaggtggacgcgccgccgccggcggcggccgggggcggcaaggccgggcggcggggcaagaacgcgcgccagatcacgtgggtgctgctcctcagggcgcaccgcgccgcgggccgcctcacgggggcggcctccgccgcgctctccgtggccgccgccgcgcgccgcagggtggcggcgggccggaccgactccgacgccgacgccgacgccgccccgggcgagagcgcggcgctccgggcgcgctcctacggctgcatccgcctcttcctcgccctctcgctgctgctgctcgccgtcgaggtcgcggcctacctccggggctggcacctcgaggtggacgtgggcgccgggatcctcgccgtcgacggcctcttcgccgccgcctacgcggcctggatgcgcgcccgcctcgactacctcgcgccgccgctgcagttcctaaccaacgcctgcgtcctcctcttcctggtccagagcgtcgaccgcctcgtgctctgcctcggctgcttctggatcaagctcaagggcgtccggcccgtgccgccgctgcccgccgacaaggaggacgtcgaggccggtcccgacggcgtccccatggtgctcgtgcagatgcccatgtgcaatgagagagaggtgtaccagcaatccatcggtgcggtttgcagcctggactggccaaggtcaaatttcctggtccaggtgttggatgactctgatgatgctaccacttcggcacttatcaaggaggaggtggagaaatggcagcgagagggtgtgcgcatagtataccggcaccgggtgatccgggatggctacaaggctggaaacctgaaatcagccatgaactgcagttacgtgaaagactatgagttcgttgtcatcttcgatgctgatttccaaccacaggcggacttcctgaagcgcaccgtgccccatttcaagggaaaggatgacgtcgggttggttcaggcgagatggtcgttcgtaaacaaggatgagaacttgctgaccaggcttcagaacataaatctttgcttccacttcgaggtggagcagcaggtgaacggggcgtttctcaacttcttcgggttcaatggcaccgcgggagtctggagaatcaaggcgcttgaggagtctggaggatggatggagaggacgacggtggaggacatggacatagctgttcgagcgcacctcaaagggtggaagtttctctttctaaacgatgtcgagtgtcagtgtgaattgccagaatcgtatgaagcgtacagaaagcagcagcaccggtggcactcaggtcccatgcaattgtttaggctctgctttgtggatataatcaaatctaagatcggtttctggaagaagttcaacctcatattcctcttcttcctgctccggaagctgatactacccttctactccttcaccctcttctgcgtgatcctccccatgacgatgttcgtccccgaagccgagctccccgcgtgggtggtgtgctacatcccggcgacgatgtccatcctcaacatcctcccgtccccgaaatcgttcccgttcatcgtcccgtacctgctgttcgagaacaccatgtcggtgaccaagttcaacgccatggtctccggcctgttccagctggggagcgcctacgagtgggtcgtcaccaagaagtcggggcgctcctccgagggcgacctcgtggccctcgtggagaagcactccaagcagcagagggtaggctcggcgcccaacctcgacgcgctgaccaaggagtcgaagggcaccgaggaggagaagaataagaagaagaggaagaagaagcacaacaggatctacaggaaggagctcgcgctgtccttcctcctgctgaccgcggccgtttagaggatnnccaagncttacggtnacgcgt

SEQ ID NO: 6827 - DNA, 779 bp, Zea mays
  misc_feature (758)..(758): n is a, c, g, or t
  misc_feature (763)..(763): n is a, c, g, or t
cgggccgccccccaaccccagacgaaaccctagcctgcctcccaggagcgccgagtccctccgcccccaacagatctacgcgcgcgaggttcggttcggtcttcggagctcgagacatggcggaggagaatgccccagttgaggttgccgctccggttgcggcccctaccccagttcttggagagcccatggacttgatgactgctctgcagcttgtgatgaagaagtcaagcgctcatgatggccttgtcaagggactccgtgaagctgcgaaagcgattgagaagcatgctgctcagatctgtgtgcttgctgaggactgcgaccagcctgattacgtgaagctggtgaaggcactgtgtgctgagcacaacgttcacttggtcactgtgcctagtgccaaaactcttggcgagtgggctgggctttgcaagattgactctgagggcaaggcaagaaaggtggtgggctgctcatgtgtcgttgtgaaggactacggcgaagattccgagggtcttcacatcgtgcaggaatacgtcaagtcgcactagggacagccttccagtttccggattctgcaggatgctagtagcttcgttatgattgtgttccatgtctgaaacttgttagcctatgaaaattatcttgtgcggttttgtcgaatcagagtttcgtttctggtgctgggacatcatggcttgattgtcagagatacagatcttccagtttccatgttgtcggtgctatctctatattanatatngagtgtgttgattttc

SEQ ID NO: 6828 - DNA, 1040 bp, Zea mays
cggccgggccgggatctctagcctgcgccgccgcctccaccgcaccccccaaaaccctagcgctcgcttcgccccgccccaccaccatggccggcgcgcaggagtccctcgtctacgccggtgtgatgcgcggccacaacgacgtggtcacggccatcgcgacgcccatcgacaactcgcccttcatcgtctcctcctcccgcgacaagtcgctgctcgtctgggacctcaccaaccccatccaggccacccaggactccagctccgagtacggcgtccccttccgccgcctcaccggccacggccactttgtccaggacgtcgtcctcagctccgacggccagttcgcgctctccggatcctgggacggcgagctccgcctctgggacctctccaccggggtcaccacccgccgcttcgtcggccacgagaaggacgtcctctccgtcgccttctccattgacaaccgacagatcgtctccgcgtcccgcgaccgcaccatcaagctgtggaacaccctcggtgagtgcaagtacaccatcggcggtgaccttggaggcggcgagggccacaccggctgggtgtcctgcgtccgtttctcgcccaacaacttcgccccgaccatcgtctcgggctcatgggaccgctccgtcaaggtctggaaccttaccaactgcaagctccgctgcactcttgatggtcatggtggctatgttagcgccgttgcagtcagcccagacggttcgctttgcgcgtctggtggcaaggatggcgtcaccttgctgtgggatttgaccgagggcaagagactctactcgctggatgcgggatccattatcaactcactatgcttctcgcccaaccgctactggctctgcgcggcgacacaggattccatcaagattctgggatcttgagtcaaagcacatcgtgcaggaccttaggcccgaggtccctgtctcccaccaagcagatgctctactgcacttgcttgagctggaagcgcggatggcagcactctgtacgctggttacaccgat

SEQ ID NO: 6829 - DNA, 613 bp, Zea mays
cggaacggccggagggtgtataatatatgcactcgaggattcaggtgggtggatggagaggacgtccggcgaggacatggatattgctgtccgtgcacacctcaagggctggaagtttctgttccttaacgatgttgagtgccagtgtgaattgccagagtcatatgaggcatatcgaaaacagcaacaccgatggcattctggtccaatgcagttatttagactatgctttgtggatattatcaaatcgaagattggattttggaagaagttcaacctcatattccttttctttctccttcgcaagcttattttgcccttctattccttcacccttttctgtatcattcttcccatgacaatgttcattcctgaagccgagctccctgcatgggtcgtgtgctacattccggcaaccatgtccttgctgaacatcctcccagcccccaaatcgttcccgttcattgtcccctatctcctgtttgagaataccatgtcagtaaccaaattcaacgccatggtttctggcctgttccagctcgggagcgcctacgagtgggttgtcaccaagaaatcaggccgttcttccgagggcgacctcatcgcccttgtc

SEQ ID NO: 6830 - DNA, 986 bp, Zea mays
cacgactctcggcaacggatatctcggctctcgcatcgatgaagaacgtagcgaaatgcgatacctggtgtgaattgcagaatcccgcgaaccatcgagtctttgaacgcaagttgcgcccgaggccactcggccgagggcacgcctgcctgggcgtcacgcctcttgtttctggcgtcgcctccgtccggctccgcttcttccacccgtacccgtagattgatttccatccgggtcccttccgttccacggcaagtatccgtcgcacgattcaggcccacccctcgacgtcgtccatggcgctgcagtacgtggaggcgcagcggcaggcgcggccggacctcgccgactggtacgccgacctcgccgacctctaccagcgcaagctctggcaccagctcaccctcaagctcgaccaattcctccagatcccggccgcacagactggcgacacgctcatacagctctacaacaatttcatctccgatttcgaaacaaaaatcaatttgctcaaactcgcccagttcgcggtcatagggtcgcgccaatatcccgacaaggatgccgccatcaccttcctcgaggggataatcacaaagcttcgtgagaccagggagctgcggatcaatgagcctatccttcacgtcaagatgcagatcgcggcaattcacctcgacaaagggaaccacaaggagtgcaagaacctgctggaggaagggaagaccaccctggatggcatgactgatgtggatccaacagtccacgctagcttctactggatatcgtctcagtaccataagtcgctccaagagtttgctgagttctataagaacgcacttctctatctggcctacacaaccgtagggtccctctcagagtcattcaagctggacttggcatttgacctttcccttgcagccttgctgggggacaacatctacaactttcggggaattgttagctcaccctattatcaatagtcttat

SEQ ID NO: 6831 - DNA, 985 bp, Zea mays
cctctagtttcgacctgcagattggattttggaagaagttcaacctcatattcctggtccccccccggcccgcccggattttgcccttctattccttcacccttttctgtatcattcttcccatgacaatgttcattcctgaagccgagctccctgcctgggtcgtgtgctacattccggcaaccatgtccttgctgaacatcctcccagcccccaaatcgttcccgttcattgtcccctatctcctgtttgagaataccatgtcagtaaccaaattcaacgccatggtttctggcctgttccagctcgggagcgcctacgagtgggttgtcaccaagaaatcaggccgttcttccgagggcgacctcatcgcccttgtcgagaagcagcctaaacagcaaagggtagggtctgcacccaaccttgagtcacttacaaaggagtcttccagtctcaaaagggactccaaaaggaagaaacacaataggatatacaggaaggagctggcactctccttccttctcctaacagccgctgctcggagcctgctatcggtgcaagggatacatttctacttccttctgttccaaggggtgtcgttcttggttgttgggctcgatctaatcggtgagcaagtcgagtgatgcggtacaagggagagtaatggggtatctattttgctgcgagtggggggcaatgcgaccaaagaggcacttcaggtaaaggcaagcgcggtacatgatccaaagaagatttgattccggattaagaagggttatatagtttcatcggggggatacttgaaacggtgaaaatgtggaattgtggattgtagatataatatggcttgggactgtgggctgtaaaaggcttgggggttctaattcttttgtaagaaaaatcatcagtggttagatgggttattttgcttacttgacagtttaccttcaaagggggatactgttgggatccatgtgatttgggc

SEQ ID NO: 6832 - DNA, 826 bp, Zea mays
  misc_feature (729)..(732): n is a, c, g, or t
gggaccctcggggccgggaggccggggtttaggaacaacccatctccattcaccaacggcgcctccaactccgagcgccgcctctgcctcgaaaactcttactcgcggagctgcagccaggggggcgaccggtgtgtgaaccgctgccgctatggctgctgcttccgttccgccaacatcttcatccggcggctgggacttcacctgtaaccttgaagtcgattatgggtctgaagaaaatgcatccatagtctacagaacgttagcagttgacaaggagttgcagcctgacaaggtgaagagggagatgactctatcaggcagcaagctggccgtccacttcgcagccgtggaggcccgcttcctgcgagcatcgttcagctcatttgtggatcttatgggactcgtgacgaagctcgtcgaagaatatggtgtggccaatgcagggcattcttgaatcttgatgaacaatctcatacacggcattgcggagttgattttagttcgcctgtgagcaatttggagttttggacagtctttaccagtggaactgctcttgatctgtgtcaagctagtgtagtatttgcccttgattggtcaaatcctattcggaacggttaattcttttcggcaatgccgttgtgaaatgtatagatgatgaataggtaaaaattatctatatatcctcagttaggctttctccacaaaaaaaaaaaaaaaaagcggccnnnnactcgccgtcgtcttctgcggttctgccgtctacgcctccaatttggcctctctcccttgcaagccatgggtaaggagaagtcccacatcaaca

SEQ ID NO: 6833 - DNA, 8991 bp, Zea mays
ggcaacgggaaggcgttcgcatattgtaccgacaccggttaattcgtgatggctacaaggctggaaatctcaagtcagccatgacctgcagctatgtaaaggattatgagtttgttgttatctttgatgctgattttcaaccccagccagacttcctgaagcgaactgtgccccatttcaaggtttggcggacatcttttgcttgcattttcatctaaggatgagtccatgtgaattcaattgtctgactcattgtgcgagaggtttctagggcaatgaggacgttgggttagttcaggcaaggtggtcttttgtgaacaaggatgagaacttgctaactaggctgcaaaacataaacctttgcttccactttgaggtggagcagcaggttaatgggatcttcctcaatttctttggattcaatggaacggcaggagtgtggagaataaaggcactcgaggattcaggtggatggatggagaggacaacagtggaggacatggatattgctgtccgagcacacctcaagggttggaagtttctgttccttaacgatgttgaggtacttacacatatataacattttactttatggttatattatattgtgttaagacttgtgattacaaatgaagctgtgttgcatgattattctttcagtgccagtgtgaattgccggagtcatatgaggcatatcgaaagcagcaacaccgatggcattctggtcccatgcagttatttagactctgctttgtggatattatcaagtcgaaggtgtggacctttccttgctctctatgattatatgctcaacaataagttaacatgtttgcttttcggaaaattttgaacctttttttatgctggggctaaccgctaacctttcattccttttttttttgctgctgctcggcgtctggaaggagttcaacctcatatttcttttctttctcctccgcaagctcattctgcccttctattccttcacccttttctgcatcatccttcccatgacgatgtttattcccgaagccgagctccctgcctgggtcgtgtgctacatcccggcgaccatgtccctgctgaacatcctcccagccccgaaatcgttcccgtttatcgtgccctatctcctgttcgagaacaccatgtcggtaaccaagttcaacgccatggtctccggcctgttccagctcgggagcgcccacgagtgggtcgtcaccaagaaatcaggccgttcttccgagggcgatctcgtcgtcgagaagcagcctagacagcaaagggcagggtccgcatccaaccttggttcccttgcaaaggagccttcctccagtctcagaaaggactcccaaaggaagaaacacaataggatatacaggaaggagctggcgctctccttccttctcttaacagcagctgctcggagcctgatatcggtgcaaggaatacacttctacttccttctgttccaaggggtatcgtttttggtcgttgggctcgatctgatcggcgagcaagttgagtgacgggaatacaagggagagtaatggcggtatttgtttttgctgcgagcggtggcaatgcgaacagggagcacttcaggtaaaggccaggcccggtatatgattcaacgcaaacacgacaagatttggttccggattaagaggggttatagatggttagggatacttgaaacggtgtactgtggattgtagatatatggcttgagactgtggactggggtctgattcttttgtaagaaaatctttcagtggggtcattttgctttcttgacagtttaccttcaaagggggatactgtttgggatccatgtaatttggccagttagtacgaatgcaccctgaatgatacctcctcgtcgcttcttgttcgtttcttgaattctaacatgtggataaaggattgcgctaaggggaacccagaaaaagggaagaagatgttctgcatgagtgcatcagtagaatgcctacgggctctgtttgtgaatgcaagagcgcaagtatgagcgactactgctattgccgtcaaagcagttgacgatcggtgaatcggtgatggtggggtgaagctaacgaggaggaagatgagtttgaccccgacgatagaagtggttggcgatagcatttaatttgtcgctaagaccatgtccaataattcacattcaaaacactgtcagtgtagaatttgttagtgtagaattgcacagtttgttcataaagtggagtttaaatatatgtatgaagatgagaatgaataaactattagagataaaatagcctaacggacaacatcccgttttcaaaataaatcgtaaaaataaaatcagaggagaggttatctcgatcgattccgctttcgttttcaatctctactcggtcctcacctcgtgtatgctgtatggtacttgctacctactgccatgctgggctcgtccaggagagttgagagttaagcccgtcgacagcattatcgactaagtggccctacatgggcccagatcacatgcggctcacgaacggtaatcttccagcccacttgtccagcagtgatggtggagagagacagggtatcaggggaactggggaaggggtttaggaacaacccatctccattcaccaacggcgcctccaactccgagcgccgcctctgcctcgaaaactcttactcgcggagctgcagccaggggggcgaccggtgtgtgaaccgctgccgctatggctgctgcttccgttccgccaacatcttcatccggcggctgggacttcacctggtgactcttcccgtccctgcccgtcttccagtctccctgccttctatccctggccggcagtgtgcggatgcagtcagatttgcgtactgtttaggtacgtagcttccttgctcagctaatttgctgttacgattcctttgtgcactgcgaatgctgttgacggctgtgccctgccctgtgcgaggctgcaccgccatgcttgtttcatgttcgacggatttccttggagagaaactaacggttattgttaggcagaaaatggcagtgtataaacgaatgtctagaccacctaagttcggactctctttaggggccgtttggattcctttattttggaggaattaggatctacttaatagagtaggctatttagcttggaattttgacattccaccactttctaaaatctagatataagtttatctcaaattgataggatgaagcgtggaaattgatttattaatgtatcaccagactatgtttccactctataattgttagtcaaagatttaaaaggttagacttcttaaaatacacgcatgccttaatcaatgggatgaaggtacataggaaaaccgtgtattttcatgaatgattgttggggaaaaaccgactgaacctgtgggaattggtagcatgtagatgtagcttggcaagtccatccttattatgatttccagggaggggtaactcgatatcagtgtccatagctttgcttggttccccgattgacctcgacaccgtgctctgatgataatttgagatgatattttcctgatgggtcaaaaaaaaaaaaaaaagcaacgacttgatacatgttaccactacttccctaccgtgtaggagtattttgcttctgctgtgaatgatttctgggtagaactcacagcgcaccactgacatatcgtttggcagtaaccttgaagtcgattatgggtctgaagaaaatgcatccatagtctacagaacgttagcagttgacaaggaggtaaagtagccgtattctactggcactttgtgaactcgtccagttttcatcttgccgacagctttgcaactttatattgcagttgcagcctgacaaggtgaagagggagatgactctatcaggcagcaagctggccgtgttagtatatccgttctgtcatctctaactgtttttctgcgcgttcccgtgtcaaggctaaagactgaagtccatcttattttgcgaattcagccacttcgcagccgtggaggcccgcttcctgcgagcatcgttcagctcatttgtggatcttatgggactcgtgacgaagctcgtcgaagaatatggtgtggccacgggagggcattcttgaatcttgatgaaccatctcatacacggcattgcggagttgattttagttcgcctgtgagcaatttggagttttggacagtctttaccagtggaactgctcttgatctgtgtcaagctaatgtagtatttgcccttgattggtcaaatcctattcggaacagttaattcttttcggcaatgccgttgcgaaatgtatagatgaggaataggtaaaaattatctatagatcctcaagttaggctttctccacgagtaatgagtggtcttggtctggtctctggttgtggcctctccggatgatgctatatgtcatctcccatctccgttatcgtgtttctcggtaaaaaaaacgttacgagccgttttctctatgcagtggcagctacaccataaacataactgttatgatattgcaagactatcctaagataatataataatgcgcacaaacacgaggggtgtctatttcttacttttgatcgttagaaaaaacctagaacaagcactgataatagtggtcttactaatctaagcacttcgcaaaacaactacgttaattaacgagtaatttcttaagcatttagatgtttagagctattgtgtttgagtctcaactcaatggctattttttctcagctcctacacatctcaaatggctggtttaggatcctattaatagccttaaggagagatatagctgttgtactaataaaagccaactccactcaccatctgatcgtccaatggttgcactgttggaccaacgcctcacaacggctcttgtcagtattgtgtcaacacaggctgttgcccgactgtcagggccacgctctgtagtgtatagtgcgacgtcgttggaccaatttgacaccacacttttctatctggaacctttctgcgtgatcgttagactcgtctaaagtgttctcacgtccatgaacagttacgatctaagctactgtgagatgaatagtatgactgtatggtctaatgctctaatgattaatggtcttgtgatcacatcagatgtcctgttcttcagtcgactagtgtttggttctaccgtatagttcctttaaatcctttttttgttttgtttatttatgatttttgtgttcagcttggttctatcctgtgttcttagattcttgcataatcttgtaggtcatcaatgagccttctaatgtcttttttcaggtgttgattatcatgatcacctctttgctttcgtccaagtctatattacatcttttaaactatatcaacattagtgtataaaattattttaaacagttacgttgatcatcaaacatcaaaacataattgtcgaattagtcttggtctgttttccttacacgtgagtgctccaataagaattagtattgagtggcagctttctttctagccctttactttgagcatttgcatttgagaaaattaatgcttaaccttgcattactacaattgatatgctagaacaaggttgaaacctaatatatataatttttatggtagaaaggaaaacactcgtagaaacaaggaacagtgtgggctatccaatatgatttagttgtttcaagaaattagcctaattcacctcgattactccgctgtgaaaaaccggacaaaacacttcagagcttattaaaaaaaactcaaactgcaaaggctcatatgctctggcatgctttggtgtaggatacatgagaggattttttttaactccaatctaaatttcgttttcattgggaattaaattcagaacatgagaaatgctactcaattcatacaaccaactcaactagtgaccattttgcaccccggtgcttaataatcatcacaatgcgtataaaattagcctaactcacccctgactgtattccgctgtgaaaaaccgggccaacacttaggtgcttattaatcatcaaaatgcgtatgagcacttataaagagagacatgggacatttatttccatttagtcatactgtaaagagagacatgggatgagtaacttgatctagttgagtctaattatgtacggtggtgcacacttgtgaaaactggtgtcgtgtaaactcaagacatctcacaaaaagtttaaaagagagcactcaagacatcacacaaaaagtttaaaagagaacgcagcttaaaaaacaattgaaaagtctgagttagacagtttgcaattacactggaatgtatccggtgggagagactgggagagtgctcctctcttggattaatttgtccggtgatgaaatcggtttgccacacgaagaaagtagtcggctctctgcctccctcggtccctccagctttgtcgagtggttttgtcggatatcgacgtccgcccccgttttctcgattgaaactagacgccaagtcgccaataaccgtcactcacgcatgagcatgaccgcggctgtgccatttgtccgcgcagtctctctccgttcgttccaaaattccaaaactagcggccagctcacggcgatttctggcgtggcatgattagtacagccccaactgggccgctgacacttgacaaatctgtgtttttttttcttcgtaggtaccagcgttgaagaaacgctacaccccctagaggcaaggcaacactaccgtaggagaacagtgttcccttccctcccggctcccgctacagcaaaaccatcaacttcgaccgacacaaacgaccgcatcttggcaccattgcaccaatgggcgatggccgatggcccatcagccgccgcccgcgcgctttggccggatcaactctcaaacggctttcacaaatcacaactgggatgggaccgtggacgaatccctctcgatttccagcagcagaaatatgcgcgaattctgaccatttccctgcacggcccgtaccgaaaaccgccggcccccaccccacacgcggccacgccattcgccgaagcgagacaccgttaaacaaaaaaaaaaaaaaaacacacacacacacacacacaaaccccatcaagcgaagcaaatcgctgctacttttccaagatcagaacctggacttggccgcacctcgatttcagatagtgaaaatgaaaaagaaatggaaggattttgccgcgttcaaacgagtacgtacgtacaaaaggttacaggcagcccggaggaaacaacccagggtcgctatcattgtgctcatgagctcatcacactgccccacacatgccgacgtatagccatcgcgcgcgcagacctcctctctgtcactgcagctctataaaagtgccgcgaccgcgagccggaccggcacgcctcggctcgtatcgtactcatcacacatacacaatagttcgcagcttgtagtgctcgtccttgccttgtccctctctctccggggaatcgtagccaagtccacgcggcgcgcgtgcatgaagaagaagggcggcggcggcggcgggtgcctcggcgcgccgatgcgcgcgctgtcgcgggcgtgcgactcggcctgcgacctctacgtgcgcggcatgtccgggtgcgcgcgcggcgtgccgcgggggtcgtccgcgggcatcgtggggcggggcttcggcggcggcggctccggcgccgcgaccctgcgcctccgggtcagctcggacaaggccgacgacgacctcctccgcgccgcggcagcggccgccgccgccaggctgccagcgccgcgtcccggccgagccggacacggcgacagcagaggcccgtaaggtgggcagcgccggcggaggactgcccgtcagggcgccgcccgcgcggaagagggccgctgcggccaccatgggcaccatcgccgaggacgcgccgtgcgagttcgtcggactggacggcggcggtggcgcctgcgctgctcctgtcccctcgctcaacccgccgcgccgcgggggtttcgtcgccgtcaaggcggggggcgacgtctttgcgcgctgacccattcggctacgatcgccccgcccctgcagaatcagcttcgagtcatcccttatgtcatggcgccacttttctccctccttctctcgtctctctgtctatagcttgacgtgtaaattactctagggataactacgagagcagtgtatctttacgaaatctatgcatgagtgtgatttgattaccagaaattttccacaagtaccgttttagatggtcatgctcatgccctggttagtataacgacagcttaaacacgcaatgctacgtttataataggggtttgattctaacactccgatctccgaccactacttcctctccctcttccctatcttagggtaacgaaggtttatctaagttaaagttttaaaactttaatcaataatatctaaaaaacaattatttttaaattaaagcaaaattatatattgtgctagattttttaataataaatataatagttttatttttaaacaatttttgtaatcaatgtttatgaatattttgtttttaatggtcaaaatttcaaaactttgacttaggacaaactttcgtgactctatgatagggaacagagagagtactccaatagctcctgtcgcaaagtcccgatgtgagaaaacacctagggcttatttggaagcaaagagattgaaggagaatgagtgagttaaaattctttattattcaattctgaatagtaaaagattttagttccatcaatccctttcattactcttgctcccgaacaaactcttatgtacttaaatgttaaactaactagttgcccatgttttgctatggttgttatatatcatataaatatgtttttagggtttaaggtttagtattgagatatttattcaaatacaattattgtttatttttaaaccatggtatgtg

SEQ ID NO: 6834 - DNA, 1896 bp, Zea mays
accaaccagcgagaccagcacctaccacatcctacccctccaatccggccaccgagctagcacgacttgacgcccacactgccaaagtgccaagtgccactgcccctgccaccagcccaccaccagacccgccaccttcgcgctccacggcagcggcatgtccgtcgcctcctcccaccgcctgcgaccgtcgccgtcgggcccggcgcggcgcccgggatccgcggcgccgcgcgtagcgttctggccagccggtgcctcgcccccgtatcgcggccgctgcaccgtcgtggcggcggcggctgccgctggcgccggcggcgaggcatcttcggcccccgtggctgtgtcggctgtcgcccccgcgggcgctgccagggacaaggtgcggcgccacacgatttcggtgttcgtcggggacgagagcggcatgatcaaccggatcgcaggggtgttcgccaggagaggctacaacatcgagtcgctcgccgtggggctcaacaaggacaaggccctcttcaccattgtcgtctccgggaccgacagggtgctcaaccaagtcatcgagcagctcaataagcttgtcaacgtcctgagtgtggaagatctatctaaagaacctcaggttgaaagagagctgatgcttataaaactaaatgttgaacctgatcagcgtcctgaggtcatggttttagttgatattttcagagcaaaagttgttgatatatctgagaaaacacttaccatggaggtagctggagatcctggcaaaattgctgcagtgcagaggaatctatggaaatttggaatcaaagaaatttgcaggacaggaaaaattgctttgagacgtgaaaggattggtgcaacagcccgtttctggcgattttctgctgcttcttacccagacctgatagatgcgttgccgaaaaatccacttacatctgtaaataggacagttaatggcagttttggtcaaccatccaatgctgggggtgatgtttatcctgtggaatcttacgagagcttatcagtgaaccatgtacttgatgctcattggggtgttctggatgatgatgatgcgactggacttcgctcgcatactctctccatccttgtgaatgactgtcctggtgtcctcaacattgtaacaggagtctttgctcgcaggggctacaatatacagagccttgctgttggcccagctgagaaggaaggcatttcgcggattacaacagttgttcctggtactgttgaatccattgagaagttagttcagcagctttacaagcttattgatgtgcacgaagttcatgacattacccactcaccttttgctgaaagggaacttatgcttattaaggtttctgtcaacactgctgctcggaaggaaatcctagatattgctgaaatcttccgagcaaaacctgttgatgtttctgaccacacagtaacgcttcagcttactggagatcttgacaagatggttgcactacaaaggttattggagccatatggcatctgtgaggtcgccagaactggacgagtagcactggtccgcgaatcgaaggtggactccaagtacctccgcggctactctcttccactgtagccttgcagtcgtgatgatgatggcaccatgaagagctcggctggttgtttatagagcagaccatctcgcgctgggttgtgttgtgcgattacaggacttgtttctttcatgtcgtgaactcccccggcctgcgtgtccaataacgcgtgttgaggctgcatgtgtattccaacgactgtcagaataagatgcatatcgtatctgtttacttcagtgaagagatgcaggcatcgttcggaatccaaaaaaaaaaaaccaaacaaaaaaaaaagggcggccgtcgcgat

SEQ ID NO: 6835 - DNA, 1742 bp, Zea mays
gcaccccttaaacccgacggcatgtctctcgcctcctcccaccacctttagccgtcgccggcgggcccggcgcggcgcccgggctgccccgcgccgcgcgtggcgctctgccggccacccggtgcctcgcccccgtaccgcggccgctgctgcaccatcgtggcggcggcggcgcctgccgcgggcgccggcggagacgcggcccccgcccccgccgccgctgtgccggcggtcgcccccggtgccgccgccagggacaaggtgcggcgccacacgatttcggtgttcgtcggggacgagagcggcatgatcaaccggatcgccggggtgttcgccaggagaggctacaacatcgagtcgctcgccgtggggctcaacaaggacaaggccctcttcaccattgtcgtctccgggaccgacatggtgctcaaccaagtcattgagcagctcaataagctcgtcaacgttcatagtgttgaagatctatctaaagaacctcaggttgaaagagagctgatgcttataaagctaaacgttgaacctgatcagcgccctgaggtcatggttttagttgacattttcagagcaaaagttgttgatatatctgagaaaacacttaccatagaggtagctggagatcctggcaaaattgctgcagtgcagaggaatctaaggaaattcggcatcaaagaaatttgcaggacaggaaaaattgctttgagacgtgaaaagattggtgcaacagcccgtttctggcgattttctgctgcttcttatccagaccttatagaggcattaccaaaaaaaccgcttacatctgtaaataagacagtgaatggcagttttgttcgaccatccaatgctgggggcgatgtttatcctgtggaatcttacgagagctcagctaaccaagtacttgatgctcactggggtgttctggatgatgatgatgcaactggactttgctcgcataccctctccatccttgtgaatgattgtcctggtgttctcaacattgtaacaggagtctttgctcgcaggggctacaatatacagagccttgctgttggctcagctgagaaggaaggcatttcacgtattacaacagttgttcctggtactgttgaatccattgggaagttagttcagcagctttacaagcttattgatgtgcatgaagttcatgacattacccactcaccttttgctgaaagggagctgatgcttattaaggtttctgtaaacactgctgctcggagggaaattctagatattgctgaaatcttccgagcaaaacctattgacgtttctgaccatacagtaacccttcagcttactggagatcttgacaagatggttgcactacaaaggttattagagccatatggcatctgcgaggtcgccagaactggacgagtggcactggtccgtgaatcgaaggtcgactccaagtacctccgcggttactctcttccattgtagcctggcatttgtgattggtggtggacccgataaagagcttggtttgttgttatagatcagaccatctcgcgctgggatgtgttgtgcaattacaggacttgtttctttcatgttgtgaactccctggcctgcgagttcaataatgcccctttttaatgcgcgttgaggttgcatatgtatcccatcgactgtccgaataagatgcatagcataactgtttacttcagcgaagagagattcgaaaactcgaggaaaaaaaa

SEQ ID NO: 6836 - DNA, 1628 bp, Zea mays
acacctggtacattcaacttgtgtggactgtatgtttttggaatgtattgttgggttgggtgatacccaccatagtgcacaaacaaacataaatagtattaacaagcaagccattgcagtcttagtcatttgctcaatatgtagtttggactaatactaataccattaatgtttacagcatgctagttgttcagactttcatcagatgcatttgatacagtattacagtctgcacactagtcctggctcgtataacatgtagttttgactttggaactgtccagggtgatgtttatcctgtggaatcttacgagagctcagctaaccaagtacttgatgctcactggggtgttctggatgatgatgatgtaagtatagagatttccatcttgtgattggcatttagtgctacatggactatattgatgatttgctcgattctgtgcataattgcatccttaatctaattataatgtgactggagtgtgttctcatttacacttccattatgtttgcatgtgtcaatctgtaggcaaagcctacatagatttaaaaaatggtaataatgcttaacctgcatgtttatgaatactgttgttatcttgcagcggcttctccagtattgattttgtgtggtacaggcaactggactttgctcgcataccctctccatccttgtgaatgattgtcctggtgttctcaacattgtaacaggagtctttgctcgcaggggctacaatatacaggttttctttttttttcgaaaaagctcttcttgttgaatatagtagcaggttaattattaacaagtgggtacttgtcagagccttgctgttggctcagctgagaaggaaggcatttcacgtattacaacagttgttcctggtactgttgaatccattgggaagttagttcagcagctttacaagcttattgatgtgcatgaagttcatgacattacccactcaccttttgctgaaagggagctgatgcttattaaggtttctgtaaacactgctgctcggagggaaattctagatattgctgaaatcttccgagcaaaacctattgacgtttctgaccatacagtaacccttcagcttactggagatcttgacaagatggttgcactacaaaggttattagagccatatggcatctgcgaggtcgccagaactggacgagtggcactggtccgtgaatcgaaggtcgactccaagtacctccgcggctactctcttccattgtagcctggcatctgtgattggtggtggacccgataaagagcttggttagttgttatagatcagaccatctggcgctaggctgtgttgtgcaattacatgacttgtttctttcatgttgtgaactccctggcctgcgagttctataatgcccctttttatgcgcgttgagattgcatatgtaccccatcgacagtccgaataagatggcatacttgtttacttcagccaagacagattcgtaatcaaacaaataaaaaataaaaaaaataaaaaattggcgggccgtttataagaatcaaacttacattaatcttgtatgcaacggaaaaagtttatatattgttgtacctaaatttaaaatttactgtaccctatattttt

SEQ ID NO: 6837 - DNA, 675 bp, Zea mays
ttggggacctcgacccggccggacagaaaaatcaaatctttctcgcagttcacacacgggtcacggccgggacaaccatggcggcggctgactccactaagctctccctcgccttcgtcctcctcctctccgcgctcgtcgtgctcggcgaggtcggaggaagcatggcagccgactgctcgacgctccggtgcatccagggcggctacatcacctgcgacaactacccggggaagcagctggacgggtgcgactgcgtctgcgcgcccgacaacggccggaactgcgttctccacctccagtccggctccacctacaactgcagccgcagcaacaagggatagctagctagtcgatctcgaccagtcttcgacaataataatgcttcaagctgtacgctgtcgaatagtaacagttgtgctgaaacgaccgggtgatgcgcaaataatttgcaataaaactatttctctgttgtgttttaaagacactttaaaaaaaactactaaaatataaatagattccatggttccgcaatatgctaattgctgcccgcggccctgtagacaattaataagcaaaaatgtaggcgcaaacttcggaaagtcaggcaagcacatctacttcatactagaagcatcaagtccttctacaaaaaaaaaaaaaaaaaaagcggcc

SEQ ID NO: 6838 - DNA, 4451 bp, Zea mays
  misc_feature (1274)..(1274): n is a, c, g, or t
  misc_feature (2250)..(2250): n is a, c, g, or t
  misc_feature (3081)..(3081): n is a, c, g, or t
gagtgcacattaagcggtgtgcgccacctcaaggagcgcgtgaccgaggccgccatgggccatgccttcgtcctccagagcggcgaatgtgagtgcagcaacacacgacacacggtgatgggtgaaggcgaacacagatggggagaaaagagatttttttcaatttatgaaatgactaaatggcgttatagcgtgtgtgatatgtttgataatgacattcagataaagtccctcattaggatggcaaagtgacaaatcctacttctcataatgacataattccaattttctcttatgacaatgtattctatatgtagtgatactctcttctattactcacaaataaactaatctttaggagactcaacgtctcattggcttatttattttctcaaagtgccctcatattttctgcacctcctactttctccctcttccccaacaattcacccttgagttttgacaattgaatgagtgcagtaaatgttacggttactttttgcaactcaaataaatgtgcacccacttcaattaataaatgatagtatgatcttttttcttatactaaccatcctaaattcatgagtaatctatttattaaaggatagatagattaatttggtgtcataaatcttgacgtaatttttataaatccatataaagtttaaaagtttgagttaatactacacttgaatctatctagtcttaacagaagagctgcaatttatcctagaactgtaatgtcctactaatggtttgtttggattcaacagctaaaatgaaagcttaacttctcctgagaagccaaacgtaaataaaacgtgttctttttactattttagtcacttatagccttttctatttacatctttagctcctaaagtgactaaatttaagtcacttttgttttagtttatggaatagaaaaggccataaataaatgaaggggtgcaggacataaaagcagcaaaagtatcgaacgaatgcaagctcttgcatctgatgattttatcatcatggagaatgaccttgactatatttaacgcccgttttgttgtccttgagttttacggttttagagctagtttggcaaccatatttttttaagggatttttattttcttaaaagaaaataaactaatttctaataaaaaaaataaaaattccttgaaaaaaatgaggtttcgaaactagcctttacttttttttccctctctttgtcaaatctggactctggcctctgggcacaattccctgctgagctggaccaaaangcccctgcccgctcctggggttgtctgtggtccggttgcaccgaggaggcgcgacgcgcgagccatcatttctctcgtctgctcccgtgccctccgcggctccgccgcactcatcttctagtcttcttccctcccctccgtcaccactcaccacctcccctatggcatgggagcttctcccggcctcttcctccccttcctgccagaccatcttcctaccgcaacgcacctgacggtttccatccacctggcttccctgttgcgctagctgatcgacccacgcaacgcaagtgcaatgccgtgccgaggctagatcgagctgccgagcgctgatcacggtgaggccacccagatccacccgattgccacgcggacttcaccccttgccttttctcctcccgtccacccatcgggcgctttccctccatccctctctctcgtgcggcatctgggcgacccgccgacgcccctacgccaggtgcccaggccttcgtcgggtcctttaccggcgacgagcacacaccaggtttgcgcaccctttctcttccattcctgctgcgccaaaccgatcacaggaaccctaatttaatctatttgtatttggatctaccttcgatttttactgggtccgcccctgaccctaggcaacgttcatgtttttcctttaattggttcttcgggttcaattttggagcatttacatgccaccttaacatttttattccgtttcttccagggcactggagggctaccatctgcttcgctttctgaaaaaaaaacagtttcggcataattatcaccctaagatgcctggaattacaatggatggatttgttgcagaggaggtgccgaacagggtgaattcctctccacagaatgaaaatctgcccgccccaaattcgacggcagcttcaacaatggcgccaagcatgcaaagtgaggcacttgagatgcatgtcgagagctccggtactgnggagccctcaattgagcagctctacaacaatgtgtgcgagatgaagagctcaagtgagggtggctccctgtcacatgagagctttggctcagatggggaggagtctaggattgattcagagcttcgccatcttgttgctggggagatggaggccatgaaggtgattgaggaggaagaggagaatggtagtgttgccaacgttgtgccaccggttcccgctgagaatggaaccccagtaaaggagcagccttccaaatcgtccaacaagtcgaagaaggactcaaaatcacagcttgagtctgatgcctctgttggtcccaataggaaggcgtccactgaggaaggtgagagggaggtcagcaaacaggcaacccgagttggccgtcggcggaaatcaaatgccaatccacagaatggaacagaagatgctgggcttgataacccagaccttggtccatttcttctcaaacatgcaagagacttgcttgcctcagaaaactcacgtcgggcactgaaatatgctctccgtgccactaagacatttgagaaatgtgctggtggaaaaccaagcttgaacttagtcatgagtttgcatgttgttgcagcaatctactgcaacttgggaaaatatgaagaggctttacctgtgctgcatcgatctcttgagatccctgtaattgaggaaggtcaggaacatgctcttgcaaagttttctggttgcatgcagttaggggacacctatggcatgctaggtcaaactgcactctcactgcaatggtatgcttctgggcttgaaatacaaaagcaaacattgggagagcaagacccaanggttggagagacttgtcggtacttagctgaggcccatgtgcaggcattacaactcgatgaagcacaaagattgtgtcagatagcccttgacatccacagggagcatggcgggacagcctcactagaagaaacagctgataggaggctgatgggtctaatctatgacaccaagggtgatcatgaagctgccttggagcatctagtgatggccggcacggccatgatagccaatggtcaggagacagaggtggcctcagtggattgcagcattggtgatatctacctctccttgggccggtatgatgaggctgtgtttgcttaccagaaagctcttactgtattcaagaccagcaaagggcggacgcgtgggcggacgcgtggggtttttgtgcgcatagcggatctgtacaataagtcagggaagctgagggagtcaaaatcttactgtgaaaacgctctcaaaatttaccaaaaacctattccagggacttctctggaagaaattgccactggtttaactgatgtttcagccatatatgagacgatgaatgagcatgagcaagcactcaagttacttcagaaggccttaaaaatgtacaacaattctgctggccaacagagcacaattgctggaattgaggctcagatgggtgtcttgcactatattttgggcaattatggcgagtcatatgattccttcaagagtgcgattgcaaagctccgcacctgtggtgagaaaaagtctgccttcttcggaattgccctgaaccagatgggattggcatgcgttcaaagatattcgataaatgaagcagcagaactgtttgaggaagctagaacagttctggaacaagaatacgggccttatcatccagatactttaggagtgtacagtaatcttgctggaacttatgatgcaatgggcagacttgatgaggccatcgagatcttggaatatgttgttggaatgcgcgaggagaagctaggtacggcaaacccagatgtcgacgacgagaagcggaggcttggggagctattgaaggaggctggccgggtgcgaagcagaaaggcaaagtccctggagaatctgctcgagaccaacccatatatcgccaccaagagaaatgcagttgctgcatgaatcactgttctgaagatgaaaggcgaggattgttactaaggtattcaattggttcgttcagatgggggtaacgggaatattggtgcttacctattaagaaaatatgaaatgatcaaatcactgatctcaaattctttgctgtaaagttttcaaatactattaccgttacatgtacagtgctcttttataccgttcttgagaaaacgagtggtgggtacgcccctctttc

SEQ ID NO: 6839 - DNA, 3021 bp, Zea mays
  misc_feature (2973)..(2973): n is a, c, g, or t
  misc_feature (2992)..(2992): n is a, c, g, or t
ggaccctcgaggcccgccccgccgcgctagtctgccccctgctcttcgcggctctgccgcactcgtcttctctcttcctcttctctctgtctctcctaccctccgtcaccacctcgtccctatggcaagcgagcttctcccggcctcttcctaccagactatcctcctgccgcaacggacctgacggtttccctccatctggcctccctgtcgcgcgagctgatcgacccacgcaagcgcaatgccgtccagaggctagttcgagctgctgagcgctgatcacggtgaggccacccagatccacccgactgccacccggatttcgcaccttgccttttcttctctcgttcacccagctggctcgctcgctcctccctctctagtgggcaactgccaactgggcgactcgccgacgcccctacgccaggtgctcaggtcttcgtcgggtcttttgccggcgacgaacacacaccagggtattgtgtagagctatcatctccctcggtttcttggaagaacaattatttgacataattatcaccataagatgcctggaattacagaggatggacttgttgcagaggaggtgccgagcggtgtgaatttctctccacagaacgaaagtctgcctgccccaaagtcgacagcagcttcaacgatggcgggtagcatgcaaagcgaggcgcttgagatgcatgttgaggcctccggtgctggggaaccctcaatcgagcaactctacaacaacgtatgcgagatggagagctcaagtgagggtggctccccatcacgcgagagctttggctcggacggggaggagtctagaattgactcggagcttcgacatcttgttgctggggagatggaggccatgaaggtgattgccggcgtccgggagaatgggagtgttgccaacgttgtaccccctgctcctgctgagaatgggaccccagtaaaggaacactcttccagttcgtccaagaagtcgaagaaggcatcaaaatcacagcttgagtctgatgcctctgttggactcaatggaaaggcgtccactgaggaaggtgagagcgaggtcagcaaaccggcaagccgagttggccgacggcggaaatcaaatgccaacccacagagtggaacagaagatgctgggcttgataacccagaccttggtccatttcttcttaaacatgcaagagacttgattgcctcagaaaacccacggcgggcattgaaatatgctctccgtgccacaaagtcgtttgagaagtgtgctggtggaaagccaagcttgaacttagtgatgagtttgcatgttgttgcagcaatctactgcaacttgggaaaatatgaagaggctgtacctgtgctgcatcgatccattgagatccctgtaatcgaggaaggccaggaacatgctctcgcaaagttttctggttgcatgcagttgggggacacctatggcatgctaggtcaaactgcacactcactgcaatggtatgcttctgggcttgaaatacaaaagcaaacattgggagagcaagacccaagggttggagagacttgtcggtacttagctgaggcccatgtgcaggcactacaactcgatgaagcacaaagattgtgtcagatagcccttgacatccacagggagcatcgcgagacggcctcactagaagaaacagctgataggaggctgatgggtctaatttgtgacactaagggtgatcacgaagctgccctggagcatctagtgatggccagcatgtccatggtagccaatggtcaggagacagaggtggcctcagtggattgcagcattggtgatatctacctctccctgggccggtatgatgaggctgtgtttgcttaccagaaagctctcactgtattcaagaccagcaaaggggagaaccatgcaactgtggcttctgttttcgtgcgcctagcagatctgtacaataagacggggaagctgagggagtcaaaatcctactgtgaaaacgccctaaaaatctaccaaaagcctattccagggacttctctggaagaaatcgccactggtttaactgacgtctcagccatatatgagacgatgaatgagcacgagcaagcgctcaagctacttcagaaggccttaaaaatgtacaacaactctgccggccagcagagcacgattgccggcattgaggctcagatgggcgtgctgcactacattttgggcaactatggcgagtcctacgactccttcaagagcgcaattgcaaagctccgcacttgtggcgagaagaagtctgccttcttcgggattgccctgaaccagatggggctggcatgtgttcagaggtattcgataaacgaagcagcagaattgttcgaggaagctagaactgttctggaacaagaatacgggccataccatccggatactttaggagtctacagtaatcttgctggaacttatgacgcgatgggaaggctggatgaggccatcgagatcttggaatatgtggttggaatgcgcgaggagaagctaggtacggcaaacccagacgttgacgacgagaagcggaggcttggggagctattgaaggaggctggccgggtgcgaagcagaaaggcgaaatccctggagaatctgctcgagaccaacccgtatatcgccaccaagagaaatgccgttgctgcatgagtcactctgtcctcagatgacacggtattgtgatggaaggcgaggattgttactaaggtattcgtattcatttggtttgttcagatggggggtaacgggagtagtggtgtttacatatttggaaatatgaaaatgcttaaattgattgttgtaaagtttcaaatgctactgtttctccttttctactacctctctgaggtgcgagtttgcattcgtcagttggaacaggggcgtccttacttccatgcataaaaagaaaaaaaaagaaaacagcgtgccgtctnctagagggagtcccaaggncttacgtagcgcgggtgcagtgcgacgtc

SEQ ID NO: 6840 - DNA, 3663 bp, Zea mays
ttttcaaaagactgctcccgtgccctccgctcccccgccacgccccgccgggattcttcttccctcccctccgtcaccactcaccacctcccctatggcaagggcgcttctcccggcctcttcctccccttcctgccagaccatcttcctaccgcaacggacctgacggtttccatccacctggcttccctgttgcgcgagctgatcgacccacgcaacgcaagtgcaatgccgtgccgaggctagatcgagctgccgagcgctgatcacggtgaggccacccagatccacccgattgccacgcggacttcaccccttgccttttctcctcccgtccacccatcgggcgctttccctccatccctctctctcgtgcggcatctgggcgacccgccgacgcccctacgccaggtgcccaggccttcgtcgggtcctttaccggcgacgagcacacaccagggcactggagggctaccatctgcttcgctttctgaaaaaaaaaagtttcggcataattatcaccctaagatgcctggaattacaatggatggatttgttgcagaggaggtgccgaacagggtgaattcctctccacagaacgaaaatctgcccgccccaaattcgacggcagcttcaacaatggcgccaagcatggaaagtgaggcacttgagatgcatgtcgagagctccggtactggggagccctcaattgagcagctctacaacaatgtgtgcgagatgaagagctcaagtgagggtggctccctgtcacatgagagctttggctcagatggggaggagtctcggattgattcagagcttcgccatcttgttgctggggagatggaggccatgaaggtgattgaggaggaagaggagaatggtagtgttgccaacgttgtgccaccggttcccgctgagaatggaaccccagtaaaggagcagccttccaaatcgtccaacaagtcgaagaaggactcaaaatcacagcttgagtctgatgcctctgttggtcccaataggaaggcgtccactgaggcaggtgacagggaggtcagcaaacaggcaacccgagttggccgtcggcggaaatcaaatgccaatccacagaatggaacagaagatgctgggcttgataacccagaccttggtccatttcttctcaaacatgcaagagacttgcttgcctcagaaaactcacgtcgggcactgaaatatgctctccgtgccactaagacatttgagaaatgtgctggtggaaaaccaagcttgaacttagtcatgagtttgcatgttgttgcagcaatctactgcaacttgggaaaatatgaagaggctttacctgtgctgcatcgatctcttgagatccctgtaattgaggaaggtcaggaacatgctcttgcaaagttttctggttgcatgcagttaggggacacctatggcatgctaggtcaaactgcactctcactgcaatggtatgcttctgggcttgaaatacaaaagcaaacattgggagagcaagacccaagggttggagagacttgtcggtacttagctgaggcccatgtgcaggcattacaactcgatgaagcacaaagattgtgtcagatagcccttgacatccacagggagcatggcgggacagcctcactagaagaaacagctgataggaggctgatgggtctaatctatgacaccaagggtgatcatgaagctgccttggagcatctagtgatggccggcacggccatgatagccaatggtcaggagtacatgaggtggcctcagtggattgcagcattggtgatatctacctctccttgggccggtatgatgaggctgtgtttgcttaccagaaagctcttactgtattcaagaccagcaaaggggagaatcatgcaactgtggcttctgtttttgtgcgcatagcggatctgtacaataagtcagggaagctgagggagtcaaaatcttactgtgaaaacgctctcaaaatttaccaaaaacctattccagggacttctctggaagaaattgccactggtttaactgatgtttcagccatatatgagacgatgaatgagcatgagcaagcactcaagttacttcagaaggccttaaaaatgtacaacaattctgctggccaacagagcacaattgctggaattgaggctcagatgggtgtcttgcactatattttgggcaattatggcgagtcatatgattccttcaagagtgcgattgcaaagctccgcacctgtggtgagaaaaagtctgccttcttcggaattgccctgaaccagatgggattggcatgcgttcaaagatattcgataaatgaagcagcagaactgtttgaggaagctagaacagttctggaacaagaatacgggccttatcatccagatactttaggagtgtacagtaatcttgctggaacttatgatgcaatgggcaggtaaactccctacttctgaaactcaaatcgttgtctcaactaggtgttgatgattgtctgtgtgtctgcatgcataatgatttgcattccaattagtgatttgctggaaaaaggtactatggcaagtgggaattctttggtcttagtcgactcctcttccagctaggctcatgattagcatctgtaccagctccagctccttgctactccaattagtcgattagatattgatcggtacagtataaagttggatcaatttaattgaagcaggaccatcttgcatcatctttacttgcttatcactggctgctctgtaaagttgggtggcgcatactttatccttttgctttatatttttctatttgttttctccctccatattctcgtggaaacttcattcggctttgtaaggcatgtggatttttagctttatcatagtctgagtaaatctggctggatcagaaatgtcaacactagcttagctggctagatcagattgccgaagcaaaggtactatcctcctgagttactttagaagaagtatatcacctatcagcacccctgtgtcttgctaatatgaaaaaaaatgtgtttcattttagccacaattatctgttgatatttgccttttgtttcccagacttgatgaggccatcgagatcttggaatatgttgttggaatgcgcgaggagaagctaggtacggcaaacccagatgtcgacgacgagaagcggaggcttggggagctattgaaggaggctggccgggtgcgaagcagaaaggcaaagtccctggagaatctgctcgagaccaacccatatatcgccaccaagagaaatgcagttgctgcatgaatcactgttctgaagatgaaaggcgaggattgttactaaggtattcaattggttcgttcagatgggggtaacgggaatattggtgcttacctattaagaaaatatgaaatgatcaaatcactgatctcaaattctttgctgtaaagttttcaaatactattaccgttacatgtacagtgctcttttataccgttcttgagaaaacgagtggtgggtactgattctctttctctagctcaggtgtgagcttgcattcatcagttgtaccttggtttttattacattaaaaaaagttaatgccacggctaattcgatcgcaaaaaaaaaatccgagagagggggccggtaccc

SEQ ID NO: 6841 - DNA, 1749 bp, Zea mays
agttgggtacctcgaggccgccgactaggctattgccgccgccgccctacaccagatgcccagttcttcgtcagccccttctccggcaacgagcacctaacaggctgaaaaaaaatcattgatacacgtacgccgtcagaggctgcagtatattctgtgagaatggcatggggtcaaggtgctaagaggtccatactagggcttctctttcgttctcagcaccaaactgctcgggcatactcttcttcagcattccagactcaccaattgagcactcatgttccccaagatggagtgtttattaggagattcggctctgaggtgtcttcttcagagcaaatgaaccttattaagcaactcagacaaagaacgagtgctccaatcaaagatgtcaaggcctctctagttacctgcaactgggatattgaggctgcacagaaggacctaaggaagagaggtgttgctcttgctgccaaaaagtcttcacgcactgctgctgaaggtttgctagctatcgcacaagatgacaaaagggctgctgtagttgagcttaactgtgaaactgatttcgtagcaagaaatgatgttttccagtacctggcttcatcattggcaaagatggctttatctgctcagggtcctggtgaattgttcatccttttggtcctgagcttttagagaacatgcctatcaatctagatcaccctaagctcagtgtggaaacaactgtccaaagtgccgttacagaagttgctgcaatggttggggagaatgtgaaactcagaagaggcttcatgctttccacaactgcacatggtgttgtttcatcttatatgcatacctgccctcagccaggtatgggtcgtatagctggattggtcacactagaaacagaagacagcagtactcttcttgattctgtcaaaagtgttgggtcatctattgcgatgcatattgttgcggcaaagccattattcttatcaaaagaactggtttctgcttcggctttagaaaatgagcgtgaaatacttcgaactcaggcccaaagttcagggaaatcccaaatggctatggataagatggtggaaggacgattgaggaagtactttgaggaagttgtgctcatggagcaaaaatatgttttaaatgacagcactaacattaagaccgtgctgaatgacttgtcgaaagaggttggttctaaggtaacaatcggtaacttcatcagaatggaggttggcgaagggattgagagaactgaagccgctgatggtttagaggttgctggtggcgctatgtagattccaggcagagatggttcgaacgagatcattaggatctatatgaaggtcccacttctctaaagttggggggccttggttttttccaataaaacttttgggctctcatctttgctccattggattgttacaggtgtgggctaggacggagataatgtttaggcaggcactagcgttctgggacctgcgaggctgcctagttgatttgtcagttcctagcttgtttggttacagttttggttgaaccctctctgattgaattacagttcgtgtggacgtataaaaaatcgaaatagagtgggaattgccccttgaactcaaaaaaaaaaaaaaaaagtgaattagtgttagtgcaaagtagttgttttagctgtcatttttgtattaattaaactttgctagaatgacttgtgagtttgtaggataccttttgcaggctatctcgtgc

SEQ ID NO: 6842 - DNA, 2149 bp, Zea mays
cgaggcccccgccgctttcgttttcctctttcttctagtttcgtctagtcttcaaggaagaccggaaccgagccgccctgcccgaggacttgagccaccggacgcacggctgctgccgaaatccacgggagaatgacgatggccgaggccgaggctggtagggcggcgatccggcgcgccctgcggtcgctgaaacggaggcatctcgccgaggaaggggcgcacagcccggccatcgaggcgctaacccgtcccttcgccgcccacgctttggagtggaaggagaaggctgaaaagcatgagttagagctgcagcaatgctacaaggcgcaatcccggctctctgagcagcttgtgactgagatagaagaaggtaaagtatcaaaagcactgctcaaagagaaggaagcgatggttacaagtttgcaggctgaacttgagaagacaagcgaagagaatgtacaactaaagcagtcgcttgacgaaaaaataaaagccttagatcttctcattcaagagcatcagacagtgaaagccgagcttgaacaagcattgacgaaactaaaagctgcagaggatgagaaccaaaatctggttgatcgatggatgctagagaagatgaaggatgccgagaggctcaatgaggccaatgcgatgtatgaggagatggttctaaagctaaagacagctggagttggtggtatacaacttaatgcacagcaagaaactgatggcatcatacggcgttctgaagctggttacatagaaacgccaatcccatcaacatgcacaataactatccgtgctcatgatggtgggtgtggagctttgatgtttgagcataactcagacaagctaattagtgggggtcaggatcaagctgttaagatatggggtgcatctaccggcgccttgaccgccaccctgcatggttgcttggggtctgttaatgatcttgccgtgaccaacgataacaagtttgtgatcgctgcctgtagctccaacaagctgtttgtgtgggaagtcagtgggggacgtcctcgccacacgctgactggtcacacgaaaaatgtttcttctgttgatgcaagctgggtgaagagctttgttgttgctagttcatccagtgaccgtactatcaaggtttgggatctacagacaggtttctgcaagagcaccataatgtccgcgagcaaccccaactcgctagctttcatcgatggtgacaccatctgttcgggtcacagggatgggaatcttcggctgtgggatatccgcagtgggaaatgcaccacacagatagctgctcatctggatgtcacctcggtctgcgtgtcacggagcaggaattttgttcttacaagtgggagagataacgtgcacaacctttttgatgttagaacgctggagatttgtggaacattcagggccatgggcaacagagtggtgagcagctggggcaaaccttctattagccctgacgagaactgcatcgctgctggttcttctgatggatctgtttacatatggtcgaggctgaagaatggaacgccgaccatcctagagggtggtcattcttcgcccgtcctggcaagtgcatggtgcggactaggagctcttgctacctccgacaggaaccatatctatatctggtcttgagagatgtacaatttcatcaaggcgtggaaactggagagtttcgcatcatcagtatgctaatatgtgttctcttcatttcttgatgacactagttttcatgtgattatgtgaacgggttaactggttctgatttctggacgttgtaaatatcagaagtgattgttcatcgcagtgacgactacttcagttcgccatctgtgtgatggtttgcagaaaaaaaaaaaaaaaaatttattggtattgatggttcaggtttgctgttattttaaggctaaacttttgagacaccagtcagctcagcaaacatcgtccagcattaaggaaaaaacaacattggcttgggaatagttttcaatgttaattttgcttcaattaatttattaagcactacatgatcctttcttgtgttctgctgagttgggatgttctggccttacctttcctatatttgtatagttaagtcaggatggcaatggaatatcttgcagaa

SEQ ID NO: 6843 - DNA, 2882 bp, Zea mays
cgcccactcctactagtcggtgcgtgtgtgcatagagaactgagtctcgatgacgaaatatctccataatagcacggtatggatcatgaccttatggcaccctctatgtggtgttggcgagggcatgatgtggcgaccttgtcgtcctccatgactatcgtcccgtggagcagaacaatgctttatctccggctcatttggctccgatacaaaatataatgttagctggaactcttatccaacgatgattgaagcttcgacgaggatgaacggatcaccaagaactctcacgaacacgatgaatactctccatttcttagtgttgtacagccagacttattttctccttatattagctatttatttatctgcatcttgaccctaaaaaacaaacaacaagacgggttaagattaacgcgtatctctataagaaaggaaaaaagtaccaaaattcggaattacagatcacgtggggcaggcagatgaatccatggacatgatcgatcacaggtagaagtagcagcagtacgtagggtggctcgtgaacctcccagcaggccacggggccagcagcctgatgcgggcgtcgctcccttccacccgcatgtgagcagcggcggggcccgccggcggccggcgatggaggatcgatggcctccggttcggtctgcgtttatttgcgtgcgtaggttgcaactaacggccggccgcggccatatatatgcaatcaatttcccccggcccgggtccgtttgccttagctttcatttcatatatatatatatatatatatatacatgtcagtctctccccctgcagccttcaccttccacttcagcttcattccacttccacttggatcgatcgatcgcatatggcggtactgtggtggtggtcatcgtcctgcttgtcctcccgcgccgtcgctgctgcgctgctttgcctgctggtggctcacggcagcgatggaaccaggcacaacagcaacaatggcggtggtagtggtagttccagcagcagcaagagccacaagcaaggcggagggggacgagcccatgccgcgccgacgacaccgtctccgtatccgtctccgtctccggcggctggcaacaacagcagcagcgacgacgggtggctgaacgcccgtgcgacatggtacggtgccccgaacggtgctggtccggacgacaacggcggcgcgtgcggcttcaagggcgtgaacatgccacctttctcggcgatgacgtcgtgcggcaacgagccaatcttcaaggacggcaaaggatgcgggtcctgctaccagatccggtgcaaggcccaccctgcgtgctccggcgtggcggagacggtgatcatcacggacatgaactactacccggtggccccctaccacttcgacctgagcggcactgccttcggggccatggcaaaagacgagcacaacgacgagctaaggcacgcaggaatcatcgacatccagttcaagagggttccctgccagtaccctggtctgacggtgaccttccacatcgagcgtggctccaaccccaactacctggcggtgctggtggagtacgagaacggcgacggcgacgtggtgcaggtggacctgatggagtccagccccgacgacggcgagcccaccggcgtctgggagcccatgcgcgagtcctggggctccatatggaggatggacacccgccggccgctgcaggggcccttctcgctgcgcgtcaccaacgagtccggcaagacgctggtggcggaccaggtcattccggcagactggcagcccgacaacgtctacagctccatcgtccagttcgagtagcagtatatgccatgcgtcgtacatatagatatatatacactacacacacaacgcggtgtcagcagtaatttaagcaagtatatgcatcatcattaattccatggacggatcggatcgatgatatatatgtacgtaaagatagacaggcataagacgacgtctctacctagctagctatagctgctgaatacatacatatacttgtcgatcgagacgtcgcttgtgacgtccgtccagtgcattatgaatcatcttcgatcgatctgttgttggattatacatgctatatattcgtgataaagctttacccaactaaaaaaaaaaaaaagagccccgccaattagcgataatgatattcagtcaccatcatcatcatcgatggttccaaggccacacattacattctctagctagctagttagcgcgcgcatgcatggacatggacacggacagcatgcatccatcgcttttctcctttgtcaccttcacttgagcggcccgtgcgtgcagtgctggcgctttctttggtcttttgcgttggccctctgcatgctttccttggatttgcatgtcctcctctgtatctttgctttattcgcaccactcacggggtttttgttttaattcgcatgcatgccccgccgcctctctcgcatcgcatgccagccggctgcccgcatgctactatgccctagtacggtagtacccatccctctggctacccccacctagagctcaaaagttgggccggccttgatcatggtttaggctaccttttttcaaccagcacgatacaaaataattttagacaggttcgtgtcatacctagatactaaaagtttggctcgggtccggccaaaatacgacgggaagatgatcgtgccatgccggcccgactcaatcgaggctatcttttaaagaccaacacgtcacaaaataattttggattggatcgtgacgtgcttagatactaaaagttagatccgacctactgcgaagtacgggggccgatgatcgtgttaccgtacgaacaaaaaacatttatatatat

SEQ ID NO: 6844 - DNA, 1396 bp, Zea mays
  misc_feature (27)..(28): n is a, c, g, or t
cctcttgtccgttttttgtcgggcttnnccgattgggtacctcgaggccggccggggcagccttcaccttctcacttcagcttcattccacttccacttggatcgatcgatcgcatatggcggtactgtggtggtggtcatcgtcctgcttgtcctcccgcgccgtcgctgctgcgctgctttgcctgctggtggctcacggcagcgatggaaccacgcacaacagcaacaatggcggtggtagtggtagttccagcagcagcaagagccacaagcaaggcggagggggacgagcccatgccgcgccgacgacaccgtctccgtctccgtctccgtctccggcggctggcaacaacagcagcagcgacgacgggtggctgaacgcccgtgcgacatggtacggtgccccgaacggtgctggtccggacgacaacggcggcgcgtgcggcttcaagggcgtgaacatgccacctttctcggcgatgacgtcgtgcggcaacgagccaatcttcaaggacggcaaaggatgcgggtcctgctaccagatccggtgcaaggcccaccctgcgtgctccggcgtggcggagacggtgatcatcacggacacgaactactacccggtgcccccctaccacttccgccctgagcggcactgccttcggcgccctggcaaaagaccaccacaacgacgagctaaggcacgcaggaatcatcgacatccagttcaagagggttccctgccagtaccctgggtctgacggtgaccttccacatcgagcgcggctccaaccccaactacctggcggtgctggtggagtacgagaacggcgacggcgacgtggtgcaggtggacctgatggagtccagccccgacgacggcgagcccaccggcgtctgggagcccatgcgcgagtcctggggctccatatggaggatggacacccgccggccgctgcaggggcccttctcgctgcgcgtcaccaacgagtccggcaagacgctggtggcggaccaggtcattccggcagactggcagcccgacaacgtctacagctccatcgtccagttcgagtagtagtatatgccatgcgtgcgtcgtacatatagatatatatacactacacacacaacgcagtgtcagcagtaagtatatgatgtgcatcatcattaattccatggacggatcggatcgatgatatatatgtacgtaaagatacgatagacaggcatcagacgacgtctctacctagctagctagctagctgctgaatacatacatatacttgtcgatcgagacgtcgcttgtgacgtccgtccagtgcattatgaatcatcttcgatcgatctgttgttggattatacatgctatatattcgtgataaagctttacccaaaa

SEQ ID NO: 6845 - DNA, 1852 bp, Zea mays
ggagctcactagtccccccccccccccgggatgttgggccgatacacgctaatacccggggggcagaaaaatccccacccgaggcgtggaagacaccgtcgctctcctcgcgtgcgagcgccgccactgcatcttcccatcgatctccgccgaccccgcatcttcccatacgagctgtgtttctccaagttcgctgctggccatatcgacgtcgtcatcctcgatccagacgagtgcgtgtgccatctccacgggtcttcgacagatttagcaagaatgtttggaagaggatctcctaggatgaacttgatccaagctgcaactatgaaaaaaatatcccccagatctactactaacaagcgcaagaagagaacatcaccaaaagttggtcgtcttagagcaaactggaatagtggactagaaaagggtttagttgaaattcttcaagatcacaacaatgattgttataagggtcaaaatgggtggtcatcggaagcatggaatagaattgtcaagttattccatgagaaattctcttatgtcacatttacaaaatgccaaatccaagataaagagaaagagttaaagagagactacaaggctcttaaagaggcaaggcaacaaagcggggtatcatgggatgagaggttgtgtagaatagaagcagaagaacccatttggaataacctcaccactagtaacgagagacttaagaagtttcggactaaatctttcccactatttgaggctttaggagagctatatgatggaaatattgctgagggaaccatgaattttacttctattgagccttctcgacctcctgtcacacaaccttgtcaaggtgctgctacacagccttctcaagctgctttcacacttacacaaccttctcaaatcgctttcacacaaccttctctagctgctttcgcacgaccttctcgaaccgcttttagacatccttctctagccgctttcccacagccttctcaagccgcttttgcacagccttctcaaaccattttcacacagccttctgaagccactttcacacagccttctgaagccactttcacacagccttctgaagccactttcacacagccttctcaagccgctttcacacaaccttctcaagctaatatctcacaagccatttgtgatgaagatgatgagctcagagtattggatccaccagcccctgcatcagtgagcaaaagggcaaaaaatgttggtactggtaattcaagaacaagaattaacaagcgtacacaagatgggaatgtggttgagatgatgggaaggtttctagaaatgaaagaaaaacaagctgaggcggatgaaagggccacaactaatgcaaatgaggatgatttccctattcaaacatgcattgctattgtggatggaatggaagagttttctgatgatgagaaggttgattcttatgatgtttttaaggatgcccaaaaccgggccattttcatgactgccaaagatgctacgcgcataaaatggttgaggaagaagattgcaagaacatgatatgatatatgaagctaaagtaatgaaggatgattttgtagtatcgtccagcataaagaaagaaagctgcaatttgtgctattgtcagagatggatatttaactttagcaatttgcaacttttaagtaatctgttaaattaaagatgagatcttgcagacttttcttattacctaatggattctcttattagctgattcaaatctaatcatgcatattgtagtaaggactatgtatgttgaatcaatgactctggttcaattttaaatatcacatgtgttttaagtttctcaaaaaaaaaaaaaaaa

SEQ ID NO: 6846 - DNA, 2658 bp, Zea mays
ggtaccctcgggttcggccgcacctcggacccatcaggtgctgctgtgctgggcgagttctcccccccttccttgcttttgtctggcattcgctcgctctagtttcgcgcaacccggccgccgccgccgcctcgggtttctcgcctgtggctttgagccgagaggattggggactcggtttccttcctgctctgagttgggtttcgcgctgctcggactttcgccggcgggcgaataaaccggccggatgcttctgggcgctgcggccgcgaggatggaggagaagcgcgtgatcacggggagggagcgggaccagttccccgtcgggatgcgggtcctcgcggtcgacgacgaccccgtctgcctcaaggttctcgagaccctgctgcggcgctgccagtatcatgtaataacgaccaaccaggccatcaccgcgctgaagctgctaagggagaacagggacatgttcgatctggtcatcagcgacgtgcacatgcccgacatggacggattcaagctccttgagcttgtagggcttgagatggacctacctgtcatcatgttgtcagtgaacggggagacgaaatccgtgatgaaggggataacccatggcgcctgcgactatctcctgaaacccgtccgcatcgaagagctaagggacatatggcagcacgtcgtcagggggcgcgtggggcaagcgagagcgcagcaaccttgacgtctacaaagatttcaacaggctgccaggcgcggatccatgccacagccacggccacggccacggccagaccactgccggggcttccgaccagagcgggaggatcggcaggaagaggaaggaaatgcacagcgacgaggaggacgacggcgaggagaacgatttccaggagggcgacgagccctccgcggctaagaagccgagagtcgtctggtcgattgagctgcaccggaaattcgtcgcggccgtcaaccagcttgggattgataaagctgttccgaaaaggattcttgagcttatgaatgtggagaaactcaccagggaaaatgtcgcgagccatctacagaaatacaggctctatctgaaacggttaagtgctgtggcatcacagcaagctagcattgtcgccgcatttggaggtagagacccctttctccacatgggagcctttgaaggccttcagagctaccaacctttcgccccctgtgctgctctatcgtccttcatcccacaccacggctcgcttggtagaactaccgcggcagcattcggggtcccggagcttgctcctgccatcacagttcaagctgctgccagcaatggcatgataagccactgtgctggcgacgcaagcaagtttcagctctccggtatacaagaaaaccagcaaccaaatctgggacaaggctcggccacctctcttgggctgccccagctccaacagaagtggatccagcaagaaactggcgacttgtctgctgtcttctctgggagtgcactggctaacactctgtctggtgcactccagagagttgcgagcagtccattgccaccgcaagaacttttggagggcgtacaaaccaaagttagtgcccagccaccaataacaatggcatctgtgagttcagaacttgttgagaggactgttggagtttcggctaatttgcaggactccggtatatccccgcagggcactcttccaataaatgatggatttactgctgacaagttacagctgcaagatccattcgacagcaatggtggaacaaatttttcagtaaacatgcctgtttgtccctctggtagccttacagcatccagcaacgccaagggtggtgctagttcgtgcagtccagtgctgctcgctcctgatactgggagacattcaaactacttgcagtttggagttgcaggcaactctggacatgacatgaacgatattaaacaggaccatctgcatcaaggattgagcactggaggtttcaatcacgattttggcacctgtatgactgaacaaacagatccaaatgtgccgtatcttatgccacaaatgaagcctaacaccttgtcatcagaggataaactgaagcagaggaatatttatgatttggggattccaaagctccatggtggttttagctctagtagctgcaattttgatggtcttctcaattccatgatcaaagcggaaaaggatgatctctcattcacggatagcgacctggggtgcgacttctttccactcggtgcttgcatatgagacctcttaacaacccctcgtgcagattggccctcgacgggatgggatgggactacggcctacgggagaggttgtaaagtacactgcttaggagcattggccagtttatgctgcctaatgtgttactatgcttggtactgtgcacactagaaatgctagggatacaggtagctacggacatgccttgtaatctacatttcctcctcttcgaatgggaaatgaaagtgattatggttaggtaaaaaggagcaagtataatgctccaaattaacatcatcttcatcttaaaattttaccaaattttgtttccaagtgtcattagctcaaaactagaccattaggtgcattgatgacacgtataatcgaaaatattgtaatagtccttcctttggcagtgatt

SEQ ID NO: 6847 - DNA, 3352 bp, Zea mays
  misc_feature (74)..(74): n is a, c, g, or t
ggcaagtagtgtcacgtaagtaaactgaacttttatatctcatcgaacattctgagggcaaaatcgtactgttnccgtccagtttgcatccgttacaaaggaaatagacggcttttttttttttttttgaggataaaaaattgctttctaatggcactgaagcagtgacaactttttgagtagttcgtctgcaattcagatcttttataatggcttcaaaggaattgtctgaaaaaatcgcaaatcccttccctccaccatcgatcgggcttccatggccgccaagcgccgcgcccggcagccaagaaccgaagattccaaggagttgggcctcaatgggggcaacgaaggttccgacgaggaggaggaggagagcagcaagtccgacgcgctgaagcgagccgagcaaccctcgccgccgtcgccggaggatgctgaggccgagagatccggcgaggcctctccgcagaggagcaagccgcgcggttgggttgctatgaagaccaagacgacgacctccaagcgggtcaagaaaccctctccggcgtcggagaaggaatatgaggcgggggactcgggtgatttgtcaccggcgagcgacccgctacccgacaacatcgttgacgccggcgacaacaagatgcccgcgacgctgaagccgggcaagaagagctccccgacgccgcagcaggaggaagagcgcccggagaagcgtgctgcgggatctgatggcgagaccgtggccacgtcgtccccgcagcgcaagaagaaaagtaagaggtccgtcgataaggacaggcgcaaaaagaacaggaatcagattagaaaggcgttgacccaagaagacgaggaccatgacacggtgatggcagagcaagagcagagcaacacctcactgccacaggacgagcacgccgcccgtgaagaggagcaagaggagaagatggcacagcaagagcatgccggtgacacttcacacccgcatgacaaggacatgcgcagcgcccatggagaggagcagcaggatgcaaatcaagagcatgcggatgacacctcacccgcagaagacaatcacagtgtggatgaagaggagcagcaagtggagccgatcccacagcaagagcaacctaatgacacctcacccccacaagagaagaaccgagcccaggaggatgaggagacaggagctcaagtgaatggcaaagccttggaggggaggaatgctccatcaaccaagttgcgcagttttgagtcagagaaaaagccagcggtcgagcgatcatggtcctacgatgacgagctcaagatcctcaatgccttggttgagcacgcccagtcccataacggttctttgccagactcgtcgcatgttttggccaatctcacctttgacaaaattgatgccaatgaggacaagctcactgacaagatccgcaagcttaggacacggtaccgcaggtggcttttacaaggctacacatcttctgtttctggtagtcagttgtttaagctgtctgaaattctctggggccaagctgatgaagatgaacaggttgagccaacatctagggacttcagtgtagtatcaaaactgtatcctcacctggccaaagaagtcaaagcatatgccgaaacgcacagctcgggtgacttaatcatgggaatggtcatgaccatatgtgataagaaggcccgcgatcttgacgctaagtgcaagaagcaacagattgaaacattcaagctggagttgggccaagcaaacctaaccaacgaattgctctctgcactttcaagtcagacccatgtgaaattctagtaaaggtctctgctatcttttgttttagtgtaatgagtagacgtgctgtcattaggttaatgtgggaccaagaaccttcttttggggtactggaaaactcttatctgttaactagttagttgcttagctttgatgtctgtttctgcatatggaagtagctgttacagctcgatggtggaaaacagtactttaacatttaagtatcatgagcttagtgatctaatcagactgcttgtgtgatttattggttttatgatctgttgttgtgttagcttgtgtatgggatgagagtttatactccatcaaaagaaccaaaattacttgttatttactattacttggcaaggacttgggaaaaaaattccaaaaggtctaatggccctcagcatataagaatttatggctgcatttctgttcgtatggcattcactagtgttgtgaattatcgtggttaatgttgggcttggacctttatgttaatccttgtactgctagaccagagcacaccttttatcttgtttgtttttacctcacattgaattgatttctgtgtatgatgtattttgctgaactaaatttgcacttggaagttccatagagccatagattagtgattaaactgctctagggccttattgttggttcggttgctgctcaccttcgtaaacataacctttgcatttgctgatgtagcttacctattgcttttgttgtgccaatgacatcctggtcacagcagcatttgctgaaacctccatttttttccagttcctccatggtggtggttgttagttatttaaatttatgtatcattctgaaatttacaatttgttgataaatatttgacaaaaaagctagttgttgatcatgtgccacgcacttgtttcagcaaattcggtctgtcatctagatttcttcctggtgctgggagaaatctagatttccttgagcttcgtgcattgatttatcaaatgtgttgatgcatattatgttttatttttgaactgtttggccgctcttgctagtcacaccagccatggtcaggtcgcccgcgctacaggctgcagccggtcggacgtcgtgtcattggtggttaattaatcctaaactcatctaaaaacatgttttgtggagtacccatttgatcgcttcaccaaaatggtggagttaatcccaactccacattattttgggaggaaagctgctagtgttagcagttccaaacaccctcttactcatcctaaaccaagagtgcaggttactagcagatcacaacgtactttaaccagtttactctgacagtatctttcctgagacatacttgtcttgtttaaattttatctatggccagctttcgtgcaaagactaagctaaggttgtatgatgggaaaacataaattgttttgtaggatttctgtggactatgggataaacacaaaaaataatacaaagagaacaaaaaacctcacgagaaatctgatatctgaaaccacttgatagaaggattaggtccgatcttctaaaaggtaagttgat

SEQ ID NO: 6848 - DNA, 1646 bp, Zea mays
cttggctcaactcgatttgataaaattttgggtccgtggatacagaaggctggtgctgttttcctgccgcgacgcgtcggtgccgccagtaaaaaaacttgtgaagcgcggaggacgagtgaaacccactgacttttaaccgaagggattcacagtagttctctaaataagtccctaaatacaaatttaatttttttttcctccaaccattatgtaaaataaatggttaaatttataaagtccctacctaatcctatattgttgctaaatgtagcaaccccttcttcactccataaatatacatggatccaacaaaatatttggcaactaaaatagaaaactattagagaacatataattttttttacttcctctaatcctcttattgttaagcaactccatgcgtctgtttttagagatgccccagctgtcattaattgattggagtcaagtcaaatcataggttttcgttttgcatgcacaggcacagttgggcccgaagtgtttcatgtcaaagcccgccggccaaacttatcagcgacccagcacccctcagtccctcagcgactctggggctctgggctctgggctctggcctagcctccactgtctcccagtccccaggtcctcatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcctctgccatacccttttatgttacggatttgatgaagaataatagtttgatgggaaaaacctgccattggttaacttttgttcttttgaatgtggagtgtaatggatgctgtaatgtggaatcccgttgcaattaccgcagttcaatgtttcatggttttaagttttgtactctgatgaatagttgattggtcttttcatttccatcttcagaagaaaatgcagaacaatagtagaatacgcagactggtctaatgtaagcatgtgcctaaacgattttctatgttctctcagagttcttgatgtgcctgcaaggtactaggtacatgtgtagtaactcatagttccgaaactgaaaatcttttgatgcc

SEQ ID NO: 6849 - DNA, 952 bp, Zea mays
ccgggaaaaaaaaaaaaaaaaagcgactctggggctctggcctctggcctagcctcctccctccactgggtcccagccgcccggccgggatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgccaaggtcgccgatcgcatcgtgcgcgttctcgccatcgatctcgagggggggcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcctctgccatacccttttatgttacggatttgatgaagaataatagtttgatgggaaaaacctgccattggttaacttttgttcttttgaatgtggagtgtaatggatgctgtaatgtggaatcccgttgcaattaccgcagttcaatgtttcatggtttgaagttttgtactctgatgaaataggtgattgggcttttcatttccatcttcagaagaaatgcggccctatagtagaat

SEQ ID NO: 6850 - DNA, 950 bp, Zea mays
atatagagggagtaggaaataaaaaacttgctctccgattcccgagatctccccaatccccaggtcctcatcggcctcctctctctcggtctcgccagatctccccacggaaccctacccgagcatcagccatggcaatcgcggcgcgcgccctgcgccgcctcccgcttcacctctccccctcgatctcccgctccttctgcgcggtttccccggccgccgcctcggctacctcggcccccgccgccgcgtccgccaaggtcgctgaccgcatcgtgcgcgtcctcgccatcgatcccgacggggcgcgccgcgatgtggtcggcctctcggggcagacactccttcgcgctctggccaacgcggggctcatcgagccggcctcccaccgcctcgaggatatcgacgcgtgctccgccgagtgcgaggtccacatcgcgcaggagtggcttgacaagctgccaccaccgtcctacgaggagcgatacgtgctcacgcgcgcgtccaggaaccgcgagctcaacaagcacgcgcgcctgggctgccaggtcgtcctcgcgccggagctgcaggggatggtcgtcgccatccccgagcctaagccgtgggacatcccataatggcctgccgacgaaaggtaaggtgcggcttttgacgctgtgagccttccttaattcccttggctcggtcaagctgtgcgcctgtgccatccccttttatatgttacggatttagtgaagaataataatttgatgagcaaaacttggcattggttaacttttgttcctagtatatggatgctctaatgtggaatccttttgcaactaccgcagtttaatgtttcatggtttgaagttttgtacattgtgatgaatggttgattaatcttttcatttcctaaaaaaaaaaaaaaaaagaatatgaaacttggtcttgtataagcatgtgca

SEQ ID NO: 6851 - DNA, 913 bp, Zea mays
tgggaccctcgaggccggccgggcagcacccggccggccgggagcgactctggggctctggcctctggcctagcctccactgtctcccagtccccaggtcctcatcggcctccggtcttctggtctccccagatctcccaccggggaaccctacccgagcatcagccatggcgatcgcggcgcgcgtcctgcgccgcttcccgctccacctctacccctcgctcgctcgctctttctgcgcagtttccccggccgccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcctctgccatacccttttatgttacggatttgatgaagaataatagtttgatgggaaaaacctgccattggttaacttttgttcttttgaatgtggagtgtaatggatgctgtaatgtggaatcccgttgcattaccgcaaaaaaaaaaaaaaaaaaaaaaaaaaaaaaaaaaaaaaaaaaaatta

SEQ ID NO: 6852 - DNA, 1367 bp, Zea mays
ctcatacccataacggatataaaattttgtccaaactcatgcttatgcgggtttcgaatatccaatggatttaccacccactaacattaatataaaaaataattcatcatataaatgacagtcaatacattaataagccaggataaaaaacaagcgatgaatagttttagcttaaactttgttagatgaagtttatttcgattagaacatatttaattaatgatattatgagacatatttataagaaatgttgatggaatcgaacactgtttaatacccactctgttgcaaattagtaatcgttttagatcatcatttttatatctatcgaaacaaataacaacgagtacggccacatatacaaaacgcatatatcagttattgaatgaattttttaaagggcaaaaacaacttctattttggaatagagggagtagggaaaaaaacctgctctcccaatccccaggtcctcatcggcctcctctctctcggtctccgccagatctccccacggaaccctacccgagcatcagccatggcaatcgcggcgcgcgccctgcgccgcctcccgcttcacctctccccctcgatctcccgctctttctgcgcagtttccccggccgccgcctcggcccccgccgccgcgtccgccaaggtcgctgaccgcatcgtgcgcgtcctcgccatcgatcccgacggggcgcgccgcgatgtggtcggcctctcggggcagacactccttcgcgctctggccaacgcggggctcatcgagccggcctcccaccgcctcgaggatatcgacgcgtgctccgccgagtgcgaggtccacatcgcgcaggagtggcttgacaagctgccaccaccgtcctacgaggagcgatacgtgctcacgcgcgcgtccaggaaccgcgagctcaacaagcacgcgcgcctgggctgccaggtcgtcctcgcgccggagctgcaggggatggtcgtcgccatccccgagcctaagccgtgggacatcccataatggcctgccgacgaaaggtaaggtgcggcttttgacgctgtgagccttccttaattcccttggctcggtcaagctgtgcgcctgtgccatccccttttatatgttacggatttagtgaagaataataatttgatgagcaaaacttggcattggttaacttttgttcctagtatatgatgctgtaatgtggaatccttttgcaactaccgcagtttaatgtttcatggtttgaagttttgtacattgtgatgaatggttgattagtcttttcatttccaccttcagaactatagtagaatatggaacttgctcttgtataagcatgtgcctaaacgattttctatattctttc

SEQ ID NO: 6853 - DNA, 2382 bp, Zea mays
gcacgagaccattacctagaacatcctaatcgaaaaatatcaacaacattacaacaaagtaagcatgctcttggttggcagtagttaccacttgataaaaagaagagggagaccatgtgctttggcttcctctctgagccatctttcttgctctagccttaggccttagcaatggagatcagcgacgagcagaggatgcaagtggagtgccagcgccttccgccttcctggcaaggcaacggatcagacgccgatgtcgaagtggatcatcatctgtggccgtcaaaagatggccctcttccaatattccttaagtttgagaacgtggagtacagggtgaagatgaccttgaagaaccccctcacagcggcgagagtggcgtttgcgtcccagacgagggcagaccagggcagcagctgcaagcacatcctcaagggcatcgctgggagtgtggaccctggcgagatcctggcgctgatgggtccatctggcagcggcaagaccaccttgctcaagatccctggggggcaggcttggtggcggcgtcaagggccacataacctacaacgacactccctacagcccctgcctcaaaaggaggatcggatttgtgactcaggacgacgtcctcttcccacagctgacggtggaggagaccctcgtgttcgccgccttcttgaggctccctgcctgcatgtccaagcagcagaagcgcgacagggtcgacgccatcatcgccgagttgaatctagagaggtgccggcacaccaagatcgggggagcgttcgtgaggggggtgtcaggaggcgagaggaagaggaccagcatcgggaacgagatcctcgtcgacccgtcgctgctcctcctcgacgaacccacctccggcctcgactccacatcggcgagcaagctcatctttatcctccagcgcctggccaagacgcggaggacgatcatcacgacgatccaccagccgtcgagccggatgttccacatgttcgacaagctgctgctcatctccgacgggcacgccatctaccacggcaaggcccgggactgcatgcaccacttctcctcgctgggcttcgtcccggagatccccatgaacccggccgagttcctgctggacctcgccaccggcaacctcgacgacatcagcgtccccgaggcgctgcgcggctcgccggacccgcaggagttcaggtcccaggtcatcaggcacctgcagctcaagtaccgggcgggcgccgaggctcccgcggggagaaggacgcccacggagcagctgcgtcttgctgtgcgggcgcataacaaggaccgccgccggcggagcatcggctggctccagcagttcgccgtgctgtcccggcgcacgttccgggagcgcgcgtccgactacctggacaagatgcggctcgcgcaggccgtcggcgtggcgctcctgctgggtctcctctggtggaagtcccagaccgggaacgaggcccagctgcgggaccaggtggggctcatcttctacatctgcatcttctggacgtcgtcgtcgctcttcggctccgtctacgtgttccccttcgagaagctgtacctggtgaaggagcgcaaggcggacatgtaccggctgagcgcctactacgccagcagcacgctgtgcgacgccgtgccgcacgtcgtgtacccggtgctcttcatggccatcctctacttcatggccggcctccgccgcaccgtgccgtgcttcttcctcacgctcctcgccacgctgctcatcgtgttcaccagccagggcaccggggagctgctgggcgccgccatcctcagcgtcaagagggcgggggtcatggcgtcgctcgtgctcatgctcttcctcctcaccggcggctactacgtccagcacatccccaagttcatccgctggctcaagtacgtctccttcatgcactacggcttcaacctgctgctcaaagcgcagtaccacggccacctcatgtacaactgtgccagccggggcggctgccagcgcctccagtcgtcgccgtcgttcggcaccgtggacctcgacggcggcatgcgcgaggtctggatcctgctcgccatggcgctcgcataccgactcctcgcctacttctgcctcctcaagcggatcagcctcacgcccttgtgatcatccacctaattaaattggggcgcaatttcgcatgcctgggaaatgcctgcacggcgatgtgtatcaggctatcagctatactttgcagactgctaggcctaatttacgaggtgtatttgtctgacacaagttttagaagagtgaacaatgacctagtatttttagattatataagtgtttatgctatccgttcctaatcaaaaaaaaaaaaaaaa

SEQ ID NO: 6854 - DNA, 1562 bp, Zea mays
  misc_feature (638)..(638): n is a, c, g, or t
cgatgacgaagattaatgtatcaaattcagaatgccacggagcatccgaacgatgacgaagattaatgtatgcatgctgtagagttgccggtcatactttgcttgtttattgcgtgaggggcaaaactgtcttgtagaccacaaatagatggagatgaattagaaaaacgaagcaaatacggttaatggcaggttaatcaattagtagatgttcatggtcctgtttctacgaaataaatgtttgggatggcaataatgttaagtgctatgtttggagttctaaaaatgcaattatctctattattcagaccatatatatcaaatctccaacaatagctgaatcgtagatcagtggaacaatctaaaactaaaactaacaccatcaagctaaacaaacttcaatgcacagatggatctaagaacgccgtagcaaacgggttgaacctaactaaagacgagatccacgagaaatcatcaaaataacacaagggatgaatgaaatctaaaccccaaaaagaaagggcataacaaacaccgcaaacctcacagcaaatccatgaaaaaaacgacaaatactaaacgtggctccaaaatcaatcaggggatgacgggttcaagaagagaatctctcggctcancttgatgaggtcctggtagtcctggtggagggcccggtacctgaggctggccctgtaagccgcctcgtccccggcgcctcgcaccgagccgggcgcgcgagaaaagaacggcggccgcgacggctgagccccaaccgctggctgcgccaagacgatcttggtcttcttgatggccgccatggccgagataacctcacctcaagcccccaagaaaaggggcgcaggagacgaggagaggatacgggaggatgaaccgatgaggaaaggcggagcaggcgaggagataggaccgaggaaggagacgacaagaaataaaggcggaaggcgaggaggatggggtggacgaggtgggggacgtttcttgcgcctgcctgccctgctgatgctcgccctcgctttctctctcctgccgcgggcggcgtgtgaaggggagagctcctctgacccatgggtgaagtgggcgaggcgaggtgagatgatgtcgaaaactccaaaaggcccatggattgttgacaacatgccgctggggctagtttgaggaagcacgcatgctcgtcaagaaacgccaccgacccaacgactggactgatggagtttcaactacccctccctgtacccatcatcctatcagcagtagtggtagacaggagggcggtcgtaatggtgcgtggattggggagtagtgggccgctgtccctctccggctctcttccgcacatctctccggtctgcgcgagaagaggttgtcttgcttggcctcgcctcatcaggcattccagaaagccgcgtgggcgcgctatctctctctcccactagaggagacgacatcctctagaggagagatttgacattatgaaacgcgacagatgcgacttcaacgaaatagaggctcaggcgagggtttctccattatagaaaacgctg

SEQ ID NO: 6855 - DNA, 6990 bp, Zea mays
  misc_feature (5110)..(5110): n is a, c, g, or t
gcacgagaccattacctagaacatcctaatcgaaaaaatcttttttcctcttgacggcgcacataaatccgcgccaaatcgtcaaaccaaaaccaggccgcgcccgcctcgtcagtcctcagtcctcactttcgggccgagctccggatatccagcggcggcaatggcagccgaagccagcgccgtccagcagctcgctggcctcctggaccaagtggacgcgccgctgaagaagacatttgagaatgtgcatcagggctacccaacagagacattattgcgtttccttaaagctagagagtggcatgtgaataaggctcacaggatgcttgaagattctttgaattggaggatgcaaaatgaaatcgatagtatattggagaaacctattatcccagtagatttgtatagatcaattcgtgatacacagcttattgggttatcaggatactccaaagagggcattcctgtatttgcagttggtgttgggctgagtacatatgacaaagcttcggttaactactatgtgcaatctcacattcagatcaatgagtaccgagatcgttttattttgcctacagtgacaaagaagtatgggagacctattaccacctgtataaaggttctcgatatgactggtctgaaattgtcagcactacaccaaatgaagattgtgactgcaatatctacagttgatgatttgaattaccctgaaaagactgagacctattatatagtaaacgctccatacatattttctgcatgttggaaggtcgtgaagcctctgttgcaagagagaacaaggaagaaagttcatgtgttgcgtggctgcgggagagacgagcttctacagatcatggactactcctccctcccccatttctgcagacaggagggctcgggctcatccaaacattcgtcaggcgacgccgataactgcttctctctcgaccacccgttccaccaggagctctacagcttcatccaggagcaggcgctgaaccaggagctcatcaagcagggctccttgcacgtgaaaatccccgagcaggaccctgaggacgcaaagatcgtggaggtcatcgaggccgagttccacaagcttggcgtgcagaacgggtccgccaatggcatcgaccaagcatagcacctttgtctaataaggccagcctgattcaaccgagacgttgcttgccacttctgatgcaactaatcctactgtttattttttttggtggggtgggcccacccccgttgctgtttcctggggggaggggggtgattggtattggtggtatacatagcaaagtcatttgcagatccatccatgatgcaggactgagatagacgatatcacctgtgtaaacttgcagatttgcaatgtgtcctcatctcatatgtatgctgagttgagatgaaatgaataaatcatcctacaagttttttttgagccaaaaaaaaaaaaaaaatgtgctcagtcagaaaagtaaccatgcgtttctgtgccgattcttgctagccctaattaatataaggcgaaacagataatgcctatccattggagggattagaggaaggttcttcccttaaaaagaatgtgggtcaccaaacaaagggtaaacgaaccgaaccgaaccgtgcatatcaacaacattacaacaaagtaagcatgctcttggttggcagtagttaccacttgataaaaagaagagggagaccatgtgctttggcttcctctctgagccatctttcttgctctagccttaggccttagcaatggagatcagcgacgagcagaggatgcaagtggagtgccagcgccttccgccttcctggcaaggcaacggatcagacgccgatgtcgaagtggatcatcatctgtggccgtcaaaagatggccctcttccaatattccttaaggtgttagttgtgctacctcactcctgttttttttcttttaggctgacgtgtgcaatgacttgctgaactccaaaacccagtttgagaacgtggagtacagggtgaagatgaccttgaagaaccccctcacagcggcgagagtggcgtttgcgtcccagacgagggcagaccagggcagcagctgcaagcacatcctcaagggcatcgctgggagtgtggaccctggcgagatcctggcgctgatgggtccatctggcagcggcaagaccaccttgctcaagatcctggggggcaggcttggtggcggcgtcaagggccacataacctacaacgacactccctacagcccctgcctcaaaaggaggtactgaaactgtaatagctagcaaacaagaatttttcacttcacttaataatgaagattttttcactaatctgtgctgtgcgctgcaggatcggatttgtgactcaggacgacgtcctcttcccacagctgacggtgggaggagaccctcggggttcgccgccttcttgaggctccctgcttgcatgtccaagcagcagaagcgcgacagggtagacgccatcatcgccgagttgaatctagagaggttgcctttcattccatttcttgtatttatcggggaatttgagttttcgcctgtatgcaaatgcaagcatgcatgcatacatgttgtgtggatcatcatttgaattggtttaggtgccggcacaccaagatcgggggagcgttcgtgaggggggtgtcaggaggcgagaggaagaggaccagcatcgggaacgagatcctcgtcgacccgtcgctgctcctcctcgacgagcccacctccggcctcgactccacgtcggcgagcaagctcatctttatcctccagcgcctggccaaggtacattaatttgcgcgcagctagcaacgccaccgacgagacgacgatcatgcacgttgctaattccatcgatgctggacgcatggtcgcagacgcggaggacgatcatcacgacgatccaccagccgtcgagccggatgttccacatgttcgacaagctgctgctcatctccgacgggcacgccatctaccacggcaaggcccgggactgcatgcaccacttctcctcgctgggcttcgtcccggagatccccatgaacccggccgagttcctgctggacctcgccaccggcaacctcgacgacatcagcgtccccgaggcgctgcgcggctcgccggacccgcaggagttcaggtcccaggtcatcaggcacctgcagctcaagtaccgggcgggcgccgaggctcccgcggggagaaggacgcccactgagcagcggcgccgggcggtgcgggcgcataacaaggaccgccgccggcggagcatcggctggctccagcagttcgccgtgctgtcccggcgcacgttccgggagcgcgcatccgactacctggacaagatgcggctcgcgcaggccgtcggcgtggcgctcctgctgggtctcctctggtggaagtcccagaccgggaacgaggcccagctgcgggaccaggtcggtctcatcttctacatctgcatcttctggacgtcgtcgtcgctcttcggctccgtctacgtgttccccttcgagaagctgtacctggtcaaggagcgcaaggcggacatgtaccggctgagcgcctactacgccagcagcacgctgtgcgacgccgtgccgcacgtcgtgtacccggtgctcttcatggccatcctctacttcatggccggcctccgccgcaccgtgccgtgcttcttcctcacgctcctcgccacgctgctcatcgtgttcaccagccagggcaccggggagctgctgggcgccgccatcctcagcgtcaagagggcgggggtcatggcgtcgctcgtgctcatgctcttcctcctcaccggcggctactacgtccagcacatccccaagttcatccgctggctcaagtacgtctccttcatgcactacggcttcaacctgctgctcaaagcgcagtaccacggccacctcacgtacaactgtgccagccggggcggctgccagcgcctgcagtcgtcgccgtcgttcggcaccgtggacctcgacggcggcatgcgcgaggtctggatcctgctcgccatggcgctcgcataccgactcctcgcctacttctgcctcctcaagcggatcagcctcacgcccttgtgatcatccacctaattaaattggggcgcaatttcgcatgcctgtgtgaatgattattcatgggaaatgcctgcatggcgatgtgtatcaggctatcagctatactttgcagactgctgggcctaatttacgaggtgtatttgtctgacacaagttttagaagaagagtgaacaatgacatagcatttttagattatataagtgtttatgctagccgttcctagttataagttgcatttttagctttattaataagatcatctagattttgataaactttatagaaagtaggcatgtcaaacaagacttattacatacaccataaaatgagttttttatgctgttgccctcggtttttaaactgagaaaaaaaacacgactaaggataaaaatgagaacatcagcaaaaccgagtacaccaccttaaaaaaaccctaaaatatattctgatagtatattttattatattgtagttgtaatataatgttctataaactttgttaaagttaggcaaatttaacttaggataatactaaaatgtcatatactttaaaaataaaatctgagtgctaaccatatatgtcatgatcagtttattcatacatatacaatgacttcataagtgatacatggaaatcttactaaactacgaatcgataaactttattgaaaacaacacaatccttgatctaaaagtaaattacattgttaaacatcttcaatagaatgcatctctgtctccgcccaataaacgctatcctatcaccgtctttgcaacacccgctacttctcgaccctcttttaatagtagcaatgtggaagcctacttctgcctcatcaagcggatcagcctcacacccttgtgatgacctacctacatactagtaaccaatttcattcttacaacatcgaattgtgacaatagagtgagtcttagtccattaacttcctccacaagtacattcaagnaagatgatagtgtttctcatgctctaaaaagggtctcaaagaagtgtagttttttcaagatgataatgttcctcacactgactctttgccctctcattgagtgcacaaatatccgaccatagtacatgggtgtgcttgtggttctgcatatggtttaacacctccttataaaggcctaaaagggtgtttgaggcctttgcaatccatttctcatagcatatctcatcaccaactaggttggtgagatctttagtttttgaaagaccttgtgtggtggctctaaacgctccaacatctatgacctatagatacaccttcatgcaaagtttccaataataggccgtttggatccctgaaatgggtcagaattgaattatttaccatgagacggtctatttggcttcccttataattcaattaaccatttcagtccatttctcatccgtcaaaatttggtctatgcccatttccaaccctcacgcattggaaaatgctaaaaaacgtggctagggtttcatgccactccgtctcgcatcgctccttatcctcgtggttatcgttggcggcgcgacactccttggcaagcaggtgaggtctgcttcgaagcctgcatgccgtggtgtcgtgcggcatcacgtgccacctgcacgtcctaaatggctcaccacacactcctatgcacgttgcaggcacaggagcatgaccgtggcgccagatgatggctgtgggactcctggctggcgccagtgtcagcatcggcgttgactatgatgaggtgagcgtgctccatctactccatccactgcttccttctttgcgtgtatgtatatactttgatttgcttgtatacgtggtgcgacgagctgacactccttgtatgtaagttgatattgttaacaaatttgcgtacatgttgtactcctttgcgtatactcggttaaaatgtacctgccaaattaaaggattttaatatttaattgtgttgtatgtaagctgacattgttaacaaatttgaattttggtcctttgttcctatattttcaccttatgttttttgtacttatattaaattagttacttctgttctagtaatctaagtagaggatttatatttggttgtattatctcgggtggtctggctgaagggtgagctatgccaactgctaaagagagaatatcaggtgttctgaggttagtttcaaatatcctagactctaatttgtaggttgcttgagtcatttcctatccacataatatgaacaaacatgtttaacacttgctagatccactgtgttgttttaggatttgtcacgtcaagtttcgtttagctgcctccaaccgatccttaaatctctatggctacaccagtacttctcctctttcaactcgtgctcctactagtagtgtttttattcttgagtagagtcttttgcttttaactagcatgtctaattgcatacaaattacatgttctagatatcaaatcaatatactaatgatgaggaagttaaaagcaagagaaagaagcgaaagagggttgttgtattagctgattctattatggctataattgcaaacatgtatcaacggaggagacctagacacattgtagatgctaacgaagttcaagagataaatgttgggtgtagaaaacaaatgctatgtaatctgtaccatggttcaaatatctattgctatgacattttacgcctaactaagagatcgtttagtgaattgtgttccatcttgcaagaaaagagtggcctatatgataccctaaatgtgttggtagaagaaaagcttgcaatttttctatttatagtgggccataacaccaaaatgaggctggtccgtagcacatatgggtggtcccttgaacc

SEQ ID NO: 6856 - DNA, 1739 bp, Zea mays
  misc_feature (1322)..(1322): n is a, c, g, or t
acgaatgtcacatctttaatatatatcgaagttctgttgttggggacttgttctcaaatgctatgagttaagaacaaggcaacacagaaaatgttaatcggtaaagtccttcgtccttcaaagcattatttcccttaggatataatgattttcggacgaaggttatgaaggacgtaccttcataaacacagcatacgatgacgaagaatgaatcataaagaatatgaaggataacataggcaattatatattattatcaacttatttttgcattattattatggagaaacagaaatgacatcgaattacaaatgtaccttcagcttggaaggagatgaaagtacaggtgtgacgcaaaagcaaatgccaagtcagcgtgaacagtacgggggtactgttcacctatttataggcacgggacacagcccatacaaaattacattcatgccctttacatttggtagtaattctatagtaatccaccgaggtctgaatagccttttcatctttaagtcggtttcattttctgctaccacgccgaagctttcccgctcacatcttcggcgctgtatcaaccttcgtattattttgggcttctcctactgtgataccgactcgagtccgaagatacctgttcacacattatactccagaaatactgttaaatcctgtttttgaggaccttcggaagccgaaggcccccaacagtagcccctcgcaatattaatttgtttaaaataataaatttagattgcgacatggacgaaggctttaagccgaaggtccgaaaaaacaccttccctttgctagaatagcaacattcactgacaggcggggtctttcaattttcaacgcactgggcgtataaataagatcataccgcaagctcatttggcacgctctcttgccatctgctctcgctcactcaatttttagctcttgcgcaccaagatttgcttagctttttaagttttgaagcttcggcattgaaaacagttttttagtgtttccgaagatgtctgaagataagaaggctgctgccgagatgaagctgagtctctctgaagagaagaatctggggtttcttatagcaatgtcgaagaccaatacagaaaaaatcaccaaagagattttagaaggtttgtctgaagatactgacgacagcgacagttatgatgtggatagtggtggtgaagactccgaagatcgcccctggcgaccaagccatgcggttttcggcaaatcaggtatcaaagaaaatcatcttgtcaacatgaggggaagatacttccgggatttaaccattgtgagggtcgacgaangagagaaaacttgcccgactcccgaggaaaatgaagtcgtagtgttctgaagctttttgaaagctggactacgatttcccctgagcagctttgtcgtagaggtgctgaaaatgtttgaagtctatcttcatcaacttacccccgaagcaattataaggctgaatatcttcgtatgggccgtgagaagccaaggtctggaacctgatgcgaaaagtttctgtaatatacacgaattatcatacgagacaaaaccttggggtaaggaacagtatcacaataattttggctgctacaatttcgtttctcggtctgggtcaagctatcccgtgccaacctttcggaagagatggcccggcgactggatgacagaatggttttatgtgaagaatgacctgaaagcacgagaagatatcaaag

SEQ ID NO: 6857 - DNA, 1928 bp, Zea mays
ttttttttttttttttgacattggattacaaatgtaccttcaccttggaagaaaatgaaagtacaagcgtgacgcaaaaacaaatgctcagtcagcgtgaacagtacggggatactgttcacctatttatagacacgggacgcagcccatacaaaattacattaatgccctttacatttggtagtaattctatagtaattcaccgaggtctgaatagccttttcatctttaagtcggtttcattttctgctagcgtgccgaagctttactgctcacatcttcggcgctgtatcaaccttcgtattattttaggcttctcctactgtgattccgactcaagtccgaaggtacctgtttacacattatgctccagaaatactgttaaatcctgtttttgaggaccttcgtaagccgaaggcccccacaataccacacacacacaccatagtagagatcagttttctgctccgaggaccacaagcaaatgattggccggccttatccgtgatctataatggatgaagcatcacatcgaggaccacgagcgcggacagctatggatcacaaacttgaaccaagaacaagcaataagcagcacaaacttgcattcgccagggttgtccatgctacgaggaatcgtagtcagcaagaaaatagaatggccacctacagatttgagtaaaagcgaaatacatgcagtatacatacataaatcttgatcatttaagctacgaaactatcattcagagcaaacagcagcagcaaccaattaactagcataataaaccgagcgagctgtgaatctatcaatcagaatcaagaacaaacaggtgcacccaggtcagaatgtcactaccactctactcccaagagatgtagatcgagaaataaactttagaaggtaggatgcagcaactgttggtacatatatactacctgctttaccagacgaacacggccaccgtgctatgcccaaggacgggaagaagtgaggctgccacagcatgatctagcaaggcatgaccacctcgagctattgttctcctcgcgtgatcactccgagctagatcatgctggcagcttcactcgttcccttgggcaggcagttccaggctagctagaaaatgttgcataaaataccatgactaggtgtagatgggtgattcaatctcagatccaaagaacagaaggttgtacaacctaataagaaacggaagaaatcaaagcaagtgatggccagtagtgaatagaagaagctaccaaactgagatctgcaaactcgagggagacgcaaggaaatggcatcatgagaaccaaatgtttgtggaaggaaacagatatagaaacatagaacatggcgatttactagacctagctaggaagagagtggagtggatgggtgaggaggagagatggagattgtgtacaacgagaagcaagacaaagcgcatgatttatagagcgggctgtaccgttgtggtgggggagatgtaacaatattgcaacttttatgcagctctcagaatagtgtcggagtaaaaaggcagcgagaaagagattagagagagacagaggtgttcagatgaagccaagggtgcccgctacgagctaggtgtaggcactagggttctagagacctaggggacctagacagccaccgctgcagagctggaggtgtgagtaggggtgtcagggcaggaggcagcgcagtgcaggcagcaggaggctcgaaaaagagatggaaaaaaatggtggtttgatggacggatggatcggggggatggggaatcaagacaaacccccgcctgtacccatgcggcctcggccgtttcaatgggttgctttttagtgatgcagcttttctaacagcaacagtgctttagaaatgtgtacatgtatttgtgtcaccaagattcatcccactgcga

SEQ ID NO: 6858 - DNA, 2686 bp, Zea mays
ggaggagaggcctaggcgggagcgccggaggtttgaggatgtcggtgcgaatcggaagaatggtgatgtgagtaagtcgagtaaggaaatctcatctcatgagcagaaggggggagttatcaattaacggagattcacagaacggcaatgggcctaatgctggttctcagcaactgctcagtgccgttcctatgccatcttctgttcccattccttcaaaggtatcttcaattactaccaacaatgcaaatgagggagttagtattagatctgatgaggttaccgtaaaatctagtacagatggaagtgcaccttctgctgctggcaaaagtagtaacctatctcttgatgctttagccaaagcaaaaaaagctttgcaactgaagaaggaactgtcagaaaaactcaagaaattacctatggtaagaaaacatagctagtcccagtcccttgctctaatttttaattgtacctttgcaactgttctaagcttttttcctcccccacagcttaataataagcttggtacatctgttactgctgcacaagtttctaaagaagaagcaaaaacttctgtatcagctgtagatgcacaactcttttctaaaggagaagcaaaacctactgatgtttctgttctgccaactagtaccatctctggaacgccggccgtaggtggtgctatcggtattccaggtcttacgaacattcccaatcttgaatctgtgaagcgagcccaagaacttgctgctaagatggggtttcgccaagatccacaatttggtcctcttatcaacttattccctggtacatccactgaagttactgtgccacaaaggcctgcaaaggctcctgttcttcgccttgatgcccaaggtagggaaattgatgagcagggaaacgttatcagcatgacaaagccaacaaatctgagtactctgaaggtcaatataaacaagcagaagaaagaggcttttcaaataatcaagccggacttggactctcttgcaaaatcaagtgttcattttgatgaacggatgggcataaaccaaaagaagctcctccgtcctaaaaggccaggatttcagttcgttgaagagggtaaactcactaggcaggctgaattgcagaaaattaagagtcaatttggtgaagcgcaagctaaagagctcaaagtaaagcaagcccagcttgctaaggcaaagacagaagtagacatgaatccaaaccttattgaggttgctcttggtgtgagagctccaaaacaaaagcagaaggaagagatccctgaaattgagccatggttgtttttgtttcctttttgaatgatgtttttaaggttctatgttgtgattgaacataaagtaatttttattgttgttttcagggatgcaaaaattttactttctgccacatatgaggatgtctctgtggagaaacttaatttggacaagatcaccatatatgttgaacatccagaaccatatgatccacctgctgagcctgcaccaccgccgccccagccactgaagttgactaagaaggagcagaagaagttgagaacacaaaggcgtcttgctaaggaaaaagataggcaagaaatgattaggcaaggcctcttggagccacctaagcccaaggtcaaaatgagcaatcttatgaaagtgctaggctctgaagctgtccaagaccccacacggatggagatggaaataagaactgcggctgcagagcgtgagcaggctcacgttgaccgtaacattgcccgcaagctcacaccatctgagcgccgtgagaagaaagaacggaagctttttgatgatccaactaacacagtggagactatagtttgtgtttacaagataagagacctgtcccatccacagacacgcttcaaagttgatgtgaatgcacaagagaataaactgacaggtgctgcggtcattactgatagtatcagtgttgtggttgttgaaggggggaaaaagtcaatcaaaaggtataataagctcatgctaaaccgtatagattgggctgctgctgttggtggtgatgaagacgcagaagcagaagcggaagctgacaagccagtgaatagctgtgaattggtctggcagggtagtgtggcaaagcccaccttccacaggttcactgtacataactgccggagtgaatctgcagctaagaagatattcgttgatgcttctgttcctcactactgggatcttgctgtcaattcctcggagggttctccctgagcaaagcacctgttcagaaccttggtagctactgctgatctttgctggctacatgctagttacgtgtggccagtgttatagcgcttgttatggtaagacccttaccacgagtatctacatcaatggcctcatcagttgaagtactgaactcagtaatgcctggtgttagggggtgtttatccctccattttatttcatttgtccctaaattgccaaatacagccatatttgtcaatttaggaactaaaatggaataaaatggagggactaaaaattagtccctataaaccgaacacccccttaatctgttgtgaacatgctatttcagagatgttattgttggattttcctgtggcctagaaactgttatgtgagcaactgttgaattttgcacgctcagcgtgcatttggaataaaccaattgcatc

SEQ ID NO: 6859 - DNA, 5930 bp, Zea mays
  misc_feature (1407)..(1407): n is a, c, g, or t
tacagcttggtctctgctctggttgctgttgctggcgtccgtccgagatggcaaccgcccccattcgtccgcctgtccgctccgcaactcgagtcgctgtcccgtgttaatgttaacacgacacgacgacaggacagagaagaacaagtccgtctcggcctcctccggcccactcgctcgttctcgacaccaccactgtggtagattggtccgtggaaatgactaggtcgtctgtacttttttttcggttcctaatggacacgtcgtcgtcgtggtggtggtggtggtggtgtcattcagcctgtggaactgggacaacactacaacagcaacacatgtttgctatgccagtacttgagggctccaacctattagcccatctgcgtacagtgacaaacactcggttcttctagctccctgactttttccccccttcttcttcttcactgggcaaaattcgtgaagtggccttaactgaggaggctcgctcggccatgttcaagttggtaacgaggtgctaccgagtttaaccaagggtctgtttggatcctagtgttccggcagctgaccgtttggcagccggcgtcgcacttccgcggaagggacgcgcgcgtgggtgcgttcgtgcgttgacagagaaggagctaccagccaacctcctccttcctctcctctgtactcgagccggcttaccggccggcaatcacgccgccgcgacgcggcgtctcccgtccgatccgctcgtcgcgaggcggctcatcgtcgtcgtgacggcccgcgccgcgactgcacggcgaagccattccccttttggcccgctccgctccactaccgcctcatccatccgcgccctccgcccgctgccggctgacgcgacgcgcgtcgccgtctcggtaggtgcgctgcgctgccgtggacgcttccattggctagctggccagtgggcagtggccaaaccagggcttcttcgccccgattcgtcccattcctccatgtggacttgtggaggccggcacagcacagcggtgcgatccagccaccgcgatggggaactgcttgcatacggcaatggctgcgcagagctgacagaaacctcgaggacagatttttagtaatgggagtttcatgatcctcgctggagtactttacatctcgatcatggcatcaaagggcgtgagttaccaataatcacaaaagggtgacttatactagtactaatttaaacaaatcaacaccagtgatggattcagttggccacctcccgctgcatgtataaataaatttataacagcaacttggtcttgcatcggtccggctgcgccgttagaaaacaaagaaagaaaggcatgatgtctgcgctgcgctccacattcctccgctacagccgtgacttggctccggaatccnacgtaaaccagtcagccgtgacttcgattgcagacagatcgtagtagatggcatggcaaccacgtttcttgctagctactagacgacaagctggcagccaccagcatgcatgcattgaccaaacaaacctaccaaatgttgctgctagccagcacttgcctgccctactgctacatccatctgaaggactgaatcggagaacaaactgaagcacgggattggcgacaaaagaagaagaaaataaaataaaaaaaaacaaagcaaagggactgaacaaaaaaacaaaaataatttgcggtgagcgtggatcgaacacgcgaccttcagatcttcagtctgacgctctcccaactgagctatccccgcttggttgaaatttaactattatatatagtaataaggtttcatatttcctggtagaccgcaattgtagagctgaaccaagcgcagaagcgctgctggtgctgcagtattattgatgcggtgagctagctcaaactgcacagactacagttgacgacttgacatgggcctagtattcgagaattcatcactggtgttatcaaggtctgtttggatcctagtgtgccgaggaggcaaagtggtcacatatggtgatatggaagcttctggttcccacttctcgacttgtcgtccaaggtgacgacaactcgacaagtacacacacggtataatgggggcagttggcagccggcgtcgcacttcagcgaaagggacgcgtgggtgtgtgcgttgacgagcagccgtggcggacggacggagacggactcacggacccaaccttctccttcctctgggaccgaccgagccagcgctccggctggcaatcacgccgccgcctcccgtccgatctgggatgccgcgatgcacggcgaaaccgccgacctttttttttcttcgcccgctcggttccactaccgcctcaaccatccgcgccatccggccgctgctcccctgacgcgacgcccgtcgccgtcgcggtaggtgcgctgcgctgcgctgccgtgaacgcttccattggctggccagtggccaaaccagggcttcttcgcgcccgttacttctgctaccactaccgattcgtccgattcatccatgcatgtggacttgtggaggcagggcaggcacagcggtgcgatccagccaccgcgatggggaactgcttgcttgcatactcctacacgacaatggctgagcagagccgacaaaaacctcgaggacaaattcagaaatgggggtacataaaaagtttcatgcatcatgcatgatccttgctggcgtacttttacatcttgatcatggcatcaaagctatcaataatcacaaaatgctggcttgtactagtattggtttacaaatcaacaccagtgccggattcagctggcctttctcactgcatatatatataaatttataacagcaacctggtcttgctttgcttttgctcatcatcttcccatgagattgattccttatgtagcagcagtaaacaacacaacaaaacaatggaccaaaagaatcttgctagtgacataataaaaataaaaaggggggacggagaagaagaagaagattaagtcaacttgttgagagcatgacaacggggacgatagatacaccaacctatctacctccgggccggggcacggcggccggtcacggagccggcggcaaccggctcatggcctccctcagcgtggccctgaacctgtcgagatccatccggatgttctgcttgtccaggtacgccgccttgagcgcgtcccagccctgcttgtgcacggcgtaggggtcggtgagcacctggtggttcctcgggtactggtcgatcagcgagctctcctccagcgtcacgtcgtagcccatgtagctcacctccatgtccgcggcggggtccttgaaagtgacgcccgtgagccactccagcccgccgaacggcacaacctggacgagcacggcgccgcggggcaggaacaccatgttggtcagcccggcgccgtgcacgcccaccatcacgtccgccgagttcaccagcgccgcgaacgcggccgtgtccgtgtgctggtcgggctccgccacgcgcacctcgaacccggcgcccgccgcggcgcgcgccatctcccgctcgttcaggaaccgccgggagccccggcgcgagatgatcagcagccggggcttgccgcgccccgtggcgccgccgcgggaggcggcctcgcgcggaaggccgaaggcgcggcgcagcgcgcgcttgaagtccaccacggagacgtggcccggcgaccgccgcgggtccacgcccatgtccttgtggaaggtggcgccgaccacgatccgggggaagcagtgcacctcctggtcgttgtccacgtcgatgacgtcgtaccgggtcagctgccggaagaagggcgtgaacttggccacccaccacggcttcatcccgctcagcaggaactgcacccggccccggaactggtgcgtgctgatgaacagcggcaccaacacgtccgtgtagtcgtggtacaggttgccggagaagccgccgttggagaagagaaaacccgggacggagtggttccgggtgcacgccggcgccggcgccgcctccgggagcggcttgagggtgtactcgcggacgtgggccatggcgaccgggtcgtggtagcgcgcatacggcttggtcttccactcccggtctatcccgctgacgtagatggtggagcggttcccgtccacacggatgtcaccggacgcgtcgcaccgctccgagcgcttgctcgtcatgtagcacgtcggcttgcccttgcccctgttgccgccggccgcgacggccgccggcgttttcgtcaccgcgggcgccgtggtggtggtggccgacgccccattctctccgtcgtcctcctcctcctcctctgagaaaccgcaagagaagaaaaatcatcagcgcagaccgtggggaggccgaatctccgagggattagaaactcagggagctcgatttgattcggggagcagagcagagaagagcagagctgaaccgacctccgggcgtcctggccggcgacgactcctccggctccatccggatgctggagttcatctgctcctggagctggtcctcggccttgcctgcacaaacagcagcgtcagcaaaggcagtccgcacgcggtccgtaccaccgaagggggtggcgcagatgagaggtgacgaactcgcgcacgcgcgacgcaccgaagggggtggcgcagtatctggccttgacgatgctgaggacgcagagggatagcagcatggcgccgatgatgacgccgttgctgacccgccgcggctcctgccggctcctcagcgacgacttcatcccgcagccctccgtcccgccgcccgccggctgggctggcacccgtggcccagatctggcggctccgccgcgaccagagcaggacggccgaggggggaggagccgggagcgggcgaggtggcagggggtgggaacgccaggcgaggaaggaaggaagggtggagatgccaagccgaagaagaaagggaagggaaggaagcggcaggagaagactggtcttaagctgccgtgccgagatggatctacggggcaattagcacattaaacaacaacgctgtgattgagagttttgccatcggcttcagcggcatctagtctagcctaatactagtgcaataatctaacccaggcgtcgggcacgagcatgagcacgacgcggggttgaccggtgcgcggacagcgaggccggggcggccaggccaactacccgggactgggaggggcgccggcggccggcgcccggcggggcagggagcagcaggcgaggctagagccgttgattctgcactgagcggtggggaacaacggactgacggccgagtagtggctagctgcttggcggcccctgctatgtgctgcgttgtctgacgccgacgccgacgccgacgctcctaaccagagaaggggctggtgagtggtgagtgaccgccgctggctggaattttgcatgacatggtgttcagatggatggcccacgaaaaatcatgaataaaaggaaatttaggagcaaatagatctccttttcagaaaagggaatattattaatattccagcttttgtatgggctgctgctgttcaaacatacaaacagtgacgaaaatctcacactcaacaaaagtttcacaaatgaaacactcaacctatgacaaaaagtttagacattattcgaaaatattcacaccattgtcgtttcaagcacacggcaaccgtactttactagaggtatgtcctcctccttctgcaacagagtccataacattgtccaatgtatttctgtgaaggcgacctatagaggagtgtaaactcgtgcattgtcgttattacagtttaaccatatagcccaacagagggcacatgctccaacccaaatcaaactattaagtttagaatttaaaccctgtagataaatgccaaacatatgtcgga

SEQ ID NO: 6860 - DNA, 2200 bp, Zea mays
  misc_feature (96)..(96): n is a, c, g, or t
  misc_feature (108)..(108): n is a, c, g, or t
gcctgagcagcttgaccacaataacaagacatcatatctgaaacgagaggttgatgcaaaggctgacatgcgagctcctcaaaagcccataaaaantagttatggtantgatggaaatctgtctgcatcaaggtgtaatgtgattcctggtgttcccagtgagattatttctcatatcaagcaagaaaacttgtcggttgacaaagagacaagtgaaaccgcccttgaggttaagaatgaaacaaatggtccaactgatgcgactgtgtctaaatcaggaaaaccaaatgtgaatgttggcaacatcaaatttgtgctttatttaatggaagaaggaacgatggaggacaagctgaatattcttgccccaattgctatgttgaggaggtcaaatgtgggctacgcaaacctttaccacagagtgctgttattggggcaaaatatttgccgagaactgttcttagtgatcatatagaagattggctatttaaacgacttaagcagaggcccgtgcagctgctgctggcaaaaatattgatgagattccttgagcggaagaacatcaacttgacgacagggagaggcacccaagtaataatagagacacacatatgctccatccggttgatattcttggggtgcccaaagataccaaagatagagatgacatcttggaaagtgagttctttgacaccagacaggcattccttagtctttgccaaggaaatcattatcagtatgacacacttcgatgcgccaagcattcatcaatgatggtgttgtaccacctacacaatccaactgcaccagcatttgtcactacgtgcaatgtctgcagtcatgatattgaatctggtcaaggctggcggtgcgagatttgtccagattttgatgtgtgcaactcttgtttccaaaaaggagtggttactcatcctcacaagttaacgaaccatccatcaactgctgtccgtgatgctcaaaacgcagaagctcggcaaatgcttctccagcagctaaaaaagatgcttgatcttctggtacatgcgtcgacatgtacctgttccaatgaacgcaccaccggccgccattgtaaacggcaaggaatcccctgcaatgggcagctcggagttctaccacttccaccacgccgaagaccttttcgaccactgcttcagcaccaactcactcgtcgaggacttctccgccagcctagacgctgccttccatagccccgcgaagaagccgccgcggtggcgcaaggcgtggagcctctagggcctgatccaccgtcgcgccgcggggcacagggacggcgcgtccgacgccgccgaccgcgcgttctcgaagccatggccggacctgcgtgtccgcgggtacaacgacaggatgcagcggtgcaacaacaacgccagcgcgcggagctcattcagcagcaacagcggcggtctgggcagctccaggcgcagctacctggacgcccacgggaagcggaggcgcgaggagtgcgcgacactggagcggaaccgtagcgcgtggcgtcctctgcaacctccttctcctgacgtagccacgccaccgtcgcctccagctcctcggcgagggagaaatctctgaggggtggagcgggcacggacctccggactgcgcgggggcagggacgcacgcgggggtgcggtgttggctcctcggcttgatgtacgcggtgggggcggggcggtcaacacgagggcgcgaggcgggggcgtggacgcaatcgccgcgatgtggtgaagattgaggttgcacgctctgtcgacgatggaggatctggggcggattttgggggacgcgggcagctcgggcgtgtgccatgggctgggcgaggtcggatctggccgctgcggtgattgcggcgaggagccagggcgggagtagccgaggtgggatctggccgctgcggtgattgtggggacatggtaaagccgtcgcggtgattgcggtggagacgacgtaggtgcggtggggaagggcaggggcacagtgaaggcggcaggggaaggcaggagcgggtgggtgaaggcgctgcctgattttgtgctaagggtgcttctgcattttgggcgtggtacagacgtaccgtaggggcaggaacatgctgcatgcatcgagcggtggcgcggctggggcagaacgtgcgccgtggacgtttgtgaacgcgtac

SEQ ID NO: 6861 - DNA, 2464 bp, Zea mays
  misc_feature (2427)..(2438): n is a, c, g, or t
  misc_feature (2440)..(2459): n is a, c, g, or t
  misc_feature (2463)..(2463): n is a, c, g, or t
cccacgcgtccgcggacgcgtgggatttaaacgacttaagcaggagaaacaggaccgtgcagctgcctgctggcaaaaatattgatgagattcctggagcggaaggacttgtggtcagagttgtttcatcagtggataaaaagctggaggttaaaccacgttttttggaaatttttcaagaagacaactaccctacagagttcccttacaagtccaaggctgttctcttgttccagagaatagaaggtgtggaagtatgtctatttggcatgtatgttcaagaatttggtgcagaatgctcttccccgaaccagcgccgtgtttatttgtcatacttggattctgttaagtactttagacctgagattaaaacagtatccggagaggccttgcgtacatatgtataccatgaaattctgataggatatcttgaatactgtaagctgcgggggttcacaagttgttacatatgggcttgcccacctttgaagggtgaagattacatcttatattgccatcctgagattcaaaagactccgaaatctgacaaactgcgtgagtggtacttatcgatgcttcggaaagcttctaaggaggaaattgttgttgagctgacaaatctatatgaccatttcttcatcactatggggggatgcaaggctaaggtgactgcttctcgcttgccatactttgatggagattattggccaggagctgcagaagatatgatcaatcaactccgacaagaagaagatgaccgtaaacttcagaaaaagagtaagacaaagaagattattacaaaaagagctcttaaagctgctggccacaccgatctcagcgggaatgcttccaaggatgctatgttgatgcaaaagcttggtgaaaccatatatcctatgaaggaagatttcattatggtccatttgcagtattcatgtagtcactgctgtacccttatggtgtctggaagacgttgggtttgtcatcaatgcagaagttttcacatctgtgacaagtgttatgacgcagaacagcaacttgaagacagggagaggcacccgtgtaatagtagagacacgcatatgctccatccggttgatattgttggggtgcccaaagataccaaagatagagatgacatcttagaaagcgagttctttgacaccaggcaggcattccttagcctttgccaaggaaatcattatcagtacgacacgcttcgccgcgcaaagcattcgtcaattatggtgctataccacctgcacaatccaactgcgccagcatttgtcactacgtgcaatgcctgctgccatgatatcgaaactggtcaaagctggcggtgtgagatctgtccagattttgacgtgtgcaacgcttgtttccaaaaaggagcggttactcatcctcacaagttaacgaaccatccatcagctgctgaccgtgacgctcagaacgcagaagctcggcaaatgcgtgttcagcagctaagaaagatgctcgatctcctggtacatgcgtcgatgtgccgctccggcagttgccagtatccccactgccgaaaagtaaagggactattccgtcacgggatgcagtgcaaaacccgtgcttcgggaggatgcgtcctctgcaagaagatgtggtacatgctccaactccacgcccgggcttgcaaagattcagagtgcaaagtgccacggtgcagggatctgaaggagcatctcagaaggttgcagcagcagtctgattcccggaggagggctgctgtgaatgagatgatgaggcagagagcggcggaagtggccgcaaactgagtagctgcctctgtacaggggtatataactttgtggaaagaggataggaagtacgcaggccaacaagaaagcttggggtggttgaatttgaagggggggattggttggtgaagacgaagcgcttcaacgtggatttcttatcctctgccccgtcgtcctccaaagagctcaagaaggcacaccattactgatgttaggcagtgctaaccagccacaccctgctcacgttgtctcctcaacccttgggggtgtggtgaattctttgatttgacgtggtggtgctagctgggctgaagtgagctgatctcctcgtcgccgggtgtctctggacagtgccagccgtgtagttctgctgagacatttggttagccgctgatcttccccctcaccactctcctctcgtctcggtccaggatagataggagggtataggttaataaaagaaaaaaaaagggtaaatagggacgggcgtttatttgtttatttctgcccccttctcccatccattttgtaggactcaaccttgataaaagtgtaaagcaaagtaatctctccatgtcttctcttgttcccccgccgctccatagatcgttgttgaaagtgcaggggaaccgannnnnnnnnnnngnnnnnnnnnnnnnnnnnnnncctng

SEQ ID NO: 6862 - DNA, 1866 bp, Zea mays
cccatgagattgattccttatgtagcagcagtaaacaacacaacaaaacaatggaccaaaagaatcttgctagtgacataataaaaataaaaaggggggacggagaagaagaagaagattaagtcaacttgttgagagcatgacaacggggacgatagatacaccaacctatctacctccgggccggggcacggcggccggtcacggagccggcggcaaccggctcatggcctccctcagcgtggccctgaacctgtcgagatccatccggatgttctgcttgtccaggtacgccgccttgagcgcgtcccagccctgcttgtgcacggcgtaggggtcggtgagcacctggtggttcctcgggtactggtcgatcagcgagctctcctccagcgtcacgtcgtagcccatgtagctcacctccatgtccgcggcggggtccttgaaagtgacgcccgtgagccactccagcccgccgaacggcacaacctggacgagcacggcgccgcggggcaggaacaccatgttggtcagcccggcgccgtgcacgcccaccatcacgtccgccgagttcaccagcgccgcgaacgcggccgtgtccgtgtgctggtcgggctccgccacgcgcacctcgaacccggctcccgccgcggcgcgcgccatctcccgctcgttcaggaaccgccgggagccccggcgcgagatgatcagcagccggggcttgccgcgccccgtggcgccgccgcgcgtggcggcctcgcgcggcaggccgaaggcgcggcgcagcgcgcgcttgaagtccaccacggagacgtggcccggcgaccgccgcgggtccacgcccatgtccttgtggaaggtggcgccgaccacgatccgggggaagcagtgcacctcctggtcgttgtccacgtcgatgacgtcgtaccgggtcagctgccggaagaagggcgtgaacttggccacccaccacggcttcatcccgctcagcaggaactgcacccggccccggaactggtgcgtgctgatgaacagcggcaccaacacgtccgtgtagtcgtggtacaggttgccggagaagccgccgttggagaagagaaaacccgggacggagtggttccgggtgcacgccggcgccggcgccgcctccgggagcggcttgagggtgtactcgcggacgtgggccatggcgaccgggtcgtggtagcgcgcatacggcttggtcttccactcccggtctatcccgctgacgtagatggtggagcggttcccgtccacacggatgtcaccggacgcgtcgcaccgctccgagcgcttgctcgtcatgtagcacgtcggcttgcccttgcccctgttgccgccggccgcgacggccgccggcgttttcgtcaccgcgggcgccgtggtggtggtggccgacgccccattctctccgtcgtcctcctcctcctcctcctctccgggcgtcctggccggcgacgactcctccggctccatccggatgctggagttcatctgctcctggagctggtcctcggccttgccgaagggggtggcgcagtatctggccttgacgatgctgaggacgcagagggatagcagcatggcgccgatgatgacgccgttgctgacccgccgcggctcctgccggctcctcaacgacgacttcatcccgcagccctccgtcccgccgcccgccggctgggctggcacccgtggcccagatctgacggctccgccgcgaccagagcaggacgggcgaggggggaggagccggaagcgggcgaggtggcaaggggtgggaacgccaggcgaggaaggaaggaactcaggaagggtggagatgccaagccaaagaagaaaggg

SEQ ID NO: 6863 - DNA, 6320 bp, Zea mays
  misc_feature (898)..(898): n is a, c, g, or t
  misc_feature (975)..(975): n is a, c, g, or t
  misc_feature (1344)..(1344): n is a, c, g, or t
gcgcgtgtcctataggctagcgccaggctacctaccactgccaccccctgtgacctgtgtggtctgtggcacgaacggcgtgtgtgcggtgccatggctggggaaaaaagagagagaggaggtgattaaaagctggtgcactcggtgttactttgctttctactaccccactctgcgtcgcctttgaattgaaattcaaattgaacttgaacccgagtggccggcccggagccggagatccgagcaacaagttgttgattcccatgcaaacggattggtacaaattataggaacaaccgagtcggggcctttgtgccaatgtggtcttgctcttctcacgctcccccgctcttgcgttgctgggcgccgcgagagccatcgatggtggctgaacctggttttgcgttgcgacgacgccagctcccatcctccaactccaatgggagcccccgagctattcttttcgtcaccagcaagctgcgtcccattaagtttcaaaaaaaagaagagaaaaaaatctagcatttggtaaggagatcgtcgatctggccgatttgtgtcagactgtaaaagtactcctgcgcaactcgcaaccacagcgtcacttgtcttggagtcataatgctcccgtccttcctccttcctacgattccaaacgctggcaacaccaacctgatctgctcagccgaagaacacttcgtcactcacgttcatcttccaaaccccacgccaccaaatcatattcatgggcctggattccaggtcagcgctagtactaaagacctcaggctatcggcactgacgaactccacgctgaactctaccgccttggtggcattttggagtttgaaaacagctgcagcggtgaactctatcctaaactgcatcaagcccgacncaccttcgaactctattcctagagacttggcgtttggactccatcttctctctcacatccacggtggcagcggatcnttggtcccgctgtggctcggatcgcagggccactgtagacgcgagttggtatttgaaaagaaatgatataatatgtggtagttggtatagagttgagatatgaagtagatatgactgcggagaattttagtatagagtaaagaattttgctgataaggacataatattctttttagggtagaaatttagagttgtatgagtgcggatagcctgagtcacttaaacgtgaactgtttcacgcaagctccagtggtttccttttgcatactccatttttttttgcaacagtgtttgacttctcgactgctcagtgcctcggctgctcggcaaggagacggagacgcctgtctgtctgtcgtgctccttcanctgctgcacagcgtgtcagttgtctcgctcactaccttcagcgatctcttccctgcacaacgccagccagccagccaaaccggtgcacggaaacagcaaaacgagatagcacgaagctggaaccgcgtgtcattgcctctaccgcgcgagaagacatgaagcaagcatcgttcgctgttttaggcgccgctagctgcctgtgagactgagcaatgtcaatgcagcattcggtagtagggggggaacgtgatcccgccccgaataaaatcttcaccgtctgagcaaagatcccgggcgcggcgcttaaaaaaacacgaggatgtgtctagatcggtgtaaacgatccattttcctcctagaaggttgcgacggtgtccatttcatacgtgggcctctcgccgcctacctaccaagaatgcctctcaaaagacgcatggaaacacaccagcaacgtacacttggatccgcctcgcgtcgatcagacatgtgggggtgagagtaccaccactgttcccgatcaaaaggacgcaaaggctaaacgccatgattgtttatcattcctgagctcgagaaggcgacagctttggctcatccccctcatggcctcatgtgctgtgcagtgcagctcccctgccctctctctctctctctctctccgtttttttagattactatagtgacacacacaacacatctgatggctaataagggcctgtcctagctgagctgtttggtcatcagatgcctctcttttgtctccgatcgggctcgggtgggtgtgggttatgtgcctgcctaagtaggacaaatctggaggagagacgcggacagcgacgccctactgcgtgcgtgctcccttgttctcttgttgctgcgcctgtttaggcatggcgtggccgcatggggggaaatgaccgaactagccccgctcatctgggccatatgctgcgcggcccatgccagatgcgatgcgatgcgatacgggggaagagggccatggaggtggggttaaaaagggaaagctcgccctctcgtttcacgcacgcctgttgccatcacggaaaagcttgtgtttttttttttgcattgtagggtgaccatgcctttctctcatctccatcgtgctgaggttttaatcaaatgcatgcgaatataggagtaatacgcaataattactcctgctttagccgtgcagtgcatctcatcgcgctcacgcatccgagatggtggggagggatagtggcgaggggaggctgggaggaggagcagaggacgaacgggacggacggctctcctccctctccttccctgatgaaggaattgattagcttcagatacctcacgtggcccgtcgtccggaccgcaggaagctgccgggccacagctgaggctgccggcacctttgtgcagtcacgcctacgttactggccttctgtttttttttctcttggttcatggcagtaaaatttttacctgcgcctagccgaagccgagcaatttcttcgccgcctcaacgcttgctctgtcacagcgcagagtgaaaacgcaaacgcgcaagctcgtccggccggtaagaaatatattgtgttcgtggaggatggacgtgtgtgttggtgactccagtccatgctcactgctcacgcctggcggtcgtcccgtccaccgctgctagtgcctactccccggctgcacgccgtaccgtaccgacctttttttttataaacatgattcttggctgctagctgctggcgagcgtgccaagtctaccataataatgtctacgctacagtccggcagctacaaaagtagtaccttaggccatatccgcagctaaaaatactgctgtactatactggaaggatacgtcatctcttgtgccttagctacagtgccttagctgcagtaacatatgttgtgtactgtaggcggccatctacatacgtgccaattgttgagatgcccaggcccagcacgggcggcagcgacaaaactttactggtcactgtctagggcatttctcatagacccaaataacctggcaggtcttgtaacgagaatgccagaggcctgagccgggctcgtgatccaagtcgccaccgcacatgaagtcatgagccagctgctgcccagccacactggttcatggtggctgctgtaaacacatgatttttgcacgtttgcagctgctgttctttttttccctggtcgatccgtgacacggtcacactgatgctcgctctcacgcacgcacgcacgcaggcagaatatgctttggttggtgatcaccttcggatcaagcaactccgaaaggccaatcctggcgtgatcacggcggcggtaatccggtcgacgcgcacagagctggagctacagtggtacggagtgaaggttgagagcgtgtgcgcgcgtttcgatccccactcccttgggataggagtaaaagcgcacgagaagcagagcaagagagagagagaaagacatcacggtgtggtgtggaagaagcgaggcgttgggccccgtgattcccttcaactttcgctttctccccctcgggcctcgcctcctctctctctctctctctctctctctctctctctgcgccagtgcgccccacgctgcatcctcaaaaccattctccatcgaatccgtcgcgctcaaagcacgcccttcacagcacagctgcgagtgtgcgtgccaccgccgtgcgagccaagaaacgtgatgccgcgccgcggctaagaatcaggtgtattcttcaggctaacaagcgcgcgagacgacgcaatgacgctgcagatggagccgccggtgccgccgccgcggcggtcggtgtcgacgacctgcgacctccacccaggagaaaccttcacgggcttctgcgccgcctgcctccgcgagcgcctcgcggggctcgagtccaccggcggctccgccgcggccgccgcgccgggccgcaggtccacctccgccatccgctcgctcttcacccgcccgttcgccgccgccgccggcggggctccgtcgggatccggcgccgccgcgctgccggacctccgccgctgcaagtccttctcctgcgggcgcgggggcgacgcgctggccgccgcgggcgagccgcagcggaggtcgtgcgacgtgcgcgggcggagcactctctgggcgctgttccaccaggacgaccgccagcgggttcgcgacggcaccgcgttcggcgccttcccggcctcgtcctccgccgccgcggccgcgctcgccgccgaggtcctcccgcccccgcagccgccacctcccgcgtgcgtccctgagatgttctcggaggaggagatcgctgtggccgaggactctgacgagattgtcgcggtgatggagcccgtctcagtcgtgggcacctctggggagatggagacggaggtgagtgcggcgcgggacgttagggccatgaaggatcacatagatctcgaggcctcgcagtcgcagcagcccaggaagctgccgcccaaggacctcaaggagatggccgggagcttctggcttgccgcctccatgttcagcaagaagtggcagaagtggaggggcaagcagaagctcaagaagcaggaggccgcgggcagcaaggcggcggcggcggcaatgcccccgccggagaagccatccaagccctcgttcctccggcgtagccgcttccgccgtggcgaagccggctccgagttcgccggcggccggcgctcgtgcgacaccgacccacgattctccttggacgccggccgcatgtccgtcggtgacatgggcttctcctgggacgagccccgtgcgtcgtgggacggctacctgttcggcgccggcaccggcattggtctcggccgcgcgccgccgctctcccgtcttcctcctatcctctcggccggggaggactcccccgccggcattctggagcgctccgacggccaaatccccgtggaggacgactcccagccggagcccgaccacgacgcaaacgtccctgggggctcggcccagacgcgagattactacatggacacctcaagccggaggcgccgcagccttgacaggtcgagctctgtgcggaggtcctttgaagtcaccgacccaaagccagtgccagtgccagtgccagtgccaatacctgttccagtgaccgcaccggccgccattgtcaacggcaaggaatcccctgcaatgggcagctcggagttctaccacttccaccacgccgaagacctgttcgaccaccgcttcagcaccaactcactcgtcgaggacttctccgccagcctggacgctgccttccacggccccgcgaagaagccgccgcggtggcgcaaggcgtggagcctctggggcctgatccgccgccgggccgcggggcgcagggacggcgcgtccgacgccgccgaccgcgcgttctcggagccatggccggacctgcgcgtccgcgggtacaacggcaggatgcagcggtgcaacagcaacgccagcgcgcggagctcgttcagcagcaacagcggcggtctgggcagctccaggcgcagctacctggacgcccacgggaagcggaggcgcgaggagtgcgcggcgctggagcggaaccgtagcgcgcggcactcgccgggcaacgcggacaacggcctgctgcggttctacctcacgccgatccggagcgccagcggccgccggacaggcgtcctcccggtgaaaggcggtcggcagctgaggtcgcagtcgttcgcgcggacgatgctggggctgtactagagtattgacgacggccacctgattgctggtcaagctgcttcatttcagtaggcagtagctgatggcttacatgttgagtagtttgggtgggtggtataaccaaaatcgtttacatctttgtgtagtgcagtgatccttttgttcattcggagggctggataaaaagaagtttaatctcgtaaaaaaaaaaaaaaaaaaactga

SEQ ID NO: 6864 - DNA, 260 bp, Zea mays
taaactgttgtcacttgcattttaccttttccatcgctgtttattgtgagtggtcctatatcataaaaaaaaggaaggaaaaaaaggggacaagattatgctagtttgagcatgcagcggggacgacagatttagatacaccaacctatctacctccagaccgggcggttggagcggagctgacggcggccgccggccggtcatggagacggcaaccgggccatgacctcccgcagcgtggccctgaacctgtcgagatc

SEQ ID NO: 6865 - DNA, 1016 bp, Zea mays
ggtaccactccaggcctgccgggtcaagactcctactggccccgcgggtgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagtccgttgtcctactggagaagctaggattactcctgcttttgagcttcctgcctctcgggtgattcacactgttggccctatatatgatttggacaagcatcctgaggtgtcattaaagaaggcctatgaaaatagcttgaagcttgctaaggataatggcattcagtacatcgcattccctgctatatcttgtggtgtttatcgttatcctcccaaggaagcatcaaaaatagctgtttctaccgcacaaaaattttcagaggatatcaaagaggtgcattttgttctgttctcggacgacctttacaatatatggcgcgagactgcccagcagttgctatcacagtttgagaaatgaatggtccattggcagtttgctagcagttgcccagcagtcgttgtctagtgttgagatgtgagcgccataggcagtttgcctggtgtaataaaaatgggtgtatcagacaacgtttaaatcttgatgaaaccgtgtattgcacctgtggtataatgctgaatgagtaaagtttggcgtttaaaaaaaaaaaaaaaaaaaaaaaaaaaaaataaaaaaaaaaaaaaaaaaaaaaaaaaaaaacttgtgaac

SEQ ID NO: 6866 - DNA, 809 bp, Zea mays
  misc_feature (607)..(607): n is a, c, g, or t
  misc_feature (649)..(649): n is a, c, g, or t
  misc_feature (675)..(675): n is a, c, g, or t
  misc_feature (689)..(689): n is a, c, g, or t
  misc_feature (765)..(765): n is a, c, g, or t
  misc_feature (787)..(787): n is a, c, g, or t
  misc_feature (789)..(789): n is a, c, g, or t
tgggaccctcgaggccggccgggggccttgataaattttaaaaaacccaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggcccgcaccaggggccggcttactgaagctgcacaagggcgacattcacccctctggtccgtcgactgcgccaccgacgccatcgttaatgctgctaatgagcgaatgtaggtggggcggaggtgttgatggagctatacatcaagctgctggaccagagctagtgcaagattgccggaaaagttccagaggcaaaccagggaggttcgttgtcctactggagaagctaggattactcctgcttttgagcttcctgcctctcgggtgattcacactgttggccctatatatgatttggacaagcatcctgaggtgtcattaaagaaggcctatgaaaatagcttgaagcttgctaaggataatggcattcagtacatcgcattccctgctatatcnttgtggtgtttatcgttatcctcccaaggaagcatcaaaaantagctgtttctaccgcacaaaaattntcagaggatatcanagaggtgcattttgttctgttctcggacgacctttacatatatggcgcgagactgcccagcagttgctatcacagnttgagaaatgaatggtccatangncagtttgctagcactagcag

SEQ ID NO: 6867 - DNA, 1208 bp, Zea mays
ggccggtccccgggccttggcccctcggccccccgcactgaccaccaaccaaacaggacctaaacatgccaggggcaaaacgcggacccgcgctgtgcgctccacccaatgtcgcgtgcggccactagatttttcctgacgcggtgtctgctcccacttcccctcctctcccccaggtggcggcagcggcggcggggtagcatttgtgctacgagggcttttgcaatggcggcttcggggttcggcggcggcgaggcgttccggctctcggccgcaccaggggccggcttactgaagctgcacaagggcgacatcaccctctggtccgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagttcgttgtcctactggagaagctaggattactcctgcttttgagcttcctgcctctcgggtgattcacactgttggccctatatatgatttggacaagcatcctgaggtgtcattaaagaaggcctatgaaaatagcttgaagcttgctaaggataatggcattcagtacatcgcattccctgctatatcttgtggtgtttatcgttatcctcccaaggaagcatcaaaaatagctgtttctaccgcacaaaaattttcagaggatatcaaagaggtgcattttgttctgttctcggacgacctttacaatatatggcgcgagactgcccagcagttgctatcacagtttgagaaatgaatggtccataggcagtttgctagcactagcagttgcccagcagtcgttgtctagtgttgagatgtgagcgccataggcagtttgcctggtgtaataaaaatgggtgtatcagacaacgtttaaatcttgatgaaaccgtgtattgcacctgtggtataatgctgaatgagtaaagtttggcgataccgagcagttgcaatactacctatcagcatgcctccggtatttgttggccaatgcaggtactgtgaccggtccaacggttcctgtcatgcacacccattgtaatgtttaggatgatgttgcttgagactccttcaggtttcgcaacgtggatgttgtgcgcgatcgcttttaaaaaaaaaaaaaaaaaagggcgg

SEQ ID NO: 6868 - DNA, 4621 bp, Zea mays
  misc_feature (2222)..(2222): n is a, c, g, or t
  misc_feature (3166)..(3166): n is a, c, g, or t
cctcgaggccggccggggcttgcggcctttttaaccgctttttaaagctcccccgcctctcccacaccccccacttcgccttcgccctcccccgcctgcgagcgcgaggcgcggaggggctagcgcgctagcggcgccatggccctgaccgacgccaccgcgttcccctacggcctgcgggtcctcgtcgtcgacgacgaccccacctggctcaagatcctcgagaagatgctccgcaagtgttcatacgaagtcaccacatgcggtttagccagtgttgctatccaaattctccgggagaggagaaacaagtttgacattgtaatcagtgatgtcaacatgcctgacatggatggtttcaagcttctcgaactcattgggcttgagatggatctacctgttataatgatgtccatagacggagagacaagtagggtgatgaaaggtgtccagcatggtgcatgtgactacctcctcaagcctgttcggatgaaggaactccgaaacatttggcaacatgtgtataggaaaaaaatgcatgaggtgaaagagattgaaggtaatgacagctatgatgatctccaaatgtttagaaatggtgtagagggattcgacgagagggacctatttatgagagctgactctgatactatgaggaagagaaaagacgtgaataaggaccatgcagatcaggactcaagtgatggagctactgttaagaaggctagagttgtctggtctgttgaccttcaccagaaatttgtaaatgctgtcaaccaaattggatttgacaaagtcgggccgaagaaaatactggatcttatgaatgttcctggcctgacaagagagaatgtggccagtcatcttcagaaataccgcctctacttgagtaggttgcaaaagcagaacgaggaaaggataatgggtgctgctaggcaagatttcaatcaaaagggaccatcggatcatcttaacctccgaagttccttccaagagcaaccaggcaacctttccaatggatgtcagcatagttctcagaaggtcgaagctcagaccaacattctcgatcctcatctggacgacacgaagacttcaatgcccttgaaggtgccagataaaaatggaatttcagcaagtgatgctgttgaccctcagaatatcaccactgcttcacctttaagtggggtgttctcttttgaaagaatgccagtgaatcaggacaggaagctatcagaaaccatgatcttggaatgtcagtcctggattggaagtgtgccaccaaagcagttcatgcagtatccaaagcataaccatgagcgctgcgaccttctaggagactattcttgcctgcctaaaccggacttggagcacccaattgcccctggtcatctgtatgccccaccgccagtaatttcgatgagttacaatgtggaggaagatgtcagagacttctcagatgtaaaaccagatcttcttggctgtatgaagtccttatcaccagcactgacatgtacagttgagtcggtttctgctcaacttagtgacagtgttgtgacctcaactaacagtgaccggaagttttccagcgtggaggggttgtccagcattaaagattgtgactttgatcaggaaaggaacggagctattttgtttacttcagaagaggcaagtatattatgcggcactgattttacttgtctacctgaagacctgtccggctatcaacttcaaggtgtctccttcgggaataaaggattgaacagcatcgatttatatcagtgcaatgatacaatgttaatacctggactgcagaataattggtatgatgatgatgtagagtttagcagtgaaaccgtggagttcccattgctagacggaggcctgtttgcataaatgcctcatctggccctatctttcaaccatgcccttatgtcagcagggatgatgttcattggtatgttcccctatagcgcctcctgtagggctatatttaacctaacttgatcctgtggtggaaggatttaatttgtagtctcgccacttttgataattgtctgtattatagactgtgccatggcacaatgactgcaatatatactcttcacggtgatcaaaattacatatgaaggcaaaaaaaaaaaaaaaatgcacaactaaacttttgcagtgaattctaactctgatgcagcattgcacacatgtgagacttatgagtttcactngaaactttgagtataggcaaagaggactcctgcagggcctgcaggatgtgaagctatttgttgatctaacctgaaaaaaaataggtgaaggtgataatgatacaggctgtagcctacatactagtttttcaacctaaattggaccacacaggtactcggtgctccccatggatgttgaatgacatagaagccatgagtggcaggcaagttgtaatgcagggtattattgccagaactgcagacagaaccttgattggagtgtgatgatactgaaaatcagctgcttgcacattggaaacatgatgacatatctgaattacctgaaactgacaggtttgcacaagtccttgttgttttgtgcactctttctgtcagctgatcagtaactctgacgatcaaaaccagacctcatcctgtccaatgtctcctgcaaaaattaatatcctctacgtcgatctgaagatcgtttggttagcttgataggggagatacgtcgaggtttagcccaatctcaagattggttgcgtagcttgacaggttgatgttctgcgtttacggccatgaattcatgatcctttttgatggtccgcgatgccaaaggaggacactgcttctgaagatcgcttaaacaagatagctatgacaaactgcaatttcggcagttgaattcttttcagctcttcgattcttgcctcaggaaccaacgaaactgaactggtaaacagagcgcgcatattctgagaagattgtttacgcgagcttagaagatttaacgagtttgagtttcgctacattgttttccgttttccgagctttttagagtactactgctgtacacgccacacgccttaggctgtccgcactcatggaaccctaaatttctaccttaaaaggaatatttcatcctgatcagcaagattctctactctatcctataattctcngcattcatattcaccttaaatttctaccctataccaactatcacatattctattatttatttttcacctctctcctatccatacccagctgccagccaacgaggagaggagagagattataaaggttggtgtttacgcagagttggagagagacaatagagtaacgtatagggtgatccactgcagccctccacttcactgtaaaattttagcgcagcctttccagctccccactgcgggcagccttagaagattgtttacgcgaaccactgcagttggcgtattctgagaaggccgcgacttcttgaagtcctcactctgaggctgtccgcactgaaggactcggcacgctacgctacagagatagggtttactctacctgctgcagtggcctaccttttgagctacgctattttccagtagtagtgctggaacagcatatgcagagtagtacggcataaaccctatgcactgcttgggtagttgggtggaatgaaagagaaataaaaaaataatataatatgtgatagttggtatagagttgagatatagagtaaacatgactgcagaggattgtggtatagagtaaacatgactgctgacggggatagaatatttctcttagagtagaaatttagagtagtatgagtgcggtgagtctctgacactagggcgcacaaacggacaacgaacccagctcgaaaagttgtccaggagaaaccgaaggtcggcgggatccgctctccgttcgggcgcgagatccgccatcccaccagcaatggcggcggggatcgccggcgcggtggtggcagcgctcctgcttctgtatccggccagggcagcggcagcggcggcggtgggggaggggcggcggttgcacactctgttctcggtggagtgcggcgactacttcgactggcaggcggtggggctcctccacagcctccgcaaggcccggcagcccggcggcgtcacccgcctcgtcagctgcgcggaggaccagctcccgtcctaccgcggcctccgcatcggccacaccctccaggtcccctccttcagccgccacccacgcaccggcgactggtaaccctcgccgtcacatacacggactatcactcccctcgtcgctgcacctgccacgtctgttctatgtttttttttcttcggcaaattgtaagaaccaaacagtgttggttattccgatgacctatttcacgaggagaggaggcgttttgctcgtgaaaattgctgtcttgcttcggaatggaatgtgcattttaggtggaattgtcgttcggtcgagaaatttggaagcatttctgtgggggaaaaaacgattcagtttggtgaatagaaattatatgttaggaatagaattgtccatccatggccaaatgaactgtcaagctccagcatatcaaatgaatgtctttgtaggtttaggtgctgtggttg

SEQ ID NO: 6869 - DNA, 1316 bp, Zea mays
  misc_feature (18)..(20): n is a, c, g, or t
gcgaattggggtatcctnnnccatgggggccccggagccggccgggaaccaggacagatagatggaggatcatcacatggacaggaggatatccaaggaggccggcgaggaaacgaagctgaccaggagcttccgctacgaggactacagcaccaggcgagtcttcctgcgcagctacccgctgcagtgggactggtcgccctcgcgggacgacgacgacgacgacaagcaggacggccaggatgccgccgacggcgacgagtgctgcggcagcaggcggtggaagagcaagatggtggcggccgtcacggagtggggggaggacaagctgctgctgctccgcagggccaagaagcgcctcgcgctctacctcatcggctgccaccaccacggccgccgcgcgctgcccttcccgtcagcttcacccgccgggtcatgcaccgtcgccatgatgctcgcctccagatgatcgatagatatccaccaccgtacgtgcacgcacggcgtgcgtgcatcatatatgtgtgtggtcgaccatcggtcgcgcacgccccacgtcgtcttcctctctctttctagtgtatgattggcccctacatacgtgctctcggaaatgaattgaaaatgcactgtatactcttgctaccaaaaaagttgattaattacacacaccacaggtaaatacgacgacctatagcagagctattactttaattatgtactacgtctacgcgtacattattcataatgatcatggaactgagtataagtgcattgtacgaattaggtctttgtcggttattcctatttcatgtggattagatagaattggaaaaaaatatgaaagattttgacttgtttggaatttaaacccactcaatcccatccaatctacatggattaagagcaaaacgaacaagcccttagagggccttgttggacacagcctagatggtaacccacattagattgatgacccagatagtcacctttttagttcgaggacctaagtgagaattgatgaaaagtttaagaacccatggtgcattttactcaaatataaattacagcggcagtagttgcaaagcctaaatggttactccatggagtgggaaatatgtttttttccctaatacagtactataatttttgccatgctaggatcaaaccacagacttggcaacttttccatgtaatcaaattcgaatgttttcttacccagaatattcaagaggatctgatcttatcagctcaatgttcccaaacaaactctttgctggtgtaacttagggtgtcacagctcaaaggggcggagg

SEQ ID NO: 6870 - DNA, 793 bp, Zea mays
attggttttgcttctctctctgtcggtccctttttatatgaaaaggaccaagagataaaccggccaggaaccaaaaggcgacgagctcaaatctgttctggtgtatccaaggaagagcccatatatacacctgaccttacacggccataccaaccaggacagatagatggaggatcatcacacggacaggaggatatccaaggaggccggcgaggaaacgaagctgaccaggagcttccgctacgaggactacagcaccaggcgagtcttcctgcgcagctacccgctgcagtgggactggtcgccctcgcgggacgacgacgacgacgacaagcaggacggccaggatgccgccgacggcgacgagtgctgcggcagcaggcggtggaagagcaagatggtggcggccgtcacggagtggggggaggacaagctgctgctgctccgcagggccaagaagcgcctcgcgctctacctcatcggctgccaccaccacggccgccgcgcgctgcccttcccgtcagcttcacccgccgggtcatgcaccgtcgccatgatgctcgcctccagatgatcgatagatatccaccaccgtacgtgcacgcacggcgtgcgtgcatcatatatgtgtgtggtcgaccatcggtcgcgcacgccccacgtcgtcttcctctctctttctaggggatggttggcccctacatacgtgctctcggaaatgaattgaaaatgcactgtatactctagctaccaaaaaagttgattaattacacacaccacagggtaaatacga

SEQ ID NO: 6871 - DNA, 1396 bp, Zea mays
gggtaccctcgggttcggccgggactctacccggccaccccccgccccggttttccttcccatctcatcacaagcagaagaaaatcgagataacgagagctagggttttgattccagtactcacgagtcacgccgcatcctgtctccttctgcccctccctctcggcaccgcctccgccccctcattctctctcgcgtcatccggcggaggctcgaggaaactgaggccgggagcgccccgaagaatattctccacccagtcgccgacacccctgcgcgcgcgagagttaccattgtactgttgtagcttggcagttggttgactgtgtgacaactttgagctatgtcatattacgaaagaaggggtggagacaggggtagtggccgtattcaaggaagtggtgggcgaggtggacatgtcctgcgtggaagatcaggattggctccccgaggacctcttggggttaactcccgtccatctgcacgcactattgctaagtcatttagcagaaccaaagacatgacatggcgacctgatctatttagtgatagcatggcggctagtggaatagaaactggtacaaaattgtacatttcaaacttggactatggggtctctaatgaggatataaaggagctgttttcggaagttggtcatttgaaacgctttgctgttcactacgatggttatggccgcccaaatggcactgcagaggtggtgtttacacggaggagcgatgcaattgctgcactgaagcgttataataatgttctacttgatggaaaagctatgaagatagaagtcatcggaaatgacttaggattgcctatgacacctcgtataaatgttgttggggcttctaatggcagagctacaagaacagttgttatgacgcctgagtttagtcaacgtggcagaggttcaagcagtagacctctaagcaacaggtttaacaaccgtggtggtttccaagctggtcagttccagagccgggggagaggccgtgcccagttccagggacgagggagaggcaggaagcctgagaagactgcagatgagctggataaagacctggaaagctatcacgcggaggcaatgaaaaccgattgattgcaaggccggtagtgccacaaggttgtggttttatccatcattttctgggagcaacgaacatgctttgtgctttggtttcaggagactagactcttgtagtaaattcgaacaaaagattgccagtttgtagtgtttgcatgaagtttgcaacctgatgtgtttatttttgtatcggttgctttggagattgtgttaattgttaggttcatgcttagaataaccgtaattggccaaaacagaaaaaaaaaaaaaaaagtcgacgcggccgcgaattccagatct

SEQ ID NO: 6872 - DNA, 1386 bp, Zea mays
ttcgtgatgatatatttccagatccggtttgtccgacgcagatggtagggctggagaggctgccgatgtgatgcatgaattttgtgttcgtaacgtggattggtgtggggtgggagaggctcctttgccggattggccaggttaccattgtactgttgtagcttggcagttggttgactgtgtgacaactttgagctatgtcatattacgaaagaaggggtggagacaggggtagtggccgtattcaaggaagtggtgggcgaggtggacatgtcctgcgtggaagatcaggattggctccccgaggacttcttggggttaactcccgtccatctgcacgcactattgctaagtcatttagcagaaccaaagacatgacatggcgacctgatctatttagtgatagcatggcggctagtggaatagaaactggtacaaaattgtacatttcaaacttggactatggggtctctaatgaggatataaaggagctgttttcggaagttggtcatttgaaacgctttgctgttcactacgatggttatggccgcccaaatggcactgcagaggtggtgtttacacggaggagcgatgcaattgctgcactgaagcgttataataatgttctacttgatggaaaagctatgaagatagaagtcatcggaaatgacttaggattgcctatgacacctcgtataaatgttgttggggcttctaatggcagagctacaagaacagttgttatgacgcctgagtttagtcaacgtggcagaggttcaagcagtagacctctaagcaacaggtttaataaccgtggtggtttccaagctggtcgaggccgtggccagttccagagctgggggagaggccgtggtcagttccagagccgggggagaggccgtgcccagttccagggacgagggagaggcaggaagcctgagaagactgcagatgagctggataaagacctggaaagctatcacgcggaggcaatgaaaaccgattgattgcaaggccggtagtgccacaaggttgtggttttatccatcattttctgggagcaacgaacatgctttgtgctttggtttcaggagactagactcttgtagtaaattcgaacaaaagattgccagtttgtagtgtttgcatgaagtttgcaacctgatgtgtttatttttgtatcggttgctttggagattgtgttaatttttaggttcatgcttagaataaccgtaattggccaaaacatgcacccggccctgttccgctctgcgatgtgccttcgcagcattgtgttatttttagcatattgcagtttgtcgggggttaaaatacatcaatatggcattcattttggaagtcgacaactgctacagctacacattc

SEQ ID NO: 6873 - DNA, 1467 bp, Zea mays
gaaaatcgagataacgagagctagggttttgattccagtactcacgccgcatcctgtctccttctgcccctccctctcggcaccgcctccgccccctcattctctctcgcgtcatccggcggaggctcgaggaaactgaggccgggagcgccccgaagaatattctccacccagtcgccgacacccctgcgcgcgcgagagtaagtcgcctcccccgccgccagtgctcttcgtgatgatatatttccagatccggtttgtccgacgcagatggtagggctggagaggctgccgatgtggtattgaagagggatttagatgcatgaattttgtgttcgtaacgtggattggtgtggggtgggagaggctcctttgccggattggccaggttaccattgtactgttgtagcttggcagttggttgactgtgtgacaactttgagctatgtcatattacgaaagaaggggtggagacaggggtagtggccgtattcaaggaagtggtgggcgaggtggacatgtcctgcgtggaagatcaggattggctccccgaggacctcttggggttaactcccgtccatctgcacgcactattgctaagtcatttagcagaaccaaagacatgacatggcgacctgatctatttagtgatagcatggcggctagtggaatagaaactggtacaaaattgtacatttcaaacttggactatggggtctctaatgaggatataaaggagctgttttcggaagttggtcatttgaaacgctttgctgttcactacgatggttatggccgcccaaatggcactgcagaggtggtgtttacacggaggagcgatgcaattgctgcactgaagcgttataataatgttctacttgatggaaaagctatgaagatagaagtcatcggaaatgacttaggattgcctatgacacctcgtataaatgttgttggggcttctaatggcagagctacaagaacagttgttatgacgcctgagtttagtcaacgtggcagaggttcaagcagtagacctctaagtaatcccagcaacaggtttaataaccgtggtggtttccaagctggtcgaggccgtggccagttccagagctgggggagaggccgtggtcagttccagagccgggggagaggccgtgcccagttccagggacgagggagaggcaggaagcctgagaagactgcagatgagctggataaagacctggaaagctatcacgcggaggcaatgaaaaccgattgattgcaaggccggtagtgccacaaggttgtggttttatccatcattttctgggagcaacgaacatgctttgtgctttggtttcaggagactagactcttgtagtaaattcgaacaaaagattgccagtttgtagtgtttgcatgaagtttgcaacctgatgtgtttatttttgtatcggttgctttggagattgtgttaatttt

SEQ ID NO: 6874 - DNA, 2916 bp, Zea mays
  misc_feature (1)..(1): n is a, c, g, or t
  misc_feature (6)..(6): n is a, c, g, or t
  misc_feature (9)..(9): n is a, c, g, or t
  misc_feature (11)..(11): n is a, c, g, or t
  misc_feature (16)..(16): n is a, c, g, or t
  misc_feature (23)..(26): n is a, c, g, or t
  misc_feature (28)..(28): n is a, c, g, or t
  misc_feature (37)..(37): n is a, c, g, or t
  misc_feature (39)..(39): n is a, c, g, or t
  misc_feature (43)..(43): n is a, c, g, or t
  misc_feature (71)..(72): n is a, c, g, or t
  misc_feature (88)..(88): n is a, c, g, or t
  misc_feature (102)..(102): n is a, c, g, or t
  misc_feature (115)..(115): n is a, c, g, or t
  misc_feature (168)..(168): n is a, c, g, or t
  misc_feature (175)..(175): n is a, c, g, or t
  misc_feature (199)..(199): n is a, c, g, or t
  misc_feature (202)..(202): n is a, c, g, or t
  misc_feature (208)..(208): n is a, c, g, or t
  misc_feature (229)..(229): n is a, c, g, or t
  misc_feature (233)..(233): n is a, c, g, or t
  misc_feature (256)..(256): n is a, c, g, or t
  misc_feature (263)..(263): n is a, c, g, or t
  misc_feature (276)..(278): n is a, c, g, or t
  misc_feature (287)..(287): n is a, c, g, or t
  misc_feature (293)..(293): n is a, c, g, or t
  misc_feature (309)..(309): n is a, c, g, or t
  misc_feature (322)..(322): n is a, c, g, or t
  misc_feature (338)..(339): n is a, c, g, or t
  misc_feature (361)..(362): n is a, c, g, or t
  misc_feature (385)..(385): n is a, c, g, or t
  misc_feature (390)..(391): n is a, c, g, or t
  misc_feature (394)..(394): n is a, c, g, or t
  misc_feature (396)..(402): n is a, c, g, or t
  misc_feature (404)..(404): n is a, c, g, or t
  misc_feature (451)..(451): n is a, c, g, or t
  misc_feature (493)..(494): n is a, c, g, or t
  misc_feature (517)..(518): n is a, c, g, or t
  misc_feature (522)..(524): n is a, c, g, or t
  misc_feature (528)..(529): n is a, c, g, or t
  misc_feature (532)..(532): n is a, c, g, or t
  misc_feature (540)..(540): n is a, c, g, or t
nccccnccncnccccnccccccnnnncnccccccccncncccncccccccccccccccccccccccccccnncccccccccccccccncccccccccccccnccccccccccccnccccccccccccccccccccccccccccccccccccccccccccccccccccnccccccncccccccccccccccccccccccnccncccccnccccccccccccccccccccncccnccccccccccccccccccccccnccccccnccccccccccccnnnccccccccncccccncccccccccccccccnccccccccccccncccccccccccccccnncccccccccccccccccccccnnccccccccccccccccccccccnccccnnccncnnnnnnncnccccccccccccccccccccccccccccccccccccccccccccccncccccccccccccccccccccccccccccccccccccccccnnccccccccccccccccccccccnncccnnncccnnccncccccccnccccccccttgaagagaagctggttcaacaagctgaggtaaatcagcccccccccccccccccccaaacattccagggagcatgctgatcaagaacttgaagtagagagaactgcacaggctgggttggaacaagagtgtgactctgtgccaatggattctgaggaacacggttgcctgacttcatatgctcatactgatgatgagcaagatgaggtgaagcagaaagttacttctggaacagcagatgttatgcattatgcagcagacacttttaatgttaacacaaattcatggaaagaagatattgaagaggatccaactgaagctgctctaacagccatacatcaaatttgttacgaacctttgacgagcatagtcaagttctctctagatcatagtgtctccgaagaagacagagagcctgatacgccgactcatattgaaggtatatgtgattcacaggaactgctggattctaaaacagttgtttctgatgctaaatctgtagattcaagtgttgctactttgtctactgatctggaaagcactgaattggtgagtgtcgatcaactaaaatctgctttggcttccacacgcaaatcattgaacaccctatattctgaacttgaaaatgagaggaacgctgctgctatagctgccgatgaaaccatggcaatgataaaccgcttgcaagaacagaaagctgcaatgcagatggaggcgattcaataccagcggcttatggaggaacagtcagagtatgaccaagaagcactgcagaggttgaatgaactagttgttaagagagagaaggagaagcaagatctggagagagaactcgagctgtatcgccacaaggttcatctctatgaggtaaaggtgaggaaaatgtccaggcacaaggctgatgaccagaatggatcatcgtcaacttcatcgagtgctgaggatagtgatgacctttcacaaagtttctatgaaggtgatgaatcttcccatggtattaatggaagcaatgggagtattcctactgatgtggtgctacaagaaactgccaggcatcttgttacccttgatggctcactagctgattttgaggaagagagactatccatactggaacagcttaaagtgctagaagataaactttttgatcttgaggatgaagagtccgatgacatgaagcatttctcagaagaaaaccatttaagtggtgcctcgaatggtttctctgatgatgatagctgctttaagcttcatgacaagagaaagaatgtaacctatagaggaaagaaactccttccattgttcgacgatgctaccgtggaagctggaaacgtcccccaaggtaatgatgcacagcattcaacagaggtcacactggaccttgctagagagcaacataagcttgcaattgccaatgaaatcgatcaggtacacgagaggctgcatgctcttgaggcagatagggaatacataaaacagtgcgtgaggactttgaagaagggagggaaagggtttgatcttcttcaggagatattacagcatcttcgggacctaagaaggattgagcaacgtgcaagtgcaaggaactctggggagctttcgcctcattacctacatcatcacacggattgaagattccagatcagctgcctatgtccagcgaatattgcttgaagatggaaatcatacaacaatgataagggaaaaaaaagattgccgactaagtagtattgtcattggagaagttttgttggttcccggagaggaaggagctcctcctggaacacccgtcacagtcggttcgaagataccattgggaaggcagatcacggagcaattctgccttccaaggtccaggattttttttgtggaccacatcccacgttctctttttgtgttggtttagttttcccggtgggttccaaacttttgcccaagggcaagagggtggttggtgagccgcccgggcccctgtggggctgtgtgtttgttgtgggggtgtggcggcaatcatggccttgtgcagaagctttagaattcattaacctgaaaacatgccgatgccagctttgctgccagatatgttgggcttcactagtttttgttttcttctttttttctaaatcctttccctgtaaatcttctagctgtatgtaatgtgctttcggcctttggaatgatgaggtgttgggtgtgtgcatagcatgactgttgttttatgggtcttttttttctttcccttttgttctttttcgctgttattgttctggacattgcaatattttgatgcaagtgctgctgcttattagttttggaccccggaaaaaaaaaaaaaaaaaaaaaaaaaaaaaaaaaaaaaacgtcgtgc

SEQ ID NO: 6875 - DNA, 3150 bp, Zea mays
tccccctgcactactgcacgcctgtggcacaggccgcacagcccaaatgttgctattgggtgacattgctcaccatctttgaccggagctagccccttctctctctctctctgcagtctgcagtctccaatggcaatgtggcacagtcagaccaggtactgctagtcctgctgtttagaaatttgacggttttggcttcaaatctttcatccatcacactgctctccaaactcatagtggtgaaccaagtttgagatgggtcgtgttcttctctacttgctgcaaaataagaaagctaacctccagggtgtttgactgtttactgttttggcttctggatcaggattctgccaagagctctccaaactcgactcggtcgccggagatcacgtcgaaggaactggaggacgataacgacgtgaaggtgaaggtattgagtgagaggctatcatccgtggttctggatgtccgtgcgaaggatgatctcgtgaagcagcattccaaagttgcagaggaggctgttctaggtaacgatccctctggaatgaatcaggtatttgctgtttcttctgaaaatagtaactgttatttcctttgtactactaggatgggagaaggccgagaaggagatctcatcgctgaaggcgcagctgagcgctgcaacggccaagaactccgcgctggaggaccggctcgtccacctggacggcgccctcaaggaatgcgtccggcagctccggcgcgccaaggacgagcaggaccggacggtgcaggacgcgctggcacggcaagcgcggcagtgggagtcccacaaggccgacctcgagctgcgcatcgttgagctcacggcgaggctggaggccaagtccgagcgctcggtggtgggcgccaccgacggcgacacccgttccagcaggctagccgccctggagaaggagaactcggcgctgaagttgcagctgctcgccaagacggaggacctggagctcaggacgatagagaaggagctcaaccggcgggcggcggagacggcgagcaagcagcagctggagggcatcaggaaggtggccaagctccaagctgagtgcaggaggctgcaggccgcggcacaacggagggcgtcctccgtgaacgtcgagctccggcgttctccgagctcggcctgcgtcgagtcgctcacggattgccagtcggactgctccgactcatgggcctcggccctcgtcacggagctcgaccagttcaagaaggacaagagcggcgcgagcaccaggacagcgagcctcgtggccgcggacatcgacgtgatggacgacttcctcgagatggagaagctcgcctccgcgaacggctcgtcgaaaggcgaggccgtcgaggacgcgagcgggcaggtggagaaggcgctgcacgaggctcagcgcgagctgaggacttgccgccgccgggtaatggtggcagaggagagatcagctgagctacagcggcagctgaaccatgccaatggcgagaaacacgccatggaggcggaggcggaagctgctgaggcgaagggaagggagcttgagggcaagctcgagctcgcccgtgccgatatcgcgggcttgctggacaaggggcgcatcctggaggaacggctcgagtctgagaaggcgctgacacttgagctcgcagccaagtaccaggacatggagacgctggaggcagagaagagggagctgaacgctcagctggagacgtcacggtccgatgccaagaagctcagcgacaagatcgccctgatggagaggaagctggaggtggagaaggccctgtcgatccgactggcgacgaaatgccatggcgttgatgctctggaagcaaagaagaagggcgtcgagctcgagctggagtcggcacgcgaggaaatcgtttcgctgcgaaacaagactagtagattggaactgcaggtcgtggaagagaaagcgtcgtccgctggactcgcaatgcggtgccaagaactggaggagcttagatcccagctggtgtcttcaaactcacggatcgttgagctgaacgagaaggttaaaacgctcgaggatgtgatcgagaaacagaggccagtgacggcggaattggagtctcagctccagtcgagacacgacggaatcagcagcttgaaggaggacataagcctgttgcagaagaagctggagtcccagaagaacctgtcgtcagcttacatatctgcgctgggcgcttctgaaaccgagaagaaagaactggctacccggtttgaactcggagagaaagaggccgaggaattgcgcgggaagacgagtttgctggaggaacagatccacgaagagagggcacggtcatctgagtttgcggtaaaatgtcggaagatggaggaacagttctcccgcagatctcttcttggccaccaaccagtgaaatcttcggcgatcaaagatattcagataagaaaggtaacctccattccatggaacaaaatcggcacttcgttgccattcatcttgtgtcttattactattagcgattggttgtctcagaaagggtgtcgggtgtccaatgtttttgttttttttttttacaggagacagagctggccaaggctgccgggaaactggccgactgccagaagacgatagcttcactgagcagccagctgaaatcgttggccgatttcgacgagttcctccctgaaaccgagactagtggcgccgactcagccgacgcctgggacggcgacctgaagctgctccaccctgcaagctatcccacgcagattggctgtttggcagtcacatgagtcacgatcctcgttggcaggtgggcggagaaactgtttttgttcgggttccaccgcatgattgctgtggtgagattgccatgatcttccaccacatgccatatagagttaagtttataatagtctataggtgagaaaatgttcatatgaaagctgtttatagagttggttggtgaagcttcaaaggaactcataaactttgatctcccattcttcctgtcccttggaaacggcttttaaccaccagcatgtgttccatcttgattgtcttccggctattttatattctgcaggcgtgcattgtgcaatgaaatgaatggaatattcagttagatctg

SEQ ID NO: 6876 - DNA, 2299 bp, Zea mays
gcacgacgtgatactgtctttgatgaggatcgtgggtttatttcaactattcttaagatggcagagactacaaaatggccaatcatactaactagcaacaagaaggatccgtctttgccgaatctcttggatcaacttgttttggatttcaaatacccatcgacctcagagctactttcacacgttgccatgatttgtaaatctgagggagtgaatgtcactgttcctcagttaaagcatgtaattgatgtttgtctaggtgacattaggagggtggtgatgtttttgcagttttggtaccaagggcatcaattcacagagaggccaaaggaatgtttgtgtggttctttctcacttgatttagatgcagtacattctacagtgccaaaaatgttgccatgggagttcccttgtaagttatctgaaacattatgcatggaggtagacaaaactatccttttggctgaagaaaagaaaaaacagatggaaatatcagatcttgaaggcctgcagttacatgtaacagcacctttgatcaagcccacgcgtccgcccacgcgtccggctaagaaatccaaattaaagcgtgctcacttgactgagcataatgatatttcaccttgtaagaatgaacttgatgatttccatgatcttccagatatatctcttccatctgataaacaaataaaaagaaatcggcatcgttcgctgctattatctgagtccgatgatgatccagctgatgtaggtactgaaaaacataacatatttactgttactgaagttggtttcttcccacaaccttcagaggtgcctcctatgcatgggcaagggatttctgatcagttccattttcccgttgaatcacgagagacatgtgaaattgctgattctttccaaaatccacctgaaagcaacatgtatgggtccatttcacaagtttgtgatacatttatgtcacaggacgtgtcatgtgtacccgagtcatccttaattttggacggcacatctgcatccataagtggtgatgaatttttgtcaagggcagtgtccaatggtttttctgccttttgtgagggtacacacactacctccagaatggtattagaagacactggctgtgtgaagaatctaatggctgaacgacaaaaagatgttgaagatgtagttggtgagacaagtgagacttatatggaatcatttcggagaaatgaacaggcaagctgttcagctgctgggtttcaattaatggatgaatgtagtcgtgctgaaagcatctggctgctctctggcaaaaaacctaatgactcttgcaaggtggaactagtacaggacacttggaacaggctacggagttgtcgtcttgaatttaccagtgaggctaatcacaacagagcaacttctggagctttgaagcttgtctcagaagtgtctgatttaatatcagaatcagatcttatgcttttccgttgctaccctcttactaaggatacgttggatccgtctttaactccttgtgatgagccagttgattcttcttggtacagcaatcaggttgagatgggatctgtatatgcccagcatgctcttcgtattttatcgaggaattcccaaaaaatagatggtggttctgtcgatttgtcacaagagttgtttgccagtacagatgctggattcaggaatgattatggatctacggacatttctcatatgaaaaatccaactacctgtatttttaaaagaagggagcggcatgttcatctttgtgaaaccctgtctccagtggttcctccaaagttgttgcagtcattgagaggccctgcttttgttgattatttgtcttcaatcagccagatttccaaattagaaaacttgcgactctctgaaaataaagtcataaacaagcgaagaaggtcccgtcaggcaagacattacttgagttctggcgcacttcaactttcacatgaggatgttgtattattagcagaaagcggctgtttcagtagcagacgcgagagggttgaggttgtagagcaagcaccagtcagtacataagttaatgaactggtgctgatcatgagcggcagcattttgattttttttattagaaggcaatgtgactgggttggccgagccatttttatagttgcgtccgtgatcacggagcccggcggtggaggaaccggaacgtgtgcagttgattgctgtatctgttagataactagacattttaaagtttatttaaattttaaaattatttatagcaatcatgaatatggattaatcaaaaaaaaaaaaa

SEQ ID NO: 6877 - DNA, 2001 bp, Zea mays
tgcagacaagtatgtcgtcaaaaaataccaaaacacaccgacgcaacagcggcgccaaggtaacattcatggccttcggaaaggtggatggggctccagtcaatccaaatgccataaccctgaactcgtaatgaccagagtgcgtttggaaagcagttttgtgagtatcagaaggttgaagcaaaatctgatgatacccagctgttaaatccaaacttgtaaaccaagatgcgtgacccaattcatccaataattcttcaatcactggaactggaaatgtggattttatagtaatagcattcaagtgtcgaaagtcaacacaaaacctccaagaattgtccttattcataactaagagggccgaggaagaaaatggactactgttgtgctgaataatgcctgatttcaacatgactccattctgtctttccacttcatctttaatggccggtggatagcgataaggatgaatctgaaaaggcaccgcactagcaaccaacggaatagtgtcatcacagtcacgggagggtggtaacccagtaggttccataaacacagactcaaatttagacaatagttggatgaaaatttcaggtaaacccaactcagtgaatttgggggactgactgttcactgcagtctcaggagttaacaaacagaatgcaaccactgattattacgatagaactggaaaacaaaatacggcacgtgaatctaatggctgagcctaattggtaattgtctgcacgcggatgctaaagcaaacaaaagacatgttctcctggtcctgtaacgcaagacatgtgtcataaacaagttacgcatttgcatgacaggcagacacagcagcgacaacaaaccttttgagctatgccagcctcattctaaccttccaatcctaccaaatcatggcccaacccatgcacgtatacctctgacaggaccccaccatgaggcgagagtccaaggccacatggactacaggtggaaatacctggaacactgcattgcaagcaaatgttctccccgctgcctttggtagcaacagaaggtacagaaatagttgagaaagttatgaggaacagttggaaggataggctgcctttccaatttaaaggcactgccatcgtttcttcagcccaatgacaagcttccacacagtcacaagcaaccaccttgcatagttcttagcctcatggaattctgcccctaccctgcattgtctgccctgtgaagagagagaccagagagagagagagagggcttcgatgctcttctcaggctgcaggtcaaggagtgagaacaagaaagccttctttgaagttgggttgttgaggtgctctgaagaagtattagcgtgtcttccatcagtcagttctctcataatttcatcttcctttccttgtgttgtccttggcctctctttctgtgtccctgcactctcttgttatggactcctctcagcttactggggacaatgctgaagagtgcaacagtaatgaatctgggtggacgatgtacctgggctccccagtgaacagtgatgatctcaaagccaatggcagcaaatggagtaataatgttggcagtggctgtagcaatggtagaagcaaaaacgacaacatggattatgatgatggagactatgattcattagcttctgatgcttccacaggaccagctcaagtgaaggtgcttaatggcaaggaaaagaaaattcatgagaaaagagacaattccatagaagaacaagatagcgatgagcaagacgaacaagccaaactccctaacaactgtgacaaaaaggcaggcaagatgaagaaggaagagaagaccaccaggaggagccacaacaagagacgtagttcctgttcttcccgaccagcttctttaggtaactggtgtaaacccttgtaggctgtctcccaccatttacatctagctaaatcagcatgggggtgccaatccttgggggcatcttagggcaaatatgtacccctt

SEQ ID NO: 6878 - DNA, 880 bp, Zea mays
  misc_feature (782)..(782): n is a, c, g, or t
cggccgctcgggccggccgggccgggcctttccgccgcctccccaccgcaaaccccgaccagccctagggttcgccgccatgcctcagggagattacatagagcttcaccagaagcgccatggacggcgcatggactacgaggagcgcaagcgcaagaaggaggcgcgcgccgtcaagaagaactccaaggatgcccgcaagctacttggtgccaagggcaagaggttcgccaagaagcggtatgccgagaaggcgcagatgaagaagaccctgaaaatgcacgatgagtcttcttcccggcagaaggttgatgatgatgttgaggagggtgccattccttcgtatctgctggatcgtgatccgacacagcgcgccaaggttctcagcaacacaattaagcaaaagaggaaggaaaaggctggcaaatgggatgttcctttgcctaaggtcagacctgttgctgaagaagagatgttcaaagttctacgcactggcaagcggaaaaccaagcagtggaagagaatggtaactaaagccacctttgttggccctggatttacaaggaagccaccaaagtatgagaggttcatccggcctactggtctgcgtttcaccaaggctcatgtgactcaccctgaactgaaatgtacgttcaaccttgatatcatttctgtgaagaaaaacccaaatggtccaatgtacacttctcttggtgttatgacgaggggaacaattattgaggtgaacgttagtgaactcggtctcgtaacccctgctgggnaaagttgtttggggcaaatacgcgcaggttacgaataacccggagaatgatggctgcatcaatgctgtcttgctcgtgtgaagctttgatacaattct

SEQ ID NO: 6879 - DNA, 1285 bp, Zea mays
tccctgggaccctcgaggccgcccaatatctcaaaaagcccatcttctcttcctctctcgcagcaccgcctctcaacctccgccgccgctcgcccggggcgtcacccacccgcgcagaaggcccccgccgctcaaactaccggtgccctaaaccccgatattcttcttcgcctccctttcctcctcagcacccaaaccccgaccttcagggttccgccgccatgccgcagggagaccacatcgagcttcaccagaagcgccatggcaagcgcctggaccacgaggagcgcaagcgcaagcgcgaggcgcgcgaggtgcacaggcgctcgaaggacgcccgcaatttgattggtgctaagggcaagaggttcgccaagaaacgctatgctgagaaggcgcagatgaagaagaccctgaaaatgcacgatgaatcaaataagcgacagaaggttgatgatgatgtccaagagggtgctcttcctccgtatctactggatcgtgatcagacacagcgtgctaaggtactcagcaacacaatcaagcaaaagaggaaggaaaaggctggcaaatgggatgttccgctgccaaaggtcagacctgttgctgaagaagaaatgttcaaggtgctacgaactggcaagcgaaaaaccaagcagtggaagagaatggttaccaaagccacttttgttggagctggatttacaaggaaaccaccaaagtatgagcggttcattcgaccaactggtctgcgtttcaccaaagctcatgtgactcacccagaactgaagtgcactttcaaccttgacataatttctgtgaagaaaaacccaaatggtccgatgtacacttctcttggtgttatgacaaggggaacaatcattgaggtaaatgtcagtgagcttggtctggtaactcccgctggaaaagttgtttgggggaaatatgctcaagttacaaacaacccggagaatgatgggtgtatcaatgctgttttgctagtgtagaaccatagtgagattttgtttatggtgatgaatcgtcccatttgtatctgctcttgataagatgctcccttttgaccgatctcatggctattcccaggagtttgttttgcaccgtggtccatgggcgagcattctatatccttgctatgtgcgacaagccgacaaatgacttggctattatagcctgctataaagttgactaatacaaattagcaacatttttcttgagctaaaaaaaaaaaaaaaaagcggccaaaaaaaaaaaaaaaaaaaaggggcgg

SEQ ID NO: 6880 - DNA, 1252 bp, Zea mays
ccacgcgtccggcacaacctagggcatcaggagtgggaatcctcttcttctcgcgcagcatcgcctcccaagtccacaacttacgccgccgctcgctccaccgcgcaagaggctgctgctgccgctcacccacccccgctcgcgcagaaggccgccgcagctcttactactggtgccctaaacgccgatatccctgttcgcctccctttccccacccaaaaccccggccttcagggttccggcaccatgccgcagggagatcacatcgagctgcaccagaagcgccatggcaagcgcctggaccacgaagagcgcaagcgcaagcgcgaggcccgcgaggtgcacaggcgctcgaaggatgcccgcaatttgattggtgctaagggcaagaggttcgccaagaaacgctatgctgagaaggcacagatgaagaagaccctgaaaatgcacgacgaatcaaataaacgacagaaggttgatgatgatgtccaagagggtgctcttcctccgtatctgctggatcgtgatcagacacagcgcgctaaggttctcagcaacacaataaagcaaaagaggaaggaaaaggctggcaaatgggatgttcctctctgccaaaggtcaggcctgtagctgaagaagaaatgttcaaggtgctacgaactggcaagcgaaaaaccaagcagtggaagagaatggttaccaaagccacttttgttggagctggatttacaaggaaaccaccaaagtatgagcggttcattcggccaactggtctgcgtttcaccaaagctcatgtgactcacccagagctgaagtgcactttcaaccttgacataatttctgtgaagaaaaacccaaatggtccaatgtacacttctcttggtgttatgacaaggggaacaatcattgaggtaaatgtcagtgagcttggtctggtaactcccgctggaaaagttgtttgggggaaatatgctcaagttacaaacaacccggagaatgatgggtgtatcaatgctgttttgctagtgtagaaccatagtgagattttgtttatggtgatgaatcgtcccatttgtatctgctcttgataagatgctcccttttgaccgatctcatggctattcccaggagtttgttttgcaccgtggtccatgggcgagcattctatatccttgctatgtgcgacaagccgacaaatgacttggctattatagcctgctataaagttgactaatacaaattagcaacattt

SEQ ID NO: 6881 - DNA, 1190 bp, Zea mays
catcttctcttcctctcgcgcagcaccgcctctcaacctccgccgccgctcgcccggggcgtcagcgtcacccacccgcgcagaaggcccccgccgctcaaactaccggtgccctaaaccccgatattcttcttcgcccgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctgagaaggcgcagatgaagaagaccctgaaaatgcacgatgaatcaaataagcgacagaaggttgatgatgatgtccaagagggtgctcttcctccgtatctactcgatcgtgatcagacacagcgtgccaaggtcctcagcaacacaatcaagcaaaagaggaaggaaaaggctggcaaatgggatgttccgctgccaaaggtcagacctgtagctgaagaagaaatgttcaaggtgctacgaactggcaagcgaaaaaccaagcagtggaagagaatggttaccaaagccacttttgttggagctggatttacaaggaaaccaccgaagtatgagcggttcattcgaccaactggtctgcgtttcaccaaagctcatgtgactcacccagaactgaagtgcactttcaaccttgacataatttctgtgaagaaaaacccaaatggtccgatgtacacttctcttggtgttatgacaaggggaacaatcattgaggtaaatgtcagtgagcttggtctggtaactcccgctggaaaagttgtttgggggaaatatgctcaagttacaaacaacccggagaatgatggctgtatcaatgctgttttgctagtgtagaaccatagtgagattttgtttatggtggtgaatcgtcccatttgtatctgctcttgataagatgctcccttttgaccgatctcatggctaatcccaggagttgttttgctgcaccgtggtccatgggcgagcattctatatccttgccatgtgcgacaaatgacttggctattatagcctgctataaagttgactaatacaaattagcagcatttttcttgagctttgatctacacaagggaggtct

SEQ ID NO: 6882 - DNA, 1259 bp, Zea mays
attgggtacctccactcttcttctcgcgcagcatcgcctcccaagtccacaaaccacaacttacgccgccgctcgctccaccgcgcaagagtctgctgctgccgctcacccacccccgctcgcgcagaaggccgccgcagctctcactactggtgccctaaacgccgatatccctcttcgcctccctttccccacccaaaaccccggccttcagggttccggcaccatgccgcagggagatcacatcgagctgcaccagaagcgccatggcaagcgcctggaccacgaagagcgcaagcgcaagcgcgaggcccgcgaggtgcacaggcgctcgaaggatgcccgcaatttgattggtgctaagggcaagaggttcgccaagaaacgctatgctgagaaggcacagatgaagaagaccctgaaaatgcacgacgaatcaaataaacgacagaaggttgatgatgatgtccaagagggtgctcttcctccgtatctgctggatcgtgatcagacacagcgcgctaaggttctcagcaacacaataaagcaaaagaggaaggaaaaggctggcaaatgggatgttcctctgccaaaggtcaggcctgtagctgaagaagaaatgttcaaggttctacgaactggcaagcgaaaaaccaagcagtggaagagaatggttactaaagccacctttgttggagctggatttacaaggaaaccaccaaagtatgaacggttcattcggccaactggtctgcgtttcaccaaagctcatgtgactcacccagagctgaagtgcactttcaaccttgacataatttctgtgaagaaaaacccaaatggtccaatgtacacttctcttggtgttatgacaaggggaacgatcattgaggtaaatgtcagtgagcttggtctggtaactcccgctggaaaagttgtttgggggaaatatgctcaagttacaaacaacccggagaacgatggctgtatcaatgctgttttgctagtgtagagccatagtgagattttgttgatggtggtgaatcgtcccatttgtatctgctccgatatgctattttttgaccatgtcatggctaatcccagtagtttgttgtgcaccatgggcataatgagcattctgtattctcgctgtgtgctacaaacatatatggagtaatataaattagcagtatttttttcggggctaaaaaaaaaaaaaaaaaaaaaaatcgggggggggccccgtccgccccaaaaaattt

SEQ ID NO: 6883 - DNA, 1444 bp, Zea mays
  misc_feature (1051)..(1051): n is a, c, g, or t
gccggccgggccggcatctcaaaaagcccatcttctcttcctctctcgcagcaccgcctctcaacctccgccgccgctcgcccggggcgtcacccacccgcgcagaaggcccccgccgctcaaactaccggtgccctaaaccccgatattcttcttcgcctccctttcctcctcagcacccaaaccccgaccttcagggttccgccgccatgccgcagggagaccacatcgagcttcaccagaagcgccatggcaagcgcctggaccacgaggagcgcaagcgcaagcgcgaggcgcgcgaggtgcacaggcgctcgaaggacgcccgcaatttgattggtgctaagggcaagaggttcgccaagaaacgctatgctgagaaggcgcagatgaagaagaccctgaaaatgcacgatgaatcaaataagcgacagaaggttgatgatgatgtccaagagggtgctcttcctccttatctactcgatcgtgatcagacacagcgtgctaaggtactcagcaacacaatcaagcaaaagaggaaggaaaaggctggcaaatgggatgttccgctgccaaaggtgtttctcaaatctgaacacagcaaacccatttctggttgattcaatgagttacatatttcttgtcctttcaggtcagacctgttgctgaagaagaaatgttcaaggtgctacgaactggcaagcgaaaaaccaagcagtggaagagaatggttaccaaagccacttttgttggagctggatttacaaggaaaccaccgaagtatgagcggttcattcgaccaactggtctgcgtttcaccaagctcatgtgactcacccagaactgaagtgcactttcaaccttgacataatttctgtgaagaaaaacccaaatggtccgatggtacacttctcttggtgttatgacaaggggaacaatcattgaggtactccaagcatttttaccagttattgtagtcaatactcttgtgtagtgactgtattaggtgctagccatggttcactgagattacctctttatatcacccccntcccctcccctctctcgaaaattgctgctcacaatagtcatctttcaggtaaatgtcagtgagcttggtctggtaactcccgctggaaaagttgtttgggggaaatatgctcaagttacaaacaacccggagaatgatggctgtatcaatgctgttttgctagtgtagaaccatagtgagattttgtttatggtggtgaatcgtcccatttgtatctgctcttgataagatgctcccttctgaccgatctcatggctaatcccaggagttgttttgctgcaccgtggtccatgggcgagcattctatatccttgccatgtgcgacaaatgacttggctattatagcctgctataaagttgactaatacaaattagcagcatttttcttgagct

SEQ ID NO: 6884 - DNA, 2433 bp, Zea mays
gttactacataagtgtgtgtttatgatgtgttatttttcttttaaaaaagagagaatgagtgagttttattggaatgaaactatcttggagcaattaacaactcttcataagttataaaatgaaatatatatatatatgaaaacgtagaataaaacttttattggaaacgagtgtataattcaagttttgttatattttatatttaaagaaattccataaaactcagaggttatacttagaagtatgaaaacatatctggtgcacatgaaaactttggtgcacatatggtgcacatgaactagcaaaattcacaaaaaaactgaaaagaatacatacataatctttccatcttactccatcaagtttaaatttgttatactttagttgtaataataaaaaagataaaatattcaacaagtttaaattagaatatcggttaaaatgttcttttcttaagtataacgaattttaacttaaaattttgtatataattagagtgggatgtggacaggatatgtttcgtagaagtatatataattatatatactccaacctactactcgtagtggtgatccttgtcccacattttgcgcttgcgtttgcgtgaaattcagggtttccattgctgttggatgtctgtagcataacgacaggacctactccaaattaactcgctgaaagcggctccggacgatcaaagtcaagatggcaatggccatggagtatttaaactactcttaccgcgctagctctggcgattaagatgcaaatgaggatcatgtgggatgcacatcaagctgcgctagtactacagtataaatgtatgatgccgtgttttcacgtacgattgaatatagaatatgtattatatgcagggctggcaatacccggtgtgctgtccacgaaatggaaagagtactagtagtagtagagcattgagattcccttttgtcattaattaattatttaattgaaggaatggggacaacgccaatgggccaattagcaaagcgtagcaaatcatttggtgaggtcgagctatcgatccatcgcgcgcgtaaaggtgggtgacgcgtcgctctccttctcctctcccctgcttggctgcttgccctattagatctctccatgtccatttaagagagagagccagacaggtccatccacaggaccgccagagagcccagcaccagcggcagccacccaaagcccaggaggccaggccgcctcaccgccaatggccgaccgcgtgtaccccgccgccaagccgaacccgcctccaggcgcggcgggcaacagcaacggcgcgcaggcgtcgtcgttccctgcgcccaagtcgcagatgtaccagcggcccatctaccgtccgcaggcccccgcgaagcggcagcgcgggcggtcgtgccggtgcagcttgtgctgctgcttctgctgggcgctggtggtggtgatcctgctggcgttcgtggccgcggtgtgcggcggcgtcttctacctgctgtaccggccgcagcggccgtcgttcagcgtgtcgtcggtgcggctggcgtcgctgaacctgacgtcgtcggcgacggcgcccgtgctgagcgacgccatcacgctgaccgtgacggcccggaacccgaacaagaagatggtgtacctgtacgacgacctgaccctgctggtggccacggccgccaacgccgtgccgctggggagcgccacggtgcccgggttcgcgcacgcggccggcaacaccaccgtgctgaccgccaccgtctccgccagcgcggtgggcgtggaccccagcggcgccagctccgacatcaagcggtccggcggcgggtcgttctccgtggtggtggacgcggacaccagcgccggcgtccgggtgggcgggctcaagacgaagaagatcggcatccaggtgcactgcgagggcatcaagctgacggcaccgcctccgcctccgccggcgcccaagagggccaaggggaagaacagcaccgccgcgctcgcgcctgctccggcgccgtccgccgccgacgcgacgccggcgaagacggccacggtgagcacggcggcgcactcgtgcaaggttagggtccgcgtcaagatctggaagtggactttctaggtacgggcagcgggaggagaggagacacctttaggggctgcagcgcgcaaaaaaaaaagattttcgctttcattgctatttatttatctatatatataaatatatatacggcgataagtttgttatcaccatgattactatatatcggagcgggcaggagtatatgtattgtaggaccaagacatgcgtgcgtcggtgtaaattcattcccccaggcattttcttttcctttttgcttcaaccatttttcacccctgtgattgatcagtggaacggatgatgtataattacgtgtgattgtaaaaaaaaa

SEQ ID NO: 6885 - DNA, 1437 bp, Zea mays
tgaaggaatggggacaacgccaatgggccaattagcaaagcgtagcaaatcatttggtgaggtcgagctatcgatccatcgcgcgcgtaaaggtgggtgacgcgtcgctctccttctccttctcccctgcttggctgcttgccctattagatcgctccgtgtccccacgcgtgcgagagagaggtccatccacaggaccaccagaccagagccacagcaccagcggcagccacccaaagcccaggaccgcctcaccgccaatggccgaccgcgtctaccccgccgcgaagccgaacccgcctccaggcgcggcgggcaacagcaacggcgcgcaggcgtcgtcgttccctgcgcccaagtcgcagatgtaccagcggcccatctaccgtccgcaggcccccgcgaagcggcagcgcgggcggtcgtgccggtgcagcttgtgctgctgcttctgctgggcgctggtggtggtgatcctgctggcgttcgtgggcgccgtgtgcggcggcgtcttctacctgctgtaccggccgcagcggccgtcgttcagcgtgtcgtcagtgcggctggcgtcgctgaacctgacgtcgtcggcgacggcgcccgtgctgagcgacgccatcacgctgaccgtgacggcgcggaacccgaacaagaagatggtgtacctgtacgacgacctgaccctgctggtggccacggccgccaacgccgtgccgctggggagcgccacggtgcccgggttcgcgcacgcggccggcaacaccaccgtgctgaccgccaccgtctccgccagcgcggtgggcgtggaccccagcggcgccagctccgacatcaagcggtccggcggcgggtcgttctccgtggtggtggacgcggacaccagcgccggcgtccgggtgggcgggctcaagacgaagaagatcggcatccaggtgcactgcgagggcatcaagctgacggcaccgcctccgccaccgccggcgcccaagagggccaaggggaagaacagcaccgccgcgctcgcgcctgctccggcgccgtccgccgccgacgcgacgccggcgaagacggccacggtgagcacggcggcgcactcgtgcaaggttagggtccgcgtcaagatctggaagtggactttctaggtacgggcagcgggaggagaggagacaccttaggggctgcagcgcgcaaaaaaagattttcgctttcattgctatttatttatctacatatataaatatatatatacggcgataagtttgttatcaccatgattactatatatcggagcgggcaggagtatatgtattgtaggaacaagacatgcgtgcgtcggtgtaaattcattcccccaggcattttcttttccttttgcttcaaccattttccccccatgtgattgatcagtggaacggatgatgtataattacgtgt

SEQ ID NO: 6886 - DNA, 1276 bp, Zea mays
attgggtacctcgaggccggccggggcccgcgaggcccgcccacaggaccaccagagagccacagcaccagcggcaggcacccaaagcccaggaccgccaatggccgaccgcgtgtaccccgccgccaagccgaacccgcctccaggcgcggcgggcaacagcaacggcgcgcaggcgtcgtcgttccctgcgcccaagtcgcagatgtaccagcggcccatctaccgtccgcaggcccccgcgaagcggcagcgcgggcggtcgtgccggtgcagcttgtgctgctgcttctgctgggcgctggtggtggtgatcctgctggcgttcgtggccgcggtgtgcggcggcgtcttctacctgctgtaccggccgcagcggccgtcgttcagcgtgtcgtcagtgcggctggcgtcgctgaacctgacgtcgtcggcgacggcgcccgtgctgagcgacgccatcacgctgaccgtgacggcgcggaacccgaacaagaagatggtgtacctgtacgacgacctgaccctgctggtggccacggccgccaacgccgtgccgctggggagcgccaccgtgcccgggttcgcgcacgcggccggcaacaccaccgtgctgaccgccaccgtctccgccagcgcggtgggcgtggaccccagcggcgccagctccgacatcaagcggtccggcggcgggtcgttctccgtggtggtggacgcggacaccagcgccggcgtccgggtgggcgggcttaagacgaagaagatcggcatccaggtgcactgcgagggcatcaagctgacggcaccgcctccgccaccgccggcgcccaagagggccaaggggaagaacagcaccgccgcgctcgcgcctgctccggcgccgtccgccgccgacgcgacgccggcgaagacggccacggtgagcacggcggcgcactcgtgcaaggttagggtccgcgtcaagatctggaagtggactttctaggtacgggcagcgggaggagaggacacacctttaggggctgcagcgcgcaaaaaaagattttcgctttcattgctatttatttatctatatatatatatatatatataaatatatatacggcgataagtttgttatccccatgattactatatatcggagcgggcaggagtatatgtattgtaggaacaagacatgcgtgcgtcggtgtaaattcccccaggcattttcttttcgttttgcttgaaccattttttccctgtgattgatgtgtggaacggatgatgtataatt

SEQ ID NO: 6887 - DNA, 1849 bp, Zea mays
caagcagcaagtcgatcgtgagcagctagctcttccctgctcatcgtcgccagctggtccaagggaggaggaagaagagatagatggacgacgtcggcggtgctgctgctggtggtggcgattcaaagcagctcttggttgaagcagatgggaacacacgcacgcttattttgaacaggccgaaccagctgaatgtactctcctctgcaatgattaagggactcctgagctgtttcactgcttttgtgaaagatgatggagttaaattgttgattatgaagggttctggaagagcattttgtgctggaggtgatgttgttgctggtgtccagtcaataaataatggatggaaatggggcgctgatttcttccgagatcaatattttttaaactacataattgcaacatgtatcaaacctcaggtttctcttcttactggaattgtcatgggtggaggcgctggtgtttctttacatggaaaatttcgagttgccactgataacacggtttttgcaatgccagaaacatctcttggtctttttcccgatgttggggcctcatattttttggctcggcttcctgggttctatggttctctaatacctccgatctttattcaattgaaatacatgtagctatgtcattgcaacgtatatttcaatgttctgctaacactcgagggatattatgtatcatcgtatcattcttcaattttagttttataccatgtgatttattcttagcaagtgtgattcttgcacaattgatctatgcaattacatatttgatcgtggagatatattaatataaagaaatgaaaaatgataatctttcttcttttcaagttgatttattggttccattatgaggtagccatatagttggtggtaatgacaacattggatatcttgttaaataaaacattactctaacattctgcaggagagtatgttgctcttgttggtgctagattggatggtgctgaaatgcttgcatgtggtctcgcaactcattttgtcccttcaaatagaatgctattgctggaagaatcccttaaaaaggtggacacctcgaatagttttgttgtatgtagtactatcgatcaattctgtcaacagccatcccccaaaacaaaaaagttccttgaataggttggaaatcatcaacaaatgcttttctaatggaacagttgaagaaattatatcctctcttgaggaagtggcctcaaattcagcaagcaaatgggttgctcagacaattcagtatctgaaaaaggcttctcctactagtctgaaaatcacattgagatcgataagagaagggagaacacaaaccgttggggagtgcttgcaacgggaatatagaatggtttgccatgtcgtacgtggtgacttcagtcgagacatttttgaaggatgcagggctatactagtagataaagataaaaatccaaagtggatgcctccaaggttggaacaagtgcatgatgatgcagttgaagagtatttctctagggttgatgatccagagtgggaagatttggacctacctgtcatgtgttcaaatggaagaattatggagtccaagctttgaatgaagcctttattgaacaatttaatggaacctcagttgtggttaaaataacaacccatcccatgttcgaagagtctatgtacactgaatactattggtaaaataaatctaaatatgttgtgtatatccacttataccatagaaggtactcattgctatttgtgttatagggatagacaatatcggttcctagctcgatctggcttatttagctcgtgagccaccatataatatgctaccactattggttaaattg

SEQ ID NO: 6888 - DNA, 1771 bp, Zea mays
atctcgcaagcagcagcagagcagaaactgagggaagcgagggacggcgatggcgggtgcggaggggagagggccgagacggagccgcgtggcgttcgtgctggtggacgggatcggggacgtgagcgttccgtcgctgggcgggcgcacgccgctggacgcggcgtgcgcgccgcggctggacgcggtggcggcggccggggtgaccgggctcatggaccccgtggagccggggcttgcatgcggcagcgacacggcgcacctatccctcctcgggtacgacccacgggagtactaccgcggccgcggcgcgttcgaatccatgggtgccgggctcgccatggcgcctggcgacatcgccttcaagtcgaacttcgctacactggatgagaacactggagttatcatcagcaggagggcagatcggcactttgaagaggaaggccctatactctgtgctgcgttggatgggatgaaacttcggtcgtttcctgagtatgaagtcagagtaagatatgctaccgagcatagatgtggtgtggttgtcaaaggaccaaagctgagtgggaacatttctggaactgatcccttgaaggacaaccgcttgcatctgaaggctgaaccgttggatggctcagaagaagctaaaaacactgcagctgtggtcaatgagctttctatggagattacgcgcatactggtttctcaccccatcaacgcaaagcgtgcagctgaggggaagaacatcgcaaatgttgtgttgctgcgaggttgtggtattcggattgaggtgcctgcctttgaaaccaaacatggacttgcaccttgcatggttgctcctaccaagatcatagctggcctgggactgtcactggggattgatatccttgaagcacctggagcaactggagattatcgtactctcttaacttctaaagctaaagccatagccaaggcactctctgcccctatggatacaccacctcgtgtttttgtgcctggagaggatggatacaaggctggaaaagaaaatggatatgactttgggttcctgcacataaaggccattgatgatgctggtcatgacaaggctgtcaagttgaaagtacggggtctagaagctgttgatcgagctattggtcagcttgcgaggcttctttgggaagctgaaaaggccggacactatcagtactttctttgcgtcactggagaccattctactcctgttgaatatggtgatcatagcttcgaacccgtcccgtttgcaatatgcagactgagagattatgcaggagccattggggaggataatattatgaatacacagctcgacgattttcccctcccttcggtaaaatccggagaagatttgctcgacagtatagaatcactggagcacaagcctggtcaacttaaagctttcagtggcgacagtgtgtgtgagttcaacgagatcgccgctgcgaggggctgccttggacgattcccaggaagcgagatgatgggcatcattaagaagtttatcaaggccaagaatgattaatgctggttgaaatgctaacctttagcgtaatatattggccataaggtttattatcaatgtaataaactaataatgacagaatggagcaatatggaagaaccgtcttgattggagatgaataagagataccttggtgaaaaacaatgagatctgcttatgtacattgtacccagtgttgggtcactttccggccacatgaatgagaaattttgatggaagttttccccc

SEQ ID NO: 6889 - DNA, 1060 bp, Zea mays
ttataggcgcaagcttgtcgagctcattgacaagcttgacgaaggtaccgtagattggacagagtttgcaagtgaggtgaagatgcaccatggaaacaggcttggaggtccgtatcagaggctgtctggtcgaagtccaaggcatgaggagtatttttatgcaaatcctcttccagggtgcatgtgcagaagaaacacacaggatcaagtggcatgaaccttacatacgaatagactgttatcatacattgagctttcctccaactcattgacatacaccaaacagtgaaaatccgggtaaaccgacaacaaaaggacatgtttatatagtttcccatcttacacgagatacaggagggaaactatataaacatgtccttttgttgcatctcctctgctgatcagagctttcaaactcatgacagaataatgtactaaacttcagtttggtgtctatctcagtgtacctacactcagttggaaaacttcaaccacactgcaacaaggtttataaaaggtttgctatgaggaaaaacaaatttatgggctcaaacaaagtgtgatagtgaaagtcattttgcttccagcttaagaaccaagccaagaaaacagatatcaactgtgacgccacactcaaaagcttgtttggtgagagggataaggttgggatgctggagatctctaagcttttgagccgtggcttcccgaaaatctccaagcttttgtggtccatggagccagggatggctctttggtaaaagacttcgttgtggatggcctcttttatggtccatgttaagtcccaagtcccactaggtggttaagcagaaaaatcttgtgatggcattaagactttcagactttgtttttgggtctgatgcatgtaaaaaggattcccagtgtttctgttgctcttgcgatcctgtgaggacacatatgagagaaatatttagtttgttgatggcaaatcttgtcttatgttcatgcctgtacctatctgatcaagcgttatgatatgatcccatgcgtggtactgtgttcttcaaaaaaaaaaaaaaaa

SEQ ID NO: 6890 - DNA, 4208 bp, Zea mays
  misc_feature (515)..(515): n is a, c, g, or t
  misc_feature (2220)..(2220): n is a, c, g, or t
  misc_feature (2236)..(2236): n is a, c, g, or t
gtaaacagaaccatacctagctccatatgaaactatttcccggttttaagtacacctaagttaaggttcatacattggagctctggcagtaaaacaatagtccttaccttgagacagcttagattaggatggggtggatggtaatatggcatgagcaacataccgcatttcatgcatggaggaaatcatttttactttctttcctagccatggtagctatgttgctccttaccaaggcactacatggagcatcatatggttcatgatgtaaacatggttttagatctgtctatactcacactcaagaaccagccaaaatgtgatattccacaacctgagagaaatcaaaatgaaatcatgtacaacatagtacatatgatttacatttacattacatatatttctttatacaaaagtaataaaatattataagaaggaatcagggaataagcagctagagctatgggcagccctcacctgatccgctaatacatatgaaatagacttttagactntgttggagaacagaatatgttggaagtgaacatttttataacttttcaattgaatccttattttttcccgaatagaggagcaagaggaagaggatagaggaggcgccacctaaggagtcggcccgggagaagaagcgctctgagaaggtaaccagttgttctctcctgcattttggatcaggcccttggttagttcagttgctgggcggtttagctgatgtgcggtgatgtgggtgcatgtgtgatgtgtgtgtaggagaggagggcgcagcttgattcaatccatgtcaagtcagaggctgctgcgaggtttgcatatgcaggtagaatttagatggtgaggttttgtctctgttcccatttttataacgactaggtgtttgagttcctaagattaaagtttatgtagattcttctttgtaattagatctttgttaggcatctaactgaataaatgatctccattatggactggttatattattttctgtgcggccggttgggttaaagaaaagacgtgaaatggtattttccagtatggactgtataaatgtaattatactcctatgctggtacgtctgtctaaccttgctattacacttactattatggctttgtgtttacccaaagttccaaacctttcaggtcctgcttcgctttcaggtggatttatcttgcaaatggtatgtggatccgttccagaggcaatgagccttgcagccaggtaacatgaccacctcagtcgcttcccttgagtgccaaaaaacttctattcgcccgccctttataatttctgttgacttgcctccccttttcagtttgcagtataaaaaatacccaattatgtccgctgctggttcgacgcagcgtgtgccgaggatttctactgccgagcataagaaagtatttgaaatcaagaacttgcattcattcaatcataatgtgtttcctatcaagcataagtgtgtgcgttttgtttgatatctgctttaataggatattgttcttgtcaccccaaaaatgttcccattctactttcgggcaggtgaattgcaaagaaatgatctgttcgcaactggtgctctcgggcgactccatcaccgagcagcccttcgccccggtggctgcggtgtcgcactggctgacacctgctcgcagctgcattacaagttttactgactaagtattttcaggtttattcaatttcggttgtaatgcttctgacagcagttgtatcagtcctcttgtttagcttccatgtttcaccgtgcttgcaggtttgctatgaggaaaaacaaatttatgggctcaaacaaagtgtgatagtgaaagtcattttgcttctagcttaaggtcagttaatcttgtttcagtaccttgtcttgctgatttacttgccccacacaattgttgaatcacattgcttatgcatttgtggactgtgctacatatatttatgagagaattccatgtgtgttgtaaaaaattgctctcacatttataccacagaaaaagtgtgttaccctatggtatcacaattcgagttttagtctaccactgctgtctgtttttgctaacttggacattaactataaaaaacattatgaattattgattaggttgaacagaaggttgttctgagaacaaacacagattatctcactgaattattgattacttgtcttgagaatactgttattgtagnaagcttgtgcattgcntgtatatgaaaaaagaatcttacataggtatcgatcttctcggagatgtttatttattggtgtttgagaatatatattatatatatatatatttgaattattgcctgcacagttcaaaggatcgagataactgtagttgtgttggctttcctttttccattcagtgtgtagttgatggctaacttcatgactatcatgagtgacttaactgattttgtcaaagaattcaattagtaacacgcctgatgaatcataatcctctgtgctacctatacccgtcgtagtaaaataaaatattatggcctgttagcctccttgctttgttagtttggagagtactctgtaattttcttggtttccttgtaataccaggttactatagctgtctgcatcaagactgttttgtgtcttgaactaagaaaaaactctcccatggtttgcagaaccaagccaagaaaatagatatcaactgtgacgccacactcaaaagcttgtttggtgggagggacaaggttgggatgctggagatctccaagcttttgagccgtgacttcccgaaaatctccaagcttttgtggtccatggagccagggatggctctttggtaaaagacttcgttgtggatggcctcttttatggtccatgttaagtcccaagtcccactaggtggttaagcagaaaaatcttgtgatggcattaagactttcagactttgtttttgggtctgatgcatgtaaaaaggattcccagtgtttctgttgctcttgagatcctgtgaggacacatatgagagaaatatttagtctcttgatggcaaatcttgtctaatgttcatgcctatgtctatctgatcaagcgttatgatatgatcccatacgtggtactgtgttctttagagatgtatttaattatgtttctcttacatttcatattgctttgtctaattgttaccgcaaattaagattttattataattccaatttgatatgtctcatcataaccatggttactgtagggcgcacgaagtgcgcctcctgatctagtatatacaaaagtctagagtaaagtatgtctctaatatggattcttaatgtatagaagacgagatataaaagacattcctagagagggaaagatgttgcagatgatgaaatcttttagagaaaacgatagataggaatatatcgcctgattggttaactgcttcggcacatgcatgggctcgttgcgtgcaaaaagtccatgtcctgggtgatgtttggttgtctatatttatgttcgagccaggccacttgcgtgcaaaaaatgatagcgagccatgctccccacactttaaccgagacgctttttagttagtttttattatatattttcattgaaatatttaatcatcgaaccgatttcatatgtatgttcctaagattttttgaacaaagctagaccactcatgttgtatatatatttttaaaatctccgcacatatatctgctcaaccaaccaaataatgtgtgtaccatcctgcatttatctgtacacacaaccaaaaaaatatgtttgtatggtcttaaccaggcgttgctcatcttgtctcggctatggttggactcctacagacaaccaatcaaacggatagagtataaggctggatgtataatctgttccaatcatctcatgcgcaactcactctaatagagtcatcgatgcatcggcctcgctgccacctctcccctctccaccgtctggtctgcctttctcctaaaagaagacttctaagagcaactccaacaaaggtcttaaacccagccctattttttaaaaaataggactctagactctaaaataacttccaagagagatcctattttataaatttggctcaaatttatatagggatccaactatgagatccccaaatatactacctcgttttgagcggtcctatatccaatctcaaccaccccacattctcgag

SEQ ID NO: 6891 - DNA, 969 bp, Zea mays
gtattcctcctatgacgaattcctcaggctccatgaaggtaagcctgtcttaatgggcttgattgttgaacctgacttagtacttttatccatgtcacgacattgaaccagacagtcactcatgtccttaggatattaacggtatacatcaacaattcattctattttaaccccgcgcccgacttttttggcccttcaaatgagttccacgcatcaagaagtcaagattccaggaggcctaaaataggagaggagggcgcagcttgattcaatccatgtcaagtcaaaggctgctgcgaagtttgcacatgcaagtagaatttagatggtttattcaatttcggttctaatgcttctgacagcagttgtatcagtcctcttgttcagcttacataataatgtactaaacttcagtttggtgtctatctcagtgtacctacactcagttggaaaacttcaaccacactgcaacaaggtttataaaaggtttgctatcaggaaaaacaaatttatgggctcaaacaaagtgtgatagtgaaagtcattttgcttccagcttaagaaccaagccaagaaaacagatatcaactgtgacgccacactcaaaagcttgtttggtgagagggacaaggttgggatgctggagatctccaagcttttgagccgtggcttcccgaaaatctccaagcttttgtggtccatggagccagggatggctctttggtaaaagacttcgttgtggatggcctcttttatggtccatgttaagtcccaagtcccactaggtggttaagcagaaaaatcttgtgatggcattaagactttcagactttgtttttgggtctgatgcatgtaaaaaggattcccagtgtttctgttgctcttgcgatcctgtgaggacacatatgagagaaatatttagtttgttgatggcaaatcttgtcttaaaataaaaaaaaaaaagcggcc

SEQ ID NO: 6892 - DNA, 1767 bp, Zea mays
cggacgcgtgggtttcatcttgaacttttctggtactgacttgaaatgtctattaaatttgctagaaatgccaaggaattgctaagatttaatgacgctggtgttgacctggttgtcaaggtgtgtggagagacatgtgtattcctcctatgacgaattcctcaggctccatgaaggtaagcctgtcttaatgggcttgattgttgaacctgacttagtacttttatccatgtcacggcattgaaccagacagtcactcatgtccttaggatattaacggtatacatcaacaattcattctattttaattgcttgcaaaacttttttggcccttcaaatgagttccacgcatcaagaagtcaagattccaggaggcctaaaataggagaggagggcgcagcttgattcaatccatgtcaagtcagaggctgctgcgaggtttgcacatgcaagtagaatttagatggtcctgcttcgctttcatgtggatttatcttgcaaatggtatgtggatccgttccagaggcaatgagccttgcagccagtttgcagtataaaaaacccaattatgtccactgctggttcgacgcagcgtgtgccgaggatttctactgccaagcataagaaagtatttgaaatcaagaacttgcattcattcaatcataatgtgtttcctatcaagcataagtgtgtgtgttttgtttgatatctgctttaataggagattgttcttgtcaccccaaaaatgttcccattctactttcgggcaggtgaattgcagataaatggtctgttcgcaactggtgctctcgggcgactccatcactgagcaacccttcgccccggtggctgcggtgtcgcactggctgacacctgctcgcaattgcattacaagttttactgactatgtattttcaggtttattcaatttcggttgtaatgcttctgacagcagttgtatcagtcctcttgtttagcttccatgtatccctcgcatccttccttggatccacataagtgttaatgataattttgttgcatctcctctgctgatcagagctttcaaactcatgacagaataatgtactaaacttcagtttggtgtctatctcagtgtacctacactcagttggaaaacttcaaccacactgcaacaaggtttataaaaggtactgttactattgttaaaattagtcattttagctatccgcttctatttcaccgtgcttgcaggtttgctatgaggaaaaacaaatttatgggctcaaacaaagtgtgatagtgaaagtcattttgcttccagcttaagaaccaagccaagaaaacagatatcaactgtgacgccacactcaaaagcttgtttggtgagagggataaggttgggatgctggagatctctaagcttttgagccgtggcttcccgaaaatctccaagcttttgtggtccatggagccagggatggctctttggtaaaagacttcgttgtggatggcctcttttatggtccatgttaagtcccaagtcccactaggtggttaagcagaaaaatcttgtgatggcattaagactttcagactttgtttttgggtctgatgcatgtaaaaaggattcccagtgtttctgttgctcttgcgatcctgtgaggacacatatgagagaaatatttagtttgttgatggcaaatcttgtcttatgttcatgcctgtacctatctgatcaagcgttatgatatgatcccatgcgtggtactgtgttctttagagatg

SEQ ID NO: 6893 - DNA, 1981 bp, Zea mays
tttaagtaatccagagctaggctactgctgctggagtactggacgcgtctgacatgagactgtcttcaacgcatgccacgcccttccccctccccttgcactgtgcacgtttagggtaacgagatgggtgcagcggccacctctaaaccttctcctgcaagcaacagtggtagcgctgagagcagtgctccgctagatatggagggctgtggcaagccctctaaatactgtgcttgtactgttcaattaattgttagtagaataaaaattgataggaggtgaaaagtaagtatagaaaatgtttgtagtggggtgtaggggaaggatttagggggaaccgctgtacagggtggagatatagagggaaagagaacgctgatgtggcacgtgagtgggatatagggggccaaatttaggggcaaccgctgaagacagtctgatggggcttgaatgaggtgagctgtgagcctgacgggccacatatgccaagccattgcagccttccttggtgacggccggggctgacgcacgggcttgaatgcctctgacctctgacccgaccctactccaactcaagctgagaatggctgccagtagtaaatggcttcttatcgcttccctggtactccctccaacggctacctattcatcagtctcaggtagggggtaggagtagtaggagtcataatgccgaccaaccctagatcctaagccctaatgcttaccttaaacaagaccaagagttcagttccagtggttgaaatgagagctgaaacgcctgtactgtactgtactgtaatgtaccatgtggaaaatgggattgcacttgcaggccatgaacaggaggaactagtacactgctgcaaagaatgacaactggcacgatatcttgtatcgataaatcatataataaaaaatccaccacctacatatgttgtcgaggaaaatgaaaggtaattaaccacgtactaacattttcaatttgcatcttgtatatttcccgacgaaacagaaggtcaaagtcgtcagcgcctccgacgaaaatcaggagcagaaaccgtcggatggaaacgaaacaaactcaaaactgaaatgacaacaactcacgagctaatcgcacagtctttttcgcgtggcttggctgacatgtgaaaaagctaggcgcccccgataaaaagggcctccccgctccccggacgcggcggctactgtttctgtttcttccttcgaccccggtcgtcccgtcctccgctgggcatcgaaagtcgaacgcctcccccctccctccctcccagttccgtcgtcggctcctgcagcagcagcaagcaatggcggcttcctggagagccgtggcgctggcggtggccgcagtgggctggcttcttgccggtgccgcgcgggcgttcccggccgaggacttggtcgcgcggctgccggggcagcctccggtcacgttcaggcagttcgccgggtacgtggacgtcgacgccaaggccggcaggagcctcttctactacttcgccgaggcgcgggaggacgccgccgccaagccgctcacgctgtggctgaatggaggtcctggctgttcttcggttggaggtggtgctttcaccgagctagggccattttatccgcgaggagacggccgaggcctcagattgaacaagaagtcatggaacagagcgtccaatcttctgttcgtggagtcaccggctggagttggatggtcttattcgaacacttcatcggactacagcactggagacgtgcggactgctcatgacatgtaccaatttttgttgggatggtatgcgaagtttcctgagtacagatcaagagctttgttccttaccggagagagttacgcagggcattacataccacagctcgctgatgtacttatcacccatcacgaggaatccctacagatgaataaattgtgtggttttttctggctcaaaaacaaaaaaaaaaagaaaaa

SEQ ID NO: 6894 - DNA, 7518 bp, Zea mays
tctcctgctgctgcgagccctgtgccaaaacatggttgattatagtagggtagttgttcttgcgtctttgtgactttgtgcacgcgtgatcttctttcttgtgtgtgttgctacgaattgctcttgtgtgcgtactttatcttcctaccttactctaagttataactctgatcttttgtaaggctgcaagaggctccaatttgtggagatttcttgcgaacgggaacacccttaatctaaggaagaactatggcactcaagtggatgatttatgtgacgatgtatatgtggtatagataatttacgtgatgtatttgatgttatatatgtgtttgtaaatgtatacgatctgaataatgaatagctagatatatttgctgtgatttgaacaacaaccggtcatacttttcatcggtctctatgtttaaaaactatcaagattgctgatgtatgcttggttgccgatgtacgtacacgccggcttgtcgtcccggtatacgtcatcccaaagaatgtctggtgcggagaagaggtgcgtacagtagacgactggaattatgtgaagagagccgcgcgctagctagggcctagatgtggccgcagacagacggacggcgactggcgcgcagaacaagccgggggtggcagcgaccggacggacaccacgagctgaagcaaccccgtcgtgcgctgctgccgcgccggagccgtctacttgtttcgcttgtatcgttggagaaaacgacgtggaaaaatgggcgtcagggctgggctgggcaggcacgcacgcacgcacgggcgcgcatgccgcggcgctggacatgaactgaaatccgccggtggtaagccactgtagttaccggctgaaacctggccacatgttggccctaccaagtacaatcggcccagcaagttccgacggcggccccataagtttaggcagcactagaaacagcgatggcccaaacgagagcgctcgctagcactagcagtagcagcattcccctacaggtacaggtatatataccacgtcacctcaggtgtagtaggacgtcgttcccggacggtcaaagcaagcgtaggcgcgggggtccaggactggacgggggggaatcgccggtcgcgccgtgtaccaccaaagcggggacacccgtagcgcggcgcggatcgggctgccgcgcaagcccggcccgcggggcgagggcagccaccagccagcagccagccacttcggcagctcgcgttgcgttctccggcggcgccgccacagccccagcggggatttggcctagctctgcttaggcttcctgcgatctatcccctccttcggctgcagtgcagtgcagtccagtgtccagtgctagctagtactagtagctagctagcacagccacagcacacgacaccacgggacggggactgacagattctgcagcctgcagcagatggcaggggtggtgcggtgccctaaacgaaacgcggcctttctccgggactgatggatgggcattcggttcctctccagcagctcgtgtgcctcacgcttcgttcaaggctggcccagttccccttccccggcctggtagtacttgaggcgtacgagcctttgcatctcgtgtgtctgcgcgcatgcatgcatgcttggttgctttttttctttcttttacagccataccccccggacggcggtggtttccgactttcgatacggtaatttcggccaccattgacgacgacattggtctttgttccaccctaccctagtacggaggaaggaagaagaagcgttactctacctttttccttataaacacacaccagcagtggggttcatgcatactagctctggcgctcacgcagacgcagaatctgccacacgtgtcgtccaccagtagtcgaggcaggatgggcacggtgttgcatgcagagagcgcaaggcagggcagggcggaacaagagacgatcgatctatcgctcatccaacaagatatcgccggccggtgttgaaatcatatcgagatcggaatctgtcacgccaaagctcgatcgggtgccctgccgatcgtatatatatggctatagctacctagcgaaagcctcatatataggactagtaccgctagctagcatgcatgttaccgcttcaaatggagatcttgggggccgggaggatgaagatatatgtgtcgactacccatacgtgcagtgcaggcagcggcctcagagagacatgaggtgacccaaagctgatcgactctacccgaccagattccaatccaaccccccggtgtcggctcgaccttgtctctctgtactgtatctttagtagcgcttgccagtacggccgggctagctaggtagtaatcacatacgacagtaatcagctgcactaatccaacagtcacatctacctagctacttgcgtactctcacgcatgaatatatgcaccatatatgagtagtaaacgccaaaaactccatcgagcgccaccaggctaggctgttgtttgtcggctcggttcgtctcaccaacggcaccacccaattatagcaaaaggttagggagagaaaaacataaaaataaaaaaaaagatgcccgtgcagttgttcttgttctcccttccgcatatataagtatcgagctcatgcgttctccatgggggacaccatcaaccctccactctcccccagcctccattattgatcgagcggctctggtaccatcgtatacaaataatgatgatgttgttcgaggaggacgcagccgccatggccatcccagatgccttgtgcattgtaagtcgtctccctcccgccctagcttgataatgtgtccaaccctgccatactgatgtactacctgaattattgtcagatcataatgtagagagataacatatacatacatagaatgatgtgcttacactatattttttccagcttatcagcaaattaagagatcttctacagtagcaagggctaagacagacacgatacgatatattccatatatatattcagtaaaaacacaataatttaatgccctctactgtcaaatgactaaaaagagatcgtcattgcaaaatatattgttccataccagccagctaagacgtccccgttcatcggggtccgaggagtgaccgaattctttcaggacttcttcccaggccggaataagcagtctctgcgccaaaatagcatcccttgcattagaccatgcaccgtaccacagcagcagcatttataggacgtccaattttatgttcgctgcctttattgttggttcaatcctgtcttcgcttctatcccgtacctctcccgaccgcaattgtagcagagaaacttctgggagctgactagcttccttgctcctcggtgttgccatcttggccaaaaaaaaaaacagagagaggaagtcatgcatgtgcatctgcatggccaaaacaggcttattttcggcccaccttgctcgcacacatgccccccctctcttctcccattatataaccacagagtagaaccatttctcttctcaaggatcaatgtaatatgttggagagattttttttacccgagaagctgcgccgcgcgccaatctgatcatctccatgcgctgaagatcgttggtgcccgccatgcttcccgatgattgctgccacatcgtcgctgtaattttgcttctctgacccaacacggttttttgctcgcctcttcctactttctgggatgatgatgtttttatgaaacccaaccgagcgatttcattcgtttccttctcgacatccttttgctgccgcgtttcttgcatcgtgcctatatatgcatcaacgcatgccgatgcccatgtggagttgtaattaaaatggcaacaagtccgatccgttacgtttcctaggacaacaggtgcttgcctgcacaagtaattcaatggttattaggcatttatcaaaggtaaaccacaacagctagcgttggcataagcgtaacacatcatggcttctttcagatttgggccttgtgatttaccagagaatataaaagatgttctctttgttttatatgtcgtctatgtctttgtcattttattccgaatcacacacacatgcatgatcttattttgagaagttgtatattgatttgccttcaaaacttatgacatgcatacgagagtaacactcgtttaacaaccaaaaaacgagaggactcacatgtcttgtcccgctctgaaatttgcaggaggaaatttcaagccccatagctgcacatatactcgacttctactacggcgacggcctgggcgatgacctctttgccgcggtgactgccacctctggcccattccctgccactgacgatgatgtttcttcgtctaccgctaccacccctcctatctgcggctacagtgaagacaccgcagctgctggtggagccacagcctacaccccgttgacatccttcgacaccactctcacagccctcctggaggaagagcagcaccatggccttgacgccgggttcctcccgcagatcgatggcctatcagaggtagcagcatactatccaactgccaccgatgaggccagcatagggcagttcgaccagatgggacttccagagaccttagacgagcaggtgcctcctccagtgcagatgagcagcagtgcatctgccttgatgccgctcgctacagactatgatgagtgcttcatggcagccgtagcagctggagggttcatgggtctggatggagccatgtatcagcaaactggagcagttcttccaggctgcagtgcagatgcatcacaacaggaattcttcagcagtgccggcagcaacagtatggtgatgattggcgagtatcagaagatgatggaaggtgaagggctgacaacaacatatgacgacacagattccatgcaagggacatttaacactaatgcagagatgcaggtaacgttcaaaaacctaggtacacagcacaggtaaagtaaccagttgaccatgcataccatttccgattcttacacagaattatgttaactaaacaggtaggaggaaataatcagcacctgataaacggatgcaacgggaacccagcaacgttacctccgacggaactatcagtactggaagactccacgtttaaggtcgtccgcttgtcgcctgaagagagaaaggaaaagatccataggtacataaagaaacggaacgagagaaatttccgcaaaaaaataaaggtaccattgagcatttcaatagagcggtacctccgcatggacatcttacgtattcagctgtgctgacagcctgacatacaacgaaatgcagtacgcatgtagaaaaaccttggcggatagcaggccccgtgtccgtggaaggtttgccaagaatgatgaactctgtgaagcagcgcaatcaggctcccagagtcatgaacattatgaacaaactgtaagttttcaattgaactatacacagtcttatcaaacgagaacctggaataaaaaaaaacatgattcttcttatgcattctcattgtttttaaacaagaacctggaatacttctatgcatagttaacaagatctcttacctttttttcaggaccatatgaaagaagaggacatgctggacacatctgacattcttgcgcaactaaatggattaaatccctacaactacaagtataaatccaccattgaatcatggatatgattctcaagtctcaaccacacaaaaactaagacccaatgtcttatttgaagttgtgcgacgtcgagcacagtttttttatttccattaaaataaacttacatcattagaagctcaagaatttagttcaactaatgtagatttaatgtatgtgtcaatctgctgtcacttgtttaccattgtcacaagtgaatgtggtagtgagtctccagaagagtcatttgtgtatataactatgtcatctatagaaataaaagttctgaggatctcttaagtatttcttcgtagcagagtctagatttgatctgctcatcagagaatttcaaggatagaatgtagcaatggtacatcagagaatcaaaaaacatggcaacagagcacagtaataagtaaacttaatatattgggcctttttagcctgtgcccttatgtgcagaaggatcaagagttggaactaacaagaacaatatgaataagcatagcaaaaatgttcaacattatactctttgagtttagtaaggttaatgatcttgctgataaatcataggcccatgaaattccagatatccaattctgttgattttctgtttaatttgagttatccaagaacaaactacagatctatagagagtaatgtatccacagttgcattacggcaaagagtaaaatcttaatgaactaaaaggtttgacgctacggggtaagtaggcattgtcccaggttgcaaatctccattacagctaagctacaatgagtggtcaaatttacaaactatgcttcacccaaaccagcattctacagaattggaactccgactggatggcaatctagaaaacaacactcagaattccatgtcagaatttactctggcaaacaagatttgatcgatgaagtcaatgcgattggatccttaatgaggtgtttggtttgatgaatcactctatccaaaatgaagtggtgcataataggttcattcctcaaatttggtgggatgactctattccacatattagtactaaacaactaactttgaggaatgaggtggtgatggattaactcactccatttcacaaaccaaacaaaaaagtgaagtgtgtgttgttgttggtcgtcgatgaagtcaatgcgattggatccttaaattgatgtacagtttcttcaaccacacttgtctatccgtacacgaacatagttgcacgcgttggatgaagaaccgcctcaacatatatctgacaaaagcaaatgtacagacagttacaatgtgctaaaggctaactcgtacaacgagggagagcaattctgaggccggatcgaagagcgcaacttggggggttcagatttgctacagccaaggaggactaagctactggggtggcgaagccgaggaacctgacgcaggagcgcgcccataaccccagaatcggcccccgacccaaacagcgacctcagagacgatgacggcgaccttgacgaccaccccgagcgcgtcgatcccgttcctgaaccccttgtgcacctggaggccgaggaagccctcgacgatcgttggacgtacgtgttattggagagcgtgtagatggacttgaggacggcgagcacaggccacgaccgcgggcgacgcggcgtggaggaggcggtggcgagcgccctgtggaggccgccaggggcttgggagagggcgtcgagcagccgcaccccagcgtacgccgaacgtggaggtgccggcaacggcggcgagaggcatagaggcatgccggcggcctccgtggggactggggaggcacaggccataggaggcgagaccg

SEQ ID NO: 6895 - DNA, 1496 bp, Zea mays
  misc_feature (1399)..(1399): n is a, c, g, or t
ggaggggcagcggcaatccaccctgcctctgcctgccacacggaaaggcctgggccagaccaatgcgcccgttttcactctagtgtagtgttgccacggccggaagaggaaccgctgtcggcctggcgggctgctccacctccacggctccacctccacggctctctgtctgtcccgcgtcctcctccgcagcacgacgaccgcatcgcgttctacgttctccgccctctccgctccccctactctgcttggtttcccagaagatttgattggtttccccaaatccggtgactccattcctgttgttcttcacgtcgaccccgggaacctcccagaaggctctagcgaccccggccgcccggcgctctgagggctgtgctgccggcggcgagatccaggagctgcctgccatggtgaaggacagcgcctactacgacgtcctaggggtcagcgtcgacgcgtcctccgccgagatcaagaaggcgtattacatcaaggcgaagctggtgcatccggacaagaatcccgggaaccctgacgccgcactcaagttccaggaacttggagaggcctatcaagttcttagtgatcctgggaaaaaggaggcttatgataagtatggaaaggagggtattccccaggataacatggtggatcctgctgctgtctttgggatgatttttggaagtgactattttgaagattacgttggccagcttgctctagcatctatagcctcagtagaggttgatgaaaactcaaacagtcaagaagcaagagcaaaggttcaagaaaagataaaagagttacaaagagagagagaacaaaagcttacccagagcctgaaagaccgacttcaaccatatgtagatgagagaaaggatgaatttgtgagctacgcaagcacagaagctaggcgtttatctgaagcagcatttggtgaggctatgcttcacactattgggtatatttacgtgcggcaagcagcaagagaacttgggaaaagtagaatttatatgggtgtaccgtttatagctgagtgggttagagacaaaggacaccacattaaatcgcaggttaatgctgcttcaggtgctatttctctaatacaacttcaagaagggatgaaaaagatggaaggaagcgagaacagtgaagagcaacttatgaagagttttgaggagaaaaaagatgccatgcttagctcgctatggaaaattaatgtggtcgatattgagtcaacactttcacgtgtctgccaagcagttctgagagataacacggtctccaaagatgtcctgaagctgcgagcgaaagcgttgaaaaagctcggaacgatattccaaggcgcaaaatctatgtaccgtcgtgaaaacacctgcgcgttgaaacgagccanatcagcagctactcgccactgagccatgacaccggtacagggatcgattgtgatttttgcgggttggcttgtaattgttgctgtacatacatcgaaa

SEQ ID NO: 6896 - DNA, 1543 bp, Zea mays
cgcgagggcccagctcacggacctgtcctgtgtcctccgcagcacagcacgaccccatcggcgtcaccccggcgacttctgcgtcctctgccctccacgctcccccgctctgccaggcttcccagaagatttggttgatttccccccaatccagtgattccatccctgttctccacttccaccggaacctcccagagacttccagaaggctctagcgacccccgccgctttagagctacccgcggcgagattcaggagctgcctgccatggtgaaggacagcgcctactacgatgtcctggggctcagcgtcgacgcgtcccccgccgagatcaagaaggcgtattacattaaggcgaagctggtgcatccggacaagaatcccgggaaccctgacgcggcactcaagttccaggaacttggagaggcttatcaagtcctaagtgatcctgggaaaaaggaggcgtatgataattatggaaaggagggtattccccaggataacatggtggatcctgctgctgtctttgggatgctttttggaagtgactattttgaagattacgttggccagcttgctctagcatctatagcttcagtggaggttgaggaaaactcaaatagtcaagaggcaagagcaaaagttcaagaaaagataaaagaattacaaagagaaagagaacaaaagcttactcagagtctgaaggaccgacttcaatcatatgtagatgggagaaatgatgaatttgtgagctatgcaagcgcagaagctaggcgtttatccgaagcagcatttggcgaggctatgcttcacaccattggttatatttatgtccggcaagcagcaagagaactcgggaaaagtagaatttacatgggtgtaccttttatagctgaatgggttagagacaaaggacaccacattaaatcacaggttaatgctgcttcaggtgctatttctctaatacaacttcaagaagggatgaaaaagatggaggggagtgaggacagcgaggagcaacttatgaagagttttgaggagaaaaaagatgccatgctcagctcgctttggaaaatcaatgtggttgatatcgagtccacgctctcacgtgtctgccaagcagttctgagagatagcatggtctccaaagatgtcctgaagctgcgagccaaagcgttgaaaaagctcggaacgatattccaaggcgcagagtctatgtaccgtcgtgaaaacagcctgcgcgttgaaacgagcacagaccaacaagccgcttcgtcacactgaagccacctgtggaccaccgtgtaggaatggatttggtgttttgtgtgtgtgtgtggctttcttctttgtttgtaattgtgtatgctatattaattttcttgtagaagatgtgaaacatttaacacaaagattttaactgctattgatgcagaaatataacctgcagctgccttttttccttcttgatggtagaattgtatttgtacacttatttgccaagtgtgtggcttcattggttcactataaaaaaaaaaaaaaa

SEQ ID NO: 6897 - DNA, 2306 bp, Zea mays
ttgggtacctcgaggccggccgggagctcctgccagtcgcaactcgcgtcctctccaaaaaacagcacgagaccattacctagaacatcctaatcgaaaaacgaatgctcagtgatatttctctcgaggtctgcacactcgtctcctaccgagaccgtcggcggccatcgtcgcacacgctgtgctcatgctaagtgtcgaggctcacacgtactactactacccgaccgcgaggccgagacggaagctatgcgcctgcagaaacgtcttgcaggaaaccgccccgcgtgacgcagaggcaaatccctgccgtcacggcgagaggaagagcaggagaaggggcgacggtgcttattacatcgacaaggacggcggcggcgtagccaggaccttcgaccggaagaaaatatccagaaagagggggggtgctatcaaagggcgcggatggaagtacggctccgggttcgtcgacggagtgttcccagtgctgagtccgatggcgcaggatgtgctagaactcgtgcagacgagggggaccgacgcggccagcgtctgggagtcactggacaagatccctcaagcgcacgatctttgggacgacatcgtcaacgtcgccgtccagctccgcctgaaccggcaatgggagccgatcatcacagtctgcgagtgggtcctgcgccggagctcgttccgccccgacatcatctgctacaacctgctcatcgacgcgtacggccagaagcgtcagctgagcgaggcggaggcggcctacatggcgcttctggaggctcgctgcgtgcccacggaggacacctacgctctgctgctgcgcgcgtactgcggctccgggcagctgcaccgagccgagggcgtgatttcggagatgcagaggaacgggatccctcccactgcgactgtgtacaacgcgtacctggacggtctgctgaaagcgaggtgttcggagaaggcggttgaagtgtaccagaggatgaagaaggagcgctgcagaactaacaccgagacctacaccctgatgatcaacgtgtatgggaaagcaaatcagccgatgtcgtcgttgagagtgttcagggagatgaagtcggtcgggtgcaagcccaacatctgcacctacacggcgctggtgaacgcgttcgcgcgggaaggcctgtgcgagaaggcagaggaggtgttcgaggagatgcagcaggctgggcacgaacctgacgtgtacgcctacaatgctctgatggaagcttacagccgcgcagggctgccgcaaggggcgtcggagatcttctctttgatggaacacatggggtgcgagcctgatagagcctcttacaacatactggtggatgctttcggacgagctgggcttcaccaagaagcggaagcagcgttccaagagctgaagcagcagggcatgcggccgacgatgaagtcgcacatgctgctcctgtcggcgcacgccaggtccggcaacgtggcgaggtgcgaggaggtgatggcgcagctgcacaagtccgggctgcgcccggacaccttcgccctcaacgccatgctcaacgcgtacggccgggccgggcggctggacgacatggagcggctcttcgcggccatggagcgcggcgacggcgcgagcgccggcgccccggacaccagcacgtacaacgtgctggtgaacgcgtacgggcgcgcggggtatctggaccggatggaggcggcgttccgctccctggcggcgcggggcctcgccgccgacgtggtgacgtggacgtcccgcatcggcgcgtacgccaggaagaaggagtacgggcagtgcctgcgggtcttcgaggagatggtggacgccgggtgctacccagacgccggcaccgccaaggtgctgctcgccgcgtgctccgacgagcgtcaggtggagcaggtcacggccattgtcaggtccatgcacaaggacgccaagacgctctttgcattgtgaaatccgcgcaggctaaattccgatcctgctgcgtgatcacatacgaaccttgacgagagtcacctagcttgcatactcgttaacaagtcacaaggccccgtttggttagatatagaataatctagtttttagtcccgtttagtacttagtacttaattgtatttagtctctagcccctcacatgggtgctaaaggggactaaaggatatcatttactctaattaccattgcacggagaatctgcaccgtatacatgcaataaaaagagaggcatttcagaaaaaaaaaaaaaaaaaaaaaaaaacaaaaaaaaaaaaaaaaaaaa

SEQ ID NO: 6898 - DNA, 2266 bp, Zea mays
attgggtacctcggggccggccgggagctcctgccagtcgcaactcgcgtcctctccaaaaaacagcccacagctgaagcgagaacacgaaagctcagtgatatttctctccagggctgcacactcgtctcctaccgagaccgtcggcggccatcatcgcccacgctgtgctcatgctaagtgtcgaggctcacacgtactactactacccgaccgcgaggccgagacggaagctatgcgcctgcagaaacgtcttgcaagaaaccgccccgcgtgacgcggaggcaaatccctgccgccacggcgagaggaagagcaggagaaggggcgacggtgcttattacatcgacaaggacggcggcggcgtagccaggaccttcgaccggaagaaaatatccagaaagagggggggtgctatcaaagggcgtggatggaagtacggctccgggttcgtcgacggagtgttcccagtgctgagtccgatggcgcaggatgtgctagaactcgtgcagacgagggggaccgacgccgccagcgtctgggagtcactggacaagatccctcaagcacacgatctttgggacgacatcgtcaacgtcgccgtccagctccgcctgaaccggcaatgggagccgatcatcacagtctgcgagtgggtcctgcgccggagctcgttccgccccgacatcatctgctacaacctgctcatcgacgcgtacggccagaagcgtcagctgagcgaggcggaggcggcctacatggcgcttctggaggctcgctgcgtgcctacggaggacacctacgctctgctgctgcgcgcgtactgcggctccgggcagctgcaccgagccgagggcgtgatttcggagatgcagaggaacgggatccctcccactgcgactgtgtacaacgcgtacctggacggtctgctgtaagcgaggtgttcggagaaggcggttgaagtgtaccagaggatgaagaaggagcgctgcagaactaacaccgagacctacaccctgatgatcaacgtgtatgggaaagcaaatcagccgatgtcgtcgttgagagtgttcagggagatgaaatcggtcgggtgcaagcccaacatctgcacctacacggcgctggtgaacgcgttcgcgcgggaaggcctgtgcgagaaggcagaggaggtgttcgaggagatgcagcaggctgggcacgaacctgacgtgtacgcctacaatgctctgatggaagcttacagccgcgcagggctgccgcaaggggcgtcggagatcttctctttgatggaacacatggggtgcgagcctgatagagcctcttacaacatactggtggatgctttcggacgagctggtcttcaccaagaggcggaagcagcgttccaagagctgaagcagcagggcatgcggccgacgatgaagtcgcacatgctgctcctgtcggcgcacgccaggtccggcaacgtggcgaggtgcgaggaggtgatggcgcagctgcacaagtccgggctgcgcccggacaccttcgcgctcaacgccatgctcaacgcgtacggccgggccgggcggctggacgacatggagcggctcttcgcggccatggagcgcggcgacggcgcgatcgccggcgccccggacaccagcacgtacaacgtgatggtgaacgcgtacgggcgcgcggggtacctggaccggatggaggcggcgttccgctccctggcggcgcggggcctcgccgccgacgtggtgacgtggacgtcccgcatcggcgcgtacgccaggaagaaggagtacgggcagtgcctgcgggtcttcgaggagatggtggacgccgggtgctacccggacgccggcaccgccaaggtgctgctcgccgcgtgctccgacgagcgccaggtggagcaggtcaaggccattgtcaggtccatgcacaaggacgccaagacgctcttcgcattgtgaaatccgcgcaggctaaattccgatcctgctgcgtgatcacatacgaaccttgacgagagtcacctagcttgcatactggttaacaagtcacaaggccccgtttggttacatatagaataatctactttttagtcccgtttagtacttaattgtatttagtctctagcccttcactgtaagggcctcacatcacatgggtgctaaaggggacgaaaggacatcatttactctaattaccattgcatagagaatatgcaccgtatacatgcaataaaaagagaggcatttcagtctgtgta

SEQ ID NO: 6899 - DNA, 3381 bp, Zea mays
  misc_feature (2319)..(2319): n is a, c, g, or t
ataatcagaagatcagcagtccaaatctgcacaagttagttcaaaagttggcggtgcggggaggtcatgcccgttttgtctttctggataagaggtgctgaacgataggtccaaaccacagcactggatagaacacgccaaaagcaagagatatttcagtttcgctcttgtctcagctcagctcagctcctgccagtcgcaactcgcgtcctctccaaaaaaacagcccacagttgaagcgaaaacacgaaagctcagtgatatttctctccaggtctgcacactcgtctcctatcgagactgtcggcggccatcgtcgcccacgctgtgctcatgtacgtcccgattcttaggtgtttaattttgcgggtatttttgagaatttgggattcgattttacggcactgatgttcaactggacaatgaatacttcggttactagctcactgttgccttctatgaatttgctgacatgcctttctttctccaccgtctctcgccgcaggctaagtgtcgaggctcacacgtactactactacccgaccgcgaggccgagacggaagctatgcgcctgcagaaacgtcttgcaagaaaccgccccgcgtgacgcggaggcagatccctgccgccacggcgagaggaagagcaggagaaggggcgacggtgcttattacatcgacaaggacggcggcggcgtagccaggaccttcgaccggaagaaaatatccagaaagaggggtacggtaaatgattatgacagtgtgccagtgtgccacaccactccttaattttagttcccacacaatgctgcagatcaatgccagttcttagatcttcttcttttttttttaaaaaaaagcaagaacacaaaggttgttccttttccggattcactcactgttccatgcattggaagttcaaggacaacatggcgtaggtaggttctagctctgaatggcatggcatggcttgggcttgggcgtgcagggggtgctatcaaagggcgtggatggaagtacggctccgggttcgtcgacggagtgttcccagtgctgagtccgatggcgcaggatgtgctagaactcgtgcagacgagggggaccgacgccgccagcgtctgggagtcactggacaagatccctcaagcacacgatctttgggacgacatcgtcaacgtcgccgtccagctccgcctgaaccggcaatgggagccgatcatcacagtgagtctgagtcctaaccgaaccgcagccccgcacactcttgctgcctgcattgactctgaaacttgcaagagcaaaaatcctcagcctttggctatgggtgtttgatctgatctgcctataggtctgcgagtgggtcctgcgccggagctcgttccgccccgacatcatctgctacaacctgctcatcgacgcgtacggccagaagcgtcagctgagcgaggcggaggcggcctacatggcgcttctggaggctcgctgcgtgcctacggaggacacctacgctctgctgctgcgcgcgtactgcggctccgggcagctgcaccgagccgagggcgtgatttcggagatgcagaggaacgggatccctcccagtacgcaacgcaacgcatcgtgtgttcctctgtcatgagatgaagtgaaatcatgccaagaactctctctctctctcttgcattgcagctgcgactgtgtacaacgcgtacctggacggtctgctgaaagcgaggtgttcggagaaggcggttgaagtgtaccagaggatgaagaaggagcgctgcagaactaacaccgagacctacaccctgatgatcaacgtgtatgggaaagtaagccatttttttgctggattaatcttttaatgtgcagggatctgagatctgactcaaaagtgtgtgtgagtgtcatcgttctgagagagacaatggccgtcattcatgcatactcacccttctgcatgcaatgcaggcaaatcagccgatgtcgtcgttgagagtgttcagggagatgaaatcggtcgggtgcaagcccaacatctgcacctacacggcgctggtgaacgcgttcgcgcgggaaggcctgtgcgagaaggcagaggaggtgttcgaggagatgcagcaggctgggcacgaacctgacgtgtacgcctacaatgctctgatggaagcttacagccgcgcagggctgccgcaaggggcgtcggagatcttctctttgatggaacacatggggtgcgagcctgatagagcctcttacaacatactggtggatgctttcggacgagctggtcttcaccaaggtatgcacccagccacanctgccgctacatcgcatgcagtagctgcctcaagaagctagctttggctggtgagctcaagaactcgctggatttactggtgccttttttgttgttgttgttgtggctgtttgtacgttccagaggcggaagcagcgttccaagagctgaagcagcagggcatgcggccgacgatgaagtcgcacatgctgctcctgtcggcgcacgccaggtccggcaacgtggcgaggtgcgaggaggtgatggcgcagctgcacaagtccgggctgcgcccggacaccttcgccctcaacgccatgctcaacgcgtacggccgggccgggcggctggacgacatggagcggctcttcgcggccatggagcgcggcgacggcgcgagcgccggcgccccggacaccagcacgtacaacgtgctggtgaacgcgtacgggcgcgcggggtatctggaccggatggaggcggcgttccgctccctggcggcgcggggcctcgccgccgacgtggtgacgtggacgtcccgcatcggcgcgtacgccaggaagaaggagtacgggcagtgcctgcgggtcttcgaggagatggtggacgccgggtgctacccggacgccggcaccgccaaggtgctgctcgccgcgtgctccgacgagcgtcaggtggagcaggtcacggccattgtcaggtccatgcacaaggacgccaagacgctcttcgcattgtgaaatccgcgcaggctaaattccgatcctgctgcgtgatcacatacgaaccttgacgagagtcacctagcttgcatactggttaacaagtcacaaggccccgtttggttacatatagaataatctactttttagtcccgtttagtacttaattgtatttagtctctagcccttcactgtaagggcctcacatcacatgggtgctaaaggggacgaaaggacatcatttactctaattaccattgcatagagaatatgcaccgtatacatgcaataaaaagagaggcatttcagtctgtgtacttcatttaatatgtttagaatctatttagtcctgtgaaccaaa

SEQ ID NO: 6900 - DNA, 1102 bp, Zea mays
  misc_feature (19)..(19): n is a, c, g, or t
ttttttttttttttttggnttattttattcagagttgctaacccacctcaggaaaaaggatcgtacggtcgctgttctttcgatcttagcttgttcacctcaacaaccatcactcactcactagttagtagccacgctcaccgaccctcactctccatcaccacacacacgcagcgcgcagccagggaaggaaacaacacgtacagcagcgacgacagcgatgccgacgctgcggcggcgcaacccggaactgcacgtgaaggcgctggagggaatcgtgtcggccaacaccttcttcacggtggcggtgttcatcgggatcacgggcaccatcacgccgtcctcgtccgtgccgcccgcctgcgtcgcgcgggacgacatcgcgcgcaacttcttcctcttcgagatcctctccttcggcttctacctgctgtccagcctcgtggcgcaggggatgaagctcgccgtcacgctcctggccaccgacgacttctacggcgacgccgaccagaagcccccgccgtccgacgactgcgaggagatgccggcatggcgcgccgccgggccgagggagaggcgccgcgccgtgctcaggttcgcgcagcccatgatgctgctcgccgccgggtgctccaccatgggcaccttcttcctgctgctctccatggtcgacgccatccagctcaagttcggcatcctctcctgcggcatcccgctcgccgtcgccgccaccttcgccctctccgcgctcgtcgtcggtggcctcatcttctacggagcgaccgtcgcatacgccctcacgcattatctgccctgaatacaaatccaatataatataatataatacttttctcttatacaaaagaaagcaagcagtgagtaattaatttgttagcggtgggttggaatcaggttcacaatctcgtttttactgttccgaaataccattttgacctcaaaaaatttacttttagatttttaaatttgtcaccgaaaaatagcaaacaaaaagatttctcttatacgtcaatcgatgtttgatgtttcgtacctcgctgcgaaaaataaatttattgtacgtgttccaaaaaaaaaaaaaaaa

SEQ ID NO: 6901 - DNA, 2550 bp, Zea mays
ccgccccgaggccggccgggctccctttctgctgcccagccgccgtccgtccgcgcttcactatccttcattccctcccctgtcagcgacgactgggtaggctaccgccgccgccctacgctaggtgcccatctcttcgccggcgaagagcgcccaccaagctccggccaagggcgtgatggcggctgtaggcagcttgaagccggggatggagactcttcatgtgcaggactacaaggacgcgcctccggccaaggccgcggtagagagcctccagccggcgatggagagtctgcatgtgcaggattacaaggacgcgcctccggccaagggcgtggccgccgccgccgtagggagcttgcagccgggggcggagaacctgcaggtgcaggactacaaggacggtaacatgtattatggtgcttacccggcttatgcctatggagcctatggtggctggggggagtacccatacctgagccatgatggagcacagacaccaactgctggtacctatgctgacatgtactatggctatgctccatatggtgttgcaaccatggggcatgatggtcagatttatgggtctcagaattaccagtacccgtcgacatacaccaagcaacagaactctactgccaagctgtcatccaatggtataagtgagaaattgactccagcgccgcaaacggatgtatctactattggtgtggatgaggtgaaaggtttgaaaaattcaaattcggtgctgaagacagaccggaacatgccaggttccaatggttcatatggccggtctagtgtgcgttctggcagctatcagaaccagactagttggtcacactatccatattatagtagtgagatgttctctgacaagcagcaaaagttcaccggcaaccacaattcgacttccaaccctaaaaccaaggggcagtcgaggaatcaaaacacgaggcagtatcctcatctcatgggtttgcaaacaccaacttcatcagtgtactcagctaatggaatttatgggtatgatgggagctatggacccggcctttggtatggatcgcacatgtataattctggattatatggtggatggaattcactgtatgatggaaagtacagaaccagaggaagaggtaacaatgggtattatgtttatggtaatggaagcatagatggctttaatgagctgaaaagagggccaagaagtggtatgtacaaaaaccagctggggcttgaagctactacccaagcaccagcaaaagagcaggatcttttgtttgctaatggttcacatcctgccatgaaggatcagtataatcaggctgactttgcggaaacatactcagacgctaaattcttcattattaaatcttacagtgaagatgatgttcacaagagcgttaagtacaatgtgtgggctagcactcccaatggtaataagaaacttgatgctgcctatcaagaggctaaagaaaaatcaagcgaaactcctgtttttcttcttttctctgtgaatgcaagtggccagtttgtcggccttgctgaaatggtgggtcgtgttgattttgaaaaaacagtagagcattggcaacaggacaaatggactggttgtttccctgtcaagtggcacattgtgaaggatgttccaaacagcttgctgaagcacatcattcttgagaacaatgaaaacaagccagtgacgaacagcagagatacacatgaggtgaagcttgagcaaggccttcaagtgcttaagattttcaaggatcatgtctgcaagacatccatactggatgacttcggcttttatgataatcgtgagaagatgatgcaagagaggaaagccaaacagcagcagtcgctgaaaaaggtcattgatgtgaagctgcccagcgtcaccgacatggagagaagtcctaaaggggagactggatcaacagaactcactggggttgggactgacgtcttgaacaaagagcgtttattaggcaaagcaggagagaaaaatggcgagaaaggaaatgatgtcgccccacaggacctgaaaacacaaactgagaagttggcgggtctaaatggctgttaatatttttcgttagctcaagccgttgacagtggtgtcggggtggaacctaaggctgtggtgggttgtttgaggaaattctgatgtcccattgagcttgtttcctatagttcataggagctagaggcttagctagttgcttgtgtttggtggtagtcatggtctgtgttctggcgtgtcaggtattttaggaatagaaggatgattaactgggttttgcaatgatggatcatgggttttgaggctgtatttttcgtttatttgcctttcctctctggattctagttcctctctctctctctctctagattctggacaagtgtagtgcttattttaagttggttggtttaagaacctgaaatgaacatgggaattctatcaagcatttacaaacttactttcctcagtacaaaaaaaaaaacaaccccacacaaacaagtgagccggtccagccggtaatt

SEQ ID NO: 6902 - DNA, 3121 bp, Zea mays
gcacgagaccattacctagaacatcctaatcgaaaaaccaatccgactctcgtccctccccgactcaccccactgcccagccgcacgcgccgccgtgtgttcgcgctctctcccactgtgtctgtgacgactgggtaggctacagccgccgcccgtcgccaggtgccgatcccttcgccgacgaagagcatccaccaggctccggccaagggcgtgatggcggctgtagggagcttgcagccgggggtggagactctacatgtgcaggattacaaggacgcgcctccagccaaggctgtggcggccgcggtagagagcttgcagccggcgatggagagcctacatgtgcaggaattcaaggacgcggctccggctaagggcgtttccgccgctgctgtagggagcttgcagccggggatggagaacctgcaggtgcaggattacaaggacgctagcatgtattatggtgcttacccggcttatccctatggagcaccctatggtggctggggggagtactccacatacttgagccatgatggagcacagacaccaactgctggcgcgtatgctgacatgtactatggccatgctgcatatggtcatatttatgggtctcagaattaccagtatccatcgacctacagcaagcaacagaattccactgccaagctgtcgtccaatggtaaaagtgagaaattggctccagctccggaaggggatgtctccactattgttgttgatgaggtgaaagtcctgaaaaatccaaacccgaccctgaaggcagacaggaatgcaccaggttccaatggttcatatggccgatctagtgtgcgttctggtaactatcagaaccagactagttggtcacactatccatattatagtagtgagatgttctctgacaagcagcaaaagtttaccagcaatcacaattcgactgctcccaatgataaaaccaaggggcagtcgaggaaccaaaacacgagacagtatcctcatctcatgggtctgcaaacaccaacttccccatcagtttactcagctaatggaatatatcggtatgatggcagctatggacctagcctttggtatggatcacacatgtatagttctgggttatatggtggatggaattcactgtatgatgggaagtacagaaccagaggaagatgtaataatggctattatgcttatggtaatggaagccttgatggctttaatgagctgaaaagagggccaagaagtgggatgtacacaaaccagctggggcttggagctactactgaagtaccagcaaaagagcaggaccttctgtctgctaatggttcacatcctgccatgaaggaccagtataatcgggctgactttgcggaaacatactcagacgcaaaattcttcattatcaaatcatacagtgaagacgatgttcacaagagcgtaaagtacaatgtgtgggctagcactccaaatggtaataagaaacttgatgctgcctatcaagaggctaaagaaaaatcaagcgaaactcctgttttccttcttttctctgtgaatgcaagtggccagtttgttgggcttgctgagatggtgggtcgtgttgattttaacaaaacagtagatcattggcaacaggacaagtggactggttgtttccctgtcaagtggcacattgtgaaggatgttccaaacagtttgctgaagcacatcattctcgagaacaatgaaaacaagccagtgacaaacagcagagatacacatgaggtgaagcttgagcaaggccttcaagtgcttaaggttttcaaggatcatgtgtgcaagacatctatactggatgactttggcttttacgataatcgtgagaagatgatgcaatataggaaagcaaaacagcagcagtcactgaaaaaggtcatcgatgtgaaggtgcctaacgccactgacgcagatacaagtctcgtaggaactggatcaacggaactcaccaatgttgaggctgatgtcttgaacaaagagctttcattagacaaagcagtagagaaaaacgaggagaaaggaaatgatgtcgccccacaggacctgaaatcatcagctgagaagtcggcaagcccaaatggctgttaatttttttttttttggttagctcggccattgacagtggtatggggcgggaacctgaggctgggggttgtttgaggaaatcctgagatcccattgagcttgtttcttgcccttgttttctatagttcatagaggattagttagttgcttgtgtgtttgggtgataggtgaggtcagtgtcctggcatggcaggtatttaggaatagaaggacgattaactggggtttacaatggtggttcatgggtttgaggttgtgtttccatctatttgcctttcccctctctatattccagttcctacctctctagattctggacaaacgtagtgcttatttaatgctggctggtttaagaacctgaaatggacaaaggaatccaatcaagtgtttacaaacttcctaaaaaaattacattatgtgaaaaccgtctactctcaaacttgtacagctgtctgctatctgttgtgatccgaaccactatgttgagaagggcctgttgtatttgcattgcgtgaccggcttgtaaattcccatgttaatgttcacctagaacaaatgcatcactcactatgcttacaacaatttattttggaagaagcgtccttggtattttcacaaactgtcagtatgactggatctggctaatcccagcgtagtatttaatgttaaaaaaataagagaattgttctgggaaaagagaaaaggaacacagccttacagatgcaagtggaactgaagctaaaacttgagcagtaataatatgcgcactaattactggcaggtgaattcatctgcctgacccttctcttcactgactgcagcagctgtcacagctgatgaattcggatgccttttgttcataaaaggcccgtccgcccgttactggcccaactagtgcgaagtaaccctaacaaaacaggcaccgatccggctctcctccgtgactccgtcccactgcccagccgctgtgcgttcgcgctctctcccacactgtctgcga

SEQ ID NO: 6903 - DNA, 979 bp, Zea mays
  misc_feature (834)..(834): n is a, c, g, or t
ccacgcgtccggtttgttgggcttgctgagatggtgggttgtgttgattttaacaaaacagtagatcattggcaacaggacaagtggactggttgtttccctgtcaagtggcacattgtgaaggatgttccgaacagtttgctgaagcacatcattctcgagaacaatgaaaacaagccagtgacaaacagcagagatacacatgaggtgaagcttgagcaaggccttcaagtgcttaaggttttcaaggatcatgtgtgcaagacatctatactggatgactttggcttttacgataatcgtgagaagatgatgcaatataggaaagcaaaacagcagcagtcactgaaaaaggtcatcgatgtgaaggtgcctaacgccaccgacgcagatacaagtctcgtaggaactgtatcaacggaactcaccaatgttgaggctgatgtcttgaacaaagagctttcattagccaaagcagtagagaaaaacgaggagaaaggaaatggtgtcgccccacaggacctgaaatcaccagctgagaagtcgggaggcccaaatggctgttaattttttttttgttatctcggccattgacagtggtatggggcgggaacctgaggctgggggttgtttgaggaaatcctgagatcccattgagcttgtttcttgcccttgttttctatagttcataggagcttgaggattagttagttgcttgtgtgtttgggtgataggtgaggtcagtgtcctggcatggcaggtatttaggaatagaaggacgattaactgggttttacaatggtggttcatgggccccccccccccctccccatntattcgcctttctcctctctaaatcccagttcccccccttttagattctggacaaacgtagtgcttatttaatgctggctggtttaagtacctgaaatggacaaaggaatccaattaagtgtttacaaaaccccaccacccaccc

SEQ ID NO: 6904 - DNA, 2382 bp, Zea mays
  misc_feature (1372)..(1372): n is a, c, g, or t
  misc_feature (1558)..(1558): n is a, c, g, or t
ggattagctagactttgaagtggaatgccctactacgcatgggagtgtagaagaggagcttgagaagtaaggagatttgttagagattcctccgtggggattcaattgagcatgtccgccctcgagtccttgtacgggctcgagtctggtcctccctagggcatgggcgtcgcaagtgtacccctaggcttgtcctctaagtagcgagtgtgccctccctttcatagccaaggggggacatgtacatgggcactgaggaaccccgacaggtggaccttagccgtataacaaacggagtgtggagctattaatcctctagtccaaggccttcacttgatcaccatgcaaattctctgcccagtcgcaccttcgtcatgtctagtcggcatgcgggcgaaggcaacagtgtgccggtgtaggctagctcattgtcttgcgtaggggagtaggcggacgatgatgtcctatcccttttgcatgtctcttcatctgacgccgtagtgggaacaacaagagtcatgatgggagttatccacacgcggcgtgtgggtcaatggtctttgcctcaataactcgcggattactagcgcgccccaggccttgcggactgcacacgccgcctgcacttaatacgaggcgcacgtcgcctgccaccggtatgaacaggagggtggccccatgtcagaggcccgctctaagcgacgcttagcagcttccgcgacacaccttgggctacgtggcagcatcgcaccccgtctgggcagagagcagcagctgggagcgtatgtagacatgacagcctcggacctcccctagtaggggtctagaaaagacttaggaaagtttgggtccttctaaaatgacttggacacgtggcggcaccagacctcctttgaccggaggtctggatgacatacgtgggggtcctggaccatcccttggggtcccaatcccgggctgtagctaacgagcagtctcacctccgggacctacggtgacatcggtctagaggcttgcgactcggatgggcctaggccccaaattagggtagaccactcgttctcctggccagaagtcctgtcttgacccaacaggagtgagtacctcatatttaaggttcctgaaaactgaaatataaagtagcccatttagaagcatcctaatttttataacctagtttctctgtttccaaacagaaccttagtgcggctgattaaaaaaaaagtaagaagcaactagaaccgacaaaagcacaactgaaataactctaaatgaacttcaaataaacggtaacaactaactctacggtctacacactcgccatcgccatgactctcacgatcgatcgatgcatgccattgccattcccagncatcttcaccacgacgcatacagtctaaaacaaacgacgtgaaaaagtgtagtaggataaacatgttcagactgctgattaggacacagcagtaattgtagtaggatgtacacatacatacacctgccctgccaatgcaatccgcccgtcactatttcagcactacaatcagagagcaaaccagtnatttgcagcaacgtcaattagtagcgtggtcgcggccgaggtacacatatatagtagaagtagactagtagtcgcaaactaattgtttgcaggttgtgactcatctgcctaacaatctagctaaaccactacaaccctaaacattagctgataacaaggaggttctcctgggacatgattccgacgataaaatctgtcataatgtcatcatggatcatcctggcaatcttcgttccaaccagttctacctcagaaccatggtccaatggcaaaggctgaacatcctccaagaaaaagtgcccacagttacttcgcttctgcaccatttgcctgacgatttcagttaactgcccgtgatctatttcaggccagcgcttcatcatgagctttgaacacaagccagtgtctggaatggtcatgtcagccaaaattgagttcacaagatcaaacagaagtttcctgtcagatttcgaccacagaaccagcttgctgtacctgcccgggcggcagcggaacacatctgagctcacttgccaatcttctaggtgctctggcaagtcgcacgcgctagcaagcatgtcctgtacataagagaaatctctgtcctccccatccttaaacatagacaactgctcttccatggttcgatatattgagatgttcatattatcgaactcgtcgcttgacaatgtatcagaatagtctccacaaatgtcattttggtcttccatcttcagcatcttcagttgctctttgagttcttgaataccgacgttgatgcttttaaagttgccactgctcgtctccttctgctttatcgcaac

SEQ ID NO: 6905 - DNA, 4327 bp, Zea mays
  misc_feature (888)..(888): n is a, c, g, or t
aatgaaaacgaaaacgaaaaccgtgggatcccaacgaaaatcgaagcatgaggaaggctgacatgtcagcgacggggccgtgggccccacccgctctcctctctagaagacgaaaaccatggtcgggtctggcgtccggcgtcctccctcccccgccccgcctcctcttcctcctctgcctctttcccggccggccgtttcttcccaagtggcgccggtcccggtcccggccccagtccccgcaggctccaccgcgcaacccgacgcgggcactgggtacgcctgcgcgagcgcgaccatttccgcgccgtcgccgtcctcccacctaacctaacgcgcccccacccaatcgatcgcctacccgcctcgcctcgtcaggcgggggaggggtcggtcaaaggaactgggggattccgttcctcccggccactgaggaacggcggcctctgcgctcctcttcgccatggccgcgcaggcctcgtcgccgatcgagttcctgctccgccggccgctgccgcgccagcggaggaggctgcctctggccggcgcgttcttcgcgcccacggggctgtccggcgcgccgctgctccgcgcgctggcgtcgctcgcggcggacctgctggggaccccgcccccgccgtcgcagcgacggaacctcgacgcgctcatgcggaggctcgcgctgctctccgcgctcctcgactcgctcctgctcctcctcgccgacgaaggcgaggccgccttctccgacgccgccaacctctgcttccgcgagctctacgtcgtgctcttccgcgccgacctgctcgtctcctacgtcgcctccgccgcccgcgcctgggcgctgctacgggcgccccagctcgccgcctcgttccgggacctcgnacgcggagctcgccgtcgtcctcgacgtcctccccgccgcctcgctccgcctctcgttggacgccgcccagtacctcgacttactccgcgcgcgctgccgccggcgggcgccggcccactaccacgaccccgcggaggccgctctcggggacctcctcctcgccgccctgcgccacttcgaggtcggccagccgccagacccctcgatgctccgatccctcctcctccaaatcggaatctccgacgccgcttcttgccgctccgaaatcgagtacctggaggagcaaatcctgagccaagaggaggacgccgacctccccctcattggcggcgtcgtcgccttgctccggtactgcctcttctcccttttcgaccccagcaacacaaagacgttgcgtgtttggctgtcggcggggaacaggcagcggctgctctcctggagctgcagcgacgacagctccttctcggtgcccaaggagttctcctgcccgatttctttggatttgatgcgcgatcccgtggtggtatccacaggacagacctatgaccggacttcgatcatacagtggatcgaggaggggcattccacctgccccaactccggccaggccctcgctgacaaccggctcgtaccaaaccgggcgctgcgcagcttgatttcacagtggtgtggggtgcatggctttcagtttgattcgccggagagcaacgaagggatgattgaatgtgttgctgcatcttgctgcagcaaggcggcaattgaggcgaacaaagccacagcaaggattttgttcaggatgctgatggagggatccgatagtgcaaaaccgattgcagctagggaaatccggttgctggcaaagactgggaagcaaaacagggcattcattgccgagttgggtgcgataccattgctatgtaagttgctgctgtcgtcagattggatggcgcaggagaacacagtgacggcgctgctcaatctatcgatctatgagccgaacaaggcccggatcatggaacaagcggactgcttgcatcttatcgtcagtgtgttgaagaatggtcggacgacagaggccaaggagaatgctgcagctacgctcttcagtttatctgtggtccatgactacaagaaaaagataatgaatgagccaggggctgtggaggagcttgcctctatgctgaccaaagggacaccaaggggaaagaaagacgcggtgatggcgttgttcaacctctcaacacacccagaaagctcaggacggatgcttgagtcatctgcggttctagctttaattgagtcactgaggaatgacaccgtgtcggaggaagctgctggtgctctggctctgctgatgaagcagcctaccatcgtgcatctcgttgggagctctgaaacagtgatcactagcctcgtcgggctaatgaggcggggaactccaaagtgcaaggagaacgcagtgtcagcgttatacgagatatgccgtagaggcggatcgacattggcacagcgcgtggcaaggatacccgggctgaacacggtgatacagaacgtcacgctcacgggaacgaagcgtgccaagaagaaggcaagcctgatcgtcaagatgtgccagagaagccagatgccgtcggcgttggcggcggcgccgctaggaagcaccttgacagtggttgatcattcgttggtagggaacggcacgttgaggcgcgccgcaagctttggcagcgaggagttatcgaaccctgtgtcgatctcagtgcccgtgccctaggtggtgaaccctgtatccatcccagagcccacatgattctcgcatttggtgagtttttgtccctgatattctttcattccatcctcaaatgaaggtatacagatttaatcccgaagaatcaaatatatcagatgtgctcgtgtgtacgtgactgctggatagctgtgcagatataggtttacagatagaattccttggcaagcttggaaattatttatttgattttgttcagttaaaaaaaagccgaatatgcatgctatacttgctgtaaactgttcccatgatttggaaacggggatgatacatcatttcgccaatggacttgtaatagtagaactgatgatgaattgtcatcttcgacgtatgcgtgccttgctttttgatccaccaaagagaacaactggtgctgacttgctgcgtaggcgagggaataaacgccggccagaagaacgtcccggagaaaaaggctgagcgctttttggttcttgaagagatttccccactgcaagaaacatcccgagaacgttctgacgttctggtaacgtcaccgcctcgccgtttctttcttctggtcttcccggccgcgattgttctccaaagggaaaccgtgtgccctctgcaaactttctgcccgtaataaatagaatgaggggggaaaaaagggacgagtttttgaggccacatgattcggcgatgcgtcagagatcaaccgcaaccttgccagactagtccacacctggatcatgccgacgccagtcgccagtcgccaccatgtgacggaggcttccagcttctctctgaagctgatgtggacgcgctggagcagcctgatcgtggagctgcaggcaggatacgcgtatcaggagaatcggagctgctccaagattggccgacgattttgtggttgctgtttgattcaggtcaccagcagcaggtgggccccaggaccaccttccaccgtcttcgaatcgccgacgccctgggaatgccgtttctttcttcacctgttctgatgacaccggcgatataaacattcggaccaaagttcgtcaagacttccttttgccatctcaagtaaccaaacgtgcttcaccgaggcgcctgtctcccacacaaccgacgagtacaaaaaaaaagttgatgaatacactgctttgccttgacgatgcggagaagccgcccatgaggtttaacattcgtctaaaaataaaaaacctgtcatctattcggtcagatatcgtatacacattcttacattatctcagggacgtgacaagcattctcgacaaaatccatatgacagaatcgacagctcgcagttgtttcaaccacacaacttttagcttcctcgtaaagtcatggttgttgccttgctggatcagatttttagaaatttatggctggacaagggaggactctaagggtcggtatggtttagtcgtagattactgaaaatctgattctatttgtaagctgtgagaaagttactgtgacctgacagttttgacaaagctaaacaactgttaactacagatataatagtatgatagtttggtaacatggttgacagaaatctagaaaatctacggtaggaggtgattctgaattgactagaggaatgtaatatatatatatatatatatatatatatatatatatatata

SEQ ID NO: 6906 - DNA, 5195 bp, Zea mays
  misc_feature (4683)..(4683): n is a, c, g, or t
  misc_feature (5064)..(5064): n is a, c, g, or t
ctacatctgtgccaaattatataaaacatcttctacataaactatctatctaaaagtatattttaaaaaatattttaaaaatcatgatctataatttagtcataaaaagtacttttagaaaaggatgcattttttaagaaaccaaaaaaaaacttatacttggccaaactaatttcatttatgatacccaactaaatatcattatattaattataaagcatattttatagtattccaattcaagacatggatttttatatttgtcgtatagacttaattaaatttagaaaaatggtttatctaaaatcgaaaattatttttttcaaaacagcgatggctgcaccacgagtcccgctgggcagggaagtcgcaacgtcagaatcaggtagcgttacacccgcacgaccataaattcacaactcgcgccgcgttgcgccgcttgtatactgggagaaataaatagcagcatagtatagcaaaagaaaatagaaagaaaaagaaaaggagacgaaaccgaaggagaataaaaaaacacacgacaaataaaaaccgtggatcccgatgaaaaccgaagcgggaggaaggttgacatgtcagcggctggcgccatgggccccacccgctctcctccctagaagacgaaagctgtggtcgggctcgggcgtcctcctccccgccccccgccctccctcacccgcttcctcttcctcctcctcgcctcctccgcctcctttccgtccggccgtttcttcccaagtggcgccggtcccggtcccggtcccactcccagcaggtgccagcgcgcaacgggacgccggcagtgggtacacccgcgcgagcgcgaccatttccgcgccgtcgccgcccgtctcctacctaacctaacgcgcccccacccaatcgatcgcctatccgcctcgcctcgtctcgtctcgtcaggcgggggaggggtcggtcaaaggaacgggggcagggattccgttcccagttcctcccagccaccgaggagcgggcctcgacgctcctctggtcctgtcctcttcgccatggccgcgccggcctcgtcgccggtcgagttcctgctccaccgcccgctgccgcgccagcggaggaggccgccactggccggagcgttcttcgcgcccacggggctgtccggcgcaccgctgctccgcgcgctggcgtcgctcgcggcggacctgctggggaccccgcccctgccgtcgcagcgacggaacatcgacgcgctcatgcggaggctcgcgctgctctccgcgctcctcgactcgctcctgctcctcctcgccgacgaaggcgaggccgccttctccgacgccgccaacctctgcttccgcgagctctacgtcgtgctcttccgcgccgacctgctcgtctcctacgtcgcctccgccggccgcgcgtgggcgctgctacgggcgccccagctcgccgcctcgttccgcgaccttgacgccgagctcgcagtcgtcctcgacgtcctacccgccgcctcgctccgcctctcgtgggacgccgctcagtacctcgacttcctccgcgcgcgctgccgccgacgggcgccggcccactaccacgaccccgcggaggccgctctcggagactgcctcctcgccgccctgcgccacttcgagctcggccagccgccggacccctccatgctccgatccctcctccgccaaatcggcatctccgacgccgcttcttgccgctctgaaatcgagtacctggaggagcaaatcttgaaccaagaggaggacgccgacctccccctcatcggcggcgttgtcgccttgctccggtactgcctcttctcccttttcgaccccagcaacacaaagtcgttgcgtgtttggctgtcggtggggaacagacagcggccgctctcctggagctgcagcgacgacacctccttctcggtgcccaaggagttctcctgcccgatttctttggatttgatgcgcgatcctgtggtggtctccaccggacagacctatgaccgtccgtcgatcatacagtggatcgaggaggggcattccacctgccccaactccggccaggccctcgctgacaaccggcttgtgccaaaccgggcgctccgcagcttgatttcacagtggtgcggggtgcatggctttcagtttgattcgccggagagcaacgaggggatgattgaatgtgttgccgtgtcgtgcagcagcaaggcagcaattgaggcaaacaaagccacagcaaggattttggtcaagatgctgatggagggatccgataatgcaaagccagtcgcagctagggaaatccggttgctggcaaagactgggaagcaaaaccgggcgttcattgctgagttgggtgcgataccgttgctatgcaggttgctgctgtcatcggattggatggcgcaggagaacgcagtgactgcattgctcaatctatcaatctttgagccgaacaagacccggattatggaacaagaggattgcctgcatcttatcgtcagtgtgttgaagaacggtttgacaacagaggccaaggagaatgctgcagctacgctcttcagtttatctgtggtccatgactacaagaaaaagataatgaatgagccaggggctgtggaggagcttgcgtctatgctgaccaaggggacagcaaggggaaagaaagacgcagtgatggcattgttcaacctctcaacacacccagaaagctcaggacggatgcttgagtcatctgcagttgtatctttaattgagtcactgaggaatgataccgtttcggaggaagctgctggtgctctggctctgctgatgaagcagcctagcatcgtgcaccttgttggtagctctgaaacagtgatcactagccttgttgggttaatgaggcgtgggactccaaagggcaaggagaacgcagtgtcagctttgtatgagatatgccggagaggtggatcgacattggcacagcgcgtggcaaggatacccgggttgaacacggtaatgcagaacatcacgctcacaggaacgaagcgtgccaagaagaaggcaagcctgatcgtcaagatgtgccagagaagccaaatgccatcggcgctggcgctaggaagtaccttggcagtggtggatcattcgttggtagggaacagcagattgaggcgcgctccaagctttggcagcggggagttgtcaaaccctgtgtcaatttcagtgcctgtgccttagatggagaaagaacccccaaaaaaaaatccatttttgagagcccacataattgtcaccgcattcagtgagttttgtccctgaaattctttcattgcgtcctcaaatgaaggtatacagatttaatccaaagaatgaaatatatcagatgtgctcgtttgtatgtggctgtgaataactgtgcagatatataggtttacaggtagaattctggcttgacgtttccttggcaagcctggaaatcatttatttatttttgttcagtttcggaaacaccgaatatgtatgcgacttgctgtaaactgttcccataatttagtactcgccgcatttcacaaaatcgtaagtcgttttggctatgcgtaaggtatgtacctgggaaaagccaaaacaatttacaaatggaattgtaataaaacagaggaggatgaattatcaacaaatgcgcctttagcttatacgtacatgtcttgctttcgatcgaccaaagagaactggtgctgcttgttgcatagcagagggaatggatgccaatctgaagaacatcccgagaaaggcagagcgctttgattcttgaagatatatttttcccccactgaagacaaccttcttgcaaaagaattgtcctctcaccagaatctgaatctcctccagaaagattatatacgtgtgcatgccaatctatgctggactatgaacagaaaccgtgtggaatattgtgttcccagatgggagatttgcctacacccattttacacactttgtccgtttgcataattgcatgtttgcaacagccggataaagtatcatcacgacaagtctggtgacttgtcctccaggaacacctagttaggctgaacccaccttgaatattccgttcagatctcaacaaaaaaaaaaaaaacattcccctttttctcaagaaaaaaaaagaacccttaaaaattcatcaaagcattttggaccggacgcataccaacctctaggagccatttgaaaaaagtttcagagaacctttccggaatccaaggatgaaacaaaagtgttgagcaatgctcttgttcgtgttacatttgctccagaaggctccaacgttttttttttgccgttctggtaaagcccacctcgccgttcgttctggtcttcccggccggccacttcgtttccaaacgaaaccgtgtggcctctgcaaatagtctgcctgtaataaatgagaaaaaaaggtccgtccgttctcttctctacgccgcagctctgacggtgacgggtttcacaccacaccacaccacatgattttagcgatacgccaggtccaggcaatgtccagaactttgttgcaagaccagtccacacctggatcatgtcgacgacgcgcccatcgccaccatgtgatggaggtttccagctgatggttctgttactggaggacaccgggcgagtgccttctttntcaagttctgaagctgatgtggatgcgctggagcagcctgatcgtggaaacgcaggatacgtatcaggagaaccagagttgctccaagattgacgattttgtggtcgctgtggattcaggtcaccagcaagtgggccccaagactacttttcatcgtcttgtttactagtatcaaatagtgaggaggttcctttcccatggatcccttttatttccgtgtgcaccaaaccagccctaaatagcacccaaacattccaactcccacattcattgcaaagagcaagacttcactccatccacacactcaaagcatcaaagtcctctccaagtaccataattatgtttaaagatcattagtgattagtgttttggagagactcnagagagatgtgacattgtgattttcttgttgctcttttagcttcgtgttttgatcgtgctctttcttcttctaatctcattctcaagtcgtaacgctctagcaagagacttccgttttttgtgtgaaaatc

SEQ ID NO: 6907 - DNA, 2956 bp, Zea mays
gtttgttgagaagaaggataaaagcaagttgctgtgtgtggattatcgcgctttgaatcaagtgacaatcaagaataaatatccgcttccccgaattgaggtcctctttgagcagttgaggggtgcccaggtgttctccaaaattgatttgaactctggttatcatcaattgaggattcgtgaggaggatattgagaagaccgccttctgcaccaggtatgggcattatgagttcatagtcatgtcttttggcttaactaatgcccctgctgcctttatggaagcaatgaataggatgctgcatgaattcctggacgactttgtggtcgtgttcctggatgatattctgatttattcaaagaccgaggccgagcatgagcagcatctccgtctcgttctgggtgccctaaggaagaatcaattctatggcaagttgaagaagtgtgccttttggctttccgaagtggctttcctggggcacgtgattaatcagcagggtattgcggttgatcccaagaatgttgcggctgtggtggagtggaagagaccctctagtgtctctgaaatccgaagtttcttggggcttgctgggtattatcggcgcttcgtaccaaatttttccagcattgctaagcctttgactaggctcctggagaagggtgttcccttcgtctggtccggcgattgtgaggtcagttatcagtcattgaagagcaagttggtggacgcccctatcctagctttgcctgagagcggtaagcgtttcacagtttatacggatgcttcgcgtattggtcttggctgtgtgctgatgcaggaaggcagggtgattgcttatggctcaaggcagttgaggaagcatgaggggaattatccaactcatgatctggaattggctgcggtggtttttgctctaaagtcgtggaggcattacctttatggcgaggcttgtgacattttcaccgatcacaaaagtctcaagtatatttttactcagaaggagctgaatttgaggcagcgtcggtggctagaattgattaaagactatgatttgtccattcattatcacccggggaaggctaatgtggtggcggatgcccttagcaggtccggggttccaaaggtggccttgccgttgatcgctgatctggaccgtttggggatcgctttgtgttatgtcggcaccgctagcgaggagactcagatgcttattcaatcctctcttatggagagagtgcgtgcggctcagcagcaggatcgtcttttgcaggaagcccgaaggagggttggtgatggtaaaccgcgggagttcaccattgatgagaatgatttggttcgtttcaggggccgtctttgtgtgcctcagaaatcagaggtgaagctggatatcctgcgagaagctcataaaacgccttacaccgtccatcctggcgaaaccaaaatgtaccgagatttgaagcaaaacttctggtggaagcggatgaaggttgacatttctaagtatgtggccgcctgtgaagtatgtcagcgcgtgaaggccgaacataagcggcctgcaggtttgctgaagccattggaaattccagagtggaaatgggagcatatcaccatggattttgtggtgggtctacctcgttcccctcgtggcagggatgctatttgggtggtagtggatcgcttgactaagtctgcgcattttattcccatgaagaccacgaattcagcttcagatttggttcccttgtatatgaaggaagtagtcaggcttcacggggtacctaagtctattgtttctgatcgagactccaaatttgtatccaaattctgggagagtctccatagtgcattgggcaccaagctttcgcttagtgtcgcttttcaccctcagacggatggtcagtcagagcgaacaatccaaaccttggaggatatgttgcgtgcttgtgttctgtcatggaagggtagctgggaggatcatcttgctctggcagagtttgcgtataacaacagctaccaggctagcatcaagatggcaccatttgaggctttgtatggcaggcggtgtatctctcctctgtgctgggagactttgggagagagatccctggttggtcctgattgggttcagcaaacttctgaaaaggttcgggaaattcgtcagaatattttggcagctcagagtcgtcagaagagttatgctgatgtgaggaggcgggatctggaatttgctgtgggtgaccaagtccttctcagggtatcacccactaagggagttgttcggttcggtgtctctgggaagctcagcccgagatacattggaccgttcactatcttggcccgagtgggcagcctggcttatcgcttgctgctgccggattccatggcaggggtacacccggtttttcatgtctctatgttgaggaagttcttgcgggatccggaccatcagattgagatggaaccaattgcggtgcagcaggatctgactctggagtgtcgtccggtgcgtatattcgaattctcggagcgtgtgttgaggaagagatcaattaagtatgtcaaggtcttatggtctaatcagtcagagcgcgaggctacgtgggaacttgaggagttgatgcggcagaagtacccggaacttttcgttgtgggtggtggacttccggatcgttcttagggattttgcccgaacttcggtaaaggcacctgatctttgctttgcgaaggaagggatgtagcagcacggccaccacacttttaaataaaggaattactgattaataatgatgttaaacaggaagagtcaagtctagggaattattacattctaatctttcatggtagttgaactgtttagtttggtgggcggtgatgtctatcttttgtctggtcatgaatgttctttcctaccgttgtattttgattatactatgtcaattatctttcttttatattc

SEQ ID NO: 6908 - DNA, 3982 bp, Zea mays
ctgcagaatatctcttgaaaccagtcatccatgtgatggattcctcatctatatcaatctcagcagtggccaggaattgctttactgccatctcactgaaatcagtcctctgacccataaagtgatacagaccacatgtctcaaattttggaatcaggtcctccataactaattgtcccagcataaaatccaatcaatcacttgatgtttgtgaaagttggtatccatcaatgtgccccaaaagacatcaaattggaactgagtgtgaaagaattgaacattagtgtctgatggcagagcatattgattgacagtcctcctggagcagtattctgccatagagaacctcctctttggaaaagtccatcctgtgatatcaatcggatagtcaggtgtgatacccggttcgcaaagaagagaagttggaggttattcttttttcccattcggttgatgcattttggggatttggaatttgtggaaaaaattcaccattagggcagtagaatttctttggttaggcgcttgcaacagggtcgggagctgtcgcgtgggcgagttgggccgtgaatcttgattcggcccactaacctccactaaccctagccgccctctcccctaacccccccttcctttgtgcagccgccccccattcccctaacctttggccgccgcccccccctcccatctcctcctccctcaaacccttgcagccacaccacctaaccctagacgcccccatctcctcctcccaaggtgccattccttgccgctcggatcttcgtcgcgtggtgcaaatctccaattgttttcggtggagggaggaagggaggaaggaaagggggagaacccaaggtgatttttgtgtttatctcttgttcatttgtgctgcaatccaattgtttagatgttgcgtatgcgattgggtagagggggttgtccagaattttagggggtggacgaacagcagcagtattagtggtttctgggcatttttcgtgggatattaatgggaatcagtttaggaatcatgtagaactttggcatacctttccaacgagtatttatgcgctcaatttggagttataaattaaaagttatcaccgtttgaatccgggtatgtggctgtccaaaaaaaacagattttcagggggatgaacagcagcagtgttagcagtttctggggatttttcgggagtaattagtgttaatcagtatgagaatcatgtagggctttttcttacctttccaacaagtacttatgcgctcgattcggaattatattttaaaagttatcgctgtttgaatccgaatatgtcgctgcccaaatcagggaaaaacagattgcagggtttatcttgtggaccgtttaggggtaattagatgttagaatttaatcataaattatatacaaaacttgtggggaattttatgtagttgtctctggagtttttgtttgacaccactgctgtcttaattttaaagttatggaattgttaagcagcgccgctgcagtttggttggtgtggggagaattgttacccgtggcggggtttgagattgctcgtaggtgcgacattgtttcgaggctttttatgtgaatttggtgcactaagttgggtgtcaaaaataggtggtggactcccagatcgttcttagggatttgcccaaacttccggtgaaggcaagtaaaactgtgatggttattccgtctgtcagatgaggagtcttatacttgtttatgttgtgctattatgttcaaattcatattttcttttgagtaccatcatttgaaaatgttcatgtttcatggatttcatatgttgagtttgaggtttgattatgttactcaagtggttattatgtggaatgggtggaagtaaatgcctagcacatttttatttgggaagaactcatgatgttgtcatgcataatgcactcatcatccattgcattgaagtttcgtcgcgatcttatggtccgaccgtaccggtacattgagcatcatatgttgcccgagaaggggtatggtgcagcttcatatccttagagatatggaggcagaagtcattattgcatttgtagccatgtgcattcatgggagaggtgttgaatctattatgtggatgtggataatttggacttgtgcatggtgattctacttggcgttgagtttttagttacttgtttacttgctgcaatttactgttcaaaagaaaagaaagaagtcctgaacacgtggttgtgtaagcacagttgatttacaatgtcctatttgttgttgttatgtttacttgctgagatgtgttatctcacatcttgcattgtttgatgcaggcacctaatttctgctttgggaatagagggatgtagcagcacggccactacacctttaataaaggaaccaccatttaataatgttgttaatcagagttggacaagtctagtgaattgctttgttcttggttgagcgtttattttggggtgggctgagtttcttatcccatttgttttgcttcagttgggtcataattaagttttaccacttttgcatttcagtttctactatgtgaatcatatgtctttatatcttgtatgagcttcatgtttcccctccttgttatgcctagttttcaaaggaggtgctgccggatttttgctatatattctttctttattacttctcttgtgttgagtaagtttggtgtggtggggtttgtggtattatccactgtgtgtgaccagtggggtgttacagttggtatcaaagcataggctgtaggtcctagcaagtggagtagtaataaattgacacactgcacatgtaggatgggtttcctgctttactattgatatcttatgttattgtcagtgctagattgacattgtttgatgaagtgctatgccaatcttatttacttatttacttactcttgtggttgcagttatgctgcctcgtagggctcgtggcagcccacaagcccctagtggggattctatgagtctggcggcaatgttagccgcgatgcaggccatgcagcaggagttggccattctgaggtaggctattcctgttgctcctgcgagtgctgcttagggtgctggtggtggaggagtgcctaggggcgctgttcccgcgggtgctgcttcaggtcgcggggctgaggtgccttcagtggtcttcctatgatgcagtggatggccatgaagttggacacttttgatggcagtggtactccgatcgaggcggcagattggctaacttacgtggaggataagatgaatgtcttcgagattgtgtttggggaattggggatcgtgttcgctttggcacacagctgctgaagggagaggcttagatttggtggagaggcgtgcaggcagctcactcctcttcaccaggagtcctgtcctgggatgttttcatcaggcagtttgagaggaggttctacccggtcaccttcctggagaaaatgaagattgatctgcagtcctacaagcaagagaagaagtctgtcacagagtatgaagtgggcttcaacaagatggtccgctttgttcctcatgtggcttataatgagttggagaaggcgagccagttccgtcagggcctgaaaccttctatcaggcatgcccagggagcctttccgttggtggatttccgtactacagtggagcaggcattgggtgtggagatgcaacaccagtacaccatggagtcacagaagtcttcgggtgttgatcagcctcgtggccaggacgcgaggaggggcaacactggaggtccagcccacaagaggggcaagtctcagtaccagcgccaccacccctaccgtggcaaaacctctgaattgggtacttcgggaggaagtactcagaggtttcgggctgtccctaagcccgagctagggctggtgtgtttccgttgtggtgatgcgcatcgccgtgcagagtgctagtggagtggcaggtgtctatctga

SEQ ID NO: 6909 - DNA, 1629 bp, Zea mays
taagcacaacagttatttagtggttcccgcgcttcgcgcgtgctgatttacatgtcattcgcgcgatgtcgcgcgtatggattcgcgtgtactgttctgcacgtggtgtcgtgctgggccatgtgttgtctgcacgctaagtcgtgtatatccgtgtgtcattcgcgagtgtcgcgcgtgctctccacacacgttgtcgctcgacgttcgcgcgtatcacatgttattcgcgcgtgagattaagtcgtttgcttataatcactcatgacagttaattaactatttaatcgtccactattaaactagtaagttagtcataactatatagtagttttaatctacatttgatgtcaattaatgtgattgcgtcgaattaaatgttctaactaatactttgtagcataaatattataacttctcgaccctagcttcgactatcgcggttcttttcctcgcataaccgtaaaagcgctatatattttatattgctcgtttttataacattttgtattgtatggtgtaatgttcttatgtatatgtatatgtttgtttgcttgtgcctgttcgtcttcgcgtcgcgttgcgattagaccgcgattcgtttccaagcttcggggaatcgacgatcaagcgctggcgaccaagtgatctggctcttcgagttctacgagattgaagactctgagcatctgtttggtgaaggcaagtgtcctttgacctatctctgtcctattcattctttaattcacctcccgctttatacatttatgcctaaggattgactagctttattatccatgtccttgcttacctatttgggttggattattattgtttagctttatgctattgctcaaactctaatgaatgaacatgatgagattatctatgatacgctgttttccctcctcttattatgatgttgtacttgtggctttaagggggctcgagcggtttctcgagtgcctctccataaggacctgttctatggatgaccgcccgggaaaacagtgcaaccatgagggtggaatggggtgcccttagctgaataattagaggatccggggtgtagttcgcttcgccgtcgtgccgtcaatggggctcggtgtatgcggctcgctctgccaaggttgatttgtcccttggggaggagtgcggtacatttaggaaacctaacgggcggctacagccccggggaatctttgtaaaggctacgtagtgaaaccctgcctattcaccttggtagtgtttaagggtttgatcggcccgaggcaagagggaatcacggcttgtgggtaaagtgcacaacctctgcagagtgttatgaaactgatatatcagccgtgctcgcggttatgagcggccaagggagctccagtgattagtggtacttgatcagagacattgtggtacaggtggttatgagatcgatggttttggttatgactatggtgctggtaagtggtattctttccgtttggaaagggtacatcgggctaataacttgggttaatgctaaaacttggctttctactagtaaataataatctgaccaactaaaagcaactgcttgacttatcccccacataaagctagtccactacagccaaacaggatgcccgctgagta

SEQ ID NO: 6910 - DNA, 1052 bp, Zea mays
attcgctttatttgttatcttgtatggtgtactgttcttttgtattaaatatgtggatgtatgtatgtacgtttgcgctcgcatagagaacgatccggtcgaagagcccgaggaattcgcaggagaagcccctgagcagcagtcggttggtggaggcaagtgtcctttgacctatctctgtcctattcattctttaattcacctcccgcattacacatttatacctaaggattgactagcttttgttatccatgtccttgtttacctatttgggtcggattattactacttagtctgatgctattgctcaactctaatcaatgaacatgatgtgattatctatgatacgctgttttcccgttcttctttatgattatacttgtggttttcaaggggactcgagcggtttctcgagtgcctctccgtaaggacctgttctatggatgaccgcccgggaaaacagtgcaaccatgagggtggaatggggtgcccttagctgaataattagaggatccgggatgtagttcacttagccgtcgtgccgtcaatggggctcggtgtatgcggctcgctctgccaagtttgggttcgccccttggggaggagtgcggtgcatttaggaaacctaacgggtggctacagccccggggaatctttgtaaaggctacgtagtgaaaccctgcctattcaccttggtagtgtttaagggtttgatcggcccgaggcaagagggaatcacggcttgtgggtaaagtgcacaacctctgcagagtgttatgaaactgatatatcagccgtgctcacggttatgagcggccaagggagctccagagattagtgatacttgatcagagatattttggtacaggtggcaatgagattgatggttctggttatgattatggtattggtaagtggtattctttccgtttggaaaggatacattgggttaataacttgggttaatgttaaaacctggctttctactagtaagtaataacctgaccaactaaaagcaactgcttgactgatccccacataaaggctagtcc

SEQ ID NO: 6911 - DNA, 1128 bp, Zea mays
taagtatgtcaaggtcttatggtctaatcagtcagagcgcgaggctacgtgggaacttgaggagttgatgcggcagaagtacccggaactttttgttgtgggtaagtgttgttgatttgctaagcttttcttgtgtcattccgatagaagcgtcagaattcgaggacgaattctttttaagaggggtagaatgtgatacccggtttgcaaagaagagaagttgggggttgtttttttccctcatccagttgttgttttggggatttggaattttgtgaataacattcgcaactagggcagtagatttttttttggtttgacatttgcgttgcggtcgggagctgtcgcgtgggttagttgggccgcaattggtgtttcggcccattaggcctcccaaaccctagccgccaccctcctatctactccccctcaaggctgccgcccccccccccccactcctccttcccccttggccgccgccccccctgtccacctcctcctccctccattgttgcagccaccaaaaccctagccgcccccccccccaatcccctcctccctaggtgctactccgtgccgctcggatcatcgtcttttggtgcgaatctccaatcgttttggtggaaggaagaagggaggaaggaaaaggggagaacccaaggtggtggacttccggatcgttcttagggattttgcccgaacttcggtaaaggcacctgatctttgctttgggaaagaagggatgtagcagcacggccaccacacttttaaataaaggaataactgattattaatgatgttaaacaggaagggtcaagtctagggaattattacattctaatctttcatggtagttgaactgtttagtttggtgggctgagatgtctatcttttgtctggtcatgaatgttcttttctaccgttgcattttgattatactatggcaattatctttcttttatatcctgtataaactatatgcttcccttgttatgctactttcaagggaggtgctgccggattttgcagtactttctttctctgtgtgttgcatgagtcttgtagaaaggggcgccgccaaggccgtggcgctggtgctgccgcagctgaaggggaagctgaacggca

SEQ ID NO: 6912 - DNA, 943 bp, Zea mays
tgctgtaaatagtgaagaggtcaacaagtatgttcttaacaatgctccaggtaattgcactttgactagcccaaagatacaaaagcagattattcagtgttgcgctatagaaactagaaagaaaataattgaagagcttggggaagagccatttgcaattttagcggatgagtctagtgacatatcacacaaagaacaactagctctttgcttgcgttatgttgatgcattgggaaggccatgtgaacacttcattggagttgttcatgtagatgatactagctctttatcacttaagaatgcaattgaagctttacttgttagtcatggcttgactttgacacgaattcgtggacaaggttatgatggggctagcaacatgaggggtgatattaaaggattgaaaacattgatcatgcaagagtcaccttctgcttattatatccattgttttgcacatcaactccaactagttcttgttgttgttgccaagggaaataatgattgtgtgtggttttttgatcaagtaactctcttattgaatatcgttggagtttcttgtgagcgtcacggtatgcttcgagatgctagacttgagaatctcatgaaatcacttgaatgtggtgaacttgatactgggagaggattgaatcaagagatggggttgcctaggcctggtgagactcgatggggctcttattacaaaactatatgcaacataattactatgtatcctgtcatccgagatgttctcatgattcttggagagggatactacaattagaagtgattggacaaggatacattctatgctgggagcttttgagtcatttgactttgttttgtatgcacacttaatggttgttattcttggacgtatccaaatgatttatcagtgtatttgcaaagaagggagcaagatattattaatgcaatttcactt

SEQ ID NO: 6913 - DNA, 1338 bp, Zea mays
  misc_feature (1240)..(1240): n is a, c, g, or t
ttgtaactgatcattagtgcataagctttaaccccccccccccctgcgagaccctttcccgtttctttttaatcataataaatgcgatatcgaatgtcatacttgatgcatattcactttacttgttctcttgtatggtgtactgttcttttgtattaaatatatggatgtatgtatgcttgcaatcgcatagagaacgatccggtcgaagagcccgaggaattcgcaggagaagcccctgagcagcagtcggttggtggaggcaagtgtcctttgacctatttctgtcctattcattctttaattcacctcccgcaatacacatttatacctaaggattgactagcttttgttatccatgtccttgtttacctatttgggtcggattattactgcttagtctgatgctattgctcaactctaatcaatgaacatgatgtggttatctgtgatacgctgttttcccttcttatttatgattatatttgtgaccttcaaggggactcgagcggtttctcgagtgcctctccgtaaggacctgttcaatggatgaccgcccgggaaaacagtgcaaccatgagggtggaatgggacgcccttagctgaataattggaggaaccggggtgtagatcgcttagccgtcgtgccgtcaatggggctcggtgtatgcggctcgctctgccaaggttgatttgtcccttggggaggagtgcggtacatttaggaaacctaacgggtggctacagccccggggaatctttgtaaaggctacgtagtgagaccctgcctattcaccttggtagtgtttaagggtttgatcggcccgaggcaagagggaatcacggcttgtgggtaaagtgcacaacctctgcagagtgttatgaaactgatatatcagccgtgctcacggttatgagcggccaagggagctccagagattagtgatacttgatcagagatactttggtacaggtggcaatgagattgatggttctgattacgattatggtattggtaagtggtattctttccgtttggaaaggatacattgggctaataacttgggttaatgttaaaacctggctttctactagtaagtaataacctgaccaactaaaagcaactgcttgactgatccccacataaagctagtccactgcagccaaacgggatgcttgctgagtatgttgatgtgtactcacccttgctctacacaccaaaccccccccaggttgtcancattgcaaccactgctcaggcgaagatgaagctgtggaaggagacttccaggagttccaagactacgacgagttctaggtgtgggttagcggcaaccc

SEQ ID NO: 6914 - DNA, 1889 bp, Zea mays
aggcgcggagatcggagcgtggtgcggcgtgccacgggcgtgcggcgctctcctccgtggatctccgcgcagtcgtggcggcactgcggcagcggcgtgcgtccctgctgtgagcttcctcgcaccgttgcgccttcctcgtgaggccgtatacatggacgcgaaggacatactagggcttccgaagacccccttctcgtcctcccaggagaagaaatcgcggccgcccaaggagccgcagcgcaagcctgatggcgtctcgcgcgaggtctatgccctcaccggaggggtgggaatgcccccgctcatgccgaccattgaggcatcgcacctgaagaggcggcctgctgcggagaaagagaaggtagcatggcagtggttacctttcacgtcatccgcacgaactgataaccttcaactctatcactgggttagagttgttaatggtattcagccaactggggattatcagtttgcaaaatataacaagagggcggatgttcttaaatatacggatgaagagtatgagaagtatttagttgaccctgcttggagcaaggaagaaacagatcaactatttgaattatgtgaacgatttgaccttcgcttcatagtaatagcagataggtttccaactgctcgcagtgtggaagatctgaaaagtcgttactattctgcttctcgggctcttctaattcatagagctaggtcattcgaagatgtttctgggaatccccttgtgaaggatgcctatgatgctgctcatgagactgagaggaagcgtgcattatcagcacttctctcccaaacaaagcagcaagaacgaaaggacgccgagactttagcagaagcaaaacgtatcatggaatctcgtgctgctagcaaaaatgttgatgtagctgtaatgcctccgaactctgataatgctatggtacctgttgatggtgtatctccttcaagcagtactcatccatctttagcacatccaaatacatcagctaacatcttgatacctaattcactacgaacgcttcgagtgtatttgagaacccatgcgcttgaccaaatggtccaagcagtaggtgcttcagctggccttagagttatcaaaagggttgatcagacactacaagagctagcggtgaatttgaagcctaaggtcccaacgaaagcagtttgcatagagcatattgaactgcggaatgagctactcacattgcttaacctacaaaagcagctgcaaaataaagaggctgaagtttcagctaaccgggaaagttccttcacagaggcaccaagcacacctaagcgttctaatagggacattgatcggcccttcatccctgatacaagtgggtttacaggtgaaagagcaggcaaacgggatcacaagcggaagtccactggaagatttatagatgcgcctccatcaccaccccagtcgaagcggcctagaaaattgaagggatctgactgatagtgctgttcaaatgtcaggatgaaaactctagtcaaacaaccaagcacttgcagtcttacagtagagatgaactagtagaacctaataggtcagcaacggcatcaatggaaatccgttgggctggccagtcatgcaggaaccgactttcgctgcttgccctgacttcgggccatatgctgggtggaccggttttggatttataatgtatctatctattattgtcatgtaatgttacacagataactgagaggtcgaaatcgtcacttttcagcagatttctgaattctgagtatgggagaccggtaagcccgacaattccgttttagctcctgtccaaccagcacggtcaatcggttcacccaatagacgttcaacaaacaggctttgagagcacgctagtgcccgttta

SEQ ID NO: 6915 - DNA, 990 bp, Zea mays
gaatcgattcaaaacatataagcagaatttttgcgcatgtgctcagcgttgcatagcccccgtcttttcttactagttacgcaacagcaacttgtttccatatatttttccaatgtaaatagcaaatgcaacgacacacgcgtacaaccaagaattaagagtatttacgcgacatggagaacagtagagctccgataaattacaccacaggaaacccttttgctttgtttcatctattagtcaaccataagtatctgttattggcgaataacacctcgcaccagtgctacagcgtaatcaaccttcaggtaaacgcacgctgcatcgtttgccggtcatctagttggttttctgtcgaattcagattcatggcagtgagggtcgagccaatcacgaggagaactctttggcaggctggtaccagtaccacctctagcacccagcagctcccttaggctctccatcttgttctcctgagcattgccggagaatttcctatctgcttccttcagtttgttccggaaccgctgcttgcggccaacggtgttcagctcctgctgctttgcttgagatggtggagctccatgaggtcccagatatattttctcatcgcttgcctgtagaggctcaggatctttttctttggggacactaggctcagccacatcattatcttgagtgggcaaattaggaataacatatccgtcagcatcccactggtcttcctcggcggcagccgcggcctcaggcggtagggtagcctccaccggcgagggcgaaggggcggccatgttggtccgcgaggccacgagccggagttggagccgcctcgactcaacggagatggatccctctcgcgctggaagcctggactgcaggcccggccggctggtagggactatatcccaatgctgaatgccgaaaccgcagaagcagagaggtcctgtggcttcctagggttgcgtttggttggaatgaagtgtttttccc

SEQ ID NO: 6916 - DNA, 1524 bp, Zea mays
cattgggtacctcgaggccgcccgaagagctaagagggaagaacaatcgagctactaataaggtcgtatacatatcttctatatactcctctgaaagttgtgaactccggtcgagcttaaaaacagcagcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcccggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgacgacggcgacctcagcgccgtggacctcatggaggccggcagcggcgtctggactcctatggcgcacaactggggcgccacgtggcgcctcaacaacggcaggaagctcaaagcgccgttcgggctccggctcacctccgactcccgcagggtgctcgtcgccaacaacgccatcccggccgcgtggaagcccggcaagacctaccgctccttggtcaactacccctgaaaagagaaataccgacaagtggatggcgtgtattgtgcgtccgggtgttgcgagtggcggcggtgtactactggtgtcggaaaacagaagagaatgaaagaggaggttgaagaagagaataatgtccttcttccctccctggacggtctctgcagtccccaaaagtgatgtgtgacggtgttagtcaaatcatgccggtaatttgatacttcatctcgatttgagttttactgctatactactgtgattgaggtaagacagaatcttatttcttgaccacgtagtacataaactacaaagcatgcccgttgcgttggtaattagactcttgtagtggtttttgccaatatcaagatgtatgtagaatgtgtgtgcatgcgttcacagtgatgagaatatacatgcgtgtatctgatcctgtaaaaaaaaaaaaaaaaaaaaaaacaactacatactatgtttatat

SEQ ID NO: 6917 - DNA, 556 bp, Zea mays
  misc_feature (535)..(535): n is a, c, g, or t
atttcctctctgccgtctccgtccccgggtcaaatcgaatcgagcccatccatctccatttccgccgccgccgccgccgagagaccccaaccccacccatccaccaccatgtggcgccgcctccacaccctagcccccgccttgcgcagggctaccgccgccgccgccgccgccggggcccctgcggcgtccgcttcctctgcagcccgcgccgccccgctctcctcggcggccgccgctttccgccgcaccagcccgctcctctcaggggacaagccggcgagtgtggaggacgtcatgcccatcgccacggggctcgagcgggaggagctggaggccgagctcaaggggaagaagcggtttgacatggatcccctggtcggccccttcggtaccaaggaggaaccatctgtagttgagtcctactataacaagcggatagtcggctgccctggtggtgagggagaggatgaacacgatgttgtatggttctggttgaaaaaagatgagccgctatgagctgtccagtcttgcntcgcaacacttttgtgcttaa

SEQ ID NO: 6918 - DNA, 2222 bp, Zea mays
gggaccctcgaggccggccgggccgggggggagttcggcccggccgggccgcggggtcccgccgcctgaacagccacttcccctgtccggtgccccggttgtttttttcctctctgccgtctccgtccccgggtaaaatcgaatcgagcccatccatctccatttccgccgccgccgccgccgagagaccccaaccccacccatccaccaccatgtggcgccgcctccacaccctagcccccgccttgcgcagggctaccgccgccgccgccggggcccctgcggcgtccgcctcctctgcagcccgcgccgccccgctctcctcggcggccgccgctttccgccgcaccagcccgctcctctcaggggacaagccggcgagtgtggaggacgtcatgcccatcgccacggggctcgagcgggaggagctggaggccgagctcaaggggaagaagcggtttgacatggatcccctggtcggccccttcggtaccaaggaggaaccatctgtagttgagtcctactataacaagcggatagtcggctgccctggtggtgagggagaggatgaacacgatgttgtatggttctggttgaaaaaagatgagccgcatgagtgtccagtctgctcgcaatactttgtgcttaaggtcattggtgatggtggtgatccagatggtcatgacgatgaagatgatggacatcactaaggatgccttgtggttctgaaaataagaatttggtgaggcagatgaatccaatacacttctttttctagaaccagactgctccacggcatccttgtttatgaaaagacagttggccatcaagcaggtggtagttttcacctaggtattttgtccaaacaaaagctgtttgagatttgacccttgcgtttctttaagagcatcgtcgaataaaagatgactgcagtcagattgctttcttttgatacctcatattggcccatcgggtgtgatggacatgtaatattcagtaatggaacagccccatttctatgcttagcgtgctgggaattttgcaaaaggcctcctatatcattgacgagttttaagccagagtttgatgatccaacatgtttatgaccattgttttaatagccatgctattctgtgacaatctccatgatgctatttttgtattgagtacgtcttgtgacttgtggcatatatgctgtttagtaataggggctatttggcttggaccctcaatagctggagcactgggggagctctggctcttggcaaaaaaacgactccgccttctctgcctgctgttcattaaaaaaatgttctttatagtgtttggtatggtattgtttcttgggctcctagtgcttggtacggttttttcgctgaagctgtgccaaatagaagcggctgggatatggcaactctttgcgttataaataatctgtacaaaaaataaaatggcacaagtttgattggaatgaaatgacaccttattggttgttctgggacgtttacgttcttgattgtgtttgatcttcgattcaccagatggacgaacaacgacgatacatcatgttaaccaaaggatgagatgacttgccactttgctaacctctacaaaaggacctgtggtttccacgaggaaaccacgttcacgtcacccaaaattctccccagccgttgggccttccatcctgcggctgagattgcttggagccgctttatttcataaaaggggtccagggactttgagacaatgactattgaggagcgcaagagacactgttgctgataacattcagaagagaaagagagagagagagaagaagaagaagttctgctctgcatcacttgttcatcgtcgaccacctgtcgcgccagcatgagttgcatagcgaaattctggtttggacggacgggataaacaaaagggcatgtaatctgcttatctttgttccatcccatccttcccatggccttttccaatcctagcaaaaagggtcgcctttgtcacatgtgatccgaacgacgatgcaacaatactttttctgctagctgcagtagccggtttgagttgctaattggcctgtctgcatttcataccaccaagcacacttagtgttataaataaatgcgacacaaataggatcaatcacagagtagacacggatttaacgtggaaaacccctccaaagtgaaggggaaaaaaccacgggcgccggccggcaa

SEQ ID NO: 6919 - DNA, 1054 bp, Zea mays
atcaaccacccactcccgactcgccgcccgaacggcccctcccactgcccggctgccttattatttcctctacgccgtctccgtccccgggtcaagtcgtatcgagcacatccatctccattaccgccgccgagagagagacccaccccgctcatccaccaccatgtggcgccgcctccacaccctagcacccgccttgcgcagggctactgccgccgctgccgggggccccgcggtgcccgcctcctctgctgcccgcgccgcgccgctctcctcggcggccgccggcttccgccgcactagccctctcctctcagaggacaagccggcgagggtggaggacgtcatgcccatcgccacggggctcgagcgggaggagctagaggccgagctccaggggaagaagcggtttgacatggattccccggtcggccccttcggtaccaaggaggaaccagctgtcattgagtcatactataacaagcggatagtcggttgtcctggtggcgagggtgaggacgaacatgatgttgtatggttctggttgaaaaaagacgagccgcatgagtgtccagtctgctcgcaatactttgtgcttaaggtaattggtgatggtggagatccagatggccatgacgatgaagatgatggacatcactaaggatgccttgtggttctgaaaataagaatctgatgaggcagatgagtccatcacacttcttttttcttgaaccagactgcacggcatccttgtttatgaacagacatttggccatcaagcgggtggtagttaatcacctagggattttgtccagacaaaagcttattgagatttgacccatgcatttctttaagagcatcatcgaataaaagatgactgcatcagattgctttcttttgttaccgtatggccatcgggtgtgatggacatgtaatattcagtcatggaatggaacagacccatttctttattcagtgtgctggggaatttgcaaaaggtctcctatatctcttacaagtttcaagccagagggtggtcctgccgtttttcgtc

SEQ ID NO: 6920 - DNA, 1479 bp, Zea mays
cctcgaggccggccgggctattgttcaggatggaacagtccatcctttgactagctatgtgatcaattatgtcaaattcctattcgattaccagtcaacattgaagctactgtttcaggaatttgatagtggcactgaggcagaatctcagcttgctgcagttaccacaaggataatgcaggccctacagaataacctagatgggaaatctaaacaatataaggatcctgcattgacacacttgtttcttatgaacaacatccactatatggttagatctgttcgcagatcagaagcaaaagatatacttggtgatgactggattcagaggcatcgcaggattgtgcagcaaaatgccaatcaatataaacgtgttgcttgggcaaagattcttcagacactttctgttcaaggtgcgggcagcggtggtgaccttaccagcagtagtgtttcaagagccacaatcaaagaacggtttaagtctttcaatacacaattcgaagagcttcacgcgaagcaatcacaatggatcgtacctgatcaagaactacgagaatccttgaggctcgctgtagccgaagtcctgttgccagcctaccgatcttttatcaaacgctttggcaatcttgtggacaacaacaagaacccgcagaagtacgtgcggtacagcccagaagcagtggaccaacttctaggccagttcttcgaagggcagcaatgggcggagcaaaagcgctgagcaacatagagtgagagtgacggcatgagtacagccagatgccagcactacctagttttcttttctcagaaaaagcgcgcctaagtttcttttctcgccatttgggtggctggaacggaaagctaacggcaaaaaagtgttggtggaactttcttgctggaggttcctaaacttattagtgttgatctataaaaggtaaaagaacgagacctctacggttgtggccttgtgggttcacaatcagcagttccaacaccaaggactagtttgataattccatttttccaaaggattttcatttttcaagggaaattcattcatttttccttaggaaaacgggaatcccttagaaaaatatagtaactttttttgggtgccgtagaagtattgttttcatcagtatagaaccctatgttgcaataaaattgttccttaaagataaaaaaaaaaaaaaaaaaaagaaaaaaaaaaaaaaaaaaaaattttcagcggtagttatgacgagggaaaagaggtgatagcgctttcctcttcttttctcacgaattgcgatcctactcgaaggagaataaagaaggaagcaagcgtttttgttgtctggtatatatactttctatgtaggagtagatagcaagtgactggatggggccgggcaaggacgttacgttgctaagcctaagagcatctccaacaatgtctcaaactaatgtctcaaatcgaaatatagggctctacacagg

SEQ ID NO: 6921 - DNA, 848 bp, Zea mays
  misc_feature (798)..(798): n is a, c, g, or t
  misc_feature (832)..(832): n is a, c, g, or t
gaagcttctttggtacttgccgatccatgtgatgatcaagaaatgattgcacgagaccattacctagaacatcctaatcgaaaattacggcttaaggcatatttgccacttggagttcgtggtgtttttgatggtgtaattgaaaatatgcacttgcattggaagcacagggaagttgttaaactaatttcaaagcagaagaccttgtcattcgttgaagagacggcacggcttcttgcatatgagagtggtggtatactagttgcaattgaaagagttccaaagggttatgcactcattttttaccgtgggaagaactataggagacctattaacataaggccaagaaacctcttaacaaaagctaaggcattgaagcgtgcggttgctatgcaacgccatgaggcccttagtcagcatatagatcaactggaaagcaatataaagcagatgaagttggatttgggtattgaggactatgaggaacaagatgaggatagctcagattcagaaaatgaatatgacaacgcagtcacctctgttagctatgatgaggatcaagacgattttgacgaatcagctgatgaagatgaatatgatgattacgacgatgaagatgacgagattgacagctagtggtttggaattgtttcttgtgatgtgccgctctgaattagtgattctctggacgttgtacttctgtctctgggacatttcgtggtacgagaaaacaaagttgcttcttgtgttcactagtccttttctattagttaacctcaagggctcaaggtttagttnaaaaaaaaaaaaaaaaaaaaaaaaaaaaaaaaangaaaaaaaaaaaaaaa

SEQ ID NO: 6922 - DNA, 1496 bp, Zea mays
agcccggctcctttctctacgaaggatggtacggcaccagctggtgattccagagcgagcagtgcatctatgaagatcatcggacaagtgtccaaacccgcgccgaaacgaagagccaagtcccctatccccaagcgcgtcatctcggatgtgtttaaggaggcgaaagcagccaccaagaggttctccagcccgcagcggcagaggaagcccacatctccacggtcactagatgacagccctccattcggctttgcttcgctaagaacaccaagcaagctgaagattaatagcagaacctcctcatggccgagaaggaacctcgacagtgggctggcgaaagttgctgcactggagatccttgagaggtggacggtcgatcgctctgagttgctcattggacataggtttgcatccggggcttatagccgattgttccatgggatctacaaggagcaacctgttgctgtaaagtttatcagacagcctgacgatggtgaggatgacgaattgtctgctaagcttgagaagcagttcacttccgaggttaccattctggcaaggctccaacatcgtaatgtcattaagcttgttggggcctgtaattgcccgccagtattctgtgtaatcactgagtttctgtctgggggttctttgagggctttcttgcgaaagctggagcgcaaagctcttcctttggagaaggtcatttccatcgctttggatatcgcccgcggcctggaatatattcacctccaggggatcgtacaccgtgacgtcaaacccgagaacatcttatttgatggagaattctgtgctaaagttgtcgattttggagtggcgtgtgaagaaacatactgcaatttgttaggggatgatccaggtacttatagatggatggcaccagagatgtacaagcacaagccctatggccggaaagttgatgtgtatagctttgggcttctcttgtgggaattggtcaccggttcactcccttatgaagatatgactccgcttcaggcagctttcgccgttgttaataagaacttgaggccggtcattccattgagctgcccagcggcgctgaagcttctgattgagcagtgttggtcctggcaaccagaaaagaggcccgactttcagcagatagtttcaatcctcgaagatctcaagacagttcttgaaacagacggaacactccacaaggtcccaagctcgatctgccaggccttggaatccaatgatcagaacaagaagaaggccggtaactggatccagaggctgtcatacgctcaacctgatttctccgggcctccacccccaaagttactgtagctacgcgtcttcttgttcttggtagcttgtttatccggttggtagcaactgtgtaaattgaacctttcttgtttcttgttgagagaccacagatttcgtcatggtatatactcggacaaagtacatacatcaattcttttttcggtgaccttaacaacttc

SEQ ID NO: 6923 - DNA, 1005 bp, Zea mays
  misc_feature (995)..(995): n is a, c, g, or t
tggggccccccgggcccgcccgggattgattcgctgctcttgcttggcggctgaggggctctgatcggcgcgtcgggttggagcagtcgaccttgggagatttcgtgtcgctctggaagggatcaaatgcggcgcctacttacttggtggtctggcactggctggagagctctagtgtcagccagtgttcctgctgtcgcctgcatcatctaggtcccctcccttcgttcagctgttcttgcgagttgttaatctaccgtatcgaggaggggaaggggggtccatttggccggaggttttgaggagatggacgacgaggactactcgtgggtgcggcgcaccaggttctcgcagtctgtcgtcaggtccagctccggcagggagcggtatggcgcgttcatcatcgacccgttcggtcgtggcgccaagctgaggcaggacgggttgggcacgggccccggggtctctagctcggcaaggctgccgatccccaaggcgagaccggcagttgcccggtcggaagggaagctgaagcacgcgtcttcagagggccaattgaacagggtgaggaacagtgatcgctcgtcgcaaggatcaccggcgaagcagagcccgggagagggtcggcctgagcttggacattccacagctgcatggatgtggctgttcgaccatccaaggagagcccagacgctgcgctggatttctctttccactcggacgagcacagccagaggctccagcgagtgtgttccagcccggctcctttctttctgcaggatgcaacagcgacagctgatggtggttccagagtgcgcagtgcatctacgaaggtgtccaagccgccgccgccgaaaccgaagcgaagagccaagtcccctatccccaagcgcgtcatctcggacgtgttcaagggagcgaaagctgccaccaagaggttctccagcccgcagcggcagaggaagcccatgtccccgcggtcaccagacgacagnccctcactcg

SEQ ID NO: 6924 - DNA, 1586 bp, Zea mays
ggcaaggcttctccatctggcaaccggggaccggacgatcaactcatccgcgcgactccgcttcgtcacgcggcgtcgccggcctcctcccgtgcccgtggttcctgcagtgcgcagtgcatctacgaaggtgtccaagccgccgccgaaaccgaagcgaagagccaagtcccctatccccaagcgcgtcatctcggacgtgttcaaggaggcgaaagctgccaccaagaggttctccagcccgcagcggcagaggaagcccatgtccccgcggtcaccagacgacagccctccactcggcttcgcctcgctaagagcaccgagcaagctgaagatcaataccagagcatcctcatggccacgaacaaaccttgacagtggaccggcaagagttgctgcgccggagatccttgagaggtggacggtcgatcgctccgagttgctcatcggccatagatttgcatccggggcctatagccgattgttccacgggatctacaaggaccagcctgttgctgtgaagtttatcaggcagcccgacgatggcgaggacgacgaactgtctgctaagcttgacaagcagttcacttcagaggttacaattctggcaaggctccaacatcgtaatgtcattaagcttgttggggcctgtaattgcccgacggtcttctgtgtcatcaccgagtttctgtccggcggttctctgagggctttcttgcgaaagctggagcgtgaaactcttcctttggagaaggtcatttccatcgctctggatatcgcacgcggcctggaatatattcacctccaagggattgtgcaccgtgacatcaaacccgagaacatcttatttgatggagaattctgcgctaaagtcgtcgattttggagtggcgtgtgaagaaaaatactgcaatttgttaggcgatgatccaggtacttatagatggatggcaccagagatgtacaagcacaagccatatggccggaaggtcgatgtgtatagctttggacttgtcttgtgggaattggtcactggttcactcccttatcaagatatgactccgcttcaggcagcttttgcggttgttaataagaacttgaggccggctattccattgagctgcccagcagcgctgaagcttctgatcgagcaatgttggtcctggcaaccagaaaggaggcctgagttccagcaaatagtttcagtccttgaaaacctcaagacagttcttgaaagagatggaacactcgacaagatcccaagctcgatctgccaggccctggaacccaatgaccagaacaagaagaaggctggcaactggatccagaggctgtcatacgctcaacctgctttctccggacctccacccccaaagttactgtagttacacgtcttcttgttcttagcagcttggtatctggtactccagatagcaagtgtgtaaattgaatctttcttggtttcgctgggagaccagagatttcttcatggtatatactcggatacagtacatacatcatttttgggggcagtgggagcacagtaaatacttgtttggctatcttaaccaattctatcttgatgat

SEQ ID NO: 6925 - DNA, 3557 bp, Zea mays
ctaaatcacagcaaagattatactaataaaccaacataaacaacttttagtacaaaaaagaaaaggttgcatggatgagtagaaggtagggagggaactgcgttatgtattccggacgaacgaaactgcagtgagtaacgacgactaacgattgctctggtcctctaggggccgggcccaaagttgcaatgcaaagctgtctggccggccggtcggtcgcagtgcgcgcagcacctgctggtactactgcgaatgcaaaacgtcggttagctagcatgggcgcgcgtggattacgcgcgtttaataagaaggggaaccgtgccatcaccggagcgattagatgttgtgtccactccgtgcgctgtctcagggacgacagggaatcgacgcgagccacacaggttgaggcgaagcttccttttcctggtctttggatgcgcactgctgggatcctgttgtcctgcatcctgctgcagatcgaatccaccacacgtacggatcctagccaagccacatgcatgatgagagcgcgctccgtcgtcgtcgtcgtcggtgagcagacttgagagggcctgcggatctgtcaatcagataacgacaagaccgaatcaacttgatttgacgtacacatgcagaaacccccataccaatggtctcgaactggccagccgtgtggttggtcctacgaggcctgctacggcagcaccagcaccgcacgttgtgcaccgggccggtttctcagccccgcgtagaaatgtggtgggcttttactggcttcccattttttacgccagcccacaccgtcccaggttccgctccaagtcctgcgaccgcccagctcgaaattgcggcctgccacggtctccatacgaatttgaactcgggacatgggtacatgacgcatcctatccttgtcggactaacttaggagtgttatctctccgtctgcgagtttcatcgtgacaaaaaaaatatcacaaaaaagaacttatccacatttttgccatttcagaaaaagatcaattaggctatctccattaaatcccatattttaattttctatttcaaacttcacccatcgaagcagtaatttggctataggcaaattttagtctttccggtacaacaagatgactacgccgacacgaaaaattcgaggtaacccgaacgccattcggaaattcctactttacggtcgtacttttttgattccgtacttgtgtctttcacggacgggcaaagtccgaaagggacgcccatttccgagcagtctgcgcgtgccggcgtgcgtcagtctccgcgaccgcccgtgagccgtgatctgacgaggaggcgcacctgcttcgcccgcgctgcgacgactgacgactgacgaggcgtgcggcgcgcgtgaggaggaaggcttctccatctggcaaccggcggcaggaggacgatcaactccgcgactccacttcctcacgcggcgtgtcctctccccggtgctcatccgtctctgtcatcctgctcccatgctttttttttagttcctcgcacggttcacgcgcttggcgttctgttccgtagccgtggtgatgattgccgttgttgattgggagcagctgcgattcggatttggattcggatttgatccggtccgatttgacgtgggtatgggttggttgctgcttcgtcagagagggtgtgcttgtcgcggcgcggaacgagcttccttccagtcccatgcgggccggtagccgccagcagagctcgcgtctgcctgggactgggagcgacgtctcgctcgctttcccccctttcctgtaccctgtgtgatgtgaggaatgacggtctccgcactcatggtcctccccggtcgcggtcgccctccacggttgctcacccttgtacggccctttggttggtccacactttttctccgccccccccaaaccacatcgattattgcgttgagcgcttagactcttgttgtctttgtttttgtggtcggcgagcatggtgagcagctcgcggtgggaaatcgccgggggggtcttttaacgctgatcgcggcgtcgtcagactcttgttgtctttgtttttgtggtcggcgagcatggaggaggcggaggcggctcacgggctctgattggcggatggcgcgtcggatcggagcagtcgagcttcggggatttcctgtccctctggaagggatgaaatgcggcgactacctggtgaactgggtggagctctagtgccagccagtgttcctgctgacgcctgcctcatctagtccccccttcgttcagttcttgtggcgagttgttaatccaccgtgtccgggatccgtttggcctggggttttgaggagatggacgacgaggactactcgtgggtgcggcgcaccaggttctcgcagtccatcgtcagatccagctctggcagggagcagtatggcgcgttcatcgagcagttcagccgtggcgccgagctgaggcagaatgggttgggcacagggtacaggaaccctcgccagagtgtacagcccttggcgaagggatccggggtctccaactctgcaaggctgccgattcccaaggcgaagtcagcagttgcccagtcggaacggaagctgaagcatgcgtcttccgaaggccaattgaacagagacggtgatcgcccgttgcaagaatcatcggcgaagcagagccggaaaggggccgtcggcctcagtctggacattccgcagctgcatgtggttcggccatccaaggagagcccagacgcgctggatttctctttccactcggacgagcacagccagaggctccagagagtgtgttccagcccggctcctttctctacgaaggatgctacggcaccagctggtgattccagagcgagcagtgcatctatgaagatcatcggacaagtgtccaaacccgcgccgaaacgaagagccaagtcccctatccccaagcgcgtcatctcggatgtgtttaaggaggcgaaagcagccaccaagaggttctccagcccgcagcggcagaggaagcccacatccccacggtcactagatgacagccctccattcggctttgcttcgctaagaacaccaagcaagctgaagattaatagcagaacctcctcatggccgagaaggaacctcgacagtgggctggcgaaagttgctgcactggagatccttgagaggtggacggtcgatcgctctgagttgctcattggacataggtttgcatccggggcttatagccgattggtccatgggatctacaaggagcaacctgttgctgtaaagtttatcagacagcctgacgatggtgaggatgacgaattgtctgctaagcttgagaagcagttcacttccgaggttaccattctggcaaggctccaacatcgtaatgtcattaaggtaaccatgtgaactttcatgtaacagtttgtaacactctgtccattcctggacctgcgttaattacttatggcagctctctaggatcatatatcgtccctatagaccaacacgagtcttttgtgcacactttatcctcactcat

SEQ ID NO: 6926 - DNA, 1527 bp, Zea mays
ggtacctcgccggccgggccgatgacgtcgctactcttccgggatggaccaataacattttatatctggacgccccttatcgccctcgttatttacatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatgcagggttggtggcaaggaaaacttcttccactgtgtgaagtgtgggtcctgctattctgttatactccgtgataaccatcagtgtgtggagaactcaatgaggcagaattgcccaatctgttatgagtatctatttgactcattacaaggaacaagagttctgaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacaacatcgcgccctgcagatttatccggaagcagctcaccttcaacagactcatccgacaacaacatatagagaagaaaccattgacagagccaatatgattgaagaaccggaggaggaaacattgtttcggggcgtgcgtgcttgccaaacttgaagactcccagccgtttattggccctcatcttgtctagattcagttcattccatgagtctttgctgttgtggcaacttccagcttgcgcatcgctgggtcaacaacccacatggccggcgtagctgtccctttgaatcttgttcgcagccgtgattttatcactgtggatgaaacgtaatcacatacttactgtaatctactatggttgaagatgtgtgcccccctgactcatgccttgtgtgcttgtgctgaactgtttatgaattcccatgctgttccgtaacactatattgccatttgtgtttccttatctgtcaagtaccgccaagtgtgcggtgaaattgtaattatttgcaatgaatagaatcttatatctatacctaataataaagactcaacatttctaccaagttacccacac

SEQ ID NO: 6927 - DNA, 2784 bp, Zea mays
  misc_feature (2580)..(2580): n is a, c, g, or t
tgttttcctttaaatggtgaacaaatcagggttttggaaagataaatggttaggcattcaactcctcatggtgcaatatccatccttataccaaattgtccgacacaaaagtgtcataatggctagcgtctttagttcaataccactgaatataatatttatgtagagctttggtgggacatgacttagttttatggtataaccttattcattgtcttgtacatgttcgattaaatactgagaaggattactttagttagaatttaactatgtcggggcaatttactattcaatcgatgtatgggactatgattaacaatgtttatgtcttccatcacaaagttctgtggaaattaaaattgtcgttgaagataaaaaaatttgtatggtacctacttcgtagagtgatacttactaaagacaactttgctaaacagaattgacatgataataaaaaaattttgtgtttcgtgatagtgatgaaacgattcaacacttattcttccaatgtcattttgccaacaatatgtggcgactcattttctggtgttttgggttgagaccacctcggtcaatctgccatgttttcgggaattggcttctgggtgtgaactctagaactagaaaactgataattacatgtatgtcagttctgtgctaggctatctagattagtatgaatgatttagtttttggtaatgttcctttgctaactttcttacatgtgctctttaagggaacatgttggcttaggctctcgatcatgttcaagaaaagccaatcggaaagagaaaaaataatggaaagagaaagataatggcagcctttcatcgattagaaatggtgggaatggggatttacgcccgtagtggatgtaggtttataaataggattgtgctgtaaccaaactatctatccttttgtttcgccgttgttagtatgggaggtttgttcctcttcttgtggcagatagttgctggtcttgtaataatttagccctatcctcctaacgaggtcaaagacggatataattatccattatctaaaaaatcaaaactgaactggaaatgactcgagagaagcagatgcaggagccgtcttgctgtccaatttttttcctcgaacaaacgctcgtgcttgtgcatgtgcaccatcaatcttctcaccaagagaaaaatatctggaaagattccttaagtaaggtggtcatttcactgtcctaaatcagaaatgtgagcttgataaagtccctttgaaatgcaggaatttcagagaaattttataaaatcagttgttttcgcataaaaacgtaggaatacgatttcagggaattttttcccgtttactatgttttttcttgtaaataaattaatttctataagattcatgtatgcttcctcagttcctctgaaattcccgagggcctgaatcttattgtaatgaagtacgtgtcaggcgtccttagaaatgaagtacgttttccttatgagaaagcgtatcaacgaggggagtgccttgcccctcgtcagcggattagatagggggcaggcagcagaggttcccggctccttcgcggcgctgcttatctcccgctcccggctcccctcctcccccgcgccgcgatgaacacagccatggccaccacctccttatccctccaaggccgcccatcccacgctcccactaggaagctctcctccccgttcctcggagcccccgcgtcctttctccggccgctggctcccacgcccgccgccggcccctcctcgcggcggacgcttgccgtcagggccatggcgcctcccaagccgggaggcaagcccaagaaagtggtctctaggcccgtggcgtccgcattcctttcctggctcatcagggatgacgtttcttgcgcctaacctcttccttgtcctgcagtggtgggccttataaagctggcgctcgaggccggcaaggcgacgccggcgccgcccgtcggcccggcgctcggtgccaagggagtcaacatcatggcgttctgcaaggagtacaatgccaagacggccgacaagcccggctacatcatccccgtcgagatcaccgtgtttgatgtgagtgagactaatgctgtccgtcctactttgggcagaagcgagaatcgattgctgttatggttgtcataatgctggttactttgcttcgcattttgcaggataagagctttaccttcgtcttgaagacccctccggcttcagtcctgctactcaaggctgcaggtgcacaccctgtacattagcttggatctattcttcagagttttctgacgcattcatcaaattacccaatgcatctataaaagaaacacaacatgaaggaaatgaataccctccagcaatccaatattgtttttggcatatgttggttcttcacattggattagccatccaatgtctaactctgctagatattattaagttcagacaatccatattgtttttggcatatgttggtataacagaaacgaatgcgattgcagctcaatctagtttagagcagtcgacagttgcgcaatgactcagtatgggtgtaacagtaacttgntatttctatttcagctctagcatcccatttccttttctcataaacttctgcaacaattcaaatattttggatatacagcgtacataaataagtttcttttagagaagaggaaatttattcgagtctaagttatatttgttatagttagaggtttctaatcctggttaatacaattaaataaaataattgttgtttatttctatt

SEQ ID NO: 6928 - DNA, 979 bp, Zea mays
gtatcaacgaggggagtgccttgcccctcgtcagcggattagatagggggcaggcagcagaggttcccggctccttcgcggcgctgcttatctcccgctcccggctcccctcctcccccgcgccgcgatgaacacagccatggccaccacctccttatccctccaaggccgcccatcccacgctcccactaggaagctctcctccccgttcctcggagcccccgcgtcctttctccggccgctggctcccacgcccgccgccggcccctcctcgcggcggacgcttgccgtcagggccatggcgcctcccaagccgggaggcaagcccaagaaagtggtgggccttataaagctggcgctcgaggccggcaaggcgacgccggcgccgcccgtcggcccggcgctcggtgccaagggagtcaacatcatggcgttctgcaaggagtacaatgccaagacggccgacaagcccggctacatcatccccgtcgagatcaccgtgtttgatgataagagctttaccttcgtcttgaagacccctccggcttcagtcctgctactcaaggctgcaggtgtcgaaaaaggttcaaaagagccacaacggcagaaggtgggaaaggtaacagtggatcaagtgcgtgcaatagctcaagagaagttgccggacttgaactgcaagagcatcgactctgctatgaggatcatcgctggcaccgccgctaacatgggcatcgatgttgatcctccaatccttgttaagaaggaaaaggtcctcttgtagtttgtttttgctggcaccaccagtgcccattttgagattatatgtgaaaggaccaagatgatcaaaagagtgaattgagtttctctaaaatatcttgtataaattaatgcctattaatgagtccatttcaccctttgtatcaaaaaaaaaaaaaaaaaaagcaccacgcaaaaaaagggcggccgccaccgcggtgga

SEQ ID NO: 6929 - DNA, 1329 bp, Zea mays
ttttttttttttttgtggcaagcaagcaagcaaacaaacacatcgcacaagcacaatacacaagtcgtagtttatgcaacgcaacgcaacgcaacgcagtgtactgacgtccccgtcccgcgcctctgcatccccgctctgcaaaacagacagattcccgcagaacagacagggcaaacggatcggctcagcttctgcgtgccttcactacacaacagctagcttacactctacaggctacagcagcacagctaaaccaagacgatacatagaatacagcaccacatcgtggggagagagagaggatcaggcacacgcacactggctggcacacaccctaggacactggaggttacagatcaacaaacagatgcagtagtggtggtggtggtggttacttattattggactttgtaaaaacgattagcccgggaagtaagtaaaactcttgcgttgcgtcaaaggatgaggatgaggagggggagtcctcgtggaccggtcaggcgagcagccagaagttgttctgccaccgggtgctcacgaggtagccgcccacgcccttgctccgccgccgcaccgccagcgtcaggcactccgcccggtttatgcactcctccaccagctcctcctcctcgctgctgctcctgctccgcaggaagcagcagaaaggcgagggtttgcgttggctgagcaccagcacggacgcctccagcttcttcacctggctgaggatggtcgacagcttgggcccctggatcacgagcgcctccacctccacctcaggcttgcaggccttgcaaagcgcgccgagggagttggcgagcgcggaggcgtcctcctccccagcaccgcggccgccgccgccgctcccgctgtgcggcggcaggacgtggagcagggtgaggaagtcgcccctgttggcgacgtgggtgagcgcccacatcatggcgtgcttggcgccggagctctggtccaccaccaccaccacccgcttccgcgacgccgccgcggcctcctcagtcctgcagaacccgccgccgcggcggtgtccccgcgccctgcccttcttcctggaccagcgccgcgacccacgcctgctgccggtgccggtgccgcagtcccactcccgctgcagcagctggtgcggcgcgctgccgccgtcgctcgagctcagctgccccaggaagtgctcgcagctgcccccgctgctccccatcgatccactcccgctaccgccgcgaggtgcgtgtgtgcgcgcggcttggtgcgtgcgcgctctgtggtggtgtcgactgtcgagagctgggcttggctttggtgcgcgtgtgc

SEQ ID NO: 6930 - DNA, 1258 bp, Zea mays
  misc_feature (1108)..(1108): n is a, c, g, or t
ttttttttttttttttctagcacaatacacaagtcgtagtttatgcaacgcaacgcagtgtactgacgtccccgtcccgcgcctctgcatccccgctctgcaaaacagacagattcccgcagaacagacaggacaaacggatcggctcagcttctgcgtgccttcactacacaacagctagcttacactctacaggctacagcagcacagctaaaccaagacgatacatagaatacagcaccacatcgtggggagagagagaggatcaggcacacgcacactggctggcacacaccctaggacactggaggttacagatcaacaaacagatgcagtagttgtggtggtggtggtggttacttattattggacttgtaaaaacgcttagcccgggcagtaagtaaaactcttgcgttgcgtcaaaggatgaggatgagggggaatcctcgtggaccgatcaggattcaggcgagcagccagaagttcttctgccaccgggtgctgacgaggtagccgcccacgcccttgctccgacgccgcaccgccagcgtcaggcactccgcccggtttatgcactcctccaccagctcctcctcctcgctgctgctcctgctccgcaggaagcagcagaaaggcgagggtttgcgttggctgagcaccagcacggacgcctccagcttcttcacctggctgaggatggtcgacagcttgggcccctggatcacgagcgcctccacctccacctcaggcttgcaggccttgcaaagcgcgccgagggagttggcgagcgcggaggcgtcctcctccccagcaccgcggccgccgccgccgctcccgctgtgcggcggcaggacgtggagcagggtgaggaagtcgcccctgttggcgacgtgggtgagcgcccacatcatggcgtgcttggcgccggagctctggtccaccaccaccaccacccgcttccgcgcggcctcctccgtcctgcagaacccgccgccgcggcggtgtccccgcgccctgcccttcttcctggaccagcgccgcgacccgcgcctgctgccggtgccgcagtcccactcccgctgcagcagctggtgcggcgcgctgccgnccgtcgctcgagctcagctgccccaggaagtgctcgcagctgcccccgctgctccccatcgatccactcccgctaccgccgcgaggtgcgtgcgcgctctgtggtggtgtcgagtgtcgagagctgggcttggctttggtgcgcgtgtgc

SEQ ID NO: 6931 - DNA, 1114 bp, Zea mays
cgacatcaaatcaagttcgtttgcttccagcgttctggagagcatattaggggcatcaggcaacgttgagagaaacaggatgagagacaactggcgaggaagaagaacaggacacacggacgcttttttttttttttttggcggaagaaacgactttcatatatagaggactatcccgtccctccgacctgtaggcgatcccaattcccaaccctcttgtccctgaaccaaacgccatttcccagcccgttccgttccatcccatgctttcagactcaaaccaaacgccttccaaagaagggggggaatatggttgtggatcacgcgaggagccagaagttcttctgccaccgggtgctgacgaggtagccgccgacgcccttgctttgccgccgcactgccagcgtcaggcactccgcccggtcgatgcactcctccacgagctcctcgctgctgctccgcgggaagcagcagaaaggcgaggggctgcgttggctcagcaccagcacggacgcctccagcttcttcacctggctgaggatggtcggcagcttgggcccctggatcacaggcgcctccacctcgacctcaggcttgcaggccttgcaaagcgcgccgagggagttggcgagcgcggaggcgtcctccgcagcaccgcggctgctgtggccgctctccggcggcaggacgtggagcagggtgaggaagtcgcccttgttggccacgtgggtgagcgcccacaacatggcgtgcttggcgccggagctctggtccaccaccaccattacccgcttccgccccggcgcagcctcctccgccctgcagaacccgccgccgcggcggcggtgtccccgcgccccggtcttcttccgcgacccgcgcctgctgccgctgccggtgacgccgccgcactcccactctcgctgcagcagatggtgcggcgcgctgccgccgtcgctcgaactcagctgccgcaggaagtgctcgctgctgcccccgctgctccccatcggtccactactccactcccgcagctcggtgtgcgtgagcgtggctgcgcgctgtggtggtgtcgagtgctgggcttgggcgcttggctttggtgcgcgtgtgt

SEQ ID NO: 6932 - DNA, 1312 bp, Zea mays
aaatcgaaactctgctgcatcttcttccactctccagtctccactagcatcagtcgccgccgcctatcctcgagcaccatttccatcaacagcatccgcctctggcaagctagcgacagcaactcatggcactccgcgcgctcgacaacacgatgcccgccgccgtcgaggagcggcccaagaaggtggctaaggtgggcgtccccgccgccgccgccaaggccgccgcctcccccgggagtggcggcaagaagaagaaggggaacgacgagaactcggcgccaagggccacggccgcggcggcggagcaggccgtggagtacatctcgtcggaggagctggaggcggcggccagccccaaggccaaggccgcggggctggtcgcggacctggactccaaggactgggtcaggacctgcgaggcgctcaacgacgcgcgccgcctcgcgatccaccaccccgcgctgctgaacccgatcctggagaaggtggtgctggcggtcgtgaagacgatgaagagcccccgcagcgcggtgctcaagacgtccatcatggcctgcgccgacatcttcagctccttcggcaacctgctcgcctccgtctccgacgacgccttcgacaagctgctgctccagctcctgctgaaggcgtcccaggacaagcggttcgtgtgcgaggaggccgagaaggcgacgcgcgcgatggcggcgtcgatgccgccgctgccgctgctgaagaagctcaaggcgtacgtccaccacgccaacctcagggtcagggctaaggccgccgtcgccatctcccactgcgccgcccggatggacatcggcgcgatgaaggagttcgggatgtcggcgctgctgcagctggcggcggagctgctgaacgaccggctgccggaggcgagggaggccgcccgcggcgtggtggcgtcgacgcacgcggccttcgccaaggaggccgccgcgagcggccaggaggacgacgcggccgcgtcctgggagagcctctgcgcgctcagcctcccgcccatctccgcgcaggccgtcgccaagatcgctgccgccgccgcctcctcgcagtagccactgcacgcgtgcggacgtgcgccgctggcgttgattttgggggtcgtctggttcggttcagaagtagcgctcgtgagtcttcagacagagctcgtttgtcgccgccgccgccgagtctgtttgtttgttctttctactccatgctatctcgcatggttagtgttctgtttatggcttcgtcaagtaataacatagtatcaattaacgaaaaaaaaaaaaaaaaa

SEQ ID NO: 6933 - DNA, 540 bp, Zea mays
agcaactctgctgcatcttcttccactctccagtctccactagcatcagtcgccgccgcctatcctcgagcaccatttccatcaacagcatccgcctctggcaagctagcgacagcaactcatggcactccgcgcgctcgacaacacgatgcccgccgccgtcgaggagcggcccaagaaggtggctaaggtgggcgtccccgccgccgccgccaaggccgccgcctccccctcccccgggagtggcggcaagaagaagaaggggaacgacgagaactcggcgccaagggccacggccgcggcggcggagcaggcggtggagtacatctcgtcggaggagctggtcgcggacctggactccaaggactgggtcaggacctgcgaggcgctcaacgacgcgcgccgcctcgcgatccaccaccccgcgctgctgaacccgatcctggagaaggtggtgctggcggtcgtgaagacgatgaagagcccccgcagcgcggtgctcaagacgtccatcatggcctgcgccgacatcttcagttc

SEQ ID NO: 6934 - DNA, 2212 bp, Zea mays
gacggggatagaatattccttttagagtagaaatttagagtagtatgagtgcagatagcctaaggtcaaatctaggggtagacattagagatagcctaactgaggccactccctctctttgtacataagttataggagacctcgaggtttgatacattactgaaaaatgaaaatgcaccgcaacacagataactcttttcaaaagtttaaacttttgtgactgttcatctttttttctcgagagaaattttctataagaggaacggaggtccgataagtttttcattgagcggatctttggccactgtgtttttgtcttcaatttttcagcggttcagccacattagacatgaattcaaatacttgcatgcctgcagaactcatgggccataactcaatcatgtacttttgcacgtgtttccttgtgttttaaaatcgtttgttttaccagaatttatggcaacggtagaaagacagcagcagcgtcacaacgttcaccgagtttgaaacatttatagccgttagacacagccgcccattaattccccaccctcggcgtttaaaatttgcaactctgctgcatcttcttccactctccagtctccactagcatcagtcgccgccgcctatcctcgagcaccatttccatcaacagcatccgcctctggcaagctagcgacagcaactcatggcactccgcgcgctcgacaacacgatgcccgccgccgtcgaggagcggcccaagaaggtggctaaggtgggcgtccccgccgccgccgccaaggccgccgcctcccccgggagtggcggcaagaagaagaaggggaacgacgagaactcggcgccaagggccacggccgcggcggcggagcaggccgtggagtacatctcgtcggaggagctggaggcggcggccagccccaaggccaaggccgcggggctggtcgcggacctggactccaaggactgggtcaggacctgcgaggcgctcaacgacgcgcgccgcctcgcgatccaccaccccgcgctgctgaacccgatcctgtgagtttggtttggtgctgttacattacatctcgtccgattttcagcgagttgcccggtttcattcgcgtggctgatccgtccgtcggcagggagaaggtggtgctggcggttgtgaagacgatgaagagcccccgcagcgcggtgctcaagacgtccatcatggcctgcgccgacatcttcagctccttcggcaacctgctcgcctccgtctccgacgacgccttcgacaagctggtacgtgccatgtcgcgctcgcgctcctcgggggacagttacacagatcccgagctcgcagctgctgagtcggtctcgtctccgttggtactggcagctgctccagctcctgctgaaggcgtcccaggacaagcggttcgtgtgcgaggaggccgagaaggcgacgcgcgcgatggcggcgtcgatgccgccgctgccgctgctgaagaagctcaaggcgtacgtccaccacgccaacctcagggtcagggctaaggccgccgtcgccatctcccactgcgccgcccggatggtacggcacgccacgccacgccacgcccaggaaggcaggaacagctgctcatcagtctgcccatttcagagactcagattctcctttgttgctggcgcgcaggacatcggcgcgatgaaggagttcgggatgtcggcgctgctgcagccggccgtggagctgctgaacgaccggctgccggaggcgagggaggccgcccgcggcgtggtggcgtcgacgcacgcggccttcgtcaaggaggccgccgcgagcggccaggaggacgacgctgccgcgtcctgggagagcctctgcgcgctgagcctcccgcccatctccgcgcaggccgtcgccaagatcgctgccgccgccgccgccgcctcctcgcagtagccacggcacgcgtgcggacgtgcgccgctggcgttgtttttgggggtcgtctggttcggttcagaagtagcgctcgtgagtcttcagacagagctcgtttgtcgccgccgccgcgagtctgtttgtttgttctttctactccatgctatctcgcatggttagtgttctgtttatggcttcgtcaagtaataacatatcatctatcaacatagtttactagtgtggtgggtgtgaaaagcaaaatcttttaaaaaaaaaagagagaga

SEQ ID NO: 6935 - DNA, 2785 bp, Zea mays
gacctgttggagtcagccaaagtgctgctgcacttcaagagtcagccaaaagagctgcttcactctgggtgttgttctctagggttttctgtagccgacctaggccacgcaaagtgcaaaacccagagccatcgctgccgcctcggtcgcgattcctaaaggcggcgatggccatgacgcggcgttctgcttcccatctcctatccgccttccggcccttctccctcctcctccagccgcacctcgtcgactcttcgccggcggccgcgtcggcgaggcgggcgatgtcgtcggcgtcggccctgcgtgcacgggacgagaaggatgtggcgcggtggcgggagtcgatgggccggatgcggaatatcggtatctccgcgcacatcgactccgggaagacgacgctcacagagcgagtcctctactacacgggtcggatccacgagattcacgaggtgcgcggccgtgacggcgtcggtgctaagatggactccatggacctagagcgcgaaaaggggatcaccattcagtctgctgccacctactgcacctggaaggattaccagattaatattattgatactccaggtcacgtggatttcaccattgaggttgaaagggcactccgtgttcttgatggagctatacttgtactatgtagtgttggtggagtacaaagtcagtcgataactgttgatcggcaaatgagaagatatgaaatcccaagggttgcttttattaacaagttggaccgtatgggagctgatccatggaaggttcttaaccaggcgcgatccaagctccgtcaccacaatgcagctgtacaagtacccataggattagaagaggagtttgagggccttgttgaccttgtagaaatgaaggcttataagttcgagggatctagtggccagaatgtaactgcttctgatgttccattgaatatggaggatttagtcactgagaagcgtcgtgaacttattgaagttgtttctgaagtagatgaccagcttgctgaagcttttctcaatgatgagccaataacagctaatcagcttaaggcggctattcgaagagctacagtggcacggaagttcataccagtatacatgggaagtgcattcaaaaataagggtgttcaaccacttcttgatggcgtgctggattatctaccgtgcccgttggaggtttataactacgcccttgatcaaaacaaatctgaagagaaggtattattagctggaactccagctgaaccacttgtggcattagcatttaagctagaggaaggtcgttttggtcagctgacctatctaagaatctatgacggcgttatacggaagggtgacttcatatacaatgtcaatacagggaagaaaatcaaagttcctcgcttggtaaggatgcactctaatgagatggaggatattcaagaagcatatgctggccaaattgttgctgtttttggtgttgattgtgcatcaggcgatacatttacggatggaacagtgaaatatactatgacttcaatgaatgtccctgaacctgtgatgtccttggcagtttcacctatatctaaagactctggaggacagttttcaaaagctctgaatcgcttccaaaaggaggatcctactttccgtgtgggtttggatgctgagagtggccagacaattatttccgggatgggtgagctgcatctggatatatacgttgaacgtattaagagagagtacaaggtggatgcaaaggtaggaaaacctcgtgttaacttcagggaaacaattacccagcgtgctgaatttgattatttgcacaaaaagcaatctggcggtcaaggtcagtatggacgagtttgtgggtacattgagcctctaccttcaggttctgatggtaaattcgaatttgataacatgattattggacaagcaattccttcaaactttataccagcaatagagaagggttttaaggaagcttgcaattcaggctcgttgattggtcatcctgttgaaaatttaagaattgtattgactgatggggcttcacatcaggtggattccagtgaacttgcttttaagctagctgctatctatgcttttcgacagtgctacacttctgccaaacctgtaatattagaacctgtgatgaaggtggaactcaaatttccaactgagtttcagggcacagtaactggtgatatgaacaagagaaaagggatcattgttggaaatgagcaggaaggtgacgacaccattgtagtttgccatgttccgctaaacaatatgtttggatatgcaacagctattcgatcagcgactcaggggaaaggtgaatttacgatggagtacctggagcataatgttgtatcgcaggatgtgcagatgcaactagtgacctcataccaggcggccaagggcacagagtgattcttctttttacagaagaacaaattttgtttgcgaacttttagtggcatcgacttcccggtcctctggacacgtcacaaatagtaggcgataattcaaactgtggtttcttagtgaaaatacaactgtgccgcaataattagcattcccacagtagaattgtacaaaacattatctagcaaatgcctgaagtttagtttgtaatgtcttggtaatgagaacatcttgtgcaatttctccccaaaaagaaacatctaatgcaaaactgcgaaggcatggatgttttggttactggtaatctttatttctcctgcgcccttttgggtttctgttcaaactgtttgtttttttatatt

SEQ ID NO: 6936 - DNA, 1284 bp, Zea mays
tcgaggcttgccgggaagactctggaggcaattttaaaagctctgaatcgcttccaaaggaggatcctactttccgtgtgggtttggatgctgagagtggccagggatgggtgagctgcatctggatatatacgttgaacgtattaagagagagtacaaggtggatgcaaaggtaggaaaacctcgtgttaacttcagggaaacaatcacccagcgtgctgaatttgattatttgcacaaaaagcaatctggcggtcaaggtcagtatggacgagtttgtgggtacattgagcctctaccttcaggttctgatggtaaattcgaatttgataacatgattattggacaagcaattccttcaaactttataccagcaatagagaagggttttagggaagcttgcaattcaggctcgttgattggtcatcctccggaaaatgtaagaattgtattgactgatggggcttcacatcaggtggattccagtgaacttgcttttaagctagctgctatctatgcttttcgacagtgctacacttctgccaaacctgtaatattagaacctgtgatgaaggtggaactcaaatttccaactgagtttcagggcacagtaactggtgatatgaacaagagaaaagggatcattgttggaaatgagcaggaaggtgacgacaccattgtagtttgccatgttccgctaaacaatatgtttggatatgcaacagctattcgatcagcgactcaggggaaaggtgaatttacgatggagtacctggagcataatgttgtatcgcaggatgtgcagatgcaactagtgacctcgtaccaggcggccaagggcacagagtgattcttctttttacagaagaacaaattttgtttgcgaacttttagggcttgttcggttagctctcaatccatgtggattgagcgggattggatgggtttgaatcccaaacagctcaaactttttcacaattttttccaatcccatccaatccatgtgtattgggaataaccgaacaagcccttagtggcatcgacttcccggtcctctggacacgtcacaaatagtaggcgataattcaaactgtggtttcttagtgaaaatacaactatgccgcaataattagcattcccccagtagaattgtacaaaacattatctagcaaatgcctgaagtttagtttgtaatgtcttggtaatgagaacatcttgtgcaatttctcctcaaaaagaaatatctactgctcccctgtgagggccgggatgttttggttaaaa

SEQ ID NO: 6937 - DNA, 1163 bp, Zea mays
  misc_feature (1094)..(1094): n is a, c, g, or t
agcgccacgggcacgccaagccagttcacgagcccggccaagaacccaagcacggccaagccaaaccgcccttctcctcctcctggctcctcgtgcctcgcttgactcctcgcgccaatttcgggaaacaggccatgccgggagacgggggagcagctggaagcgcgaggtgggtttgcgcggtcctttcggtgttcccgcttctagcggcggcggcggcggcggcggcccagggaaggtaccgcgcggtgttcagtttcggggactcgctggtggacgccggcaacctggtcacggagggcatcccggactacctcgccaccgcgcgcccgccctacggccagacctacttcggctaccccaccggcaggtgctccgacggccgcctcgtcgtcgatttcatcgcgcaggagttgggcctcccgctgccgccgccgtccaaggccaagaacgccagcttcgcgcagggcgccaacttcgccatcaccggcgccaccgcgctcaacaccgacttcttccggaagcgagggctcggcagcaccgtctggaactccggctccctccgcacgcaaatccagtggctgcgagacctcaagccatcgctctgcagctccgcgcaaggcacacgatgcaaggagttcttcgccgagtgcctgttcgtcgtaggcgaattcggtgggaacgactacaacgccccgctgttcgccggcaaggacctcagggaggcatacaagctgacgtcccacgtgatccgagccatctccgatggagtcgaacaactgatcgccgagggagcaaaggatttgatcgtgcccggtgtgatgccatcagggtgctttccggtctacctgaccatgtacgctgaccccaaggaagggcatggctcgcgcaccggctgcctcaagcggttcaacactttctcttgggtgcacaatgcgatgctgaagcgcgcgctcgtgaagctccgagcgaagcaccctggcgcgaggatcatctatggcgattacttcacgccaatcatccagttcatactccagcccaagaaattcgggttttacaaacaaccaccaagggcatgttgtggcgcgcctggnaggggtccttacaatttcaacctgacagcgaagtgcggtgagcctggtgcctcggcttgcgctgatcct

SEQ ID NO: 6938 - DNA, 1836 bp, Zea mays
gctcggtacccctgctctgctgctgtgtgtgtgctcaagtgcgatgatctctcccgaatcggaggtgaaatatcccagtcatccccgacgcgtctccctcgccatatcccagtcaaccgcattcaatacggccaggccatggccgcagtcaatgcacagctcgcgtccgcgtgttccccgtgtccacgcgtccgtcaggccagctccagcggcagccggcagcagcaccacctccgcgcaccgagagcggcgtccaatcggtcgtccacgcgcagctacgctacggctcggggtggtgggcgctagaactagaagaatccaaactctcccacccgaaccagtgaatgaactccacagtccatagcagtccggctcgtcactcgcagcaggtcgccagtggctgccctgcctgcctggcctacaactacaagagcgagcggacaagcgccagcgccacgggcatgccaagccagttcacgagcccggccaagaacccaagcacggccaagccaaaccgcccttctcctcctcctggctcctcgtgcctcgcttgactcctcgcgccaatttcgggaaacaggccatgccgggagacgggggagcagctggaagcgcgaggtgggtttgcgcggtcctttcggtgttcccgccgccgtccaaggccaagaacgccagcttcgagcagggcgccaacttcgccatcaccggcgccaccgcgctcgacaccgacttcttccggaagcgagggctcggcagcaccgtctggaactccggctccctccgcacgcaaatccagtggctgcgagacctcaagccatcgctctgcagctccgcgcaaggcacacgatgcaaggagttcttcgccgagtgcctgttcgtcgtaagcgaattcggtgggaacgactacaacgccccgctgttcgccggcaaggacctcagggaggcatacaagctgatgccccacgtgatccgagccatctccgatggagtcgaacgccccctcgccgccggggcaaaggatttgatcgtgcccggagtgatgccatcagggtgctttccggtctacctgaccatgtacgctgaccccaaggaagggcatggctcgcgcaccggctgcctcaagcggttcaacactttctcttgggtgcacaatgcgatgctgaagcgcgcgctcgtgaagctccgagcgaagcaccctggcgcgaggatcatctatggcgattacttcacgccaatcatccagttcatactccagcccaagaaattcgggttctacaaacaaccaccaagggcatgttgtggcgcgcctgggaggggcccttacaacttcaacctgacagcgaagtgcggtgagcctggtgcctcggcttgcgctgatcctaagacgcactggagctgggatggtattcacttgacagaagccgcgtatctgcacattgccagaggctggcttcatggaccgttcgcagaccagcctgttgtccaagcatcttgagttgagtacagtacaccccagccgctcctccctgctgttcttgcacctctagagtgagtgtaccacaatagcacacaccgtgcgtgacaccaaactggatccgataaggtaaggtagtagtagttccagtgcagtcgggtaaagagctgagataggtctattaattaaagcttgattcctttcattcaggatggtggtataagtacaatgtaatgcacaaaacaattcatatgagtaccagttagaaatcactatggtggttagcttgctcctactcctgtatctaacttttgtatctatttatatattttttatatatataggacatatcatgtacaacc

SEQ ID NO: 6939 - DNA, 1626 bp, Zea mays
agttcgaaagcctccctccccgttctcccttccttgcctaggcggcaacgcaacacccccccgtccggccttattacatcccgtcccccccgcccggccgggaaccgagacgggacgagaccagcagccggccaccagcccatccgaaccctgctgctcccctctccgggttcgcgtgaggctgtgtgctgctgggaggagaggggaagcggcggcggggcgccatggaggccgagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctctctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcagtggttgtcgtggccgccggtgtcgggatttgcaccgtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctcccttgccgtcttctgcaacatgagccaatacctctgcatcggccggttctcagcgacctcgtttcaggtcctgggccacatgaagaccgtgtgcgtgctgatcctcggctggatcctgtttgactcggccctcaccgtgaagaacatcctcgggatgctgctcgccgtgatgggcatggtggtctacagctgggccgtggaagcggagaagaaggcggcagccccggtcccccggatcaagagcgaaatgctcgacggcgaggacgtacctctcaaggccagggtgagcggcgtgcccgcagtcgacctcgaggacggcgagatgaagagctagctgctgcggctgccgcagctgccgctgattcgttcattcttcttgttcttttgtaactgtgcgcgcgcgatcgctcgatccaaagttgcttgtccgtcagccctcagctatcgacactacactgttatttttggccccttgttggggagagtccagttcctacgtgacgacgaccacccccagttcggcgtagatgaaacacaaactagcagaatgcagattgttaggatttttttttcaggcggcggggtggagccattcattgtcatggtgacaggactcataatagaaatacaggtaacatgtctaaaaaaaaaaaaaaaaggcccgataaggaattatggatccagccggcgatgtattcctt

SEQ ID NO: 6940 - DNA, 1720 bp, Zea mays
ctgattgatggagcggtatgcagtgaagcctatgaaagagtcagacgtcagattgtgttagattttgttgctgcatgcgctgtgtcagcatgccgctatttattcacggctagattacggcactgctagctaaatttcagaacaattattctcccgtcatactcgttcatatagtaggcgcggtcttcctcatgcgacggtagctgccaacaactccattagttaggatgcctagtcactgcaccctatataactatatacatccacgttgaaccgtaccatcaattgacatccaaactatggctctgttcaagtgcatgtgtgtcttcttagtctcgcttctgctcaccctcaccttcaccaacgcccagggtggagcttcacagcggacgctcccgccatttccctgcatcccaggccagcaacgacccccatggctgccaccctgtccgccgccgccagctgagtgctacacatccctatcagggctgaagccatgcgtggacttcctcacccacaccggggtgccaccggcgccacccacgagcgcctgctgcgacggtctcaggtcgctcgtcactgacgcgcccatctgcctgtgtcacgtcgtcaacggtgacatcaacgagcttctgccgacgcccatggtacccgtgcgcatggtggcgctcccccgcttgtgtgctgtccccttcccacgtgccacgctccgccagtgcatcagaggatcatatatctagcaacgatttccaatttttagttccgtatatggtcatgttgttacagtggttgaaacaaatctacacgtattgatttaatttaaattattaaacaggagggcatgtgccacctatgaccccacctccaccagaagcatcaccgccggaatcaccatcgactctaccagcatcatcatcgtcaactctgtcagcagcatcacccaccgacaccaaccagcatcatcaccgtcgtcgactaactccaccagcgacatcaccgctagagtcaccgccaactccaccaacaacatcgccaccggaaccgccgtcgactcaaccaccggagtcaccattgactccaccgccgacactagtgacggcgccaccggaatcaccgtcaaatccatcgtcgacgacagtagctatgccaccggcgactccatccccatcatcttaatcacgacacatattttaaaagtagtagtacagtctagtaaaaatagatatgcattttaggattttagctgataggcgttattgttccgttcgcatcgtatgcagcagtgtgttagctataattagttgtatacctattattactaagttttttttagaagtatctgtaataatatttaagatctttctcatccataaaatatatacaaggacatcactgatgtattattttacaaaaaaaaaataaaaactcttacctaggcggatgcaaaaaccagtacggtttttttagtcaaccagaggatcgtagatcctcatctcaatatattgtgatgccagtaaagcccagttgaacaaagttaggactacagcgaaatagataggcttcggcagcgtatttagtcacctctacgaatcaattgtagacgtagatcttgatctaatatgctctagaaaattatttatcgagacgactgtacgtagagtacctttaaaataagattatttatagagatagctaaaagtatcaatcgtctattcgtcta

SEQ ID NO: 6941 - DNA, 953 bp, Zea mays
cctcgaggccggccggggttgacgtttccggcccccaattcgaaagcctcgcgctccccgttgctcccttccttgcctaggcggcaacgccctcgtgctttataccctagcgtccccgacgccggccgggaaccgagacgggaggagaccagaccagcagcagcccatccgaaccccgcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatccgcagtcatcgtcgtggccgccggtgtcgggatttgtactgtcacggatgtcgaggtcaatgccaaggggttcatctgcgcttgcgtggcagtgttctgcacgtcgcttcaacagatcacaattggctcctttcagaagaagtacaacattggatcatttgagctgctgagcaaaactgcgccaattcaggcactttcactcattatactgggcccctttgtggactactattctaaatgggcggtcattgttgaactaccctttttcaggaggggcaaactttcttcatactgctttcctgctccct

SEQ ID NO: 6942 - DNA, 1506 bp, Zea mays
ccgggaaccgagacgggacgagtccagcagccggccaccagcccatccgaaccctgctgcccccctctccgggttcgcgtgaggctgtgtgctgctgggaggagggagggggaagcggcggcggggcgccatggaggccgagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctctctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcagtggttgtcgtggccgccggtgtcgggatttgcacggtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctccctggccgtcttctgcaacatgagccaatacctatgcatcggccggttctcagcgacctcgtttcaggtcctgggccacatgaagaccgtgtgtgtgctgatcctcggctggatcctgtttgactcggccctcaccgtgaagaacatcctcgggatgctgctcgccgtgatgggcatggtggtctacagctgggccatggaagcggagaagaaggcggcagcccctgtcccccggatcaagagcgaaatgctcgacggcgaggacgtacccctcaaggccagggtgagcggcgtgcccgcggtcgacctcgaggacggtgagatgaagagctagctgccgccgccgccgctgattcgttcattcttcttgttcttttgtaactgtgcgcgcgcgatcgctcgatccaaagttgcttgtccgtcagccctcagctatcgacactacactgttaattttggccccttgttggggagagtccagttcctaggtgacgacgaccacccccagttcggcgtagatcaaacacacactagcagaatgcagatttttaggatttttttcaggcggcggggtgatccattcattgtcatgttgacaagactcataatagaaatacaggtaacatatgtatctccgctccccggtaggattgataaggaatcataaatccaaaa

SEQ ID NO: 6943 - DNA, 1937 bp, Zea mays
agatccaggcacgcaaccgagccgcggcccccctgcgcccttgtcgtcgccgcaccgtccgtccccgcccgcgtcaatccgtcgtcgtcgtcgtctcctcgtcaccccgcgagctttttttcaccgctgccctgccctgcccccgcgcccgttgacgtttccggcccccaattcgaaagcctcgcgctccccgttgctcccttccttgcctaggcggcaacgccctcgtgctttataacccggcggccccgcccccggccgggaaccgagacgggacgggaggagaccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctgaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcatcgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatgggcggtcattgttgaactaccctttttcaggaggggcaactttcttcatactgctttcctgctccctggcggtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttctgtaactgtgcgcgcgcggtcggtcgatgcaaagttgcttgttcgtcggttctcagctatcgacactacactgttaattttgttggccccttgttggggggagtccgctcgtaggtgaaggtgatcccccctcccccgggttcgacgtagatgaaacacacgcgggcagattgttaggatttttcaggcggggaggtggcgacatgctgttatagatggtgacaagactttatataatggaaatgcaggtgtttttgaaatttaaaaaaaaaattctggttgctggggttctgacatgtttcagtcctagcacaaaaaagggcatcatgggtttcgtcggagctgttccacatgggatgggagttgggacgggagtgggaagggattggtcgtgccggtggcacgtggcacgattggcatgcgacgatgccgacggcaggccggcgccggccgggcgaggaaaagccaaggctgatcacatgaactcc

SEQ ID NO: 6944 - DNA, 1791 bp, Zea mays
  misc_feature (1730)..(1733): n is a, c, g, or t
  misc_feature (1735)..(1736): n is a, c, g, or t
  misc_feature (1740)..(1740): n is a, c, g, or t
  misc_feature (1766)..(1766): n is a, c, g, or t
cccacgcgtccggttttccggcccccaattcgaaagcctcgcgctccccgttgctcccttccttgcctaggcggcaacgccctcgtgctttataacccagcggcccctcccgcgtgaggcaaccgagacgggaggagaccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcaccgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatggacggtcattgttgaactaccctttttcaggaggggcaactttcttcatactgctttcctgctccctggccgtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccccccccctcccccgggttcgacgtagatgaaacacacgcgggcaaattgttaggatttttcaggcggggaggtggcgacatgctgttatagatggtgacaagactttatataatggaaatgcaggtgtttttgaggaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattattaataaaaaaaaaaaaaataaaaaaaaaaaaaaaataaaaaaaaaaaaaaaaaannnntnnattnaaaaaaaaatttattttttttttttntaatttttttttttttttttttttt

SEQ ID NO: 6945 - DNA, 875 bp, Zea mays
gccggccggtcttacatacatttcttcactgctcagcgaagcgacacagccgccgccgtttcctcgtctcccatcttcatcttcctcgcagcgccgggactccatcttccgcttcctcccttactcgcgctcggcacgcaggcgacgggagcggcgctcaggctcgggctctcagcggcgacttcagcggcttcccctcccgcatcgcgccctcgcctccggtcctccgcacatcggccggtgatcctgctttaagatgtcagaagcactcgagaaagataaagaaattgatgaagaggaagaggagtatgtattgctagagttggacaattgtctttattcagacatgtcgccaggtgctccgttcgtactctccggtttggatacattgacgcctaccttgataataggtgacagtcttaagatgatcggagaatatgaagaaactattggcacctgctatctattctctgaaactgaagctgaaccgaaacctacaagtaatgagatggcaccttctgaagaaaacacagacaaacaagttagcagcagtaaggaagcgccgtcgaaggaggtgaaccatctcgccagcgttcaaaagatcctcaaatttcggccaatcaatgcggagcattcgcagcatcgagcatatcagcacaaggacaaggaattctagaaaaaaattgtagctggctatctgccgttatcttcttcattggccatccaaacgaggtggtttgtacactttgctttgttctatacataatctgatctattgtatcgatctgtcggtaattgtttctcagcatttcccaaggaaaaaaaaaaccaagcgggagaattttttggccaaaaaaagaaaaaaaaaaaaaaaa

SEQ ID NO: 6946 - DNA, 1398 bp, Zea mays
aagaaaaggtcacatacctgtcgtgttttgttgagtggcgacttgcgagcaccaacaaagccgagtcacgggccgagcccacgggagattcctattggcatctccatccgtcctcgtcggcatcccagccacacacacacacacacacaccgcacctagccacctaccctgctgtcccccgtgccgtcgccgatggagtccttgggcgtgctgctgctccaccccttcaacgcgtacctggagcaggagctggaccgccgcttccgcctgtaccgcttctgggagacgccccgcgaggagttcctccgcgcgcacgcgggcgccgtgcgcgccgtcgtcggcaacgccagctacggcgccgacgccgcgctcatcgacgcgctcccggcgctcgagatcgttgcctccttctccgtcggcatcgaccgcgtcgacctcgccaagtgccgcgaccgcgggatccgggtcaccaacacccccgacgtcctcaccgacgacgtcgccgacctcgccgtagggctcgccatcgccgtgctccgcaggatcccgcaggccgaccgatacgtccgcgcggggctctggaagtccaggggagactacaccctaaccacgcggttcagcggcaagcgggtgggcatcatcgggctgggcaggatagggcaggcggtggcgaagcgagtggaggcgttcgactgcccggtgagctaccaccagcggacggagcagcgggcgacgtacccgagctacacctactacccgtcggtggtggagctggcggcgaacagcgacgtgctggtggtggcgtgcccgctgaacgcgcagacgcgccacatcgtgagccgcgaggtgatggaagcgctaggccccagcggcgtgctgatcaacgtcggccgtgggccacacgtggacgagcgcgagatggtggcggcgctggcggacgggcggctcggcggcgccgggctggacgtgttcgaggacgagcctaacgtgcccgaggcgcttctggggatggacaacgtcgtgctgctgccccacgtcggcagcggcaccaacgagacgcgcaaggccatggccgacctcgtgctcgggaacctggaggcgcacgtgctcagcaagccgctgctgactccggttgtctgacgtttccttgtttctattacgaaataacaagcgcctgcgcctgacagcgagtggggattaaattcaaaatgttttgttttgatttgatcgccgctggtgaatggaactgaaatgtgctgtcaattctcagtccagtgcacacgacacgcttgcacgaatgtcgagcaaattatggcatcttcttttgcgaagccgcctcctcgtctgtacactctcttcccctgcggccactttacgtatctgcgatgaggtttgttc

SEQ ID NO: 6947 - DNA, 1119 bp, Zea mays
  misc_feature (2)..(2): n is a, c, g, or t
anattcctattggcatctccatccgtccgccggcccggcaaagccacacacacacacacaccgcacctagccacctaccctgctgtcccccgtgccgtcgccgatggagtccttgggcgtgctgctgctccaccccttcaacgcgtacctggagcaggagctggaccgccgcttccgcctgtaccgcttctgggagacgccccgcgaggagttcctccgcgcgcacgcgggcgccgtgcgcgccgtcgtcggcaacgccagctacggcgccgacgccgcgctcatcgacgcgctcccggcgctcgagatcgttgcctccttctccgtcggcatcgaccgcgtcgacctcgccaagtgccgcgaccgcgggatccgggtcaccaacacccccgacgtcctcaccgacgacgtcgccgacctcgccgtagggctcgccatcgccgtgctccgcaggatcccgcaggccgaccgatacgtccgcgcggggctctggaagtccaggggagactacaccctaaccacgcggctgagtggcaagagagttggtatcctggggcttggcaggatagggtcagcgatagcgaaaagagccgaggcattcggttgttccataagctacagctcaagatcagagaagcctttcccagactacaaattccacgtgagcgctgtcgacctggcagccaactgcgacgtgctcatcgtgacgtgctcgcttaccgccgagacccaccatgtcgtgagccgcgaggtcatcgacgcgctgggtccagagggcgtgcttgtaaacgttggccgcggagcacacgtggatgagcccgagctcgtcgccgcgctcctcgagggtcgcctgggaggagcggggcttgacgtgtatgagcacgagcccttggctcctgagcagctcctgggcctggacaacgtcgtcttggtgcctcacgtgggcagcgatactgaagaaacgtgcagggcgatggccgacctagtgctagcaaacttggaggcgcacgcgtcggatgagccattgctcactccggtgatctgattattgttatcttttgtttcagcggcaagcgggtgggcatcatcgggctgggcaggatagggcaggcggtggcg

SEQ ID NO: 6948 - DNA, 929 bp, Zea mays
ccggccgggaagggctgtcatttcttccgctccccaatctgacgtcaccgtaccaaatcggagcgcgccgccccggttgctgggtgcgctaggatcgattcgttctgacgatagatctgtgctccatgtgccgtttgaccgactggttggttccgttccgttctgttccgcagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctgggatcattaaccagcttggccctgacaacatggagcacctgaagaggattgccgaggagatgcagaagcaggtggctgctgccggtgcggcagcacaggtcaaggaagacaacgatgacgatgttccagagcttgttcctggagagacttttgaagaagtagctcaggagacaaaagcctgatcataggctctaaatagtgaaatgttactgcaccaatgctgtgaggtcatggttttcgtgtgatggcactcttcttcctcccctcctaggccagccccagccactctttgtgttcgctgttggaaacttttagtttctccatctcaagcttttacctaagggttgtgcatgttgagatgccatggaaatccattttgctgattatttggttaaaaaaaaaaaaaaaaaaaaaaaaaaaaactcgcgcgaggcccgttctctctctctctctcctcgtgc

SEQ ID NO: 6949 - DNA, 8399 bp, Zea mays
  misc_feature (3116)..(3116): n is a, c, g, or t
  misc_feature (3162)..(3162): n is a, c, g, or t
  misc_feature (3544)..(3544): n is a, c, g, or t
  misc_feature (3638)..(3638): n is a, c, g, or t
  misc_feature (5981)..(5981): n is a, c, g, or t
cggagtcagaatagttaatagagaacacaagaagcattaggatatgtacaaccttgagaccttggatcggtttttaaaatataagggtctgtttgggagggctttactttaaaaactttggatcattctagcttctgtcactaaacaggtctagcttcacgagctctagctctgagaaaaaatgaaactagaggccaccttcatggaattcatgaagttcctcagatagtgcttcacaaacactgttttcatacctctttataaagttgaaattacccaccacatcactggttaaacaacacaacgcttcgcttcgatctctcgtgacatccactaatcatcaagggtaataaagaaaactcacacatatcgattgtattacagaagttggagtctatgtgcaaaccaaacactcattgaacccactttaacaaatttattagagttgttttatggtgaagccgaaaaaccaaagcaaaattttttaaagtgaaactctcctaaacaggccctaagagacaattaaccgtttggttcacatattggtaatataatgggtaacccataaagttaaatcatgtttgtttaagtccaaccgtaatcgatatcatactacaaatggatatcgccttattcaaatttattaccaccggtattcgagcgtgaatcgttaacattaacatttacattacatttggtgaactaaacagcacctaagagaccgtaagatacaatgttaagccattggatcataaatataattgaaagataatatgcatagagaatcgtgtagagacaagtttttattgtattttttatttaaaactataaagaaattataagatacccgataattattaataggttgtacatgccctaaatgtaaaaattccaacaagtatatttggccaactgttcacggttcttcaccagttgcgttcgtcgttcccgttctcctcctcgtatcccctggtccgtacgtcgtggccaccggcgccgcctagctcgcaccgccgacagcgtctcagactagatcgcgcctccccctcccaaatcgggttccagtcgggctcccgcaaccgccgccgtctacaccaggtgccgaggccgatcttttcgtcggcaaagatcgccgagcaggtattcccacccctttctcttccctgtttgctgtgcgaaaccgagttcgcaaactacctcaagctatttggctattcgatgcctagtaagttctaacttttgcgaaaattattgggtgtacatgtgtacacccatgtccctctactagatctgcccctggccgtcgccctacaccaggtgccgatatcttcgccagcgaagagcgcccagcaggtattctcaccccttctcttccctacctgatgtgcgaaaccgagttcccaaactacctcaagctatttggccattcgatgcctagtaacttttaacttctctcgaaagttattgtgtacatgtggacacccatgtctttctattagatccgacccccggtttggggttgctctgagaaaaaatctagcagccagcaagatgcaacataagaatggtttcagggctgcatataacattaggaagccctaaattacgtaatagtagctgagtgtggatgtcaattagcagaattagtgaaaaactaggcacaattgtaggctgaaaattctaagaaccccttttactaaaattcatgctactaaacagaaatggagcagtttctatcacatttttcctgtatgatccctacctctcttgtgttactaggggtaactctgaatacacaatgatcatgtagtatatacttctattgagccattttctaaattagaaatgccagtgtgttgaccattcctcacctgagtttgatatgtgtctttctattcctaatttgaattcatgcttctattcatgaatgataataagtacttatttggatcagtacttgtagtaataacatatatctgtcttcctagtttcaccatgatttgttgatccaccggaggtacatttggattgagcactagaacaggccagttgttagcagcataaagttagttatttgtttggttctctctgaactagcaattagctgtctgtttgcatactttcgtggtggatatgcagagggacttttgactttgtttatttaagacataaagtaacatatgttgtagcttttaacttatttctacccccctgtactaacctagcaaaaaaggatatatttttccaatgctaccacattctgtctatgaactatttgataaatgcacacaatctgctaaaagaaaccgaatgtcacggctgctttgcttatatatgcctatgtaaagcaattaagttgtataattctactgaggctagtttcacgaatgcagcagtatgttactaaatgcatccatctatatctatatttcacgacactacaattatgatcaccactgtatggaaaacagcagggttggtcaatgcctcacggagctgcttgcacaacttgcatccttctatatttcatgcagcgttggtcataattgttaagagttatggaattttgatggatgcatttagttttatagtgctgcattggcatattagaatggattcagtttatttttgcagattgcatgcattaatcaagtagttcatagttagaaggtggcagtattgggaaaacaattttttgctaggttagtagacaaaaaaggaataaattaagctataacatctgacaccttatgttaaatgtgaatgccggtacaaattttatgaaagttttttttgtctgaaagctagcttttacttcttagttttggacatgttgtatgctgtgtaattgaatagttggaatgacataaataaatcattttcaagtttgtattgacaggtacagtgatttgggattctatactacctagctttatgattgcaagacctggttattttcacctgaggttgtgttcaacatgttagtggcatgaaaattgcctcaattgggggcaatggcatctagtacaaaatcagatttagtgtctggtagccctgatgggcatggatacttcaatgcacaacgtgggtcctatgcagctgcttcattggaaagntcaggaagcttccgtgaaggcggtgatggctatgcgatgttttcancatcaaactcatcaaggtcagcggcagtgaactctatcaatctagttcagtcacttgcactggacttgagaccggcaactgtggatcacaaaacatctcggttagatctaaagaaatcaataagttccatttttggaacctctgcagaagattcaacatcacttccatctctagggagaaatttaccaaatgctatcgaagagatcagacgtatgaggagtaatcttaacgacaattcaaataaggccaggtattatttcattagttactttgttcttttgcgatgaacttatctgatgaaacggggtagcagatacttgaatgtaatatcaattttacaaagaaacacaacttttatcaacacaagattttataatgatgntgtttttaccttctggggaaagttgtatggggaaagttttccagtatatggtgatatttatgtggggtataaattatgtgctcctgtctaattntccactgtggaattctcttgcagggaaagatctagagcttttggtggtgctatggcgaagattgataaactttgtcccaatattgtgcgaaaacgttctcgaggagacagttcatctaatgaacgatctagtgtgttatcatctggaggagttacccctaaaaatgttcctcagagccatttaaatgcagatgatatggaagctgggcttcagagagaagagaggacaaagaatgcaggacaaaataggagaatacgtacatccatggtggaggttggtcctgattccaaatgttcatgtagtttatttttacttgtatgaagggcaagcttggtgcagtggtgagagctgtctcaccgagtctccaggtcgcaggttcgaagcggcctctccgcattgtggggggagacttgccttggtttatcccttccccagactctactcatgttgggagcctccgatactgagtctgcccttttttagtgttttacttttatcttaagttagatagttagtgttgtttgcgaaatgatacaattgggttttgcaagttttgaactcatttatatatgtgaaatttgttgcgtgtcaatctaggccttatttggcaatgtggcttagttgctgtttttagcatggtaaatttatcctattgccattgttaatttgcaactgatgatacttcattacttcctgtacatatagatcatgtcattaggtgccttgtgcccttgtttagcctaccagggatttttgtaccatttacctgatgtacatctgatttgttagatggatgcaagaacagctggtccatcaagaggccccggacctactgataggatctcagatcctggtaaagccaccaatggtagttctgcagtcccagaagaaaaaatcagaggtttggcaactactatcgatggttgggaaaagccaaaaatgaagaaaaagcgttctaccattaaggcagacatgtcactggctggtgttttgaggactgttgatgtagaccgagagtcaaaacaaggcatgcagcacaagtttactaatgacggtagggcgagaatgacaagttctagtttcaggtcagaaatttaaccaactaggctcggagttcatatttctagttctatattgattctgatattttatccctttaagcttcttttgagaggcaacttaactgttatcgcacgaagatagtggggaacattttaagaagtttatacctgaagattctgcagcgtgattaaattaataaagctttgggacatactccatcctgaaatgataagcatatttgatcagggaaagtcatacaatgtagctttggaccttaatttcttttaaaatatgttgtcatttgctaaagagttaataccattttagaagcactttgaatacaaacttattggtgcaagttgtatataatctaacaaattgttggtcaaagtttgtaaaatttacttcttgttcaaaatacgcttatcattctgggatggagggggcagttccttaaatcattaatgaaaaagtttgttacgattccattttgctttctgttctctgggtatcactatatgaaactctgtgcaggtctggaactgttgcatctggcacaaccaaagcagatttgctttctacacaaaatggtcttgttatgcgacccttaaataggagtgatcaagacaatggtttccatcctactaacaaaagggaacgtcaagctgcattagataaagaaacgcccaacccgagaaccattaacaagtaagatgtgcttttttacctgttctgctctatgctcctctattttatcatttaccacattaaactaagaaagttatcttctgctgcacactgagtcctaattctttcatcataactgtgattagtatttcaccttcaccgccaactcagttcacacacttgaatgaacaaaatcaggccttgacacattgatttttcaggcctaatgaagacgacagtggatgtaacattgcatcattaccgaaggcgaatggatctgcgcggggaccccgatcaaattcagggtcaatattgaagtcatatccaaacattcatcgatcacaagctagttctgatgattgggaacatccgtctggtacaaataagttaatttctgctggtggatctggcattcataaacgtacaaaatcaacacattcattatctcctccgatccaatggggtgggcagaggcctcagaagatatcccgttcagcaaggaagtcaaatttagtccctataatcactactgatagtgcactggtaccaggttcgctggacagtcctgtcaatgaagattgtgcaggtttaccnaggcgtgcatctgtaaatagccttcaacaaacaaaacgaggagatcatgggctctcaactggacctgaaggcaatgagcctgtagttgctgagaaaaagctaagggacaaggggcaaaaagggctggtgaactggatgatgggcatggctctggttttcagaagattgctatgcttgggcatccttccaaaaggaataagttgcctgctgatgaggatattggagatgctttaaggagacaagcaagagttgtcccgggttttactctgaccaggcctgggactcctgtatccattgacaagcttgaaaatgctccgattacaaaacaaagaagtgtgaggacagtctcagagagaactgagaggtaacttgtttccttagctgaaaagcagttttatgtggctaaatactctaaccctgaattctccctgtagtaaatctgggagaccactgatgaagaaaatatctgagcgcaaaagtaatgcacggcctaggcatacaagtagcagtgtgcagtcagactctcctggtatagcgtctcttggtatcaatcagagtgctttatgcaacttgaaacagttccttttgaaccatacccttgaacttgtgctgttcacttttcagtgcaatctgaagatgatcatgaggaacttcttgcttcagcaaatgctgccctaagtattgactttactttcacattctgtttatcttccttcattggaaaattattgaatatttgaatgttatttttcttgttgcaggatctgcttgtgcaagcacgttctggcggcaggttgaacctttcttcgcatttttgactgcagaagacatcacatatcttagtcaacaggtaatgtgggtgattttctattgcgccaacagatgtattttactcttcactacattaattaattgttccttggtcaatactttgttggttagatacatttaccagatgattcctcttcaagtaggtcaatggaagggggtgaatgccaaaaatataaggtaccttttcataactctgtccgtgcagtattattgtactaacaaagttgccctggtgtcaatgcatttctggtagtttctgtttgtagaaatggtagaagtcatttcaacacttgatttcaattgagttttatgcttgatatttttcccaaggcagggtggtcttgaatacatttcacacccctcaactccagccgctagcaacaaagatgatcacgctgctcttccaaatggttttggcttgaatcagttggataatgacataaggggttggctgggaggcaagctgcattgaacctatcctcgatcaacttgtccatgggattggggtaccaggatggtcttcagttggccaaagacttattcaagcattgattgatgaagataggatcgatagtattaccaacaacacttacataagcgagggctatgcatttgatacacatgaaattcattttgatggaggaggcccacagtgtgccccgggccgggccgcggtacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctgggatcattaaccagcttggccctgacaacatggagcacctgaagaggattgccgaggagatgcagaagcaggtggctgctgccggtgcggcagcacaggtcaaggaagacaacgatgacgatgttccagagcttgttcctggagagacttttgaagaagtagctcaggagacaaaagcctgatcataggctctaaatagtgaaatgttactgcaccaatgctgtgaggtcatggttttcgtgtgatggcactcttcttcctcccctcctaggccagccccagccactctttgtgttcgctgttggaaacttttagtttctccatctcaagcttttacctaaggttgtgcatgttgagatgccatggaaatccattttgctgattatttggtttgtggtcggttcacaacattacatgtgcaccaggttttgctgggttatcactatataatgtttgtgtagtctacacaccgtgactaactcttttgcaggggtattgtaactgtgctttgctgtttccag

SEQ ID NO: 6950 - DNA, 4461 bp, Zea mays
  misc_feature (31)..(31): n is a, c, g, or t
ggtggactggtgggccgtgggtggtggacanggggcaaggcctgtaggctgtaactagcgtgggccaatctgccaatgtttaatgggctttgcatccgggaaaatatgggaaattcccggtataatacgggataccgtaaatacgggcgggaaacactctcaaccgttttcggacccgttcccggacatacctatcccggttcccgtaccgttttcttattttcccgaaaaaacgaaaacgaacggttcaaaacgggaatacggtatgggatgggacggtattttttctgatcgttttcatccctacatacatgcataagttgaatatattcacggtgtgattcttattattggttgtcgtgcaatcattaatgtaatgcatggaaaatgcagaaccaaggcactcatgaacgttccagtaaacatttctaaatcacgaaaaccatggcggctctttatcataagaaaaaaatgttccccaaagaggaaagaaaaccatgattttgaaagaagtataggcccatcgctcgcctcaatctgatgcgatgggcggcccgcggcccactgaaagccccttttcagtttttagcacacgcttacataatacataatacgcagaaacttcagggactcgcatcgaaaattgaaaaccctataatcctccccaaaggcccaaacctatcgcccgtacgagactgcgccgccgttgccgtctcctcctccgtcccatcactctctgctcgcgcactctcacctgcccgcgccgtcttcgaccgccaccaaggtcagtcatttcttccgctccccaatctgacgtcaccgtaccaaatcggagcgcgccgccccggttgctgggtgcgctagaatcgattcgttctgacgatagatctgtgctccatgtgccgtttgaccgactggttggttccgttccgttctgttccgcagatgaacaaggagaggctcatgaagatggccggcgccgtccgcaccggcggcaagggcaccatgcgcaggtaggtgttgctgaccagctcggctctcgcatgtcttgtgttcatatgtggttgcgaagccagtggttgaattagaaaatgagctttgggttttcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaaggtatgccacccctgttctgtcgttactggccactgttacatgtttccgaagcgggggaatcctggtgttatcgactggcttagctgatgttttgtgctctgccgatgcagtgcaagcttccatcgcagcaaacacatgggtggtcagtggatctccacagacgaaaagtaagaatactcattcctcgttttcatttgatgtactggtgatgtggtaacctagagctttagctttttccgatcagtggatgttctatatatatggtcattgcttgcccaagtacagcaactaggctttgcaaaaacccttatgagatttttggaaatccgaaatctggattactagtcttcacacctacaggattttgcagctggttaatctgaacatgtttctaggttcttctgtttcttcaaaactacatttttattcaataagttgctatctgagtggtttctaaaatgttatacatgctgtaaatccattggtgcactttgaatggcaatgtttctgtttcattctattctttttttacacagctgacttattgaaacctttatttattgtgtttctacagaagctacaggatgttctccctgggatcattaaccagcttggtatgttacaatctgtaccttaacgtttaggatattatccaaaaaatggttatcttgtactacctccgtccgtttcgaatatttgtcttccgttaattcacttttaactaaaacatggcaaataaaaaagaacagagggagtaacatatttgatgctttgtttgattaggcaagttctgctcatttaatttgtttgttattatctatagtcctggtcttttctaattttattagaaatgtgttgctgcattccaccatttcttgttttgtcatttgtggtgttctctcgacagttaccacttctagacgcacgacaatggatgtatacttctaggcatattttatctgttgccttgaagtttggcagtttctgttctgcctccctgttgctgtatgtgtttcaatcaatcaaatacaaaaagcaacaagcgtgaagcaaacagaagcttgttgccacaatacaaatgatatgaaagagggattaacaccttttctattcttccaggccctgacaacatggagcacctgaagaggattgccgaggagatgcagaagcaggtggctgctgccggtgcggcagcacaggtcaaggaagacaacgatgacgatgttccagagcttgttcctggagagacttttgaagaagtagctcaggagacaaaagcctgatcataggctctaaatagtgaaatgttactgcaccaatgctgtgaggtcatggttttcgtgtgatggcactcttcttcctcccctcctaggccagccccagccactctttgtgttcgctgttggaaacttttagtttctccatctcaagcttttacctaaggttgtgcatgttgagatgccatggaaatccattttgctgattatttggtttgtggtcggttcacaacattacatgtgcaccaggttttgctgggttatcactatataatgtttgtgtagtatacacaccgtgactaactcttttgcaggggtattgtaactgtgctttgctgtttccagattttcacttctcgaaggggtcactgacatttagggcttggttgggagcaatatacccgaggggctaaaattttcttgctatttaattttaaatagaaaggagattttagcccctcaaatcctgtttagtatttgtggaataagctgttggggatggctccctatcctcgagaaaaaaaaaatcatgtccacgcaaactttcatgagtgtttttctctcatctccgtctctacatggcgaattttctttgtgaggaatccatctccattacgagatgcaatacaacctaattttatcaaatcaacataaaataaacaagcaagatttaaaataatagaattaacaacatatcaggtgcaaaccttacaagccctcatgtattttttttcaaaaacaaccctcccaccgtcaatcatccttaaaaacgaccttttcaccctcaactctcccaccgtgaatgtgaattggcctttaaaacgaccctttcaccctctatatattttcaaatatagcctccccctccaacaacatattattttgtacggtttgcaccaagtatttggtttgtacatgatatatagtttagtttgttaattattctaggctacatcaagtttctgatagaattttaatatgaaaagagaatagtttagagccggataagttcacgagacgggtggctgtgacgaatacaagcttcgggccacgcccggtccatggtcctggatatccatatgtatctatttatctttattgtatttagactaaatatattaaaaatatattagatctaattgatcgatctcaccatgggtgatgatagaggatgatttttatattcccgtctcgtgaaccctgttagtttggctcgatgcctgccctgcaaggggcttgtattctgtttatatagatgtacagggtacatgagtatggtaaccatacaagagaatcaaggaaaggatcagaggcgcagctcttcaggagaaagaaaatcagagacgcagctcttcaggagagaggaaatctgcccttctatctatagaatatatgctatcatttaacaaacccaatgtgatttccccatttcaatccttataaagattaaattgccacatcccgtttctaataggggaattccgtgtgggaaattgatgatcagatctctatttacatctctactaatattccataacatagtagttcaggatatttgagcaatgaaagctaagcttattaaaagccagttgcatatttattcctttgaaattgcgttggcggcatcagcagctttgcttcgctgcctcctttcctgccacgggcattaggtcgtcttctcccctgctggtgcaggttaaccggaaactctgtgtttctgggataaactatgaacattcatgaggattcgcgggaaatacagagaaactggaacagttgccaacaagatcgattgagaaatagaaataacgatcgaagccaataacataaaagccgcataatgaatcgggaaggaagctctaacactaggcctaagaacatctccattagcttttctcgttattacttgtagcttcaaatttaat

SEQ ID NO: 6951 - DNA, 1390 bp, Zea mays
ccggcatcgaaaattgaaaaccctataatcctccccaaaggcccaaacctatcgcccgtacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctcgtatcattacatttgatgtactggtcatgtggtaacctagagctataccgttttccgatcagtgggtgttatatctatatggtcattggttgcccaagtacagcagctaggctttgcaaaaatccttatgagatgtttggaaatccgaaatctggattactagtcttctcacctacaggattttgcagctggttaatctgaacatatttctaggttcttctgtttcttcaaaactacatttttattcagtaagttgctatctgagtggtttctaaaatgttgtacatgctgtaaatccattggtgctctttgaatggcaatgtttctgtttcattctattctttttttacacagctgacttattgaaacctttatttattgtgtttctacagagctacaggatgttctccctgggatcattaaccagcttggccctgacaacatggagcacctgaagaggattgccgaggagatgcagaagcaggtggctgctgccggtgcggcagcacaggtcaaggaagacaacgatgacgatgttccagagcttgttcctggagagacttttgaagaagtagctcaggagacaaaagcctgatcataggctctaaatagtgaaatgttactgcaccaatgctgtgaggtcatggttttcgtgtgatggcactcttcttcctcccctcctaggccagccccagccactctttgtgttcgctgttggaaacttttagtttctccatctcaagcttttacctaaggttgtgcatgttgagatgccatggaaatccattttgctgattatttggtttgtggtcggttcacaacattacatgtgcaccaggttttgctgggttatcactatataatgtttgtgtagtctagaaaaaaaaaaaaaaatacatgacaataaatactgtaattgctttacaacttagcttgagaat

SEQ ID NO: 6952 - DNA, 940 bp, Zea mays
gggtaccctccgggggccccgccggggcccgagatcgaaaattgaaaaccctataatcctccccaaaggcccaaacctatcgcccgtacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcaaacacatgggtggtcagtggatctccacagacgaaaaagctacaggatgttctccctgggatcattaaccagcttggccctgacaacatggagcacctgaagaggattgccgaggagatgcagaagcaggtggctgctgccggtgcggcagcacaggtcaaggaagacaacgatgacgatgttccagagcttgttcctggagagacttttgaagaagtagctcaggagacaaaagcctgatcataggctctaaatagtgaaatgttactgcaccaatgctgtgaggtcatggttttcgtgtgatggcactcttcttcctcccctcctaggccagccccagccactctttgtgttcgctgttggaaacttttagtttctccatctcaagcttttacctaaggttgtgcatgttgagatgccatgggaaatccattttgctgaccgcccggtttgtggtcggttcaaaaaaaaaaaaaaaaaaaaaaaaaaaaaaaacaaaaaaaaaaaaaaaaaaagcggcc

SEQ ID NO: 6953 - DNA, 2819 bp, Zea mays
tttggggtggaaatggtctctctagcccatatttagctcattttagcaccctttgagcagcttatgagataataggagctaaactttatcacaacactattagctctactgtttagatcaccaaatagctaaaagtagctaaaaagaagctgctaaaatttatctcatagcattggaacagggcctaagaggctgcactgtaaagaaacacatggaaatggaggacagagatgtaaataaacacaaacacatcttttcaatttatgacggggaattccatacgggcaacgacgtcaacagtcgacctattgccctgtttgtttgggattataatctatatagattatataatccaatgtaaataagctagtgaggaaacaaacaagcaacttatctgataagattatataatctagcacttgagattatataatcctataagctcatcaaagggtgcttatttcagcttattttttatgaaagacccactacccatagcaagttgattaaaattacttctaattgtcatccacctgtccataaacgttctcacccaccagacaattaaaacaaccaagggtattattgtatttgtatgcatataaataataagttgagtccaaataatctgagctaacaaacagcagcacctaacttatttaatccagagcaaataatccagattatataatctagattataatttagattatataatctataagttgaaacaaacatggcctatgtcgatttcagcgtcatagtttgtgcacatgtggccgtgagtttcgcggggtcagccaatggcatacacaaaattataattattgtttggatgcaccaacccgaatggccgtacatagagcttttgcacttgctccacatgcaagcaattgcattggattggtagcaggtaaacttcacgctggctcttcctctacaagataacgggtgtttggtttcacccaaatacgctacggtattgttcggttagtcccattttatatggattagacgagaaataaaaaaaatagtagagattttaacttgctatagatttaaacctacctaatcctctatgatatatttagaatatgtcatatcgaatatttgaataataattatgaatattaaatataatctaattataaaactttagtaaagcatatgtgatataatatatgtgagatcgatgtcactgcaaacgtcacaatcccaagtggtgcgtccctacaagatctacaactgaacagataagatcagctgagcacagattcactagattttcgtagtgcactctctagtctctccacacaccacagtcgagcgagcactcctctccatggcccacggcgagggacgacgccagcatttcctggtggtggccctcggcgtccaaagccacgtcaacccggggcgcgccctcgcccaccgcctcgcacggctacgcgccgacggctccatcacggccacgctctccgtgccggtaaccacctaccggcgcatgttccctcggtcggcggattccgccccagcgacggcggagaccagcgacggggtcatctcgtacgtggcgcactcagacggcctcgacgacggctcgtcgtcgtcctgggccgcggacgccgaggacagggcgcgcaggcgccgcgcgagcgccgacagcctctccgccgtggccgcccgcctggccggccgcggccgcccggtgacgtgcatcgcgtgcacgatggtgtcgcctccggcgctcgacgtcgcgcgggagcacgccatccctctcgccgtcttctggctccagccggccaccgtcctcgccctctgctaccactacttccacggccacggcgcgagcgtggccgcccacgccgcggacccggcgcacgaggtgcgcgtgcccgggctgcgccgccccctccgcatgcgctgcctcccgtcgttcctcaccgacacgtcgggcagcgacagggccacggccctcaccgacgtgttccgagagctgttcgagttcttggaccgctggcggcccacggtgctggtcaacacgttcgacgagctggagccggacccgctcgcggaggtgaggcgccacctggacgtggtcgccgttggccccatggtcgggcccgccacggacgcccgcatccacctgttcgaccacgacgacgacgccggcaagaagaggtacacggagtggcttcacgctcacccggacggctcggtggtgtacgcgtcgttcgggagcgtcacgaagctcgccaagcggcagatgcaggagatcgccggagggttgcgccagtgcgggcggccgtacttgctggtcgtgcgcagggacggggtcgacgacgacgaaggcggcatccatggcctggagaacgacaccgagatgcaggggatggtcgtggactggtgcgaccagctggaggtgctgtcgcacccggcggtcggctgcttcgtctcgcattgcgggtggaactcggcgacggaggccatggcgtccggcgtgcccatcgtcggtgtgcccaacatgttcgaccagccgacgaacatgtacttggtcgaggaagagtggggggtcggcgtcagaggagagcgagacgccgatggcgtgctgacaggggcggagctggcaaggtgcattgagctggtcatgggtgatggcgcaggagcagtggtgatcagggaaagggcaaaggccttgcaagagacagcgcaggcggcggccagtgcagcaggcgggcccgccgagagaaacctttgtcacctcgtcaagacgatgtcaaaataattatcaaagctgtcgtagaaaaaaaaaaaaaaaa

SEQ ID NO: 6954 - DNA, 2820 bp, Zea mays
cttataatttgatatggctttaaattatttttaattttaaaatgaatagaaatatagatcaattttagtcgattagattgtaaaatttagagttattgttatccttaatctcggtatatttatatttaataagttattgcataaaaacggggaactttctgcatgcctcccctttctggtgctttaagcacacgataaaacttgtggacttgcccttttcctgtccataatcttctcccttttgtgtgtgtaggggtggggggtatgcatgctcgtcatgggttggttatactagtggacaagtcgaagtgtcccaaaagccgcatggttcatgtacctaccaagtactttgcgttgccattatacggcactcacaacaacatgctccattacatacactttgtttatgccgcctcccctccctagtatagataatgatggatattattgatccgccttcatttattttatttgttttatttataatttcgtcggccgggtttaaatcctcggccggccccccggccgctggcatgcaacgccttccacacttgaagcagccaagctaagtgaggtgagcttagccatgccgacggcttcctctgcccaccgctcactcctcctctgcctctgcctggctctgctctccaacccggtcgccgcctcgccctcgccccgcggcctccgcttctccgccaaggacatcgcggcggtggaggccgcgctgccgcgacacggcagcagggcgtcgtcgtcgtccaagaccaccttcttcgaggtcgaccgcccgctccgcccgcccaggggcagctcggggccctgctccacgctgctgctctcgcactccttcgcgttcacgctcaccaagccgcccgtcaccgcggcctactcgccgccgccgtgcctgtccggctccgacgcgccgccggtctcgctcgccgtgctcgagtggcgcgccgagtgccgcggcgcgcagtacgaccgcaccttcggcgtgtggctcggcggcgccgagctcctgcgcggcagcaccgcggagccgcgccccggcggggtggtctggtcggtctccaaggacgtcacccgctacgcggccctcctcgcggccggcaacgccacgctcgctgtctacctcggcaacctcatcgacgacacctacgacggcgtctaccacgccaacctcacgctccacctctacttccgccgcggcgtgcggccgtccgccgccgccgccgccgccgatgccgtcgtcccggtctccaggagcctgccgctcaacgacgggctgtggttcgtcgtccagaacgacaccgacgtgcagtccgcgcgcgtgtcggtgccgcgcaacgcgtaccgcgccgtcctcgaggtctacgtctcgtcccacgacgccgacgagttctggtacatgaacacgcccgagcagaacgggccgttccgcgaggtcaccgtcctgctcgacggcgccgtggtgggcgccgtgtggccgttcccggtgatctacaccggcggcatcaacccgctcatctggcgccccatcaccagcatcggctccttcaacatgcccacctacgacatcgagctcacgcccttcctcggcagcctcctggacggcgaggagcacgagctcgggttcgcggtgaccaacgcgcagcggtcgtggtacgtggacgccaacctccacctgtggctggaccccaagagctccaggaccagcggcgggctcgtcgcgtaccacgcgccgaagctggcgggcagcatcgtgtcgcgctccgcggacggcgtcgacggggagtacgcggcgacggcgagccgcaatatcacggccacggggtgggtgagctcgtcgcgcggcaacgtcaccaccacgttcgcgcagcggctcagcttctccaacaccaacgtggtgagcgggcagggcagcgcgcaggcgatcaaccagacgaccgacgcgctgacggccgtcagcggcgggcccgcgcccgcgcaggtgcaccagagcttcccgctctacatcttcctgggcggcgacggcagcggcacgtcgtcgcagcggctgatgcggcgcgtggagatcgggttcgacgagacgcggtcccggggaggaggaggagcaggaggagagggcgccgcgtccacgaccacgagcacgctgcggaactcgcaggtggcggcggcggaggtgacgctccgggacgacgccgtggtgggcgcgtcgtggcggatgcaccagacgtacgagtacggcgccagcgacggcggctgctacctgaggaacgtcagcagcgtcggttacgacgtgcttttcgaccatcgcgacgcgtcctgcgccggtacgctgggccgctgacgcttgtcgccgacagcgagcgccttgtcggcgcctccgccgcgcgggccgctggataacggccggggaagcgacagggtgtaaaatggaacgctgcaccggtggacaaaactgtactggcttggctcggcctggcccacgtccggtcttcaattattaaatataccacggtgacgggccattttcgtgggccaattagcttttcattaagaaaagatgtgacgtgacgtgacgtgatgcagctagtacacaggcagcactaaaatgtaaagaaaaccgctggctatgtttatttaacagtacctgttttatgaaatttgtagaagtgttcatgaattctatacgtctgtaaaaccgctgactaaggtcctgtttgtttgggattataatctatatagattatataatccaatgtaaataagctagtgaagaaacaaacaagcaacttatttgataagattatataatct

SEQ ID NO: 6955 - DNA, 2953 bp, Zea mays
ggccttgtttgtatgggattataatctatgtatattatataatcaatgtaaataagctagtgaggaaacaaataagtaacttatctgaaaagattatataatctagcacttgagattatgataattctataagctcatcaaaggatgtttatttcagtttattttttatgtaagacccactacacatagcaagttgattaaaattatttctaattgtcatccacttgtccataggcgttcccacccaccagataagtaaaacggctaagggtattgttgtatttgtatgcatatgaataataagccaagttcaaataatctgagctaacaaacaataacacctagcttatttaatccagagcatataatccagattatataatctatattataatttagattatataatctataatttaaaacaaacagggcctaacttgggatgacccatgtgggctgggctgtaaaagttcgcggcccaaataggttgttcagcaaatgcaaaacccttcgcctcgcctgtctcaccacagtgtccactgtccagtcgcctagtcgcaaatctcaccccgccgccatggcctcccccgccgccgcctcccccgcgcgccgcctttccgtcattttctcctcgaccaagccacgcgcccgaccacccaaaccggcgccggctccgaaagcgccggccggccaggcggttgcgaaacctgacgagcgctgcgagtcccggaatctcacgaaaatcctgcaggtcatcttccgggagcgcgatccggacaagctggtttcccagttcatcgccgaatcgaccgcgtctgaacgcttccgcaacaagcaccgcgtgtacgacgtggccgtggcccgcctcgcctccttcggccgacacgatggcattgctgccatcatcgactcacagaagccgttcatcgcggcctccagcgtgggcttcgccgcacgcctcatccgcctctgcggccgcgcctccatgccgtcccacgccgccgcgatcttccatgacctcccaccgaagcacaagtcctccatgactttcaatgccctcctcgccgcctacctcgacgccagcgacttcgacgcactcgccaccgcgttgcaggaaatcccggccacacaccccactattgctcccaccatatactctcacaatatactcatcagtgcgctgtgcaagaagccggacctctcggccgccgtggatgtcatcacgctcatggagaagcgcggtattacccctgatatcatctctttcaacattctgctcaatgggttttacagcaatgatcgctttgatgacgtcgagaaagtttgggagatgatgaaggagaggaatgttgagccggatgcgaggagctataatgcaaaactgcggggtttggtttcccaagggagggttgaggatgcagctgcattgattgagaggatgcaaaaggagggaccaaagcctgattcagtgtcctacaacgaactgattcgagggtattgcaatgaagggaggttgaatgaagccaagaaggtatatgataatatgataaagaatggatatgcaccaaataggggcacatttcatacccttgtgccacattttgtggaggctggagagcttgatcatgctctaagctgctgccatgagatcttcactaggaagtgcagagtgcagtgctcgttgctgcagggggtagtgactgcgttgtttgctgcatcaagggtggaggaggctaagaggatcgttcatcttggaagggagaactactatcctcgaaagggtttgaggatgccaccacgtactagaaaagacgagggtttgaagatgccgcaacctggtggagaaggcaatgatgtagaagctggaactgattcagaagattctgtatcatatgaagatgggtgcgagcaagaagaggagtcgaaaaatggtcagtgaggatgtacctttgtaatttaagcattgatgtggcatggcgatgcaagctgaatttgctctacttctttgatggcctgatacaacagaattgcctgtgcaattggaattctctcgtactttagtaatatgatggtttattttgcttctctaggttgattggtaaaaactcctctactcattatatacatgatattagaatcaacccctcttccctagaatggcttgttttggcattttttgtcacacgtcttcaatattgttaattatgtttgtttcaatgtgttttccctatgtatctattcgtaaatgatgtgtgagctttatagttgttttcatgtgctggtgtttaatcattgggctggttggcttcaagtttggaatatggagattccaagtttgggacttgggcttgatgtcactctagagcgacttccattttccgtagtaactagcgtcagtagtgtgtcaaactagagatgaatatttatatttgcataaccgacttattttcactttatagtcattgttgtttaattgatttttctttctttgaatagatcatcttatttgttttttctctctctctaacacatcttacttgtcaaatagtaacttactattagaagcgacctaacaaaaaaaaatgcaggttgatgcataccaatttgtcacactttgtactgctggttttcatgtacatggagtcttgttttgatttaaaatacatggacttagaatttagcagtagcaggttgactgtaatttgctattgctggttaaacgttgagatggtcttttcgggtttgtttctacagctaaggtaatggaattaagaatggaggaaaatgagctatttgatccactaagttgcgagacaaacatattaaaagggggatcaaggtcaccatggaacatgtatagttttacatgccattttttttcttgcgcaactttcaaagtttttctttgttggatgccttcacagttttctgccaagtcatgtgtttcttgcaa

SEQ ID NO: 6956 - DNA, 1891 bp, Zea mays
gggcaggccttctgccgtttcgtgtttcgcggcgtgggcggctcgagatcgcgccggggtccgatgttgattaccgttgcttcctcggcggtctcgcctgggccacggacgaccactccctcctgggaggtttggaagtggaagagtggcgcacggcaataacggcgtgtccctgcttggacgctccgcgagatctccctctcctgcgttaggtcggaatattgtagagccacctcctacggcccgctcatcatcggcaggcaggccagctgttgcatcacgacccaccaccacagtggtcccgccaatcaaaaccaacacgtcgctgcgaacaccgtcccctattccaccggtggctgtggagcctccagcggatcgcactcgaccgaaaatatttgatgcagcgcttcatagctcaagagaatcaggactgaaaagagaggcatctacacttcacgatgagcttgatatgctacaagaggagaatgaaagtgttctagaaaagttgcgacttgctgaagaaagatgtgaggaagctgaagctagagccaaggagcttgagaaacaggtagctgctcttggagaaggagtatcattagaggctcgcctcttgagcaggaaggaagcagcacttaaacagagggaggctgcgctaaaagctgcaagagaatcaaaggatggcagagatggggaagtaacaacactaaggcaagaacttgagtctgccaaagaagaggttgcatcagcaatggaccagctaaaggaggcagagtctgaaacgaaggctctccgatctatgactcagagaacggtcttaactcaagaagaaatggaggaggttgtcctaaaaagatgctggcttgcacgctattggggcttagcagttcaatatggtgtgtatcccgaaattgcggtatcaaagcatgaacattggtcatcattggctcctcttcctcttgaggttgttctttccgccggtcaaaaagctaaggaggaacctcgaaaacaaggtgacaatgttcaagggagaaataaacttgcacgagaaatgagtgatgtaatgggagaaggcaatatagagagcatgctttcagttgaaatgggccttagagagctttcttcattgaaggtggaagatgctgttgtagttgcagttggccaacatcgcagacctagcatagttcgtcagttcacatcagatttcaaatcacctggtgaacctaaatacttggaggcatttgatcttagcccagaagaggctgaagatgttagctttaagcaggcatggcttatatacttctggagaagagccaaaactcatggtgttgaggaagatattgctgatgaccggcttcagctttggattggtcgcaacgcacaagctccaaattctcatgacgctatcgatgtggagagaggtctaacagagctgaggaaattgggcatagagcagcaactgtgggagggctcgcgagcagatatagatcaagcttctttggcgatggagaatcagtaagaattttccacggctgtctatgcttcgtgtatcatcccagttttggagaaacgggaactccatttcccagcaggtctcggccctttgcatcatcaggtatcacagtcacaggattgtgctccgatcttggggtgtgaccgatggacttccgatgagtttgtgtagtgcatgtgcaagccattcatctgttgttattaaaatagctttgtgaaatgtgtaatagctctgctttggcaagagaaacgatggcaacgacgaccccacttccagcaattgtgaattttgtgattatcacaaaaaaaaaaaaaaaaaaaaaaaaaaaaaaaaaaaaaaaaaaaaaaaaaaaaaaaaaaaaaaaaaaactcgaggaggggc

SEQ ID NO: 6957 - DNA, 1109 bp, Zea mays
ttgggaccctcgtggccaccccgaccccatccgtcattgacagatcccgcaatactcacagggccctcttctctcatctctcactccctcgctccgtctaccagtaccaccacgtccctcctcgtcgacgatctcgtagcggcggcgcacatggcgagcgacggcgcggcggctacgccagcgaaggttaccccaaagaaggccaatctcctcgacccgcactccatcaagcaccttctcgacgagaccatctccgaggtcgtgaagagtaagggctacaccgaggacacgcggctgggcaactggaagctggggatcggagccgccgtgattgctgtcgccctcctcgctcagttttaccccaagaagttcccgcagaaccgcgatttcctccttggctgcatcgccctgtatgtggtgctgaatgtggtgctgctgatccttagctacaccaaggagaaggatgccatcctattcacgcaccctcctatgggttctttcagcagcactggcctcactatttcttctaaattaccaagattctcggacatgtacactctcacaatagcaagtgcggatccacagtctatctctgcaaacaagccagttcatttcactaagagcgtaacaaagtggtttacaaaggaaggagttcttgtggagggcctgttctggaaggatgtcgagaagctgattgatgactacaacagtgagcgcaagagtaaatgaattggtagctcgtgtctctggccatctggggagacatcgctgtctagagaaatccgtcaaagtttagcttaatctgaacaggcatttttgctatactgtaccggttgaccagtgaatgaatgatgttctagacattaactttggttccaagctttctgtcgtgtccatggataactatccgtccgaatcctagaaacgtggtccgtgcttgtaacctgtttgttctggtgcttccatacgccggagcagattttgaagagaaatgaaacaaatcgttaaatcgaaaaaaaaaaaaaaaaaaaaaaaaaaaaaaaaaaaaaaaaaaaaaaaaaaaaaaaaaggggcggccgccgcctattaacctcttcaacccggaaata

SEQ ID NO: 6958 - DNA, 1612 bp, Zea mays
ttttttttttttttttatgaataacaaaattatgcttcttatgcttgagcatatagatagatcccttcagagtcacacacacataactaagttgttgctcgcattgcattcaactgcaggccttgcacatatcaaggcaaattaagacccagatcaaaacaaaagataaacaaactaatacaatactactactacaacaatgggaagatagcccttcaaatgacacctttcaaccaaacagtttaaatggatggttggcttcttgctcgctcatgccttgcaaccacaaccacaaccatggccataaacacccatgcactgcactgcactgcatatgacacctttcaattggcatgcatggatgggcgcatgtgtgcaagcttttttctgtcctgatgggctggaagaatttcagcaagtcatctaattctttcaccacgacctggatctaggtcaggcagacatgcccccttccaagatgcttgctgttaccatgctccaatgattcaccatttttgccacattgcccaaaacccggtggctgctgagttcccctctacagggccagaaattacaatgggttaaagcttcacacactgcctgctgtagttagctccccttttataataacaagatgtaatccagggttcggggctcgaaaagtccacccaacacattataacataatttcatgagtgaagaaacaaaaccatacctgctcccttaatggttctatttgctcctcctcgacctgcataacctgcgaatctgtctctacgatgcaagcctgtttcctgtccctggacatcgttgcgaactctcggttcttgatcatgagcttctaccattgcatgacggcgcggtccgtgggatccagaagggctcgcttcctgcatctcctcatgtcgcccactccccccaccacgctccctgccacatctccatcaccatcagggaaccccaacgccatgttcccctccatcaccaccgccctagcgcaggaatccctggcaaggaaatcctccagcgtcatctctgcggcactgtcagcgtcagagctggcagcggggatgggggagggaggatgggcgtggagagccctccagcggtggagatctccttccacacccccgacattcgctggaccgcaacctccaaatctacctgggaaggatccgccgggccggggctgacgctggcggcggcagcgttgacggtctcgaggtcgtagatgttatagatgatgtcgtccatgttcatggatatgatgctgctattcctaaattgcgcgaggttcgaggacgagccgacctcggtgtgctactgcggggacgacgacgccatcacctgtgatgaggcggaggcgactgagagcgatgtgcgggttgggcgggcacacgccgcaacgagagtgtgtggggagcatgttgagcgcaagcagggcgagatccaggtggcacaagaatgagagcaggctggtggtgacgagggcttggaaggagaggagcggtgtgctcggggaggaagaagactcctatctggttcactaattggaaaacggagcagagggggacccgcaccatcactcggcatgaccgcgcccatgccttcc

SEQ ID NO: 6959 - DNA, 2667 bp, Zea mays
tggaggtggagggagcgaagccggattgttacacggcggtcggggcgctctcagcgtgcacgaggttaggtgcattggatttgggatgacaggcggttgaaatagtgcactaggatgaggtccttgacaacccagtcctgggcactgcactgatcaatatgtatgctaagtgttggagcacaagagaggcatggatggtgttccagcagatgttggagagggacatcattgtttggaatgcgatgatcatggggcttggcatgattggccacgagaagattgcatttgtgcttgttggccagatgaagaactcgggtgtgaagctgaatgataataccttcattggattgctctgcagctgcacacatactagccttgtgaatgatgggcggcggtattttcataacatgactcatgtatacagtataagccctaggattgagcattatggttgtatggttgacctgttgagtcgtgcgggattgctggaggaggctcatcagctgattggtgacatgccaatgctggcaaatgccgttgtatggggagcacgcctcggtggttgcaagatccatcggaatgctgaccttgctgaatatgtgctgaagcagctcatccgactggagccatggaattctgggaactatgtcatgctttctaacatttactcgaacagtggaagatgggaagatgctgcaaagcttaggttggaaatgaaggcaaaggggattgagaaggtcgctgcctctagctgggttgagcttgatgataaggtccacaagttctatgttggggacgattcacatcctctttcagataagatctatgcaaagcttgatgaattgggccacggcataccttgtagattgagcccatagcagcccatatatgaagaaaaaacaaaagaaaaagagcccaacacgtaacaagcaacatctcgcattgattttgaagcgtgagaatctggtctgcttattctgttcgctgtgtttctttcgtccactcagctttccgcagccgccgttttacgttagccaattctgctgtcagcttgccgctgtccgctcgtcctttgagctttggttgtgtctcccaaatatcttgcctttttgttgcattggactcttctgtggttagaatggcagcacccaagcccatttctcgtcttatttctcacgtcattcttgatttggatggcaccctcttaaacacagattctgttgtaagtaaggtagtaaaaccatttattctaaagaatggaaaaacgtgggatagcaagaaagctcacaagctagttgggaagacaccttatgaagctgcagctgttgttttagaagactatggactcccttactctacagaagagttcctctcgatgattactccgatgttcagtgagcagtggtgcaacttaaaaccacttccaggagctaatcgactgataaaacatttaaagactaacggggtgcctactgctttggcttcaaactcaccaagatgtttcatagaagccaaaattttcttccaacaagggtggaaagagtctttctctgcaattgttggtggagatgaagtagagaaggggaagccatccccgaatatatttttggaagctgcaaagagaatgaactgtgctccttcaaattgcttagtaatagaggattccttgccaggtgttacaggtggaaaagctgcagaaatgcatgtcatagctgtaccttcaatacccaaaaagactgctgagttcagttctgctgatgaggtgatcaattccctccttgatgtgaggcctgaaaagtgggggttgccaccatttaatgattggattgaaggtaccttaccaatagaaccatggtttattggtgggcctgtgatcaaaggatttggccgtggttctaaagtactaggaataccaacagcaaatttacccgcggagaatttttccgacgtagtgtcagaacatacatcaggggtatactttggctgggcaggactttcaacgcgtggtatatataagatggttatgagcattggctggaacccatatttcgacaataccgagaagacagtagaaccttggctgcttcataatttcggcgaggacttctatggcgaggaggtgcgccttgccatcgttggctacataagacctgaggccaactttccttcgctcgagagcttgatagagagaattcacgaggatggaagagtagcagagaaggcactagacctgccaatgtatgccaagtacaaagactcgccttatctgagaaacccttcgaagcacgggagtagtactaccggtgggacccagtctgagatggattccaagtgacaacccccctacagggccactagataatctgttacttattttccctatggtaaatgcgtcggtgttgatgcagaaacaattggactctctgtgagctaactcgcttcttaattttcggaagtagatagtattcctcgaagtggtgtttttactttgtaatatagaaaaaaataaagtggggttgttgaaacttgagagtcaaattccgagacgttatgcacgttttgatttctgaattaatcgattggtatcacttgtactgtttttataaaaaaaaaaaaaaaaaaaaaaaaaaaaaagaaaaaaaaaataaaaaaaaaattatatttttt

SEQ ID NO: 6960 - DNA, 2181 bp, Zea mays
gtgcggccgctcgggccggccggtcgggacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggggaaaaggaaaaaaaaaaaagaaccgcgcacgcttcttcttccctcccccacaaagggaagaaaaaaaatttccgtgtacggtttcgcccggcgccgcctttggcagttgctttgcttgctcttgccctgttgagctccaaaggatctccatttcaccactcccatcgatcccactaccggtccgcatcaagcagccggcgatggggtccgcgtccgcccgcatcgccaccgccgccgtgcacctcgtcaccgcggccgccatcctcctcatgctcgcgcgaggcggcgaggccgtcagtctctggctcccgccgccgaccgccggaggagggggcttcctcggcggcgcggaccgttacctgactcgggaggagcactggatgaaccaaaccctggatcacttcaacccgacggaccatcggcaattcaaacagcggtactacgaatttctcgactactaccgagctccaaatggcccgatcttcctatacatctgtggagaatctacgtgcaatgggattggcaataactacttagctgtggtggcaaagaaatttggtgctgcattggtttctcctgagcatcgatactatggaaagagttctccttttaacagtttgacaacagaaaatctacagttcttgtcatcaaagcaggctttatttgatcttgctgttttccgccaatattatcaggaaaccttaaatgccaagtataatcgctctggggcaaacagttcttggtttgtttttggagggtcatatgctggagcactcagtgcttggttcaggttgaagtttcctcacttgacatgtggaagccttgcaagttcaggggttgttcttgctgtatacaactttaccgattttgacaaacagattgggatctctgctggtcctgaatgcaaggcagcacttcaagaaataacaggacttgttgatggacagcttcagtctggccgtaactcggttaaggagttgtttggagcgacaaagttagaaaatgatggtgacttcctctacttactggcagatgctgctgctattgcgttccaatatggtaatcctgatgtcttgtgctccccactagctgaagcaaagaagaatgggacagatttggtggaaacatttgctagttacgtgaaagattattacattggaaaatttggggcgtcagtagcatcatatgatcagcaatatttgaagaacacaactcctgctgaatcctcatatagactatggtggtaccaagtttgcagtgaggttgcatatttccaggtggcaccaaaaaacgatagtgttcgttccccaaagatcgacacgaggtaccatttggacttgtgcagaaatgttttcggcgaaggagtctaccctgatgtctttatgacaaacttatactatggaggcacaggaattgcaggttctaaaattgtttttgcaaatggatctcaagacccatggcgccacgcttctaagcagaaatcatcagacgaattgccatcatacttaattgagtgcaagaactgcggacactgcagtgatctctctggatgccctcaagctccttcaaacattgaaggtgattcatccaagtgctcacctcccgaagctctgaacaaagtaaggaaggagattgtcgatcacattgacctgtggctatcagaatgccaagagcaaggacatgacaaggagccatggctgggaagcagatggagcatagctgctatttgatcaatctgtgaagctataagcatgtgctgctagagtaaccaaggcaaatatgctttctttttcttgcagcactgtggtttatcgtttcggcaaactatgtgggctgctgagtaatccacctgtggcgaataaataaagcagtcagttctcagtctaaagaaaaaagggcgggcgggggctgggggggtgtttcttgttcctgctctcattttgttttcttctgtaaaattgaatagctctttacaaaattcccgcgtgattcctacg

SEQ ID NO: 6961 - DNA, 3726 bp, Zea mays
atacagcataaaattaacatcttctaatttttattcgtttggttgacgctctattttttttttaccaacaatagcactttacatgaggagctgaactaaacacaaaataacaggtcgatctgaaagaaatgttgactggggagcatccattttactactagtgttaggtgtacagtgtagtgtatcctactcgaccatatctcgtttttttactgtatagtaagcggatcaagttgcagtcgatcgatgtgccaaattaatcattcgtcgctgccgccactgttgctgggacgcatcggctccaccacggcagcggcgacctgcttgggcgtgtaccgggcggcgagcaccatgtagagcagcaggttggcgacgctgatgatggtccagagccagaagtagtagtccaggtggccggtgtcgaggtccgtcgccagccacccgggccgcttcgtcacggccgccaccagcgtcaccaccagcgagttgacgtagaaccccagcgacagcgccaggaaggagaaggccgagcagatgctgcgcatcgcggcgggggcctccccgtagaagaactccagctgcgcgatgccgcagaagacgtcggagcccgccaccagcacgaactgcggcacctgccacacgatgctcatcgggccgctcccgccgtggatggcgcggagccggcgcctctcgacaagcgcggccgtccccagggccagcaccaccaggaaccgcccctcgcccccgcgctgcagctgcgtcagcccaccggggcgccccgtcagccgccgggccgccgggatgatggcggcgtcgtgcagcgccacccacaggagcatgaacaccacctccacggacaccaacgatgccacgggcaccttgaaccggccgcccagccgcgtgtccatggccatcccctgctggatgaaggtggtggtcatctgccccagcgacgccgcgtacagcacgcacgtcatccagatgggaagcatccgcaccaggatcttgacgccctccacctcgctcaccgtgcacagagaccattcgctctcccgctccttgtctccgtccatgacgatgatcgccgcggccttgtcaaggcaccgcagacccttggtgcgcgccagtcgctgctgctgtccagcgctatcgccgtcttcgtcttcgtcttcggcttcgtcttcgtgcagcagcaccgccgcgccctcgtcccgttccatcctgacgtcgcgcttcctgaaggcggcgacgaacaccctgatgatgtccttgagtgggctgcccgtcggcatctgcaccctgtagcagggcgtacccgccgcgaaggcgagcgcggccacgaacaggcaggccgtgccgatgccgaagccgagcgcccacgacacgttctgctccagccacgacacgagcgtgccggcgacgaagatgcccaggttgatggcggcgaagaaccagctgaaaaaggcctgcttccgctccggccggcccgcgtcgtcgtcgtactgctcggcgccgaaggggagcagcgcggacttgacccctcccgtgccgatggaggtgaggtagagcgcggcgaagaagacggagaactgcgtcttggtcgccggcgcgcacgactcccccatctggcacgccgtggcaggccgcagcgacgggatcgcggcggacacggtgaggagcaccaggccctgtccattcggcagcaatcgattcagttcagacattcagtgtctcagcgagtgagtgtcactgtcaggcaggcattcctgaatcgcagaatacgggattcgattggatgaggaagaaaaaactcaccacgaggtagaagacgatggaggcgaggatggtcctgtacttgccccagtagctgtcggcgaggaaggcgccgatgacagggacgatgaaggtggtgccgttccaggtgtcgacgtgggcggcgttgaaggcggtgctcccgtgcagcaccgtggccaggtacaccaccaggttgagagccacgcccgagaacgcgatgctctccagcagctcgaagactggatgtaaaaaaaaaaaagaatcaccaacagctccacaccggagggaatcgaaggccacggatcgggatcagactccttacctaggacgattaccgggcccttccaggggaagcgcttggtcgccgcccccgacgcgccgccgccggattccatggacgaaaccgcctcctgccgctgctgctggtggcggcggccattggagccgccagggggaggcggagacatgccgctctgcggggacgggaacaattgcctcaggcagctgctcctctgctcctacagaaacgatacgcaatgccgcccgcagacgcgacgcgacacgcgcggactagagcgcaggctgctgcaccgtggcctggggtcggtccaggaaggtgacgaccagatcgctggccgcggcagtcaacgaggagggaggaataccgatcatggacgatctcgttcccgcaccgccattttaaaataataggcggatgagcgccgaggagtcaacatgaggcagaagtagaggacagatccgatggcgtgcggtgcgtcgtcaatcgccgtctcgaccgctccctcctcatgtcatttcatctcgtcagcgccggagcagagtgactgagtgagagagcgcacgcacgcgcaagacgggaaggagtaattaattattgtaggaaaaaaaacaaggatgggatgagagcactcgtatgtatgcaacggatgaaattggaagcctatccggcggcggcggcagttgtaacatttgcatttggctaggatctctcttctcactgtcgtagtctcgttctcgtctcatcacatctgccaaccaccgtccagctaggagcgcagatggatccaatccaaccagccgtgcatgcaagcaataataatacggcaacagattacaatgaaccaggcaaagcaactaactctcgactggatgtgtggccatcgatcaaactgccagagcagaagctagctttcctttattgacagctgctgtcgtcgctgcacagaacactgctagtaccatctaccacaatgatatactccagcatgagtagtcgctaggcactgcagtcagtacctgcgtcgccggaagcagcggcccgattcccctctctcggacgcacccgcgcccacacggctcctcctgccgctgccgctgccgccgcccatgggcctgtctggaacacgcggtggacggacgcggcgcgacctgtcctatacaaaatcttggagacacgtcgatgtcaccgaccgtgacggctcctcggtcggctatcctatccatcccttacaaatgactcaaggcctcaaggggcaagatgtcgtccgctccatctcctcctcctttgcaagcagagcagctaggttacagcgcaaccaacggcacttggttgaagcaagtgtgttgtgtgtacgggaaggaaatgaaacgagatcgtctgacagcaggcacacagaacatggctcagttgagcacagacagcagacagcagacagcacagaacagaacacattcagttgagcactaaacaactggctcgctcggttccgtcatcatctaatgaaaccgtggctgtcagctcgcgaaataaacaagccgctgtccaggccgaacggcctcagggcttgttcgctttggagtggattgagggggattggaggggatttaatcccctcctatacaaattttgta

SEQ ID NO: 6962 - DNA, 774 bp, Zea mays
gcacgagagccgccgttccgttcccttctcctctgggccattgggtccctcgaggccggccgggatcgtccatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgcagcagggttacccacagcagggctacccgccgcagtacgcgcagccgcctccacagcagcagcagagcagcgggccttccttcatggaaggatgcttggctgccctctgctgctgctgcctcctggacgcctgcttctgacggatccatccgtgccgggttcaacacggctgcaagtgaagcaacaagcttacggaagagctggaactgggccgtgctattctagctttgtcctgcgttatcgccctcttttcttttcttttcttttttttttctctctctctctctctctgttataagactactggtactctgtcgatgtcgattggattagactagggctggtgtgtattctgtggatgctccgtgtttctggtgggattcaagttcaaacctgggattattgtatttcttctacctgttaatctgttgccgagcaaaaaaaaaaaaaaaaaaaaaaaaaaaaaaagcggccctcg

SEQ ID NO: 6963 - DNA, 838 bp, Zea mays
atacgcgcagtacggtccggttcccggcacccgcgccgcccgcgcccgacatcgtccatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggtccaacacggctgcaagtgaagcaaccagcttacggaagagctggaactgggccgtgctattctagctttgtcctgcgttatcgccctcttttcttttctttttttttctctctctctctctctgttataagactactggtactctgtcgatgtcgattggattagactagggctggtgtgtattctgtggatgctccgtgtttctggtgggattcaagttcaaacctgggattattgtatttcttctacctgttactctgttgccgagcacatttcgcttgcgtacatgatccgtagcgctccgtaggatgttcgactgtagcgcaatttattcggatcgacttatttgacctggcattttggacgaagtcttgtttagag

SEQ ID NO: 6964 - DNA, 717 bp, Zea mays
cattgggtacctcgaggccggccgggatcgtccatccgtattcccgtcacaactcacaacccgagccccccaaacccgaagcagcaggagctcccctgaccctgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccaccgcagggctacccgcagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggtccaacacggctgcaagtgaagcaaccagcttacggaagagctggaactgggccgtgctattctagctttgtcctgcgttatcgccctcttttcttttttttttctctctctctctctctgttatgagactactggtactctgtcgatgtcgattggattagactagggctggtgtgtattctgtggatgctccgtgtttctggtgggattcaagttcaaccctgggattattgtatttcttctaccaaaaaaatggacgcgtttcttcgctgctaaaaaaaaaaaaaaaaaggccccta

SEQ ID NO: 6965 - DNA, 2603 bp, Zea mays
ccgggataatcctctttcgttgctcgccagcctgcatcctgagacactcccaaattcccaatgttccaccgcgccagctcgcgactttgatcccgttccagcctccgttccgttcgggtcctgctggtccattacccttgtaactaaaaccccggttccgcctcgccgcccggcaatttcaaagcgtgaagctctgctcacgtcgtcgcctccgcgtccgccacccactcaacaacgcggcggcgaatcgcgggcggttcgccgccgaccgccgccgcctttccctcgccagccccccgctcctgaagcaatggtactggaccacgccatcaggggctcggcggcccgcagggctgagacccaaaccctagcgccagtgctgctcatgggcccgccgcctccaccgccgatcccaccgacgacggggatgtacctcccggggcccccaccccccgggacgctcctgccgcacccgatgcacatggcgctcccgcgtgaggtcatcatttacatggacgagtgtcggagccgctccctcctcaagttcatttccgacgcggggattgtgccttcgctagaggacgagcggaggagggagcgggtagtacgcgagctcggcaagatagtaatggattgggcaaagagggtggcctacgagcagggcaactggcactggatcgcttcagccacggtgttgaccttcggttcctatgccctgggggcgtatggacctgaatctgatattgatgtcctctgtattggtccttgtattgcatcgctgcaacaccatttttttgttgtcctgcgacaaatgctcgaagggaggccagaagtatcagaattgcattcaattgaaggagctaaggttccattgatgcgttttaaattcaatgggattttagttgactttccttatgttcaactcccagtgatcaatgctgcagaggctatgcatgcatttgatccccatgttctagaaaatgtggatgggccaagttggagatgtctatctggagtccgtgctaatagacaaatcattcaattagttcccaatatgaagaaatttcaatatttgttgcggtgcctcaaactatgggcaagaaaaagaggacttcattgccatctacttggcttcttcgctggaattcatttggctatccttgctgcatatgtttgccgcagacatccgaatgctagtataaatactctgttgtctttgttcttcgacatttttgttcactggccttggcctcttccagtgagtttgcttgatccgcctgttccttgtcggggtcctgatgggtgctccctcatgcccataatgttgccatgtattccaccagaattttgctcctctagtacaacagaaagtactttcagcaaaatcaaagaagaactttggcgtggctatgctctaagcaaggataccagaagtactgattttaactggagttggctctttgcaccttttccatatggtgcaagatacaaatgctttctccgcatagttctctctgctccgatgggagaagaattgcgtgactgggttggatgggtgaaatcacgattccgcaaccttcttctcaagctggagagtcttggtgtttactgtgaccctgatccctcagaacaagttgatcataccatcactgatccaaatgttgtattcttctggggtctcatctatagaaggaatattcaaatatgtataagttctctcaaagaagatttcatgaaaagtgtctgcaataacatctatggaaaggaaaaatgtgcccattcagacatcacaatgtccattgttgggcctccccagctgccaaaaagtgtctttgatctctcagtttactctgaaaagctgccacaacatatgatggggcaccaactaatgaagcagaactacaatgcagtcagttaggctcagctgtcatattgcgtgcgagcttcatatgtcaatatcacaacagcaagaagctgctgttgaagtcgttttcaacatcagatttgaatttttttttactgccctttttagatgtaggggcttgttcatgcctcgggaacaaggaatatgggagattttttccttgtgaagctggatgtcgatagctggatctcttcaagcatccagcaaaatgagatggaagcatctcttgaagcattcaagcgacttattcctgttatgaggtgtgtgtgcaggtacatgcatattcatgtacacatcatagcaattggtatacaagtgaggaggaggtacggtatagctgtatgtaaactgtagatgtaatgtttgtactcagcagcagaaatgtgtaaattgcttcctgttagcgctgcttctgggcacagatgctgaggttgatatggaggccatgaatggaagctatatattccaggccagtatgcaaatgcaagtgttttggatcgattcgacccacttttgttttttaggctgtaaaaaaactgtgtcctagaatccaaggattcttatggtaatgagtatgactttgtggaagaaaaacgtttactcatgcgaagcttttgatgtaattgtggtgaatattcaaaaaaaaaaaaaaaaaaaaaaaaaaaaaaaaaaaaaaaaa

SEQ ID NO: 6966 - DNA, 1048 bp, Zea mays
  misc_feature (26)..(26): n is a, c, g, or t
gaaatcataaatggtgatcaactggnattttatctggtcgagattttgcagtactgtgatgattcatgagatcgccacacagtcttgtgaatgctatgcaagaaacttccacaaattgtcaatgatatcgtttgttcttgttgctgaaacttcgtccattttacttattgactgttagcattaagttagcaactataagtttcatccttccctggatcggaattcagactcgagtgcccttacttaccatgccatgtctctggttctgcagtttttcctggcactctcatgcttcatcgccattggtgttaatctgagccaattcatctgtattgggcgcttctctgctgtatccttccaagtcctaggccacatgaagaccgtacttgttctgtcccttgggttcctattctttggcaaggagggcctgaatcttcaggtagtccttgggatggttctggccgttcttggaatgatatggtacgggaacgcatctgccaaaccaggcggcaaagagcggcgcagcgtcctaccgctgaggtctgcaagtctcaagggaagttcagaagaaaagggtggtgccgagaaatagtcttgctctctctgactgccaacttgaatggggagttttccgttccaaggttgaatttctggtgaggtgacgtgaagtaccacatattgggaactcttgcctaatgtttgacgcagaggacaaactcgttccatctagaaactcaggatcgttatagttacaggtatactgtaaaggttcatttttttttggcgctctgaatcatttgcagtgaggggaaagacagacatggttgttacgagtcttcaagacagtttttttatcgaatatataatgcagttgtttgaggaacatgctcctatatttttcgtggtgatgtactgtaggatgttttgatttgcagtaagatattaatgaaagtatagggctgggtttcctgaaatgaatttgatttaaatcttagaagaatgcagtttttcttctgaactctgaaggtatagaaaaattgtattttgg

SEQ ID NO: 6967 - DNA, 5538 bp, Zea mays
catctatttggtttgaggaatgaagtaatccatcatcttctcattcctcactttcttgtttggattgtggaatgaaatgagttgatctatcaccattttattcctcatacattaataattagtaataatataaggaatgagtccattttaccaaatttataggatagactcatgatacaccaccctatctagaattaactggttttcaaaccaaacacccgctccatgtacgtctcgagccacgtatttgagttcgtctacggtaacttttatataagttaaacttccacggtctatggacccaaataatttctcgctagaaacagaatgttctgggttcattgggctaacaatcaacggtgtgggagttttacctccttagggctactttgggaacctcaaatccccttcgggattggaggggattgaggtggaaataaggctggacgaaatactcgtggctcgataactcgctcgactcggctcgttagtagctcaactcggctcgttttaattttgtagcgagccaagctagcattctagctcagttctctaatgagctagctcgagttagctcgtgagctagcttgcgagccaaacgagccaagccacaatacaagtttgtctagtcgttggtgtcgtctcatctctcatattcttgtttctcgtagttatgatctgtgatatggacatgtgtggacgtgccatgtgcttaaatatttgcattattgcatggctacatacctacattgtatatttaatatttgattatcggatatgattttgtgaactttgtttctagccgtatatgatgttagtgttgtgcaataaaatgttacatgtttgtagaatggatgatgaattgctttataatgatgcttgttgctatcttattataataagggtttgtaaatatgtaagttaatacatatttggttatttaatttaatattaaaagttagaagctaggacgataatatgataataatattataaaagttttggttttgtagtgttaaacactacaaatatgattttttggttatatatatatatatatatatatatatatatatatatatatttatgtacatagatctttgtatttagttgtgtagctcgcgagcctaacaagctggctcgagcttcctaacgagccgagtcgagccagatgtttagctcgttagtataacgagccgagccgagctggcttgttacagtaacgagccataacgagtcgagctggctcgatatccaaccttaggtggaaatgaataatttcctctccaatctccttcaatctcgaaagggatttgagttagtttgagagccacaaaatcggaggggctaaaattccctccttatataattttgaataagaaagggattttagcacatctaatctcccccggtatttggactcccaaactagcccttagcagagaaactcatctcggtgttcatggtgttcatggtgcggagaaaaggttaaaaaataaaatataaatgcaaacatttctgaaaaaaagatagaaaataaaaaaaaaacatgccacttttacgtgagagggaaacgcggaaattatggcgaatctcaatcagccgaggagtcggtcggtttcagttccttttgaatgaatgaattgcaaaaggaaaattcctataataaagcaaacagagtccgacatctgggaggtttgtgtgaccgttgcaacgaaacaaaaaaagccaaagggatcccaaacgaaaacgagccagctgagcaaacacaacactcgcatcggcacccacactgccactcatcacattggcacccctccgacacgggccgggacttctcggactgcaggcagccaggcacgcaccagcaacaccccccacccgccggctcggagcggggccccacccgaatcacacagatcgggacgccggaggaggagcaacgccgtcccgcatcaccggagcaacgcgggcgcggagaggccagccagcgcaggcgcagttcaagctttggattcccggatcccacaccaccggtctctctcggggagtgtaatccagcgagcgttgagttgaaagccgcgcaagtggagatgagtactctgaagaaatccgacaagaaggctgccctcgacttcgcagcatggagtttcaatgtcaccacatcggttggactcatcatggtcaacaaggccttgatggctacgtatgggttcagtttcgccacaacattaaccgggcttcattttgtgactactaccttgatgactatcgtatcttcggtcgtctaggcttcttgcgcttctgactgcttagcgctattatgttatggcagtgttgtatttttgttgtgcgattgctagattccaaatacctaagtaataaccagatttgctttgctaatgattgaagaattattgtgaagttatgaagtgctgcagctatttgaggtttctgcagaacctaaaacctacctggctcccctcttatggacttccttgcaaaattggtagtgtctctgctaattgagccttcatggcattagtggaagcaatcgaaacatgctagcatatgtgatttcttactgtatgttaggtggcgattgcagattctaccgtatttctggacattctcaacaaagtgtgcatcgatgtgaacttggatatatctcctgtcatgtcattaattaccttttcctcttttttttcagccacaacattaaccgggcttcattttgtgactactaccttgatgactatcttatttcgttggttaggcctgagtcagccatcccacttacccctagcagatctagttaaatttgtgatattttcgaacttgtcaattgttgggatgaatgtgagcttgatgtggaactctgttggcttttatcaggttggtgagatttttttagtagctgctatattatgcgaccttgaatcgttaacatctatattcattttattcccttgctcagatagcaaagctgtgcatgatacctgcatcatgtcttctggaggttgtatttgatcatgtacattattcccgggacacaaagctgagcataatggtcgtgcttataggagttgcagtctgcacggttactgatgtcagtgtgaatgcaagaggtctaattgctgctgttatagctgtttggagcacagctttgcaacaatacgtgagttttagcatctttaaatgcagatttcttatacgtcacctaaccagtaagattgcttgctacctcctgtttgcaattacctgcaagttcgtcggtgcgctttgagccttttcaaaggacaatatggcacttcagtgacagtgatacttgtttattatggaaagttgttgataattagcagttgtcaaattattcattggtatcaccgcagctttaggatataactccttttttttctggagattatgaatagccactcaccatggccacttgatatctttcatacttgaattgtcagacttcataaatgtgctcatgaatcatgatgccactaatatattgttctttacacaaattataactccatttcccaaattttgaacatgtgataccttttgattccacaactttggctttttctactatttaagtgccactttttcatttggacttcggccctgtcatgtgcccaatataatgggcacaatttagactcacttttatttctgctccttctgcagtatgtccattttctccaacgcaagtactccctgaactcattcaacctcctgggccacacagctccagcccaagctgggtcactgctgctagtgggaccatttgcggattacttgttgacaggcaaaagggtggatcagttcagtttgtcatcgcttgctctggtaaggacagactaaaaatgtttctatctctgtgatcaccacaatttgtgcttctgcttctgtatataatttgtctatctgtttgcttattagagataaaatggagattaggctggcattttatctggttgagaatttgcaacactgatttataagctcaccaatctcatgaatgttatgcaagaaacttattctgcatattttccccctgattctgcagtttttcctggcactctcatgcttcatcgccattggtgttaatctgagccaattcatctgcatcgggcggttctctgccgtatccttccaagtcctaggccacatgaagaccgtacttgttctgtcccttgggttccttttctttggcaaggagggcctgaaccttcaggtagtccttgggatggtcctggccgttctcggaatgatatggtacgggaacgcgtctgctaaaccaggtggcaaagagcggcgcagcatcctgccggtgaggtctgcgagtctcaagggaagttccgaagaaaaggccggtgccgagaaatagtcttgctatatctgactgcaaactttttatttagatggggaatttttcgttccgaaggttaaatttctggtgaggtgacgcgagtatcacagattgggagctctgcattatgtctgacgcgcacaaaacaaacgcgtcccttgtagagactctggattgttatagttacaggtatactgtaaagcttcatttttttttggcgctctgaatcgtttgcagtgagggggaaagacggacatggtttacggcccgttcggttcttccggaaccgtagcctggaatggttcctagctcaattgtttacctaatttatataagttttgatcaacccgaatgattcttggatgaatccaggacaaacgaacaaggcctacggagggtttaagacagtttttttttatcttatcgaacatatagttcggtagtttgaggaacatatccttctgaatttcgaggggaactggggatgtgctgtagtaagagattaatcaaaatataggtctgcatttgctgaaatggatttatttaaaacttagaaaatgcatttttgcgtctgggaagttttatgagctagccaaagcatccgtgtcgttttaatggagatcaatcttcggttttagaggatgaaaggttgttctggttgccaagaagttagacagagacactagcaataaaatatttttttttgtaactacttggaccggagggagtagatgctcaatttactttattctgaactgtttcagtattctaacccaatgttatctaaggaaattaagtttggacgtaccacgtttcaaaattcaaattattgaaacaaccccgtatttgtgcggattggagatcaattagaccttgttcgtttgtgccggattggtgggtcggaacgattcctaaccagattgcttctctaatttatataaacttgaattagctggaacgatttcgggtgtaatccgacacaaacgaacaaggtcttagctggacggagattggattaacaggtagacaagttactgatcatcatcgcatctatcgatctattctttcttacgacagctagcacaaggaaatcgtgcgagacaatggtaggagcgacgatcgacaaggtagagagcaagctactagttgat

SEQ ID NO: 6968 - DNA, 1735 bp, Zea mays
aggtttgtgtgaccgttgcaacgaaacaaaaaaagccaaagggatcccaaacgaaaacgagccagctgagcaaacacaacactcgcatcggcacccacaccgccccgcatcacattggcacccctccgacacgggccgggacttctcggactgcaggcagccaggcacgcaccagcaacaccccccacccgccggctcggagcggggccccacccgaatcacacagatcgggacgccggaggaggagcaacgccgtcccgcatcaccggagcaacgcgggcgcggagaggccagccagcgcaggcgcagttcaagctttggattcccggatcccacaccaccggtctctctcggggagtgtaatccagcgagcgttgagttgaaagccgcgcaagtggagatgagtactctgaagaaatccgacaagaaggctgccctcgacttcgcagcatggagtttcaatgtcaccacatcggttggactcatcatggtcaacaaggccttgatggctacgtatgggttcagtttcgccacaacattaaccgggcttcattttgtgactactaccttgatgactatcttatttcgttggttaggcctgagtcagccatcccacttacccctagcagatctagttaaatttgtgatattttcgaacttgtcaattgttgggatgaatgtgagcttgatgtggaactctgttggcttttatcagatagcaaagctgtgcatgatacctgcatcatgtcttctggaggttgtttttgatcatgtacattattcccgggacacaaagctgagcataatggtcgtgcttataggagttgcagtctgcacggttactgatgtcagtgtgaatgcaagaggtctaattgctgctgttatagctgtctggagcacagctttgcaacaatactatgtccattttctccaacgcaagtactccctgaactcattcaacctcctgggccacacagctccagcccaagctgggtcactgctgctagtgggaccatttgcggattacttgttgacaggcaaaagggtggatcagttcagtttgtcatcgcttgctctgtttttcctggcactctcatgcttcatcgccattggtgttaatctgagccaattcatctgcatcgggcggttctctgccgtatccttccaagtcctaggccacatgaagaccgtacttgttctgtcccttgggttccttttctttggcaaggagggcctgaaccttcaggtagtccttgggatggtcctggccgttctcggaatgatatggtacgggaacgcgtctgctaaaccaggtggcaaagagcggcgcagcatcctgccggtgaggtctgcgagtctcaagggaagttccgaagaaaaggccggtgccgagaaatagtcttgctatatctgactgcaaactttttatttagatggggaatttttcgttccgaaggttaaatttctggtgaggtgacgcgagtatcacagattgggagctctgcattatgtctgacgcgcacaaaacaaacgcgtcccttgtagagactctggattgttatagttacaggtatactgtaaagcttcatttttttttggcgctctgaatcgtttgcagtgagggggaaagacggacatggtttacggagggttcaaaacacccgttttcgttgcctggaatggttcctagctcaattgtttacctaatttatataagttttgatcaacccgaatg

SEQ ID NO: 6969 - DNA, 1769 bp, Zea mays
ccccgcgaaaacgaaaacgagccagccgggcaaacaacactcacatcttacaccagccgcactcccctgtcctcctctccgagacgagacggacgggacggcaggcaccaccgcaccggcgccaccccacccgccggctcagagcgggggcccggccacccgaatcacacagatcggaacgccggaggaggagcaacgcgggcgcggagaggcccgccagcgaaggcgcagtgcaagctctgggttcccggatccgataccaccggtctctcggcgagtgtgtaatccagcgagcgagcgctcggtttttgccgtgagagcgggagatgagtgctctgaagaaatccgacaagaaagccgccctcgacttcgcggcatggagcttcaacgtcaccacgtcggtcggactcatcatggtcaacaaggcgttgatggctacgtatggattcagttttgccacgacattaactgggcttcattttgtgaccactaccttgatgactatcgtatttcgatggttaggcctgagccagccatcccacttacccctagcagatctagttaaatttgtgatattttcgaacttgtcaattgttgggatgaatgtgagcttgatgtggaactctgtgggcttttatcagatagcaaagctgtgcatgatacctgcatcctgtcttctggaggttgtctttgatcatgtacattattcccgggacacaaagctgagcataatggtcgtgcttataggagttgcagtctgcacagttactgatgtcagtgtgaatgcaagaggtctaatcgcggctgttatagctgtttggagcacagctttgcaacaatattatgtccattttctccaacgcaagtactctttgaactcattcaacctgctgggccacactgctccagcccaagctgggtcactcctgctagtgggaccatttgcagattacttgttgacaggcaaaagggtggatcacttcagtttctcatcacttgctctgtttttcctggcactctcatgcttcatcgccattggtgttaatctgagccaattcatctgtattgggcgcttctctgctgtatccttccaagtcctaggccacatgaagaccgtacttgttctgtcccttgggttcctattctttggcaaggagggcctgaatcttcaggtagtccttgggatggttctggccgttcttggaatgatatggtacgggaacgcatctgccaaaccaggcggcaaagagcggcgcagcgtcctaccgctgaggtctgcaagtctcaagggaagttcggaagaaaagggcggtgccgagaaatagtcttgctctctctgattgccaacttgaacggggagttttccgttccaaggttgaatttctggtgaggtgacgtgaagtaccacatattgggaactcttgcctaatatttgacgcagagaacaaactcgttccatctagaaacccaggattgttatagttacaggtatactgtaaaggttcatttttttttggcgctctgaatcaatttgcagtgaggggaaagacagacatggttgttacgagtcttcaagacagttttttatcgaatatataatgcagttgtttgaggaaaaaaaaaaaaaaaatttcgtggtgatgtactgtaggatgttttgatttgcagtaagatattaatgaaagtataggactgggtttcctgaaatgaatttgatttaaatcttagaagaatgcagtttttcttctgaactctgaaggtatagaaaa

SEQ ID NO: 6970 - DNA, 931 bp, Zea mays
agaggttcgtctctatcaagtaccaaacccttttatctgcttcgtcccctcccctgtgcgtgggggtataaagcaccgggctctgcttccgtcacgcgagacggcgagagcacaacattagcaaaggctgtaccttggggccgctaaagcagcttggtccaagctgtctgtagaacttaagcaactctgatcccagccacggcacacggcaggttgaagccatcagctccggtttctggcgccggatttgggatccgcgcgatgtcttggtccgcgcccgacgacatcctcctctccacctcactcgcgggcttcctggacaagaaacttattgtcctgctaagagatggacggaaacttcttggcaccctctgctcatttgatcagtttgcaaatgttgttcttcagggtgcttgtgaacgagtgattgtagggggacaatattgtgatgttcctcttggtctgtatgtgatccggggagagaacgttgttttaatcggagaattggatcacgaaaaggatgaactccccgctcacatgacatgtgttttagaagcagaaattagaaaggctgagaaggcggagcgggaagcaagggatctgaaaggcacgatgaggaaacggatggagttcctagacttcgactgataataaacccgttcctgtggtggttgctgctcccctcccattgcggccgcggagtttttagtggcggcctgtgccatacctgatgaatagcagtgatgttttctacgtaccttttgaggcaacatcagatcctttgagcgcctcctgatacagctctgtgacctctctctgattattactactgcctggggagatgccatgtgctctcctcccgttgtcgtttgcaacagtgcattcgccctatctcgtgattttatttatttttgttactggtattgctgcc

SEQ ID NO: 6971 - DNA, 1005 bp, Zea mays
ccacgcgtccgaggattatgatctcctcggttccccgcgtggccgcgtatcaagtacccaaaccctttcgatctgctcaactaccaaactctgctcctccctgcttccgtcacgcgagagcactccactcccacgcgaaccctagcagtggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacaagaaacttattgtcctgctaagagatggacggaaactgcttggcaccctctgctcatttgatcagtttgcaaatgttgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaagcagaaataagaaaggctgaaaaggcagaacgggaagccagagatctgaaagggacgatgaggaaacggatggagttcctggacttcgattaacaccgtcaccgcggccgttgccgctccccattgtggcggaatctttagtggcggcctgtgtgccatacatgcctggtgaccgcgccggcgcaccttggattgctggagggtttagcgaacagtttctttttaactagcagtgctgttttatactctcgtggccacagaccctttgagcgcctcctgatacagctttgtcaccactctgatcattgcctcgatgaatttatatacctgacgttttggattggatctgcgccaaaacgccatttctatgcagagagtctctactcttatagctcaaaaagatttttttcatttaaacgatttgggattggatctgggcc

SEQ ID NO: 6972 - DNA, 1295 bp, Zea mays
  misc_feature (15)..(15): n is a, c, g, or t
atctagtattatatnacagtacattcactccgcgccgccccggacgttcagcatcgtcgtctttcgaaaaatgtggttcggtggcggacccatcgacgcggcgggcgcgctgcgcggcttcgtgcgggaagcaggcgggtgcgcggtggtggacgggggtctcggcacggagctggaggcgcacggcgcggacctgcacgacgcgctctggagcgccaagtgcctcgcctccgccccgcatctcatccgcaaggtccatctggactacctcgaagcaggtgcggacgtcataatctcggcgtcctaccaggccacgatcgaggggttccagtcgaggggcttctcgcgggacgagagcgaggagctgctgcggcgtagcgtgcacgtcgcgcaggaggcgcgcagggtcttcgcggcggagggcgacaggtcatcgcgccgcggacgcccgccggcgctggtggcggcctcggtcgggagctacggggcgtaccgggcagacggctccgagtacagcggggattatggaaaatcgatgacgaaagaagatctgaagaacttccacaggaggcggctgcaggtgctggcaggcgcggggcccgacctcatcgccttcgagacgatcccaaacaaactcgaagcgcaggtctacgctgagctcctcgaggagaacggcatacggatcccagcctggttctccttcacttccaaggacggggtgaacgcggcgagcggagatccgatcaacgagtgcgcggccgtcgctgattcctgcccgagggtggacgcggtcggagtgaactgcactgctcccaggttcatccacgggcttatcctctccataaagaaggtgacgagcaagccgatcgtcgtgtatccgaacagcggggagacgtacgtcgcggagacgaacgaatgggtggactcggacggcgccacggggacggacgactttgtgtcgcgcgtcggcgagtggaggcgggcgggggccgcgctcatcggagggtgctgcaggacgagcccggccacggtgcgagccatcgcgcgggcggtgcgcgaggcggaatacgacgatatccctgccgtggccgtgctctaagcttttgctagttcttccattcccggcggagaaactgaagacgatcattttcggcaataaagtacacacgctcgagtgccacattgtgcgcagttgtctttgatgtggagaaactggagacggcgattcgtcgtcatgctcacgttccttcggcaataaaaatgcacgtgcacgtgtgccaaaaaaaaaaaaaaaa

SEQ ID NO: 6973 - DNA, 1451 bp, Zea mays
gcaggtaccggtccgattgagcccaatgccatcaaagggtccgagcctccgagggaagaaaggtccacacaggacactcctccttcgtctttctccttcctcgccgctctctgctgcattcgcgaacacgcatcgaccctacgactacgagtagcgagagaggattgatggcggcgcagctgcggtacatgatgagccattattttggtaccccacctagcaaggaggtgatccaagatctgtactacgccttgaggacaaagggaggtttgacccccaaggaggaggagacgctcctggcttgcaatttacttcctggtgtttatttcatcgtgggttcagtactgggcactttcgcgatgttgttgggttcccacaaaggactcaaattgcttgggcgtccacctaattctccattaagatctttgactgtttatggctacggttttattgtcggaaaggcctgtgctaatgaaacctggcatcaattgcctgaactgcttttagacagggaagaaggacgcatgaagacagagctagctaaaataatactcaataagcatagtgatgacatatacctggttgaagttgtgagaagacacttttttgtcgagcatctgttcgatgatctgcatcaaggtcaaccacttttcaggtggcgcctacgacatacgtatgttgacagcacctttgtagaaagaacgaaggaagttgaagccagcaactctgatgatgtggctagatcaatttcaagagagacaattacaaacactacaccatttggagaaatgatggaggattcactggcttgtatactgggttctcccggatgcaacatggaaagcaacaatcccccagaaaagacagctaatgtcctgacgcgaagtgatctgcgagctcgcagaagaggtcgcaggcatcatcggcatgctgatgactagtttcctattgtgaatgttgtgtagaagtgctgtggaataccctagaccattaccattttatttgggcctcatgccccacagttaatctgctgtgcctggtcaaaatttctaggctggacaagagctgcttttgtaagctgggcaatcctgtatcgtgatgtatcccatggcccctgcattcttcacaaagcaaccaataagacggtatagacaagcgaaacgacgctgggtggtgtgatgtttgcaaaaaaaaaaaaaaaagctgccggagcatacagcagttcattttcaattcttattattagtatattatggaagaagaaatgaacatcttcaggattgaacagtgtcgcgaaattgtagatgatggttccacaatcccaatgggaccgacagacaaagagacatgctgcttcctgctgtgagttttgtattgcagacgacactgtttatgtggagtttgaattctgttgtgagttttgcaccgtaaaaaaaaaaaaaaaaaaaaaa

SEQ ID NO: 6974 - DNA, 3709 bp, Zea mays
  misc_feature (531)..(531): n is a, c, g, or t
  misc_feature (1356)..(1356): n is a, c, g, or t
tttctagttaatatgtagctaatagcatgcagaaactagtgattatgtggagttatagtttggcctgtaaattcttcacctctgagctgtgcgtcacagctgcagggtttccataaaaccaacaaactaccatggcgtcaagccttaccacattgatgttgatctgggcatgggtttgttttatctaggtggatgtagctattgtgcaaatggtttgcatcatacctttgttgcaactgagatatccttgagcctagatggtttgtataaagagatgcactgtatgttcaaatccctcatttccatctaagtattttctaccttgaattgccttacaacagatacagcaattgcattcttccactgcttagtttcttcagccttaactagattcaggggttggtggtgtcatggtcctctgaaatatgggcagcaaaaggacctacgcctttgatgatccttgcatactcactgttggtttataagggcgataacaattaacttcaagcttagctttgtgaccacaatganttgtccccttggcttttgtgagcacacactaaataaaatctgaacaactgaaattgaatataatatgccacacgatgtgcgatggagaattgattcatagccttataggctggcttggcacaacgaaattcttgtcccaacgtcagtccaacctgcttacttgcttagatccagctaactttaacgaggttgcaagatgataactagattgtttgtcttctttgtcctgtagcttgaattttctattgcatattgccaggtagtagcaatcgttcgggctttatgcaggagctgcaggaacaacatagcattctcagaaactccatcgaacaacttaaagtgtcagaatcactcagggccaccctgatttttcatttgaaggaagcgttgaatgagcaggtgctgacgcaaataactctgtaaggtctgttttatttgttaaatggatcttccgatgcttacacagattcatttattttcaggagctcaaagtggaacacctcagaagccagcttcaggtaatttccttcaaccagcattgctgggtttatttttatttttataattttttaataaaatgctatgttacttatgcttctcaaagaatagagtttgtattgtagaatacttacaacttcacctttatgtgttcgcgtatgattatgttatgggcccatctgtttagggtttgaagagactcttgattccccttagaagaggaccacttagaagcagggccgaccgctacctgtaacctttgaatctgacagttatggctctctatgtcagggaaagaagcagtttaccagattactaatggttttncattatgaatcaggcagctcagccccgattcaagagagcttctgagctctgcgtggggcttggaagcaacatggaaaggcgtcagccatcaaatcaagggcttaagaggtccagtctctccgatccacttagcactgttgctccagaagctgtgaaatctcttcaaaagggacaatcaagtgcagtgctgtattcacaggagggaaatggtgttgagcacagcgtgacagagacaaagcttgctgcaggtgctgcttcagatgatatacgtggtggtgctttgtcttcacgagtcaatgggggcaacactatgctgaaaatagaagagcacacttctggtaacaagaggcagaagctagaggatgacgcacatatttctcagcctcggtcagagtcaccgccgccgccgccacccccattccctcatcctgatacatttcaaccgcctccgccaccacctgagtatcctcgatcgccagatcctagcccaccaccgccacggacttcactgccaccccatataatccccccaccgccgccgccaccacccgcaatgccactccatatgttctcacatctaccacctccagctggtacatttgtaccttttcctgctggaccacctggcccaatgtattgcacttatccatcttttactcctgttgtcaactttcccatgaccagcccacctggtttccgtaatctaaccccgcctccatcttttcgtggattagctggtacattctatggccctcggttccccaccgcgcccccaccagcagacaggaaataagagtagtaacttacctgcagacttacagtgccagcagctttggcaagtatcataccagtttttttctgtttcaacagaggatacaaactcgtggggatgcgtcaccatgtgttgtagagctcaggagactgttctattgttgtacattcagccagtcagcgtgcaacagtcaattttctgaactagttctggtcttggtcccagagtagaaagtgtagagcctgtacatgtcggctgctagaggggatttggaattccgagagcccggacccggagcaaatggctgcgtcagtttaatgatcgactgatccagtagttcctggtctaggcggtggagtaaaaactgtagattccgacagcttagggagaagatatggaacccaatagccgaagacagatgttgtagcatgacatgttgtaactcatcacagttgtgctcttcgctagatcatccgagaacacctagatgttcttgtgatgtctttgagcgtgtaatcctgctgtttggtgtaagatatggcttcagctgctgtcgatggtcgaatctcttgctctgtttttaattacccttttttgctctcggctattctagcgccaataccttttgcgtctactttcgcatgtgttcccaaggaatttagtggtctgtcttggtttccatgtgtacaggaaagatatatcctgtcatggtgcttcggcatcgtttctctcctgctggctgctgcattcaggtgcggttgttccctgcaaatctctcctttttcatgtaacgatatttttccctcacgttgtggctgctctaaagacaggtttagatcgtgtatatttcgggtgtatatttggggatctagcttctaaaaactctaggtgatctagacagaactagttgttttgtccctctgctccaaaataaaatttggtttagggatttagtggattcattcaatacttgatgtatgtgttttatatatgagtgtctagattcatcatcttcttttttttttgtcttttttttcaaccgctaaaacgactacttttttgtaacggatagagtattttgtttttacaaccaaaagctccccctatctaccaaactctaggtttctcgatcaaaacttcaggaacggtttgaaactgttttgtgctaaacatgataaatattaaatttttttaagaagctgtatatacgtggagctattttgctaaatagttagctaaaaactagctctttccccactggtagagctgccaatagagttgctacggaagaaaaatatatagcttgacctggccatgtatgcttgttgtgagcgggcgctatacatgaacagtagaggccgtatgcttccagcggcagcaaccacatcggaaagaggctgatacttggaatagattcatataccatgtgattggttgtatgagcgtctagcgcctggctagctgcagcctggctggttggatacccgcttggatcgcgtctttaaacaacttcagactcgactctggttccttttcccaccaaacaaccaaggaacaccaaataaaatttgtaaacaaatt

SEQ ID NO: 6975 - DNA, 4369 bp, Zea mays
cattgggtacctcgaggccccccccgggacaccgcgtcttcgtccagctcactcccccgccgcgcccccgctccgctcccctctcttcctcgccgcgggtcgcgcgcagccaggcaccgagccgccgaccagtaaccgacgtatatctcatccttccccctcccccctgcacagccccctctacaactccccgattaaaccctagaatctcccaactcccaaatgcgcgcccccacctaggcccccgaattcggcatccgctccgcggaaggtgtgcaagccagggtgcacacaatgagtgcgggtttcaacaagcagatactggctcagaagctttcgaagcttaatagctcacagcagagcatagaaactttatcacattggtgtgtctttcatcatcgttactgccaacaagttgtagaaacatgggattgcgagtttcatgcagctcctggagagaggagggtatctttgctgtaccttgcaaatgatattatgcagaatagcagaaaagaaggcaatggatatataactgaattcatgagggtcatccctgctgccttgaatgaagtgttgactatcagagatgattttgggcggaatgttccaaaaagactgattgacatatgggaagaccgtaaaatatttgatactcaggcacaaagcctcaaagatgactttttcagaaggttaaaggacattagaaacaaattgaaaaatacgggcagtgagctgctggagaaggttgtctctagctacaaacatgtcctgaatgctcctatggatgaggatactctgatgcgaaaatgccaagcagctcttatcaattttgatgaactcaataaaacgtatggaaacaactctgttttaggtagcagcaatcaatcagaatttatgcagggggtgcaggaacaacacaacattctcagaaactccattgaacaactcaaattgtcagaatcactcagggccactctgatttctcatttgaaggaagcgctgaatgagcaggagctcaaagtggaacaagtcagaagcctgcttcaggcagctcagcctcgattcaagagagctgctgagctctgcgtggggcttggaagcaacatggatatgcatgagccatcaaatcaagggcttaagaggtctagcctctctgatccacttagtactgttgctccaggagctgagaagtctcttcaaaagggacagtcaagtgcagtgttgtattcacaggagggaaatggttttgagcacatcatgacagagacaaagcttgctgcaggtgatgcttcagacaatatacgtggtggtgatttgccttcacaagtgaatgggggcaacaccaagctgaaaatagaagagcacacttctggtaacaagaggcagaagctagaggatgacacagatatttctcagcctcaatcacagtcaccgccaccgccacccccattccctcatcctgacgcattcgaaccaccaccaccaccaccaccacctgaggttcctccatcaccagagcctagcccaccaccaccgccaacttcaccgccacccaatatgatccccccgccgccgccggcaatgccaccccaaatgatctcacatgtaccacctccagctggtacatttgtaccttttcctgctggaccacctggtccaatgtattccagctacccaccttttactcctgtggtcaacttccccataaccagcccaccagctggtttccctagtccaagcccgcctccgccttttcaaggattagtgggtacattctatggccctcagttccccaccgcacccccaccagcagacaggaaatgagtgtagtaacctaccagcagccccctcgtcatactagtttatttccccttttcaacagagaatatgactcggggggtagggggggggggcgctccatcagcatgtgttgtggagctcagaagattgttgtaaatttagccagtcagtgcgcagcagtgaattttctgaactagttgtggtcttggtcctggagtagaagtgtagaacctgtagatttcgactgctagagagaattagggattctgagagccgagaacaaatgcctgcgacagattaataataagttgtggtcttgttggagtaaaaactgtagattcccacagcttagagagagagcatggaactcggtagcatgacatgttgtaactcatgtacaattgtgttcattgccagatcatccgagaacatgtacatgttcccgtgatgttttgagcgtgtaattctgttgttctgtgtaagatatggcttgagccgctgtcgatggttgaaactttttgctctcggttaaaaaattgccagtagtacctttttgcgtctacttatcgcacgtgttcccaagtaatgttcctggcggccaaaaaaaaagcatctcagcacgaggacagagagcacactagtacagtacccttcacaagcagtacagatgtcctgattcttgcctattttcgcctaaaacgagatgataaatctgaaacagacacatcctaaaccactcgtgagcttgagtacaattcttgcttatctttggctaaaaccggacgataggctgaaacagacagttgcttcttctcgttcacagcctcgtgcctcgacccatcgcagagccgtgttgcccttcctcgcgcgccgacaaggcatagcctcattttcatcaccccataggccagtaggagaaaacgtttcgcattgaccaaggcaaacagagagagggagggggtgatgtgcacgtccgtgggcacatccgtgcgtcgtggactctaaaataggctttgacccatcagagtagacggcttcgtgggtcgccgtcacgagcacccgcagagtcgtgattcgtgaatcataggcagcaccacaataattgcagagcacgcgcgattcgtcggaggagaggtacgtgtgaccacgggcccggttgcggctttttcctggcacggcccacgaagcagactccctcctcgcacactttttctcgtggcctgctgggccccgctcgctacacaggaaaaatgagaccacaaggttgatagcatatagttggaccatatgacgatgggtcgtctttggaccatgtcatggtggtttccaaaaaggtgatgacgacccgtacgtcggtacgtgcgcgcgcgccccttttattttactttattttattccgatcgaggaaatcccacaccacaccaaacaaagctttccgttgacaagccgtgcagtatccaaacaaaacctctgaataattgattgattgaccattgaagatccctggaccggtcctagtcgatcatgggagggagggactgcaaagtcaaagctcatgcgccacttttcgtggacaatgcaatacgcgcgcacgtcaaaaaagtctagcacagagaattcaaccgttgaagagctagcagccggcccctccgagatgtgaccggaccgataatgatccatgctactatctgctttctgcgctcgtgtttttgctagggaggcaagatatcacaacagcaaaatagaaaacatacatcctacatagtatttccaacagctatcggacattaatctaacgttataagcgagggaggacctaggcctctcctcgtttctttattgcaagtattagtatctagattttcactgttaagtcccctgctgagtctaactaagatgctctcgctctagtattttaatgtccatccttataagtatgtcatcgctcttgttttattctaggtccgcttatgcgttcgacgactgtcagccaccggacataagacttatgtccgacggctgacaaataagccgtcgaacataaagtattttaagaactttcccacgcacacgcccactctctgcctgcgtcgctcgctagctcccccttcgccgctgccactctacctcgctggtgcacgctccctcaccaccgcacgtgaccttgtcagcgtccgcgccctcgtcagcgacagcttcatggcctcatcggcgtccctcgcctgtcgttccgtgcctctcgctggcgcccctcatcctctgcctcgtgctcgcacccgccacttcgttcgacgctaagtaagttattttcgacggcaaaaagtaattgtacaaattatttagattgttttagttcgtttagaggttgttagatattctgaatttggaattttcgagggtaattattaaaccctcggaaataagcttactcgatgttattttcacacgaaataatgttatttgtaacttaaacgtatgtaatgttagcaaacacaatctattgtagcgtaaacgcgtgtatcatagtgttaacaaatggaacataacctagacgttgttcgttcggccc

SEQ ID NO: 6976 - DNA, 3688 bp, Zea mays
aattcgccccgcggctctagccttcacgactaaatccaccaccactcccgcacacctcacctgcccgcgtcgcctcctcccctgtcctccgcgcgcgttgggcgggcagccagctcccccaccaaaccctaatcactccggcgccgcgccgcgccgcgcctcgcggccctgcctcgatccgctccagcggccgcccgccgaggcggctgtgcggtggttgcgcttgcgctttcgcgcgcaggtccccgtgggtctctgcgcgcagcgggacccgtccacggcggcgaggcgagggcttcaaggcgggcgcaggcggaggggcggaattgctcgggcgatgacacggaggcttgcggccgcggcgtcgcgtccgatgccgtgaatgggagtggcggggcgctgcgggcggcggctgcgtacatggaggccggggcaccgccccgcggctggcgctggggggtgctctggctcgtcagcgtcgagattgtgttggttctagtctgcactcgcggagctggtgcggattctggtgaaagcaaaggatcgtttctgcaagactctgaagctggagaaaaggatgtctaccttagccactcctgcatccacgacgagatactacatcaacggcgacgagctgggaggaaggagtactctgtcatgccacaagtgtaccatgagtctcgggaggatgcggaacgcgtaagaggacggcacttgttgggcatgtcatcttggcgtgctccgcacgagaatgccaggaagccaatacgaatatacctcaattatgatgccgtcggccattcgcccgaccgtgattgtaaaaatgttggcgacatcgtgaagcttggcgaacctcctgtaccatcagcaccaggaacacctatatgcgatcctcatggtgatccaccactggtgggagactgctggtacaattgcacccttgaggacatagctgggaaagacaagaggcaacgtctccgtaaggcactggggcaaacagtagagtggtttagaaaagctctagctgttgaacctgtcaaggggaacctacggctcagtgggtactcagcttgtggtcaggatggaggtgtacaactacctcatgcgtatgttgaagatggtgttgctaatgctgatttagtcctcttagtaacaactagaccaacaacaggtaacacccttgcatgggctgtggcctgtgaacgtgaccagtggggtcgggccattgcaggacatgttaatgtggcccctcgtcatttgacagctgaagctgaaacattactttcagctactctaatacacgaggttatgcatgttctagggtttgatcctcatgccttcacacattttcgtgatgaaggccaaaggagacgtggtcaggttactgctcaaagtttggataaaaagcttggaagaatggttactcgtgttgtcttaccacgagttgtcatgcacgcgagacatcattatggagcattttcccaaaacttcactgggttagaattggaagacgggggaggccggggcacctcaggttcacattgggagaagaggctcttaatgaatgagatcatgactgggtcagtggatacgagatcagtggtttcaagaatgactttagcattactggaggacagtggatggtatcaagctaattacagcatggctgaacatttagattggggtcagaatcagggaacagagtttgttatatctccttgcaactcatggaaaggggcataccattgcaatacaactcaactatcaggatgcacatataatagggaggcagaaggttactgccctatagtaaactatagtggggacttgcccaagtgggctcaatattttccccaagccaataaaggtggtcaatcttcattagcagactactgcacatactatgttgcttattctgatggttcatgcactgatgtaaatagtgcacgggcgcctgacagaatgttaggtgaagtgcgaggaagtaattcgaggtgcatggcctcaacactagtgcgaactgggtttgtacggggatctatgacccaaggaaatggctgttatcagcaccgctgcacgaacaactcactagaggttgctgttgatgggatctggaagtcatgtccgcaatctggtgggcctgttcagtttccaggattcaacggggaattaatttgtccgatgtatcatgagttgtgtactactgtaccagttccaatgactggccaatgtccaaagtcatgcagttttaacggtgactgcattgatggaacctgtcactgctttcctggttttcatggccatgactgcagcagaagatcttgcccagacaagtgcagtaaccatggtacatgcaaagctaatgggatctgtgaatgtcaaagtggatggacagggattgactgctctacagcggtttgcgatgaacaatgtagtttacatgcaggctacacatgtcagaagggttctgcaatactgcccagtctgtcaatgtgtcatgatgtacttgttagagattcagatgggcagcattgtgcgccaagtgagctcagtatactacagcagcttgaaactgtagttctcgtgccaaattacaatagattgatgccaagtgggcggaccttccttaacttcttcaacaatgccaactgtgcagcagctgcaaagcggctagcctgctggatctcaattcaacggtgtgacgaggatggggacaacaggctccgggtatgctactctgcatgcgaattgtacaatacagcttgtggagcgggtctggattgttcagaccagaccctttttagcaaaagggaagaagaagagaagggtgttccgtgcacaggatatggcgagaagaagtctttctggctataacatctctgaagcttcttccgttatggctctggtagaagctcagcgtttgtgtaaagtattttccaccccaaattattttctcttttttccccatttcatccactacttcccaattgtaggacacgggaagtaagcgtccgtttcacctaggcacccgaagatgggctgccctggtgtacaagctatgttggagtgggctctttgttagaaggttagtctgacatgaaaaggggagtggaccggtgagagttggatggtagatttttcgttttcaccgcttcagaattagtgattggaatgaatgtaaagattgatgtgtcttgtacacactctttacagaatcatttcaatgggagcccgtgttgtgttctttgctccacgcggccatgccccttgccccaaaaaaaaaaagaaaaaaaaaaaaaaaaaaggttgattgacgcatccttggccaacacagtggcagtggcttcgcttatgttcaactggaattcgttataacatagatgatgacgcttgtgggtgattacttcgcttagcggctgccgtggaactagatcctgtattgctgatccctgatggcttgatacgagtgttggagccgtcacatgacatttagcacaagtatgtcacaatataaacagcagtaacgaagtgtcaaggacagtagttatatgagcagctttcgttgttggaaaaagtatatattactgtgatggaatagtcattttggccgctcaactattgcctaaggcgcaaattagtccctgactgtacttcgaaaatatttgcttcaatcatcaacctttacttg

SEQ ID NO: 6977 - DNA, 948 bp, Zea mays
aactcctttcccccctccagttcccacttcattgtgtttaacaaattgtacaatacagcttgtggagcgggtctggattgttcagaccagaccctttttagcaaaagggaagaagaagagaagggtgttccgtgcacaggatatggcgagaagaagtctttctggctataacatctctgaagcttcttccgttatggctctggtagaagctcagcgtttgtgtaaagtattttccaccccaaattattttctcttttttccccatttcatccactacttcccaattgtaggacacgggaagtaagcgtccgtttcacctaggcacccgaagatgggctgccctggtgtacaagctatgttggagtgggctctttgttagaaggttagtctgacatgaaaaggggagtggacctggtggtgaaagttggatggtagatttttcgttttcaccgcttcagaattagtgattggaatgaatgtaaagattgatgtgtcttgtacacactctttacagaatcatttcaatgggagcccgtgttgtgttctttgctccacgcggccatgccccttgccccatttcttaagctgtcgttggcttttatgatatttgattgacgcatccttggccaacacagtggcagtggcttcgcttatgttcaactggaattcgttataacatagatgatgacgcttgtgggtgattacttcgcttagcggctgccgtggaactagatcctgtattgctgatccctgatggcttgatacgagtgttggagccgtcacatgacatttagcacaagtatgtcacaatataaacagcagtaacgaagtgtcaaggacagtagttatatgagcagctttcgttgttggaaaaagtatatattactgtgatggaatagtcattttggccgctcaactattgcctaaggcgcaaattagtccctgact

SEQ ID NO: 6978 - DNA, 1296 bp, Zea mays
acatatgttaggtgaagtgcgaggaagtaattcgaggtgcatggcctcaacactagtgcgaactgggtttgtacggggatctatgacccaaggaaatggctgttatcagcaccgctgcacgaacaactcactagaggttgctgttgatgggatctggaagtcatgtccacaatctggtgggcctgttcagtttccaggattcaacggggaattaatttgcccgatgtatcatgagttgtgtactactgtaccagttccaatgactggccaatgtccaaagtcatgcagttttaacggtgactgcattgatggaacctgtcactgctttcctggttttcatggccatgactgcagcagaagatcttgcccagacaagtgcagtaaccatggtacatgcaaagctaatgggatctgtgaatgtcaaagtggatggacagggattgactgctctacagcggtttgcgatgaacaatgtagtttacatggaggggtttgtgataatggtaaatgtgaattccgttgttcagattatgcaggctacacatgtcagaagggttctgcaatactgcccagtctgtcaatgtgtcatgatgtacttgttagagattcagatgggcagcattgtgcgccaagtgagctcagtatactacagcagcttgaaactgtagttctcgtgccaaattacaatagattgatgccaagtgggcggaccttccttaacttcttcaacaatgccaactgtgcagcagctgcaaagcggctagcctgctggatctcaattcaacggtgtgacgaggatggggacaacaggctccgggtatgctactctgcatgcgaattgtacaatacagcttgtggagcgggtctggattgttcagaccagaccctttttagcaaaagggaagaagaagagaagggtgttccgtgcacaggatatggcgagaagaagtctttctggctataacatctctgaagcttcttccgttatggctctggtagaagctcagcgtttgtgtaaagtattttccaccccaaattattttctcttttttccccatttcatccactacttcccaattgtaggacacgggaagtaagcgtccgtttcacctaggcacccgaagatgggctgccctggtgtacaagctatgttggagtgggctctttgttagaaggttagtctgacatgaaaaggggagtggacctggtggtgaaagttggatggcagatttttgggagtaaccgcttcagatgtcccctctcggtttgatgggaactggaggggtgaaatgagtt

SEQ ID NO: 6979 - DNA, 707 bp, Zea mays
ccgttcttcgcttgccttgctcgctttgcctttcccgtctcgactcctcgcattcgctgcgtcgtcaacgcttcttcctccccgcggtctccccttcacctctcggatccggcggccatggcgaggaaccccggctgcaccgtcttcataggtaggtcgtgttgtagacctacacatacctcgtgacaaggaaactagccgaccaaaaggttatgcttttgctgagtatgaaacagaggagattgcccagtatgccattaagctattttctggccttgttcgacttcgtaataaaacacttagatttgcgatctctgggcaagacaaaccctcattaaatggcaatattcctgtaattcctagtttaaactctgtaccacagccaaagcctcctcatcaacatatgaggtctagtgatacccctttgccacaacatacagcagtgagtggcaggagtgctgggtatggtatctcacaaaatcattcatatgacactcacactcaagcaccgtcaagtgggttaccgagtagaggactaagcaacggtacatatgaatatagtagacgtgtatttggttctgttctgaatgatgttagccgtcgagctaccagggaaccaattccatacccgtcctgctagcatgttgagccctggtggctgtgactctatatgctgacagaaaagtctctgaagagttgtctgttga

SEQ ID NO: 6980 - DNA, 864 bp, Zea mays
aaacccctcccccagcccggccgccgttcttcgcttgccttgctcgctttgcctttcccgtctcgactcctcgcattcgctgcgtcgtcaacgcttcttccttcccgcggtctcctcttcgcctctcggatccggcggccatggcgaggaaccccggctgcaccgtcttcataggtaacttggatgacaaggttcctgagagggttctatatgaaattcttattcaggtaggtcgtgttgtagacctacacatacctcgtgacaaggaaactagccgaccaaaaggttatgcttttgctgagtatgaaacagaggagattgcccagtatgccattaagctattttctggccttgttcgacttcataataaaacacttagatttgcgatctctgggcaagacaaaccctcattaaatggcaatattcctgtaactcctagtttgaactctgtaccacagccaaagcctcctcatcaacatatgaggtctagtgatatccctttgccacaacatacagcaatgagtggcaggagtgctgggtatggtatctcacaaaatcattcatatgacacttacactcaagcaccgtcaagtgggttaccgagtagaggactaagcaacggtacatatgaatatagtagacgtgtatttggttctgttctgaatgatgttagccgtcgagctaccagggaaccaattccatacccgtcctgctagcatgttgagccctggtggctgtgactctatatgctgacagaaaaggtctctgaagatgttgtctgttgtctcagccatcagtaaggctatctctgtactcaccatttcatgcctgtaaatatgggttatggtggtaggacatatgctt

SEQ ID NO: 6981 - DNA, 1459 bp, Zea mays
tacatcctcgaggccggccgggaaccgcgggccccgccgtgagtggaaaaatagtaattttcccgctcgcggcttgccactctgcttccgtgcttggcttgctcgctttcctttcccgtctcgactctcgagtctcgactcctcgcattcgccgctgcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcaggtaggtcgtgttgtagacctacacatacctcgtgacaaggaaactagccgaccaaaaggctatgcttttgctgagtatgaaacagaggagattgcccaatatgctgttaagctattttctggtcttgttcgacttcataataaaacgcttagatttgcgatctctgggcaagacaaaccctcattaaatggcaatatccctgtaactcctaggttaaactctgtaccacagccaaagcctcatcaacctatgaggtctagtgatactcctttgccacagcatgcagcagtgaatggcaggaatgccgggtatggtatcccaccaaatcattcatacgacacgcacactcaagcactgtcgagtgggttaccgaatagaggactaagcaacggtacgtatgaatatagtaggcgtgtatttggttctgttctgaatgatgttagccgtcgagctaccagggaaccaatcccgtacccgtcctactagcatgttgagccctggtgactgtgactctatgtgctgacagaaaatatttctgaagatgttgtctgttgtgtcagccacctgtaatatctctgtactcaccatttcatgcctgtaaatatgggttatggtggtaggacatatgcttgtttttttggttctgcttcgcattgtagtgagacttttccctgcttgttaggtccttctcatcccctagtgtgaaggccatgcctccactagtatggctgcactaggaaataccattcctagttacatgaatgggtggcaatatgctggcaattgtgttttaacattagtgccattagctatttcaatgttacagcagggcgtgtttgtgtttgagatattagtatttggtggattttgtgcttctcatcatggatctgggacatctgaaggagaaacattgttttaaaagaaaattgtgaaataagtcccacaatttatgatgtttgagtatatgaatatttggttacatatgactttttgtttgcttgtgctgtatgtctgtcgcagcacaagcattcgtgatccgcccaattggctctcagggtgatcaagttataccgtttctgctaaaaaaaaaaaaaaaagtatttgcaagttgacctgttgtcatttccaagttcattagcgtggaagctggtgctgctgga

SEQ ID NO: 6982 - DNA, 936 bp, Zea mays
ggttcttcgcttgccttgctcgctttgcctttcccgtctcgactcctcgcattcgctgcgtcgtcaacgcttcttccttcccgcggtctccccttcacctctcggatccggcggccatggcgaggaaccccggctgcaccgtcttcataggtaacttggatgacaaggttcctgagagggttctatatgaaattcttattcagatctctgggcaagacaaaccctcattaaatggcaatattcctgtaactcctagtttgaactctgtaccacagccaaagcctcctcatcaacatatgaggtctagtgatacccctttgccacaacatacagcagtgagtggcaggagtgctgggtatggtatctcacaaaatcattcatatgacactcacactcaagcaccgtcaagtgggttaccgagtagaggactaagcaacggtacatatgaatatagtagacgtgtatttggttctgttctgaatgatgttagccgtcgagctaccagggaaccaattccatacccgtcctgctagcatgttgagccctggtggctgtgactctatatgctgacagaaaaggtctctgaagatgttgtctgttgtctcagccatcagtaacgctatctctgtactcaccatttcatgcctgtaaatatgggttatggtggtagggcatatccttgtctgttgggttgttctgattttttgtattgtagtgacccttttcccagttggttaggtccatttcattccttagtgtgaaggtcattcctccaataatatggtagcactaggaattcccaggcattagttgcatgaatgggtggcaatatgctctgcaatcacaatggtgttttaacattaagtgccattagctatttcaatgttatagcagggcgcgtttgtgtttgtcataaaaaaaaaaaaaaaaaaaaaa

SEQ ID NO: 6983 - DNA, 1114 bp, Zea mays
cattgggacctcgagccggcaggaacaggagttagaatgtgagtggcctcgtggccggccgcccgctcgcggcttgccactctgcttccgtgcttggcttgctcgctttcctttcccgtctcgactctcgagtctcgactcctcgcattcgccgctgcgtcaacgtgtcttccttcccgcggtctctccgccgcctcccagatccggcggccatggcaaggaacccgggctgcaccgtcttcataggtaacttggatgacaaggttcctgagagggttctgtatgaaattcttattcagatctctgggcaagacaaaccctcattaaatggcaatatccctgtaactcctaggttaaactctgtaccacagccaaagcctcatcaacctatgaggtctagtgatactcctttgccacagcatgcagcagtgaatggcaggaatgccgggtatggtatcccaccaaatcattcatacgacacgcacactcaagcactgtcgagtgggttaccgaatagaggactaagcaacggtacatatgaatatagtaggcgtgtatttggttctgttctgaatgatgttagccgtcgagctaccagggaaccaatcccgtacccgtcctactagcatgttgagccccggtgactgtgactctgtgctgacagaaaatatttctgaagatgttgtctgttgtgtcagccacctgtaatatctctgtactcaccatttcatgcctgtaaatatgggttatggtggtaggacatatgcttgtttttttggttctgcttcgcattgtagtgagacttgtccctgcttgttaggtccttctcatcccctagtgtgaaggccatgcctccactagtatggctgcactaggaaataccattcctagttacatgaatgggtggcaatatgctggcaattgtgttttaacattagtgccattagctatttcaatgttacagcagggcgtgtttgtgtttgcgatattagtatttggtggattttgtgcttctcatcatgtatctgggacatctgaaggagaaacattgttttaaaagaaaattgtgaaataagtcccacaatttacgaaaaaaaaaaaaaaaaaagcggcc

SEQ ID NO: 6984 - DNA, 767 bp, Zea mays
  misc_feature (743)..(743): n is a, c, g, or t
ctcgaggccggccgggaagataacgcagccaagaacaagagacaccgccgagcgagcgaggcggggagaagcaggtccaggaccaggagaaaggaaaggaagcccagctctctctagcctggagccgagaagccgagggggcgaaggagcagcaaggcatggaggagcccgttccggctgatccccccaggattttctggaagtcaaggagatcagccaatggccggagcctgcaacaagagcctgacaaagacgctaccgaggaaactaacgagcaggctcaagaggaacccatgaagaccgacgacgcaacggatacagcagcagcagcagcagcagctacagctgagccgtacccgaaagctaacctatccgagaagcggaaggctctcttcgagcctctcgagccgatcaacggcaagcgcggcgctgccgagacgctgctcccaccgccggactttgagcccgcgtcgtaccccaaggggtggctggtgggcaagaaacgcaagctcgtcaacgtagacgtcgtggagagcatgcggaggatcgcgatccaggaaatgaacagaaaggttcatgcgtaatcacatctttctagtggtcaggcaatgctgtttcttcactcgatcgtaaatgcatcgatgtgttcagttcaggttgacacatttgaaaaaaatacatcctcaaatgttgttggcttctgtttttaatctgtgataataaagagtacgcgctcatgtatnaaaaaaaaaaaaaaaaaagcggcc

SEQ ID NO: 6985 - DNA, 1238 bp, Zea mays
aacgacgacgacacggccaagaaacggggagtgccttccaaggcgaccgccccctctcgcgctccatacagcacacgtccatccgtcggcccagagccacaagataacgcagccaagaacaagagacaccgccgagcgagcgagcgaggcggggagaagcaggtccaggaccaggagaaaggaaaggaagcccagctctctctagcctggagccgagaagccgagggagcgagggagcagcaaggcatggaggagcccgttccggctgatccccccaggattttctggaagtcaaggagatcagccaatggccggagcctgcaacaagagcctgacaaagacgctaccgaggaaactaacgagcaggctcaagaggaacccatgaagaccgacgacgcaacggatacagcagcagcagcagcagcagctacagctgagccgtacccgaaagctaacctatccgagaagcggaaggctctcttcgagcctctcgagccgatcaacggcaagcgcggcgctgccgagacgctgctcccaccgccggactttgagcccgcgtcgtaccccaaggggtggctggtgggcaagaaacgcaagctcgtcaacgtagacgtcgtggagagcatgcggaggatcgcgatccaggaaatgaacagaaaggaccgtgagatcaatgggctgaacgagcagctagaggaagactcccgcgtgctggagcttctgcagaagcagctggctgacgagcgcaggaagcgggcagagatcgagaaggagaactccatgctccatgagcaggtcaccatgctgatgaacatgctcgacgagaacgagggtttcgacgaggacggagaggccccgccgcccgattccttcgattaagcgttgttacagtactatatccgttttctttttccgtcagtgtgaaatcatacgtctctaggtgctggtttcagagtatccgagagatatgtgctagctgtgtagtaggatttcattggtgatcgtattccattacattacatggctttggcttctgtagataaagggtgcattgcatgtctgttgtaccgtactgtacctactccttttctaggcttcaaaagtgtatgtgagaaactagcaacatgttatatttgaatcgaagtgtatgtacatgttacgtaaaattcttccttgcgaaaaaaaaaaaaaaaagcgcggccaaaattgcaggaaatgtaagcaagatgtgatttccc

SEQ ID NO: 6986 - DNA, 2660 bp, Zea mays
  misc_feature (1246)..(1246): n is a, c, g, or t
acgctcaaaatcccaagttctatcattaaacagatagacatttacaggaatcattgtctttggagggggaatgacacaagctcaaaaaagccgccgctggttgcatggtccacgattactaaacgaaaagtcagtggaggactcggggtgatacgcctagaaactcaaaatgatgctcttctcctaaaattcttccacaagttcttcaatagtcatgatttaccatgggtaaatatcatttggaataactactatacgcctggcagacttcctggtcataaaagaattggctccttctggtggaaaagtatgttgaaacttttcataattttaagggattggcgtacccaatcattggcaatggtagatcaatccttttctgggaagatcagtggaataagagtattccaagtcaacaatatccagaattattctcttttgcacaaagcacaaaactttctatcgcagaggctaaagagcaagatcacttatttcgtatttttcaattgcctatttgtgaacaagcctacgaacagtatttggagttacatgtagtctgggagcaaattgatctaagcactgtaaaggaccgatggagatacatatgggattcagacagttattcaacaaaaaaggcctacagacacctaatggggcagacacatgctcattctatttacaagtgtctatggaaaaacaaatgtcaaccatagcataaagttttctattggttatggcttaaaaacagactcaacactcggaatatgctgtgaaggaaaaacatgacactagagtcatattcatgtgagaactgtttatggcaaagggaggagactctttatcacctgtttctcagatgcaattttgcaaaagcctgttggaatacaattggcataccccccccccagaattgctcaaccagaggaggcctcggcaaatctcaagcaacaacttaacgttcctttttctatggagatcattatactcatgacatggagcatttggaaaagtcgaaatgaatggttatttgaaaacaaagacccttcagtacatcactgtaagaatgaattcagcaaggaattacggacggttgtacacagagcgcgagggaaatatgacaactcaattccgaactggctggatcagtggcagcaataacttttgtattgctctggtcactctttgtagctctttaattagatcttaccagctaacctctaactcttgtaatcacgccgagttgtanctttaaattattaataaaatttaacagtaggggtttcccctcctgatctttcaaaaaaaattgattccagcagcattatgtatgtattagccaatgaaacactagtatttttaatgacgtcactaacgattacaataaactaggccccattaattaaataatgtattcattttgctaggtatgtagtagtttaattaattattttgtccctagttcctcgtgaaatagagatcaattttatcgtcacatctttaaaaattacaaataagatttgtatgaaaagcgaaaaaggccgcctcagcctgtgtttcgctccaagggcccaaaaaatataggtacgggcttgctagtggtgttggctgattgcttactctgacaaattgccatggcttacaggtaaacctgggttgatgccattcatcccgttgccatgggaagcccgaataaagatcatgaaaggagttgccaaggggatgtctgtcctgcatgaattcagccccaaaaagtatgtccatggtgacttgaggccaaacaatgtcctccttgggacaaatatggagccgttcatttcagatttcggccttgggcgacttgcaaacattgctggcgcatcaccatttttgcaatcagaccaagttgaattagaaaaggagcagattcagcaaatagatgcctcagtgagccctctcatgagcaaagggtcatgctaccaagctccggaagcgctgaagacactgaagccctcccagaaatgggacgtttactcctatggcgtggtgttgcttgaaatgatcactggccggtcgccctctgttctcttggaaaccatgcagatggatcttgttcaatgggtccaattctgcatcgaagacaagaaaccttctgccgatgtgctggacccttttcttgcccaggattctgaacaggaaggtgagatgatcgcagtgctgaaagtcgcccttgcatgcgttcaggcgaatccagagcggaggccgtcgatgaggcatgttgcggagaccttggagcgcctcaatggttgacgctaatgaagtgttcccctgataaagttgtgcgattttcggtggaatgggttctagaactcagttgttggacagaagcctaggaggagagggcatgatgctgccttagtgtactccatgtaaaattatcatttccctagtggccactgactgtactggactactgggttgttaacgtgtgaggtagtagctagttaaggtaattagtttgctgttgagacttggaaggtggtagtatcgcgtgcttacttaatattgtgggtatatgaataatgaattagtttaaccatttgtgtgctctctgttatactaattgtgtatcatcttgggcattttctttggataacgggcccgtgtttaggaatattcttaga

SEQ ID NO: 6987 - DNA, 5916 bp, Zea mays
ccaaccgcatcgtcggcgcgcgccagcagataaagccgcccgccgcaccgctcagcccgtagtcatcacaaatgtagaggggcgtcgcgccgggctggacgacaaagtaaaacgccaggtgggacagacgtgactacgacacggcacgttacgctacggcggcaagcggaaacgtcccgttcgaggcctgtgggggtggggctcggcccaattgtcggcatcgaccggctccgctcgcgcgccggcctcgattgcttgccttcgcctggatcgcgtcgccactcgccaccagccgtttgcttccgcccgcgttatcgcatccaaagtgctgcagcctgcaggtgcgcgcgtgtggagtaccgacagccccgcgcggtcgcgacgtggacacggtccggtggcggcggggccagggtacctcgtgcctgacatggcaaacgacacgagtaggtcaagcgttatacatatagagagcaaaattagttgtgtacgtaatcgagtactgtaagcaacggtacgttgtttgtccatgttctttagtttcgttatggatccttacagcaatatccctacaatattcgcacatgtgagataaaacaccataacgttggtgtgctcctacgcacgcagcaagagaaatggtagattgtgtgatccgtctctcacctagtatacgagcttcttcataaatatagaccgtaaaaccgatggaaatgggaagacacacagtgtttattcagtatgtatagttaagtcgtactactcgtactgctacttgtatgcaatgattgtctgtcttaacgttaagagtctccgtacacaatttagtggccatgagacagtcatacggcacggcacagcacagcacaagcaaagccggtacccgctggcagctgccacagcgcggaagtttcgtgaggaagcgggttgttttgtttggccgttggcgccgcgcctggctggcgggctgccgccggcacctgcacctgcactgcagtagcgcagtactgcaccccacggaccgcgcaccacacccacccggcggccggcgcgcaggatccggacccgccaggtgagcaaccagcgtgccggagggaggaccgcgcgccgtgcgggcacgaaaagacgcgggcccaggcggcgcggtggcatggatggcggatcacgcaacggatcctgtcgcggaatgattcgtgcgctgccgctacagatgcagacggcgcggcggcgggcagcccggtccgtcccgcgtcggcaagcgcgggcgcggcgtcctcgtcagcggattctgcggcgaccgtatcctcttgcccgcatcggatgtgggctagcggcgtcaccatggctgccgcggggaaaaaaaaagaaaaagggatgagggactcgaaagagattgtgactgcgacggcctgcggcgtacgtgccgccccatcaaaaccccgtcaaaaatatcgcgtcgggccgacgacgtcggggcccgtgcccgtcagtcgccgcaccgaacgtgcgtgcgtgcgtgccggcgcggcgcccgccatctgctgctggcgacggacggtaacaggtgagcggagcggtgtggaggcgagtgggtcgtcgctgccgtgtcgggcaccaggtcgccgccgggtcgcccccgccgcccccacgtctccatcccctcgaacgcgtacgcaggtcgcgagggtcgtgccggcgggtttctgcttggcgggcgggcgacgtctgaattgcggactccgcaggcagccactgactcggttgtgtcattgtgtgccgggtcgtgagtccactcactgccatccgtgcccgtggtttccagaatttagaatcatgtggtgtgagtcgccggaccatcagcggaaaccggctaaccattcccttctctctcttttttttttctcagaaagctttcagctgtacctgcagatggttaacctctgcaaacacgtatccaccgtacgtgtggccgacaacgttcggtcactgactgcacggccctactagaggatgatatcttcgtgtgattgctttgactggcccgtggcccctgacgctaatccgcgtagtaggtggtgcgattgcgttgcgtgaacccaacctgtacgcctgacaactgagtcgagatggggggtgttggggacgcacggttgctgggagtcagcgaaggatcgtgctgggcccgacctcacgtttcaggttccgatggtatatgacaagtccagaccacggcccggcctgaccgcctcgaaaggccatggaccggaaccggaaggccttggatccgaacatcactggatccgcagctggatagggtcattatcttttacaacctgttttcaaaaggttcttatacttaaaaatgtatggattatacatcgtaaaattatatcgcaacaaatttattcaaaatcgatagctaaaggtacaaatgcttcgttcagacgaaactaacacgacatgaataaaaacggagtacaccctgaatgagggcgagtggcacacgagagcaattcagaggtaccttcaacaatcaagacggtttaaattggctcctgagaaggtttcaaaaaagtgcaatgggcacgaagacaattaaaaaaactcgtgaatcatgcaaagcaaatattaaagcgcagtaattctaaccatggaagagaatcatagcttgacatatctgaggccgacagtgaaactggaaggaaggtctatacgcatggggcgatatttttcggataaaaataccaggatttgaatgagctccacaaggaaacaatgatcagatgacagtcctaaccagcctgtaggacatagaggctcgctacagatagtctgcaaaagcacatttaacattcagatacgagcaatgaatggagttgatatttaacagagacgtttggcgggtcttgaggttttagaagcacttactactaatctgcactgcccatatagataatttttcactgccccttagctagaatgaagtgaagtaatgaaaaagctatgcaatagcagataatggaagaattggcagaaagtaaattcacttctagattaggagacctgcccattgatggtatgcaatagcccgttgttggtgctctactactacaagcaggactcaggagtgtctgtcgtcgtctgtctcgtctcgccgcagcttcctctttctccctctgcacagcttttctccctctccacaggctccagcagccatggccgagacgagaacggcctgtgggatggtggacgacgtccaaaacgcacccactgggtgtgagagcgacctcgaggccattgagctcgcgtgcttcagtcacggtcacggagcacaacagcaagaccgaaagacatgtcactctgcataaacctagttgatatcgttggagccaccactgatgcatcccatgtataatatatgtgcagaacgtgatgccaggaccatgcattttactgtcgaggtggatgccggcagcggaaagaagctgtgcaaggccaaggtgggggcggtgtggaacaacttcaagcagctgtagaagcatcgatcccatcttggattccgcagtcacctgacatgaggtacaagttctttcacaggtgtagcgcgcacacaaataaaaagagggaatacgaccgaaatagatttgcaaaaccttgagctggcgagtcgcaatcactgctggaactttttccttgtgcttggataaccatgtttcaggaaataaaggtatcatctcccagtatgatgacgcgttatccctgaaggctcgcaatcttttcgctggaggccggagcacaacagcgaaagaatttagctgttggacatgaagggcttgtttggttcgtggctaaccgtgtcacactttgcctaaggttagtcgtctgaattgaagaactaatcttgggcagaaaagttagacaaaatatggcgacttagtcatcaaaccaaacatgcccgaaatacatctcaccggaaaagtataataatatgatgaataaaccagcctctttaccaggtctatcatatatgaaaatattgactcctgtcatggaatgagctgtgataagtaatctgaaactctttcttgctttttatttgccatacatgcatccagcaagatcttcctcaactatccaatgaagcataagcatataattaacattaaactggagagcaactggagacaggagtgtacaagtacaactggtactacatgccaaagcactacgtgttgagcgaatctagcttcggaacgttacagtcaactagccagccaaccttaaacctctggcacattataagctgcatctgcagctttggcggctatgatacacatgatacatgagaatctctaaagagttaagatgaacctacaactgtcctgctatcctacttatccactctgaaagctataagggcagagctagtcttgattgtcataatacccattctctccaatctgtatttttttttacaaagcaaactggacagggcccatctccatattgttcatgtcaggcagttcccaagcacccagaaagtgcaacagatggtcccgcagtggctgcaacggaactagtcgctggatcgactgggcttggggtggcactgtaatctcatcttcttcatcagttggatctaaattcaagtcaatgttcctgagcaaaccccttggagtgggttcagttgcatctaagacctcatcaaatggactatgccatcaaatgagtggttgaactgctccttgatgtagtagcctcttttgcttcagttgcatcttaagacctcatcggctatctccacttttaggctactagcttgctagattggttctccacgaattgtttatgaactatgacaacacccgctaagttccacacgtccgcggcagcctctcacacaagtacacaacccctcgcacaacctgtcattgcctgtatggttttctgctttctgcacacaagaaacttaatcagcaaaaagagctcaaaagtcatagggcctgtttggttcctttagtctatggactaaagtttagtcccaaccctgtttagttttagggactaaaaatattcaaaacgcattaaatgacttataagaagaccaaaatgcctcttaacattgttcaaaagggacctcaaaccaaaagggaccttaggctcaatagaaaacgggattatcatagccataaggagattgataaaattgttcaaaacatgccttttgacaaagctccagtccttaatggatttaatggaaagtttctgagacacatcatcaaaattgatttttataaactttgtcatgatttttatgatggtaacattaatctggatggaattaacacctctttcatcgctctcatcccaaaggtgaacaaccctgttagggtgaatgattttaggccaatctctcttctcagtatagccatcaaattaatcacaaagctattggtgaataggctgaagcctgtgattcaacgaattgtgcacaaaaatcaatatgattttattaaaaacagaaccatacaggattgtgtcttgcttggtgctatgaatacttacatcagtgccatctttctagaaaggaagtggttgttctcaaattttgataaagcttttaatacagtggagcatagtgtcattattgctatactcaatcagttgggttttcccgtcaggtggattcgttgggtcagttcaaccttaaattctgaatcctctactgttcttttaaatggtgtttctgggaaaaaaaattctttgcaaaagaggtgttaggcagggggatcctttatctcccttgctctttgtgattgcaactgagcttctccaatacatcattagtaaggctacccatcttagggttttatcccttcctattgagcatatgttttgtctgaaagaaattcttcg

SEQ ID NO: 6988 - DNA, 1177 bp, Zea mays
gcggtgacgaccgacagagccgccgccttacgtccagctgccacggtacttcatcgggccctttgccggtgcaggcggcgcagcacccaccgcaccaggattctgattgctcttcattaggctataaatggcaggaaggcaccgggcaccccgacaataccatgatgaacctcgaggataccgtgatggtccaccacctccacttccacgaccaagacctctctcaccgcgtcgcatggcagaggaactgtctaggcgccgtgctgagatccgtagaatccatgaggacaatcagcgtctggcggatgaaattgttagtctcaagcaaaccatgccgcgtttgcaagaagacctccgaatctcaagccaggctgttccaaagctccgggcagagaaagagctcgagtcgagggagctgactcagaggaacctgaagctggaagctgagctgcgtgccttagaacccctcaggcaagacgctctgcatctgcgatctgaagcaagtaaactgcagtctctgaggcaagagttggctgcgaaggttcaaggcctatcaaaagagcttgaacttcagaagtctgaaagccagaaaatgactgctttggtagctgaacgtgatgcgctgtgtcaagaactgctccaggctagggcgaaccttgagtttgagaagaaggcgaagccagagctgactgcgcaggttcaggcaatggagaaggatcttgtggctatggctcaggaggcggagaagctgagggctgatatcgcgaagagaaacacacctactagtttcagcagccgtggaacgtatggagcctcgttgtcgactcctgggatgggtttgcaaggcatgtatgatggcggcggctattctatggctgggagccgctacggcagtggcactggggcttggagctcgcacgatccccatggctacccgcatctttaactgtgcttctgaccggtgttttctcctgaacagctccctgagtaccttggctaagtttcttgtagtagtataacttgtggtgcaccattgctacccttcctctggtcaatacacaacaatataccaactttggttgtcttggttgtttttcccctactgcacacggtgacgctgttgtgagcattagatgtttggccactcggccgttttgccgtggtgagttttggcttt

SEQ ID NO: 6989 - DNA, 1323 bp, Zea mays
attatttgtattcgggtctgattgaatctcgaagtgtatgcatgttttttgcctactaacttcgattttttttcgtgtatatatgtgtgcaccccatgccctgggtccgcctgtgtgtgaatattttgtggatcggacaagttcctgtaaattgcagttgcagtatactttggttgcttccttgttgcaaaatgagcaaatgtaagagccatggggcagagggtctgaaatttgcttagaaaacttcgagggcgaggaactgatacatatgttgttgtctttgacgccaaggttataaatgacagagaggcatcgtgcatctcggcaatatcatgacgaccctcgggggtatcgtgaagctccacctcctccacttgcacgaacaaggcttctctctccgcgacgcttggaagctccgcctcctccacttgcacgaacgaggcttctctctccgcgacacttggacgaggaattgtctagtcgccgtgccgagatgcgcagaatccgtggagacaatcagcgtctggcagatgaaattgtcagtctcaggcaaaccatgcctcgtttgaaagaagacctccaagtctcaagtcaagctgtaccaaagctccgggcagagaaagagcttgaatcgagggagctgactcagaggaatctgaagctggaagctgagctacgtgccttagaaccccttaggcaagatgctttgcatctgcgatctgaagcaagtaaactacaatctttgaagcaagagttggctgcaaaggttcaaggtctatcaaaagagcttgaacatcagaaatctgaaagccagaaaatgactgctatggtagctgaacgtgatgctctgtgtcaagaattgttgcaggccagggctaatcttgagtttgagaagaaggcaaaaccagagcttactgcacaggttcaggcaatggagaaggatcttgtagctatggctcaagaggctgagaagctaagggctgatatttcgaagagaaacacacctagtttcagcggccgtggagcttatggaacttctttgtcgacgcctgggatgggtttgcaaggcatgtatgatggcggctatgctacggccgggagccgctatggcagtggcgctggggcttggagctcgcatgatccccatggttacccgcatctgtaattgtgcttctgacccgtattcactcctgaacagctcctagagtactttggcaattttctgtagtagtatataacttgtgctttttggtgcaccacattgctaccctttctggtcaatgaaatgcagtgtattgcgaaagcgaaaaaaaaaaaaaaaaa

SEQ ID NO: 6990 - DNA, 1187 bp, Zea mays
  misc_feature (1125)..(1125): n is a, c, g, or t
  misc_feature (1138)..(1139): n is a, c, g, or t
  misc_feature (1148)..(1149): n is a, c, g, or t
  misc_feature (1158)..(1159): n is a, c, g, or t
  misc_feature (1164)..(1164): n is a, c, g, or t
  misc_feature (1174)..(1175): n is a, c, g, or t
  misc_feature (1181)..(1181): n is a, c, g, or t
aagctgtaaaaacccccccgaaccgaagaccggggctcctgcgttcgtttctcttctcgacggggacgaccgccagagccgccgccttacgtccagctgccacggtacttcatcgggccctttgccggtgcaggcggcgcagcacccaccgcaccaggctataaatggcaggaaggcaccgggcaccccgacaataccatgatgaacctcgaggataccgtgatggtccaccacctccacttccacgaccaagacctctctcaccgcgtcgcatggcagaggaactgtctaggcgccgtgctgagatccgtagaatccatgaggacaatcagcgtctggcggatgaaattgttagtctcaagcaaaccatgccgcgtttgcaagaagacctccgaatctcaagccaggctgttccaaagctccgggcagagaaagagctcgagtcgagggagctgactcagaggaacctgaagctggaagctgagctgcgtgccttagaacccctcaggcaagacgctctgcatctgcgatctgaagcaagtaaactgcagtctctgaggcaagagttggctgcgaaggttcaaggcctatcaaaagagcttgaacttcagaagtctgaaagccagaaaatgactgctttggtagctgaacgtgatgcgctgtgtcaagaactgctccaggctagggcgaaccttgagtttgagaagaaggcgaagccagagctgactgcgcaggttcaggcaatggagaaggatcttgtggctatggctcacgaggcggagaagctgagggctgatatcgcgaagagaaccacacctactagtttcagcagccgtggaacgtatggagcctcgttgtcgactcctgggatgggtttgcaaggcatgtatgatggcggcggctattctatggctgggagccgctacggcagtggcactggggcttggagctcgcacgatccccatggctacccgcatctttaactgtgcttctgaccggtgttttctcctgaacagctccctgagtaccttggctaagtttcttgtagtagtataacttgtggtgcaccattgctacccttcctctggtcaatacacaacaaatataaccaaactttgagttgtnctaaaaaaaaaannaaaaaaaannagggcggcnncgctnctagaggatnnccaagncttacg

SEQ ID NO: 6991 - DNA, 1374 bp, Zea mays
cctcgagcacggctgttgaaaacaaaaatcggcccgatagggcacgccgagagaagcaagctgtaaaaacagccccgaaccgaagaactgttctcctgcgttcgtttctcttctcgacggggacgaccgccagagccgccgccttacgtccagctgccacggtacttcatcgggccctttgccggtgcaggcggcgcagcacccaccgcaccaggattctgattgctcttcattaggctataaatggcaggaaggcaccgggcaccccgacaataccatgatgaacctcgaggataccgtgatggtccaccacctccacttccacgaccaagacctctctcaccgcgtcgcatggcagaggaactgtctaggcgccgtgctgagatccgtagaatccatgaggacaatcagcgtctggcggatgaaattgttagtctcaagcaaaccatgccgcgtttgcaagaagacctccgaatctcaagccaggctgttccaaagctccgggcagagaaagagctcgagtcgagggagctgactcagaggaacctgaagctggaagctgagctgcgtgccttagaacccctcaggcaagacgctctgcatctgcgatctgaagcaagtaaactgcagtctctgaggcaagagttggctgcgaaggttcaaggcctatcaaaagagcttgaacttcagaagtctgaaagccagaaaatgactgctttggtagctgaacgtgatgcgctgtgtcaagaactgctccaggctagggcgaaccttgagtttgagaagaaggcgaagccagagctgactgcgcaggttcaggcaatggagaaggatcttgtggctatggctcaggaggcggagaagctgagggctgatatcgcgaagagaaacacacctactagtttcagcagccgtggaacgtatggagcctcgttgtcgactcctgggatgggtttgcaaggcatgtatgatggcggcggctattctatggctgggagccgctacggcagtggcactggggcttggagctcgcacgatccccatggctacccgcatctttaactgtgcttctgaccggtgttttctcctgaacagctccctgagtaccttggctaagtttcttgtagtagtataacttgtggtgcaccattgctggtaaaccatggcacctgctacggttgatgctgcctcatccgtcttggaagataaatctgtaaattcggtctgaatctcaggcggttgttgtatcaacaagtcctggcacaaagccttcgttgtaataatataagcattgcatggagctgtgtgctgaatgtgtgctacggtactttcaatactgggctcagcatcaatccagaagatgtactctaaaca

SEQ ID NO: 6992 - DNA, 1246 bp, Zea mays
ggattgaaggagatgatgcgcgcgatacagcagctggcacgttcgttaccggtgcgggccagcatgaacgaactatctatcgtagcacgctagcacgcatctgttcccgtctcctcagcctccgtctcaaactcgcccggtcatcccatctccaccaccacatccgtcctcttccgccgccgccgatggcccgcctcctcacacaaaccctcaccctagcccgtcccgccgcctcctcctcccccaccgccgcattcgcctccctccgttgcctcgctaccaaggtcgagatcgtcgagatcgacctcaccgaggaagacgctggctcctcggcccacggctcctccccctcgtccccatcgatcgaggtggttgggatccggcgcctggaggaggccatccacggcgtcatggtgcgccgcgccgctcccgattggctgcccttcgtgcctggagggtcctactgggtgcccccgctgcgcctcccgcacgaggtcaccgcgtttgtcggccggatcgcggcctcaggaggcgcctccggggtcgccaagttcatggacggtgtcgcggcccctgggggcgccggggccgttggcggcgcgttcgaagtcgtggaactcgacgacgacgagctcatggaggaggaggaggaggaggcgctttgcttctccaccacgcgcggctggccctcggcctctttcttcgtccaagggaaatctccggatacaaggaggaaatctaggaaaggtgcaattcaaactgatgatgaagaaagctgattcgtttgtgctatgttgcaaggggctcctaaaaggaaacgcagtgcagagtttaatgactgccatgatcaatgtacatttggatgggaatgagccatttgctggtaaaccatggcacctgctactgttgatgttgcctcatccgacctggaagatatatctgtaaattcaggctgaagctcaggtggttattgtatcaacaagccctggcacaaaaggcttcgtttgtaacatactaacaataaagcattgattgacctgtttgctgaatgtgtgatacggtacttccaatactagggtcagcatcagtccagaagctgtaccctgaacaaagattctggatggcttcttgtgccagctaggaacaatgtaaaattgatgtaagcatctgtgcccactccggatccatgtacaactaagttaaaaattttaaactgttatagattgttgcaaaaaaaaaaaaaaaa

SEQ ID NO: 6993 - DNA, 1101 bp, Zea mays
ttgggaccctcgccggcccccgcgccatctgttcccatctcttctgcctccgtctcaatctcgaccggtcaccccatctccaccgccacatccgtcgtcttccgccgccgccgatggcccgcctcctcacgcaaaccctcaccctagcccgccccgcctcctccccctccactaccgccgcatccgcttccctccgtggcctcgccaccaaggtcgagatcatcgagatcgatctcgccgaggaagacgctggctcctcgtcccacggctccccctcctcgtccccgtcggtcgaggcggtcgggatccggcgcctggaggaggccatccacggcgtcatggtgcgccgcgccgcgcccgactggctccccttcgtgccgggagggtccttctgggtgcccccgctgcgccgcccgcacggggtcgccgagctcgttggccggatcgcggctgctgggggcaccgaagggggcgccggggccgttggtggcgcggtcgaagtcttggagctcgacgcgcccatgacggaggagcaggcgttttgtttctccaccacgcgcggctggccctcggcctctttcttcgtcgaagggaaatctacacatttgaggaaatcgaggaaaggtgcaactcaaactgatgatgaagaaagctgattcgtttgtgctatgttgcaaggggctcctacaagaaaacacagtgcagagttggatgactgccaagattaatgtagatatggatgcaaggagcctattgctggtaaaccatggcacctgctacggttgatgctgcctcatccgtcttggaagataaatctgtaaattcggtctgaatctcaggtggttgttgtatcaagtcctggcacaaagccttcggttgtaataagcattgcatggagctgtgtgctgaatgtgtgctacggtacattcaaagctgggctcagcatcaatccagaagctgtactctaaacaaagattctggatggcttcctgtgccaactaggaacaatgtaaaatttatgcaagcatctctgcccactcctgatccatgtaaaactaagctaaaagcttaaattgttgtcatatcgacagttttaggagt

SEQ ID NO: 6994 - DNA, 1904 bp, Zea mays
ctcaatttatatgtattgaggtgtattgtggtgtaacttaaaactaaattgcattctaatccactataaatccacaatacatggattgatgtgaatatgagaatattcaaacgaggccttagtgggcacacgttggcacggtatggcgcccacatcagccagtcccctgatctactacggtggtgaccaagtggatggcatcagcactgtttagatttagatatgcaagagggattgatgtggctaaacggggtttttaattagttttcgaacagttatttttaaaattattttagaaaagatttaaaaataaattttcgtcattggagggtagttgggccgagtggaataatacataggcttctttttctgccttggtgggctgcactctgtttcatccgtaccgcgcgcccgtcccttccctcgatcgtccttgtccggcgcctaatcaaaaacagaatctctaattctctcaactcaaaaccctaacatccgtccccactccccaatcaacctgccgccgcccgccagcaccaaacttccatccgccccgagctctgcctccgccgccgccgcgccatgaggcctctcgacgagaaggagacgactcaggtattcgagaagctgttcaagttcacggggcccaacctgaagcacctcctggagcgccccgcagtggagggccccgacgcggagcccggccgctactgcctccggcttcaccgcaatcgcgtctactacgcctccgaggcgctcgtgcgccgcgccaccgccgtgtcccgaccgcgcctcgccggcgtggggacgcccatcggcaagttcacccaccacggcgcgttccaccttacggtccacgcgctcgacctcctcgctgcgcacgcgcgccgccgcgtctggctcaagcccgacaccgagcgttcctttctctttggcaactccgtgcccaagtcttctctcgctcgcatcaccgagaacaccaaggccggggacggggtggtcgtcatgtccatggctgacgtcccgctcgggttcggcattgcggcgaggtcggcgcaggattgcaggaaggccgacaccaacgccgtggtcgtgctgcaccagtcggacgccggggagtacctccgcaaggaggaggagctcatgtgaggtgagcgcataggcttggctggttaggtcatattcatgagtgaattatggaagattgtgccttactgttgtgtgttccaaggcttggggcatatatatatgtactgaatgattaatcactggttatgagatgcgattatcgctgttgccaaaaaaaaaaaaaaaaagctggaggaacaggattgttcttgaatggttttgttcgtcattttgttgggttcatctgaatagcttgatcttacatatttttctcaattgacattgtttccatgtggaatggtactcaaatcaaatcagaaggttaggcatagaatttaggataacctagtgcttgctcattcctcagactaagatctcatacattaatgttaatatgttattccacttttcaaccattaagaatttaggattcataagttctatatgggatcttattttctttggttttcatataccaatgatgccaatggtgccgttgaggctactcctaagtcgtacatgggaattgcttctgctgctgctcgtaagttgcacatggcaattgcttctgctgctgccaatcatgaaaatggagttgatgatctttcttcagtaaaaacagtactggattttaacttccgtagtgtgaatgatctactaatgcttgtgcggatttcaaaggaacccatcagctgctgaagtgttcttgatgtttgatccaactaactccgtccctgttggttgtttattccaattaactccgttcctgttggctgttt

SEQ ID NO: 6995 - DNA, 901 bp, Zea mays
tccccactccccaatccacctgccgccgcccgcaagcaccaaacctccatccgccccaagcaccgccgccgcgccatgaggcctctcgacgagaaggagacgactcaggtattcgagaagctgttcaagttcacggggcccaacctgaagcacctcctggagcgccccgcagtggagggccccgacgcggagcccggccgctactgcctccgccttcaccgcaatcgcgtctactacgcctccgaggcgctcgtgcgccgcgccaccgccgtgtcccgaccgcgcctcgccggcgtggggacgcccatcggcaagttcacccaccacggcgcgttccaccttacggtccacgcgctcgacctcctcgctgcgcacgcgcgccgccgcgtctggctcaagcccgacaccgagcgttcctttctctttggcaactctgtgcccaagtcttctctcgctcgcatcaccgagaacaccaaggccggggacggggtggtcgtcatgtccatggctgacgtcccgctcgggttcggcattgcggcgaggtcggcgcaggattgcaggaaggccgacaccaacgccgtcgtcgtgctgcaccagtcggacgccggggagtacctccgcaaggaggaggagctcatgtgaggtgagcgcataggcttggctggttaggtcatattcatgagtgaattatggaagattgtgccctactgttgtgtgttccaaggcttggggcatatatatatgtactgaatgattaatcactggttatgagatgcgattatcgctgttgccagatttgacctttagcagctggaggaacaggattgttcttgaatggttttgttcgtcattttgttgggttcatctgaatagcttgatcttaaaaaaaaaaaaaaaaaaa

SEQ ID NO: 6996 - DNA, 1124 bp, Zea mays
atttttttttttttttttgctacacagaaaccccctagtctgaataagtatttaccatacaaagcacaagcaaaattgttttctgttttgctaaaaaaaattgtttttcatggtttcaccaattcttcaaaaacacaacatcctcgttgttactattattaccattacaagtaacctcacaatatctgaagcagcaggttccatattattccttttggcaggagagatcagatggcaggagtgtgttccaagacgaagcgatggaagtcctgttggactctctatcatctcaagaaaacagtagagtacaggcattatcagcatgttttctttcaaacctcggagggacttattcctggtcaggagaatcgtacactgcagcatggctcacaaagaaagctggtctcacatcaacatcacaaagaaatacaatcaggaacatcgactggcttgattcttgcagaattgcctcttatgcactgcatggctcggaagcgagctggctgcccttggtgaaaatgccataagatattctgcttgtgagatcttgttgcatgacatagcaagtcaccttcatccaggaaatgagcttgacgaaagggttctagcatgcatgtgtctctataattacacctctgagccgaggcacccccagcgcgccgccgtaaacaaacggtcttggcgcatttggccgagcacctcgccggcaccttccgtgtctgtctgtgcagacgatgcctaaccttgccgcctaacattccaagagaagcacgagccgtaccgctgtacagcagctgatactgacagctcttgtcctgattccttgaatttcccccggcttggtgagtccgtgtggtgcgcagggtgccaggacgacccagcccatgtggaagtcaaagaatgtaccaccggcaacccaacagcaggactgcaggagcacgacgcaacgaaacggacggcgacgatgatgatgatgccgtgcgcggtgcgccctgctcgagccgagtctggctgctgtgtcgtcgcctggtttggcagattttaggcgcattcgttgcctgcaactgcattggatcaaaaaaaaaactattccccatgcctgtcatgtgccggcatatgctcac

SEQ ID NO: 6997 - DNA, 1283 bp, Zea mays
  misc_feature (1209)..(1211): n is a, c, g, or t
atatcgctgccgtaactaaagcagcctggctgtgcctacacgcttgccttatcttctcccgttcaccccgccgtgcgcgcgcgcccccgcggcgacaaccgggcgaccgccgccgacctacgccaggtgccaagccgttcctcagtcccatcacgaggccttcaacgagcccttcgccggcgacgagaaaatttgattctagttaactattcaagaagtaggagatgatgagctacttccaaaccactacttgcaagcctcaaagcagggtcgttgtgaacaaacctataccaggtcttgggagcacaagtcagcatccgttatattcacatgctctcagattccacaggctgcaacagaaggtgtacccaaggctacttctcgttgctgctagccacaaaaggcttactcctgtatgtgtcttaagtggaaagggaaatgctggcactgctgatgatcctttgatggaatctttgaagaaagctatggctgatgcaaaaaagcccaggtccatacaagacttgctgaaggagcaggtggctaaactcagagaacaagcatccggtggaggcggagggaatgggaatcgccgtggaggcagtggtggttctggtggcccagatgatgagtccttcaaggaagcattggatgaagtagtccaagttatcttagccactgttgctttcatacttgtgtacatccacataatcagaggggaggagctttaccgtcttgccagggactacaccagatatctcgtcactggtaagagaactgcccgactgaagcgttccatgcaaaagtggcacaacttctccgagagcttcatgcagaaggaaggctcagaagaggaccaatatgagaaacctacatggtggcaacagcctcagaaacttgtgcatcttatggaggagctttgcaggggaaactggcgtccccatgcccaggagtcgtagttgatggtgtaccatcacgcccctcttttttttttttttttttgacccattgcagaatgcaaaataggaacgtgggctggtgcagtggagtaaggtcgcctggaccagtgttttcttttgttgttctttatcgggtatttgtctctggtttcttaaaagtatgtagagagtgagtgaattcgtggcatttttgcagttgatgggaccgtgttttgagactgtaacctgccaatcaagcgttggagattccccnnnaaaaaaaatataaaaaatatgaaaaaaaaaaaaaaaaaaaaaataaaaataaaaaaaaaaaaaaaaaaatag

SEQ ID NO: 6998 - DNA, 1315 bp, Zea mays
gattgggatcctcgaggccggcccccccccccgttctcttatctcccccatcttcgtcgtcctcacagcgccggcgctccatcttccgttccttcccttactcgcgctcggcacgcaggcgacggcggcggcggcggcgctcaggctcgggctcgggctctcagcgacggcgtcagcggcttcccctcccgcctctcgctagtcgactcgcgccctcgcatccgttcctccgcacaccggccggtgaccctgcgtttcgttcttgttaactattcaagaagtaggaaatgatgagcaacttccaagccactacttgcaagcctcacagtaggatcattgtgaagaaacctatagcaagtcttggaagcacatgtcagtatccattatattcacatgctctcggattccacacgttgcaagagaaggtgtacccaaggctagttctcatttctgctagccacaaaaggcttacttctgtatgtgccttaagtggaaagggaagctctggcactgctgatgaccctttgatggaatctttgaagaaagctgtggctgatgcaaaaaagccccgttccatacaagacttactgaaggagcaggtggctaaactgagagaacaagcgtctggtggaggcagagggaatgggaatcgccgtggaggcagtggtggttctggtggcccagatgatgaatcgttcaaggaaacattggatgaagtagtgcaagttatcttagccactgttgctttcatacttgtgtacatccacataatcagaggggaggagctttaccgtcttgccagggactacaccagatatctcgtcaccggtaagaggactgcccgactgaagcgtgccatgcaaaggtggcgcaacttctcggagagcttcatgcagaaggcaggctcagaagacgaccaatatgagagaccagctgtgtcaaaacctgcatggtggcaacagcctcagaaatttgtgcattttgtggaggacctttgcaggggaaactggcgtccccatgctcaggagtcttagttgatggagtaccccccgacccattgcagaatgcatacttggctgtgattggagcaaggtcgcctgtcaggctgtcacctggggcaggttttttttttttgttatttatcggatatttgccactggtttcttaggagtatgtagaaagtcgctgaattgttggcaattttgcagttgatagaacctcgttttgagactctaacctgccaagtcgggtgtggaattgtttattaataagctgtttggtttgaggaatgatcaaaaaaaaaaaaaaaaagctc

SEQ ID NO: 6999 - DNA, 10704 bp, Zea mays
tatccatataattttatagtatttggaccttgattgttgcctgcgtccacataaacatatatatttatatgttttattaaaataaagtctatccatataatatatagaaattgtagcaatgtacaagtaagtgactagtttaatttatgggttatgcacgggtgatgttcctgatgagactaaggaccttcaagcagagggttgctcctagataggagggtctataagcctgttcgttttcatcttaattcatatggattgaattgattgggtgaatttaaatctatagcaactcaaaatctctactaatctttttcaatcctattcaatctatgtggtacctacaaggcctaattcttttgtctactattggtgtgagggctctccttattttttatggtttaatttatttatttgctccaccaattttcaaatccatcctgacaaaacattacatatggtccatatggaacccaccacccgtcttgctccactaggagtcctcaaattactttgagggccgtaatagggggtcctgctcgacttctgcttttgtctcaagacctcaaagtagagaccctgctttgtcttacaaaacattagaaatcttagtgaaagcagtgagagcgaagcaactagccacacgggagagttaaataggcctaatgtttaagagcaagggaattggaggagattgaaagattaaaatctctttccattcaatctccttactcttaaacaagcccttagagtggcaaggaaaccgctttactcgtgctgatggaattgcttagaccgttttcagcaaaccgttcatatggtcatacaaacactattagagtgtaatgtttctaaagtagattttgaaataggagatgtgatagaaaagctgttagagacaaacttagcaatgtgggcttaagtgactatttgcccatagaccaaacacccctgttgccacctttgttctatgatacggttggtattcctctagtccgtaaacaacagttagttagcagcactttagaggcagacgagtttgatcttgatgcgtctcctattaaccatacaaattcactagtctcccacaagtattaagctcaatgcaataaaaaggttacccatatctctcttcatttcgtcaagccaattgttgggaaaggaaaaggccgaacgaagaagatagcctcaatccagaaatcagctacttcggttcgacctttgattggaaagaatatcctccgctgtactcgaaggagtcggtgctcacgtccttgtcctttttagggaggggaggatcgttgtacgggtggcgaggagcccccttcgtaacgtcgaactcggtcgcggacgtcgaggcagacgtggaggcgctgctgagcccctcgctctgcagcatcatctcgatctccttgacgacctcgctcatggacggccgggctgtggccacctcgtcgacgcacctgagggccagctggacgaacttgccgaacgccgcgaggtggttattggtgctcatgatccttgcgtctaccatgtccttgagcccgcagaactcggcgtcgtcggcgtcgaacaccctcttcgcctcgcggacgatgtacttgcccttctcgatcggctgcttcgcgacgatcagctccagcatgaccacgccgaagctgtagacgtcgctcttctcggtcagctgctgggacatgtagtactcagggtccagatagccctgcacgtttccggatgaagcaacgcaaggtcagatcaccggaagcgggaatcgttcgttggctgcagcggatcggatgacggatgcagtgacagcgctgctgatcgatgaaaactagtcggcggcgtaccagtgttcctttcacttgcgtgctgacgtggcccctctcgctgtcggacactagcttggagaggccgaagtcggcgaccttggccgtgaggtgctcgtccatgaggatgttgctggacttgacgtcccggtggatgattggcgggtcggcgagctcgtggaggtaggccagcccgcgcgccgcgccaagcgccacccggagccgcttcttccagtcgagatgtagcccgctcttgcctgcatgcagtttccagtttcatcccacccagctgacagcttcagcgccggcatgcagtttccaattctaatctgaaacagtcgtccgtcgtccttaccggcgaggctgtcgcgcagcgtgccgcctgacatgaactcgtagacgagcatctgctccccctgctcgaagcagaagccgaggaggccgacgaggttcttgtggtgcacgcgcgagagcggctcgatctccgtcttgaactcgtgcccgccctgcatggacccctgctgcgccctcttgatggcgatgaactgccccgtcggcagcatgcccctgtaaaccttgccgtaccctccgtagccgagctcgttcgcctcggcgaagttgttggtgctcctcttcagctcctcgtaggagaaccacctcgcccctttcagccgcggcgcgccgccacgctcttcgctccgagcccacgacgctgccgcagttgacacgtacagcgtcgtcagtctccgcactgtactgtcagatgaacatggcatggcacaaaacgtaccaaaagggccgccaagctcctccttcgccttctccgcccgccgcctctgaatgaaagcgtaggcggctgctccggcgagcgcaacgaacaggacgccgcagcccaccgctatgccgacgatcacgcccttgctcttcgacgattgctcgcttcctgcgaccatcgaacattgaatccggcatgtcaacctgtctgtttgcaaacgtccacttgttcagaaatgttcttgctcttgacctgggaacgggtacggcgatgcgatgaagtagtaggggccgaactccttgggcggcttgaacgtctggttgctgaggtcgaagccgatgcgcatgacctcggagcggttgaagtaggcgccgctgccggcggggaagagcttgacctgcacctgcatgtaggcgtcgctgttgaagaaggggtcctgcaggtagacggagcccggggtgagggccagcttggtccacagcatgctctccagctcctggaacgccgtgtcgttggccacgtcgtggaagaagggcgcgcggaagtacatgaacgccctggtacgggtacgcgcacaggcagctctgcgggctcaggctctgccccgccgggcaggaccccgagtagcacttcaccaggctcgtcgagtagggcgccgacagcggccgctgcgtcgcgctgcagtagggcgtgttgggcaggcgctcgcacaccgggttcccggccagcctgaataatccagagagggatcagatggagatgccacagaatgtaatccagcagaagcagcaggagtgggggcggaggcgggcgctcacgcaagtgtgccgttgtagctggaggtcaccgtgagggaggcgaactcgttgtccttgaagctcaccaggctcagctcgctgctgatgctcctgcccatgtccagggtgccgttgaaggcgttgccgtcgaggatcctgcacaaagttaccagttggtcacgtcatctgatcatttcacgacccaaggttggtgagtactgagtgagcacttacacttgattcaactgcgggctgctgaaaagccttgtcggcacggtgccgtagagcctcccagactgtatgatccttgatgatgaacacacaaacatcatgtcacttttgttttacacacgcgtgcacgcgcgcgcacacacacatacgtgaatctgcaaaggtttaaggaagaaacttacaaagctgagagctgtggcagcctccaaaaccacgccgggcatggtgaaggatcaaatgtgttgttgctcaggtcgctgaggtgtaattggaccagaagagtttcagattaaccttatccagtgatgggttttaaataacacaagtagatcttcatggtgctcgttgcttacacgtaattgagaagatccatcctagttagatctggcaatgttccggtgagctggttgttggccaagttgctgaaaagcataagcatgccgtgttgagtgtaactgtaccctctcgtacactaaaatgcacagcggctaagtacagtattgtgcaactcttgaactgacttacagttcaatgactttggtgaggttattcagatttaaaggtacttggccagaaagggaattcctgtccagccgtctgctcaaacgacatgcagagaagggggaatgttcgtcagtttcatatttggtactagtaagatgtacagttccttccaacaaaaggaaacttacacaacttcgagtgtactaacaaacccaagagagtccgggatattcccggtgaatctgtttccatcgaagagcctgcgtcaagtatcttaggggtgtcagtaaacatcggtggattgcaaaagcagccttcaaacagggggggtttcacgagctcacaagtggatcaaggccatctccgggctgaagagagcgtcggggatcggaccagacaactggttcttgttgaagtgactgcaggcatgcattcagaagaacaaataaaaccagggcgcttcggttagccattcgtccgtttcaggtcagtgactgatagatgaacagcagtcagcaaaaacctacaagtgtctggttttgatgagcttgtctagacccattccgccgtctgtcgagaccggcaggggaccgctcaactgattgtcggcgatgtcaaaccagtagaggctcgagaggtttcccagcgaagctggtattttcccagagaactggttcgaattcagtgccctggaaggggatgatcgatgtcaaactttatataaaaaaaaaatagcgggcttcagaagcgcgagaaggacggacactacagctagaacgaggagttcttacatgtaggacagctttggcaggcttcctagctcatcggggatggtgccatggaaactgcaaccggacagaatcctgcacaaaaaaagagaaaccgttactgtttaccttctcaaaacaaaacaaggcagcagagaaactaagaaggagaagaaacacacaggagtgacgcgtcatcaagaacttacaaggtggtgagctgcttcaggttcccgatggtcggagtgagcacgccgccgagttcgttgttgaatgacaggtccctgcacacgcacgattagccaagccaatggttcacacttcaccgtggcaaactgcaagagcagtaattattagctgggtgagtgattccacatacatggattgcaggtcactgagctggcctatgtcagcagctagacttccttggatgcccatggtggaaagttttctgaaagagtcccatgcatgcaagtcaagctcaagcagactgagtatagtggaatgagtgtgcagtggagttttttttttttttgtgtcagagctgtgcgcgcggacggacacctacatggagatcactttgtcgccgccgcacgtcacgccctcccacggcgactctccgcagggatcgtcggactggccccaggacggcggcgcgttctgccactgatccatcaacgcccggagcacggaagctgcaacggaactcctcgtttcaattgattcttttttttcctactctactacgtacttgagtagatctttcactttttactaagggaactactagtatcacagttccctgatcatgggcagagagaagccagagcaatcgagcagagaagagaagagaacggtatcgatctgagagcaagtgaaaaatgcatggtactgaatgcatggtactcactgtcctggctgtctgtcgtgcccgagcactgttgcgcgcacgcggagagcaggacggccacggcgagaaggaaccccatcgtcgtcctccggctgcacccagctgctggctgctccgtgcgcgcggaaccctgcatgccgaggtcgcggccccgaggtgcggttttaggtcgcccagcccagcggacactgccactcagcaaaaagctcgtggggggcgcagcagaacagcaaccacctgcaccacaaccgaactccatgatgcgcctcatgatgaggtgtgcagtcagtgcacccaacggagccaatagacaggacgggccgggggaaatggtggcgtcgacttgacttgaaagcgaagccaggctccgatggaatggagcactagctagctagctagtccaagcacgcccagcccactcctaccgctgcctgagcaagaaagagctagcagtcatccgcacgcggcataaccctcgttctacggcaagtcctgagcatgcccgtaccgtactgcgcctgcgctagtgtttgttcgtggtgacggtgccgattcagagattagtgatgatgacggttgttctaaagaggagaggcaattaggtgggggattaaacaaacactatcgcccatcatttggcgtgcttctctgtagaatcttttggttggtggaaaatgcagagagacatacaaaggtgtttcagaagaagaagaaaaactgtagagatcgctgaaccggaacgcgccgagagttgctccggcgacagggagcctcgatttgcgaagataagccacggccgttgggacgtgacgtcggttgggactgatagtcctcgtgcccacagtgaagtcaatttgatgctgcgggccgggatggtgttgcaaaattccagataaaacgacacctagatggaacctggtaaaggttttctctgatttttctccgacggagaagacccgcctgtctgactctgacctcagttctgctgtttctcatctatatatgatatatctctcatctttcatagtttcatcactgttcactgtggcatcttgcctttttttttagaaccggaacacacacacgcatcttctacgaactgcatttttgtcccctttttttttgaccgcagcatggttaaggttatctaacagtttactcatcttcatactcatattaaaacatactctataaaaaatgcagtttatagtataaaatagtgttttgttcacaattttcaagcatcggtttcagctcgtgtgttctactggatttgaggattgtaatgctaaacacagaggtcctttcttcacaactgtttttttcaagctttgaaggccgtgatggggatttgtgatgattgattgaagcctgtataattgcggtggcacagaatagtagtctcaaagagtgacttcgtggcacatacttactccctggatgggtacacgtacatttaacctccctaactttgcaagggtagatatttaattctacgggctagtttgaaaactcaaattctgttaggttatctctagcaggctatgtaaacgaccatagaaattattgttttgctctataggttatactgtttgtagagtgaaatttaaaatagagagggagatagtgagtggataatgagtctgcttgaggtagttttagggtgtatgttattttctaggtagcaatcttccagagatgacattcaaataagatatttagttatctatataaaatttcttatcccttgggttgtctccccttccttctaaactagcccctacagtgtcctaacggacccacacacacacaatccctacacaaaaccatagaaacagtcaccaattcatagcacagcaagtctcgtgcgtttaatggcatgatgccggtgttgaaaacaaccttagagcagagcaatagccatagccttccttcttggaacctttcattcgagaagggagaaggaaacacaataagtaagttgtgcaagtgttacgtgtaaagagcctcgacataaggagtagaaacacgctgtaattgggaccttagagcattattgctttccttaattttcatcattcctgctatgttggaagtttcttttctatgagctcagctgcatagctaatttcttttttaaatgaaaccaggctgcgtgcgtatagggaccgaagccaggatttgtggcaggtgtcatcatcccttccatttctctttcctccccctcttcatcatctatatcatagctagaaaattcgaaggggattcaagagcgagcctctccctcccccagcagcccagcctcactttatagacttgcccccaacgacctacgtacatatgcagcgacttgagttgtttctgttttctaaacaagatcacacaacgctgcaaaaattctttgctcagcaatctgttcccaactggtagcggttagttatgaatatgtcacgtatatatagctggagatttaccgacctcggcccaaatcgttcgatggcccactaggcctgaattcaaagagatgccagcgggcgggcgggcatcttgctatcttcggattggaccggctagattaaagtttgggctcttgccatgtcatcgcctggtccataaccatagcagcccaccaaattcgaagcccagcacagcagcagtgtggtggccactggccacgccacggcttctatattcatgctctggctgtggactgtctgtcttttgaaaaatgagtggtggcttaattatggccatgacgatggtgacgagctggagaaaacaaggaagaatatgcagagaaggcaggcgacccgtgaacaggatgaaggcggaagacgaatagatggcagtatagcggcgagacgcgacaaagaacccctatcaccaggcaggccgcggcggccggtaaaccttcgactcgagtccatccatcacggcatcatcacgtgaagacagtagtagtgtagacagcagcaataggctcggggctagtgtgcacgcgttgaaatgaaacccgtgtcgtggactcgtggcccgcacaccaagtgagtgccactggacgcgttgaaatgatacgggctggactatggcagggtacatcgttgagtttgaaagagcgacggaaagctatcacgaataaaatcgaagtggcgggtatcgccaactcgagcgagccgctcaaaattcgccaggatggctttgcacgcacgcacgcacaccaagtgagtgcatcagaaagtggaaacggcaaagtgccgcaaagccgcgtatagagatacatagggtggttggtttgaagaatgagctagtccatcatcttctcactcctcactatttttgtttggtttgtggaatggaatgagttgatccatcaccactccattccttatagttagttagttagtactaatatgaggattagagtcatcccaccaaatttgagaaatgaacccatgatgcaccacctcaatttggatgcgatgattccttaaaccaaacacacccatatactcctggtcactccgtcgcgtcgccctcccgtcgtctgcctttgccttgccttgcaagagaatcgccactctctgcctcggtggtggcaagctagtaaagtatttcctccgcaaatcttttgacaaggaggcaggctcatctgtctaccgtggctaagctaaactgtaaaaggcaatggcttgatgagaggaacaagggtgtcagcatggctcgccgaacccactcaacatgggtgccagtttcatcaccacagccaaagcatggcactcctcggcatgtaaagtaccaaacgcaaccgtttgggctgtttttattttaattttagttttttctaagaaaaaaaatcactgatggtactaaggacatgtttggtgtgtggcgtcgggcaccacgccacatctaagccgcggcggccgaatcagccgccacaattgcggcgacaaaactgtggcgcgacgtggcggcttaggcgcgctgccaaacggcccctaaagccgagtttatacccttgagtcggcaccgtcaactacaacgcctatgttacgtggtttgacgttatagatcataacaccgagacatctcatcacaaattcagtgaacgtcatcatgaccctaacatgaaagtgcctcggtgttatagttcgtagcgctgatgtcgatgccatgtgctacaatgtatggccttatccggttcccaactctctctctctctctctctccttgatccgttcgatctcctctattatgtggattcaaccttgaaagtttagatttgatccgtacatattcgagagtaaggcatcctccctctcctccttaacttatacgtgttgatttggtttctcctccttaacttatacgcgttgatttggtttcggtagatactggttgaatcaattttgattttgttatataagtagagttgtttaggtatatcatttatgtttacaaatacatgtttagattatgccctctatttgtgcatgtacatattggtgcatgtgttttataattaggtcataatgttagtaactatatttaggtttaatgtatgttcattggattgttaagtgttggttttatttgtaacatttagggtttagggtttagttttagttttattttagttaattatttagtacagattatatatgtctacattttgaaatacttgtactgttgcatagcacaaaagacttgttaaaatatagccctctatttttgatatatgcatgccatgtggtgggagaagtgacaatggattgtgatatcctgacacaaggcttaatatggttgataaaatactcatataaacaaggtacgtcttaattttttttgaagcctatctcaaaagaacttctagactaaattgctggcc

SEQ ID NO: 7000 - DNA, 1772 bp, Zea mays
acactacagtgcggtcgctcgtctccgcccgcctctccccattctcacttcttttcccccagttgcgttgcgtgcccctcgtttccacattttgttgcgctcctttagcgccggcggcccgtagcctcatcatcatttccattccatccggtttcttccgacgacggtgtgtacagagagcaggatcggacaagtctctgctggtagaagcatggcgcagcgccggctgttgggcacggcgccggcgcccgcgggcgatgcggcgtcgcacggctcgggctccagccccgacgcgatgcggatcatggtgggcgtgctggtaacggtcatcgtctgcacgctgctctactgcgtctactgctggcggtggcggaagcgcaatggtgaaactgcgctctgctgccatccgagatccctgctggacagcctatggcggcggtcgagctcggacctgccgctcatggacctcgcctccatcctcgctgccaccgacaacttctccaaggccaacaagctcggcgagggcggcttcggccccgtctacagaggcgtgctgagcggcggctccgagatcgccgtgaagcgtctgtcggcgcggtcgcggcagggcgcggcggagttccggaacgaggtggagctcatcgccaagctgcagcaccgcaacctagtgcggctgctgggctggtgcgccgagcgcgaggagaagctgctggtgtacgagtacctccccaaccgcagcctcgacgccttcctcttcgatccgagcaagagtgcgcagcttgggtggagcacccggcacaacgtgatcctgggcatcgcccgcggcctgctgtacctccacgaggactcgctgctgaaggtggtccaccgggacctcaaggccagcaacgtgctgctcgaccacaagatgagcccaaagatctccgacttcggcatggccaagatcttcgaggacgactccgacgcgatcaacacgggccgcgtcgtcgggacctacgggtacatggcgcccgagttcgcgttggacggcgtcttctcggtgaagtcggacgtgttcagcttcggggtcctcctgctggagatcttgagcgggcaacggaacggcgctttgtacctcgaggaacaccagcagtccctcatccaagacgcatggaagctgtggagtgaagaccgcgcggccgagttcatggaccagtcgctggggcggtcctactccaaggacgaggcgtggcggtgctaccacgtcggcctgctctgcgtgcaggaggaccccgacgtccgccccaccatgtccaacgtcctgctcatgctcatcagcgaccacaccaagttacccgagccagccatgccgcccttgttcgcgcggctcaggaacatctccttgctggcgccgccactcactaccaaaaccgagtccaccacgtctccgctgtcgatcaacgacgtctccatcaccatgatcgaaccgcgatgagctcatgcgttttctacttctgacaactgagggagaggcttcgagtgtaaatttataagactgcaatcgttcagaatgactactcctatgtactagtaagtttttttttatgctgtgcacaagtgtgggatttaactactagactagaacatgcggcgcccgtaatcgggtcataacagatttttttttatgtttatgcattctcctatgtgatccaatggactaaaatgtgtcaccactgctagcaaagaccatataactattttaattagtttgtatacaaaaaaaaaaaaaaaaa

SEQ ID NO: 7001 - DNA, 1757 bp, Zea mays
  misc_feature (883)..(883): n is a, c, g, or t
attgggacctcccggccgggactccagtgcggtcgctcgtctccgcccgcctctccccattctcacttcttttcccccagttgcgttgcgtgcccctcgtttcccattttgttgcgctcctttagcgccggcggcccgtagcctcatcatcatttccattccatccggtttcttccgacgacggtgtgtacagagagcaggatcggacaagtctctgctggtagaagcatggcgcagcgccggctgttgggcacggcgccggcgcccgcgggcgatgcggcgtcgcacggctcgggctccagccccgacgcgatgcggatcatggtgggcgtgctggtaacggtcatcgtctgcacgctgctctactgcgtctactgctggcggtggcggaagcgcaatgccatccggagatccctgctggacagcctatggcggcggtcgagctcggacctgccgctcatggacctcgcctccatcctcgctgccaccgacaacttctccaaggccaacaagctcggcgagggcggcttcggccccgtctacagaggcgtgctgagcggcggctccgagatcgccgtgaagcgtctgtcggcgcggtcgcggcagggcgcggcggagttccggaacgaggtggagctcatcgccaagctgcagcaccgcaacctagtgcggctgctgggctggtgcgccgagcgcgaggagaagctgctggtgtacgagtacctccccaaccgcagcctcgacgccttcctcttcgatccgagcaagagtgcgcagcttgggtggagcacccggcacaacgtgatcctgggcatcgcccgcggcctgctgtacctccacgaggactcgctggctgaaggtggtccaccgggacctcaaggcncagcaacgtgctgctcgacccacaagatgagcccaaagatctccgacttcggcatggccaagatcttcgaggacgactccgacgcgatcaacacgggccgcgtcgtcgggacctacgggtacatggcgcccgagttcgcgttggacggcgtcttctcggtgaagtcggacgtgttcagcttcggggtcctcctgctggagatcttgagcgggcaacggaacggcgctttgtacctcgaggaacaccagcagtccctcatccaagacgcatggaagctgtggagtgaagaccgcgcggccgagttcatggaccagtcgctggggcggtcctactccaaggacgaggcgtggcggtgctaccacgtcggcctgctctgcgtgcaggaggaccccgacgtccgccccaccatgtccaacgtcctgctcatgctcatcagcgaccacaccaagttacccgagccagccatgccgcccttgttcgcgcggctcaggaacatctccttgctggcgccgccactcactaccaaaaccgagtccaccacgtctccgctgtcgatcaacgacgtctccatcaccatgatcgaaccgcgatgagctcatgcgttttctacttctgacaactgagggagaggcttcgagtgtaaatttataagactgcaatcgttcagaatgactactcctatgtactagtaagtttttttttatgctgtgcacaagtgtgggatttaactactagactagaacatgcggcgcccgtaatcgggtcataacagatttttttttatgtttatgcattctcctatgtgatccaatggactaaaatgtgtcaccactgctagcaaagaccatataactattttaattagtttgtatcc

SEQ ID NO: 7002 - DNA, 1685 bp, Zea mays
tattattaatagtcactgtcaattagtggacccagagagtgtacgcgctgagctaaggcaactgaagtctctgaacgtggacggggttgttgttgactgttggtgggggattgtggaagcctggactcctcggaaatatgaatggtctggttacagggacctttttggtataattaaagagttcaagctgaaagttcaggttgtattgtcatttcatgggtctggagagactggatctggtgatgtgttaatctctctcccaaagtggatcatggaaattgcaaaagagaaccaggatatattttttacagaccgcgaaggtagaagaaacacagaatgcctttcctgggggattgacaaagaacgagtccttcgttggagaactggcattgaggtctgttttgatttcatgaggagtttccatatggaattcagaaacttatctgaagagggccttgtttcttctatcgaaattggattgggtgcttcaggggagctaagatatccttcatgtccagaaacaatgggctggaaatatcctggtattggtgagtttcagtgttatgacaggtacatgcaaaagaatctacggcaatcagcattgtcccggggtcatttgttttgggcacgtggacctgataacgctggctattataattcaagaccacatgaaactggctttttttgtgatggaggcgactatgacagctactatggacgttttttccttaactggtactctggagtcctcatggatcatgtcgatcaggtgctgtcgcttgctactcttgcatttgatggagcagaaatagttgtgaaggttccatctatctactggtggtacaggactgcgagccacgccgcagagctcacagcggggttctacaacactacgaacagagacggatactctccagttttcagaatgctcaagaagcactctgtgatccttaagctcgtctgctacggacccgagtacacagttcacgagaaggacgacgacgaagcgtttgcggatccggaaggtctaacctggcaggtcatcaacgcggcgtgggatcagggactaccgctctgtatcgagagcgctcttccgtgccgtaatggtgaggcgtattcccgcatcctcgacacggcgaagcctagggacgatcctgatcgtcaccatgccgcgttctttgcgtaccgtcagcagcagcagcccccgctccgagaagcttgcctttcggagctctgcaccttcgtaaagtgcatgcacggggaggctccccagaatggggaaggttgaatctcgttagcaactgatgcgctggctcgacaatatggaagaaaccaagtaggtgggtttcggatttgagccgcttttgaaggcgtccggcggcgagcgaacattctgatactgctaggtcctattcagttggttccttctcgtcgtcagccgtctgccctgttactcgtcggctggactgagcaggtgcgtttgcagttgcagccttaccatatagcttataactttgtggtaagttagcataccgcatgctgtaacagacaatggaggatggccgtggaaagcaacagtaatggcttgcgcttgccagcccaggggggagggcatcttaaacttaactactaaatttgtataatataataatggtattgaaatttgaatcctttgacttcctacg

SEQ ID NO: 7003 - DNA, 1797 bp, Zea mays
  misc_feature (275)..(275): n is a, c, g, or t
  misc_feature (651)..(651): n is a, c, g, or t
gtggtgcttcacatgacatgaaaagaaccattcaccttttgttgctactgtttcaggtatgtggcccctgaatatgccaacactggtctgttaaatgagaggagtgatgtctacagttttggagtgctactactggaatcagttactgggagggacccagttgactatggtcggccagctaatgaggtgagcgtctgctgtcatatcatgcttgcagaacagcccatacgagagaccatctgtttcacagaaaagcagcatctaactactatcgnagacgatgcatttcagtttttaggagtatgggtatcttgacttccatttattgtggcaagtgtgctttctaaaatttgcacgagcaacaattccttgtcagcttcgatcgttaataatcagctacaacatggagacggtgcaggtacatctggtcgagtggctcaaaatgatggttggcacgagaagagctgaggaggtggtggatcctgacatggagttgaaacctgccactcgggctctgaagcgtgcccttctagtggcactgcggtgtgttgatccggactctgagaaaagacccactatggggcaggttgtccggatgctcgaggcagaagatgtcccgtcacgggaggttgtacttctgctcccccctcnccccctcctgatacaaacatactgctcttttgtgtaacaagtctgaatcttgtgttttgatcctgtgaaggaccgccggagccggaggggccacagcggtaacgcagacagcgagtctaaggcaagctcaagtgagttcgagataagcagtgatcgaagagagttggggccgtccgcgaggttccagtcctaacccctgacgagaactcggttttggactagcgatgaacatcagatgagcggtgtgtttggggggggggggggggggctggttggtaggaggtaggaaggccattgcatttcattttcgcgaggacatttgcattttgtactgtgtagagatcggaagggcattgcatttctggaggggtaggcattatcctttggtagtaggcagcttagaatgcagagggagatgactccccctgagacgaaagattcagacttgctgtcgtgaatcttggtgttctgttggtgcggacggcagcagcttcagcttgtacagacatttctttctctgtcgtttggttattaggacttgttgggtagtaggaacattaaggtctctttcgtaatgtgatgaatgacttgaaccatcaacctcttgtaatcttctgagtccattggccaagctagagttctgtgaagctccatcttcagcatgggaatctcaccgattcagatcgagctgatgctgtttcctgtgatatttctgaagatgttccaagcagggtggtaatttcctgtgacaattggaaagatgtagacgatcgctggctcattggttctaatcaatgggatgaatgtcaaatgcgaataaatcaaaatccgaggtacacagaagagctccggcgacggggaaagggcccgggagctccaaaggcttggcgatggcccggcggttgcgagcacaaagagaagcgcacggaggagggaggtgctagtactacgcatggcaaattgattctttgtaatgtttggcgtggagttgtaagagcatcggaggagggaggtgctagtactacgcatggcaaattgattctttgtaatgtttggcgtggagttgtaagagcatctgtaagagactagacaaatggttcatcaagttaaattttgactaatcaatagcaaaataattctccaacg

SEQ ID NO: 7004 - DNA, 1307 bp, Zea mays
aattcaatggcaagctttctgattttggattggccaagctcttgggtgcagggaagagtcatatcacaactcgagttatgggaactttcgggtatgtggcccctgaatatgccaacactggtctgttaaatgagaggagtgatgtctacagttttggagtgctactactggaatcagttactgggagggacccagttgactatggtcggccagctaatgaggtacatctggtcgagtggctcaaaatgatggttggcacgagaagagctgaggaggtggtggatcctgacatggagttgaaacctgccactcgggctctgaagcgtgcccttctagtggcactgcggtgtgttgatccggactctgagaaaagacccactatggggcaggttgtccggatgctcgaggcagaagatgtcccgtcacgggaggaccgccggagccggaggggccacagcggtaacgcagacagcgagtctaaggcaagctcaagtgagttcgagataagcagtgatcgaagagagttggggccgtccgcgaggttccagtcctaacccctgacgagaactcggttttggactagcgatgaacatcagatgagcggtgtgtgtggggggggggggggggggctggttggtaggaggtaggaaggccattgcatttcattttcgcgaggacatttgcattttgtactgtgtagagatcggaagggcattgcatttctggaggggtaggcattatcctttggtagtaggcagcttagaatgcagagggagatgactccccctgagacgaaagattcagacttgctgtcgtgaatcttggtgttctgttggtgcggacggcagcagcttcagcttgtacagacatttctttctctgtcgtttggttattaggacttgttgggtagtaggaacattatggtctctttcgtaatgtgatgaatgacttgaaccatcaacctcttgtaatctctcagtcctttaaactcgaggggggccccgctacaattctgtgaagctccatcttcagcacgggaatctcaccgattcagatcgagccgatgctgtttcctgtgatatttctgaagatgttccaagcagggtggtaatttcctgtgacaattgaaaagatgtagacgatcgctggcaaatgggatgaatgtcaaatgcgagcaggtttagatatttgatcacgatgctttaggaccggtcaggcaaatcctgggatcgttgggattggcaaactgtgatcgcatgcttaagttctttattaatttgttgatgcaccaaaaaaaaaaaaaaaaa

SEQ ID NO: 7005 - DNA, 1655 bp, Zea mays
gccggccgggctgcggaaaaaaaaaaaaaaaaaccttgggtacctcgaggccggccgcgcccctcataccaaaggctgactcaaagcgatgcgcagctccgtaaccacttcgtcctcacttctcagtccaccttcccaccgcaaccacttcaccacctcctcccagtcccagcaatggagctagtagcgtggctcgtcatcgtgtcctcagtctccctcgctgggctcctgccagtggtctcggcgtcgacgacgacaccgcagcagcaatgtggcggcaataatgtcggacctgccggagtgagagcaggctactggtcgccgtcctcgaaccgctactccgcggtcggcagcatcgacgcgtccctgtacacgcacctctactacagcgcggtgaccatcgacgagacgagctgcgcggtcgcgccgcctccgccgacggccgaaggcgcctcgctgctcgccgccttctctggcgcggtcaagtccgcgagcccgtccaccaggaccgtgctgtccgtgggcacggacgagtacagggtgggcgagtcgaacgccgccttctccaggatggcgtcggacgcgggcctccgggcggtgttcatcaactcctccctggacctggcccgcgccaacggcttcgacggcctggacctgtcgtggatcttcccggccacgcaggcggacatgcagaacctcggcgccctgctcgcggagtggcgggcgaggatcacggaggaatccgtcgccaagtctttgcctcctcaaccccttctcctcaccgcgacgctctacttctccaaccacctgttcggcacgcccgacggcaacctcgactaccccgtggacgccatcgcgagcagcctcgactgggccaacgtcctcaccttcggcttccgcggggacagcggcgtcaccgcggccgacgcgccgctctacgacacgtcctcgcacttctcggccagctacggcgtggtctcgtggctggacgcggggctccctccgtgcaggctggtgatggggatacctctgttcgggaggtcgtggttcctcaggaacaaggccaagaacgggctaggcgcgccggccgccgccgccgggacgaagcagaggaggagcaaccagactgggataatcgcgtacgcggagaccgaagagtacctgagctctcaaggcaccgtcgtcacctacgacgaccagtcggtggcggagtatttctgcagcggtgacctctgggtcagtttcgacggcgcgcaggtcgtgcagcggaagctggagttcgcggcgaggtctcagttgctcggctacttcctctggaccgtcggcttcgacgattcgaacagcacaatctccaggaaagcatcggagtcatggcaccagtatgctcagggtggttttggaatcatgcacgcaggaggttcaaaccaatacgttgcatttaactcgtcttcagtatcacttggtagctgctattcgagatctctcagctgtttgctgtcttcagtacttctgttggttattctgtttcgttaaagcgtatcagtaaacaggccagaaatgtaaaataatagtttcaggtgatatattcatcaaagcgaacgtctaaaacatgttcaggtgtatttgttgacttctctcaaaaaaaaaaagcggca

SEQ ID NO: 7006 - DNA, 623 bp, Zea mays
tcgagtttttttttttttttttttttttttttttttttttttttttttttttttttttttagagcaaccctcgcatgcagagcgagcaataaaattctatgcattgcacacatccaacatatatttcccctttatttgatcaccagaagacgtaaatataaaacaacacccccttctgtccggttccctgacacggctaattaatacgcatatacgtaaagcatccatggatgccttgaaacatgcatcacttgaacagaagctcacgagaggcagcgcgcgtcgtcgtcggccggcgcatgcatgtaaaagttggggcttcgcggaatggcctcaactcaagcaacaggagtaaatatgacgtagcagaggcgatcactaaagctgcaggagcaagccggagtgaagcagggagtgtttttgcttgtctcccccgggtagcacaggggggccgacagcatcgtcaccttgggcgtcggggggagggagccatccggcacggttccgcgcggggagcgggcggccatggccgtcgggggagctgccatgagctgcaaaaccagcagtatggccaccaccgcaccggccactttctttttgccacccttcccttgggccgaatt

SEQ ID NO: 7007 - DNA, 1417 bp, Zea mays
cattgggtacctcgaggccacctttcgcgtgctccgccgtcacgacccaaattattgagagcccaggaagtgagagatgagcctgcagattccggtgagatcaggcgccctgcgccgccttctccttctaggtggcgccgagggtctactgcgcacctactccaccggcgaccggcgccggcgggtgatccgcgaggcaaggcaagaggaggaggacgaagcgttcctccgcaccctcaacttcggcgctgaccccgagaacaaccctcttcccccgccgccgaggcatggcagaggattatccgacgcctcagccgggaagcagcagcagcagcccgagcgaagcgcgctgaaggtcgtcggggagacgctgctggagaagcttaagctgggcgatggtccctccgccgccgctgctataggaggcggcgatgagccacggcagtctgaggacgagcctgcgcccgcgcagccggtggacgtggacgagatcttccgaaagatgaaggaaaccgggttgatcccaaacgccgtggccatgctcgacgggctgtgcaagaacggcctggtgcaggacgccatgaagctgtttggtctaatgcgagagaagggagccatcccggaggtggttatctacacagctgtcgtcgaggcattctgcaaggtggctaagctagacgacgccgtgagaattttcaggaagatgcaagggaatggagtcatccccaatgcattcagctattggctcctgatacaggggctgtacaaggggggcaggctggatgatgctgtcgggttctgtgtggagatgtttgaggctgggcttgcaccgaatgcggagacgtttgtaggcttgcttgatgcagtgtgcaagacaaaaggtgtggatgaaggcgagaatcttgtgaggagcttccaggacagaaacttcgctattgatgagaaatcaatcagggatcacctggacaagaaaggcccattctcaccagtagtgtgggaggtgatctttggcaagagaaaatcagaccgaccattctaatctctaccagaaagtagtatgtgcacactctcatcattttgttagccttgtagttattatttctcaagagtttgcttgctttcatggttaaacaaatggctaccatgtcttcttttatggaatctataattatggcgatctgtatgcacttttgtcatatgcaattcacctccatctattcaactgccccaattaggacatacttgctgcattcaccttgagctattcaaccgtcccaattagaacaactttctttgttattatgtttctgttatgaagggttgctacttgcactgtattttgattattggcaatttaagtgcaagatgatcaattcacacacgaatacataatttgtgctcaaaaaaaaaaaaaaaa

SEQ ID NO: 7008 - DNA, 2607 bp, Zea mays
  misc_feature (1)..(252): n is a, c, g, or t
  misc_feature (2437)..(2455): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtaacattttccccccgggaaccagctttggccccgatttccgcaaggctgggaatttaccctcccttaaaggggaccaaaagctggagctcccccgccggtggcggcccttatagaactaggggattcccccgggttgccggtatagttctagtccccccccccccccattaaaccctaaccctaaaataacggtttgttttgctctctcggtttccatgggtgtggctgagaccaagtctctcagtggccgaaaccctagatttagtgttagttaaaccctaacccgagagatctaaaattcttaaatctggtttgtttatttttctgcatctgaaccactgcagggagttcaggagttttgtgtctagattcttaaatctgaataaacaagttgaatatattaactgcaatgaaaacatatagatgtcatctgccacctatctccacgcacagtctggctcgacatcacctgcccttctcgtgatatctgattactgttttgctagtgctagctatcgatgctgttcggggattagtagtgttctatttcatcctcttaatgtgttcgcatcagatagatatatgttcatatgatttaaggatatcctgtcagcagcttacacatttgtctatctccatgcttcctttctttagttggagactggattattttttgttgggataaacttagtacattatcagagcatcttaactctggatatgggtgcctttaagggatatccaataaacaaaatttgaacacatttggtttgtcgtataggtacaaagccagcacatgcttgggcaggtttgatcagtttcactaggaactgttcactaattgactgtctcagtaatacaattgaatagcctgcaactcagttagccatgactttcttcgtcatagtttctttagctgaattattttgcacatattacatggatgtgcactacccatgttgttcaatatcccacatcaatatcgaattgagtatgatgactgatgacaactaccagttattgtttcttgaattggcaacaacttggtctgtgagtcattcccactttgcccctacccttgctgagtagtgtcattcttttaggcataccttatagatgaatgattttttacattactgccttccccagtccccatcccaccccatttttttgtatcttagaaaatgtgacttggacaataagatgttgcttgagttacttacatttcttaaaagtattgattagtcttgcatctggatgcaggagctctgcagtaaaggaagtgtgtagtcaccatggtccatttcaagaataggtacatggtggtggagatctttatagatgcaggtagaggtgaacaggaccctgtaatcctcacccaatttaatataacaaaagttataaaagacagcattcagctcaactttggagagtgtggcctagctggatctcttggatcattgcaagttaagtatgttaatcctgtaacgaagctctgcatcgtccgcttgtctcgcgaagaccaccaaaaagtttgggctgctatgacgatggtgcggtgcattgggaagatccccgtttcgttcaacttgctcgacatgagtggaagcatcagggcttgcaagaaagctgcactggagtgcgatgaagcgaaatttgagcaatacaagctggctgcaggtgattgtatcacggcagagatcatccagtctgtagagaagtgctttgagaagatcagaggactagagagctaagcagaagaattgacatcacgtccacccaccctcggatcctaaaacctgctgaccctgcaccgcatccgtgatcacgtcacaccacaagctgtgtgtcctggctccagcgcccaccacggcaacggcctctcgccacttgctgccagcagcctccgtgcctccatcagctctcctttccaaggaaaagtctgaagtctgcaaccaaacaagtgttctgcagctgctctttgccgttggttgaagtctgcaaccaaacaaatgttatgcagctgctctttgccgttggttggagttctcggctccacactttcagaaagaattcatgtatacataaaatttattatatagagagtttgcttcgtatattagtaattttttaacaaacatgtgccacggtgtatatacagcaaattataccgggtggnnnnnnnnnnnnnnnnnnngggaaaaaaaaaaaaaaaccccccgggggggggggcccgggccccatttccccctataggggggccgttttaaatttccggggccgcttttaaaaacccggagatggagaaaacccggggggtaccccaaataaaacccctggagaaaaccc

SEQ ID NO: 7009 - DNA, 1223 bp, Zea mays
  misc_feature (24)..(24): n is a, c, g, or t
ttgggtccctcgaggccggccggngacaggccgccagctccagtccgacttccctctctctattttgttcttttttttcgtcgcttggcaaacagcttcgtctggcttccttgcctcggctaacggctaaaaaaaccagcgagcacgatttctcctctctcggtgcctcgcggcttttttacgtgctctcttgtctgcggccaacatacagctaactggcgagccgtggacgctcggccagctctgctggccgactaaggagggcgtcgtgggcctcaccgccggcgagtgcgtccctgcgggtgggcgcactgccgtcggtcgggtccgtcggttgtccagcacagctacaagttgaggagctctgcagtaaaggaagtgtgtagtcaccatggtccatttcaagaataggtacatggtggtggagatctttatagatgcaggtagaggtgaacaggaccctgtaatcctcacccaatttaatataacaaaagttataaaagacagcattcagctcaactttggagagtgtggcctagctggatctcttggatcattgcaagttaagtatgttaatcctgtaacgaagctctgcatcgtccgcttgtctcgcgaagaccaccaaaaagtttgggctgctatgacgatggtgcggtgcattgggaagatccccgtttcgttcaacttgctcgacatgagtggaagcatcagggcttgcaagaaagctgcactggagtgcgatgaagcgaaatttgagcaatacaagctggctgcaggtgattgtatcacggcagagatcatccagtctgtagagaagtgctttgagaagatcagaggactagagagctaagcagaagaattgacatcacgtccacccaccctcggatcctaaaacctgctgaccctgcaccgcatccgtgatcacgtcacaccacaagctgtgtgtcctggctccagcgcccaccacggcaacggcctctcgccacttgctgccagcagcctccgtgcctccatcagctctcctttccaaggaaaagtctgaagtctgcaaccaaacaagtgttctgcagctgctctttgccgttggttgaagtctgcaaccaaacaaatgttatgcagctgctctttgccgttggttggagttctcggctccacactttcagaaagaattcatgtatatgtttaaacacaataaagttggaacgggaggggggaaaggagtt

SEQ ID NO: 7010 - DNA, 1300 bp, Zea mays
atctcacttctgttctagccgcacaaagcacgggccgccagctccagtccgacttccctctctctattttgttcttttttttcgtcgcttggcaaacagcttcgtctggcttccttgcctcggctaacggctaaaaaaaccagcgagcacgatttctcctctctctgtgagtgtgttttttttttacgtgctctcttgtctgcggccaacatacagctaactggcgagccgtggacgctcggccagctctgctggccgactaaggagggcgtcgtgggcctcaccgccggcgagtgcgtccctgcgggtgggcacactgccgtcggttgtccagcacagctacaagttgaggagctctgcagtaaaggaagtgtgtagtcaccatggtccatttcaagaataggtatatggtggtggagatctttatagatgcaggtagaggtgaacaggaccctataatcctcacccaatttaatataacaaaagttataaaagacagcattcagctcaactttggtgagtgtggcctagctggatctcttggatcattgcaagttaagtatgtcaatcctgtaacgaagctctgcattgtccgcgtgtctcgcgaagaccaccagaaagtttgggctgctatgacgatggtgcggtgcattgggaagatccccgtttcgttcaacttgctcgacatgagtggaagcatcagggcttgcaagaaagctgcattggagtgcgatgaagcgaaatttgagcaatacaagctggttgcaggtgattgtatcacggcagagatcacccagtctgtagagaagtgctttgagaagatcagaggactagagagctaagcagaagaattgacatcatgtccacccacactcggatcctaaaacctgctgaccctgcaccacatccgtgatcacgtcacaccacaagttgtgtgtccagcgcccaccacagcaacggcctcttgctgccagcagcctccgtgcctccagcagctctcctctccaaggaaaagtctgaaatccgcaaccaaacaagtgttctgcagctgctctttgccgttggttgaagtctgcaaccaaacaaatgttatgcagctgctctttgccgttggttggagttctcggctccacactttcagaaagaattcatgtatacataaaatttattatatagagagtttgcttcgtatattagtaattttttaaaaaaaaaaaaaaaaaaaaaaaaaaaaaaaaaaaaaaaaaaaaaaaaaaaaaaaaaaataaaaaaaatggaaaaaaaaaaaaaaaaaaacctc

SEQ ID NO: 7011 - DNA, 4633 bp, Zea mays
tttactgatcatgaagtgtctcatattctggaatagcaccctcaataggatcctggatgagactctcaatgtgatcaagtacattacacttggatcttttccagttgaccttatagatgctgtaccgcgccatcttaaggtcatcctaaggtgagcctactgtaggcttagtgggtttctcaaaccacatgaggaatctatttcatccactgtagttatcatttcaatcttttcccgccataagtggtaataaataccacgtagcggtttaatctgtcttgtctgaccaactagtagccaaaatgtgcacttttgcaaagtaaaacagaaaatatttaggacatctgaagtaaatactcaaacatataacttgcatgaattaaatattcaacgttggtcagataataatcatgtctgatctacaaattttctagttctaaaattctaaaccatcgttggatgatctagaaaacttaattattgtataaaatgtggtaacaatattcgacgttggtcaaaatattcaatctccacaaaaacatttctgaatttctatgcacttaatgagaattaatccacgtaggcttcataataaacaataatgcatagaaaaacaaataataatctggttctaaaattctaaaaccatcgttggatgatctagaatatatatacttctgttcaaaatatggtaacaatatctaatgttggttaaaatatttaattaccacaaattttctgaattctatacaatttaaacaataattaatccacgttggtttcataagtcactataaattgcataaaatattgataaaataccaaagtacgcatcggaataaaatagtccataaatatctctgcaattttctacatctgagaaaaatgtttctataattttatgtatatatattactattttctctggtttcttttatgttcactaattccaggaaataaataaaagaattaaaaattcgctggaaaagaaagtggcctagccacttggtgcgaccacaggcggcccaaaaattggcccacttggccggccggcctacgggagggaagcagggggcacgcctgggccgtaacctggtcccaggccgctgaaaacagcccactagttctgcctgggggagttggtgacgcgcctgggccgtaacctgggcccaggccgcgtatttggcccatgcgcgcgcataggggctccccgcgtatttggcccattacgaaaatctcggcaccatggtaaaccctagctcacttctgttctagccgcacaaaacactggccgccagctccagtccgacttccctctctctattttgttcttttttttcgtcgcttggcaaacagcttcgtctggcttccttgcctcggctaacggctaaaaaaaccagcgagcacgatttctcctctctctgtgagtgtgttttttttttacgtgctctcttgtctgcggccaacatacagctaactggcgagccgtggacgctcggccagctctgctggccgactaaggagggcgtcgtgggcctcaccgccggcgagtgcgtccctgcgggtgggcacactgccgtcggttgtccagcacagctacaagttgaggtatcggccaactgtggctgtttcttgactctagtatccggatctaactccattaactcgaacccctttacctttatgaatgcatgtatgaaatggatgagatgtaatattgggtcgagcttttggagtctctcatgcgtagatccaggttccagttgcgttttttctgttgtgaatcggtcagtgcatctgtgcacttttgattcagtcccaatttgggaatatttcagttatggttcaaaaaccgtaatccgatctgtatttctgttacatattgactatttcttggccgtggatcgttggatcttgagccctccccgccggccccggtgatggcccctagtccccccccccccccattaaaccctaaccctaaaataacggtttgttttgctctctcggtttccatgggtgtggctgagaccaagtctctcagtggccgaaaccctagatttagtgttagttaaaccctaacccgagagatctaaaattcttaaatctggtttgtttatttttctgcatctgaaccactgcagggagttcaggagttttgtgtctagattcttaaatctgaataaacaagttgaatatattaactgcaatgaaaacatatagatgtcatctgccacctatctccacgcacagtctggctcgacatcacctgcccttctcgtgatatctgattactgttttgctagtgctagctatcgatgctgttcggggattagtagtgttctatttcatcctcttaatgtgttcgcatcagatagatatatgttcatatgatttaaggatatcctgtcagcagcttacacatttgtctatctccatgcttcctttctttagttggagactggattattttttgttgggataaacttagtacattatcagagcatcttaactctggatatgggtgcctttaagggatatccaataaacaaaatttgaacacatttggtttgtcgtataggtacaaagccagcacatgcttgggcaggtttgatcagtttcactaggaactgttcactaattgactgtctcagtaatacaattgaatagcctgcaactcagttaaccatgactttcttcgtcatagtttctttagctgaattattttgcacatattacatggatgtgcactacccatgttgttcaatatcccacatcaatatcgaattgagtatgatgactgatgacaactaccagttattgtttcttgaattggcaacaacttggtctgtgagtcattcccactttgcccctacccttgctgagtagtgtcattcttttaggcataccttatagatgaatgattttttacattactgccttccccagtccccatcccaccccatttttttgtatcttagaaaatgtgacttggacaataagatgttgcttgagttacttacatttcttaaaagtattgattagtcttgcatctggatgcaggagctctgcagtaaaggaagtgtgtagtcaccatggtccatttcaagaataggtacatggtggtggagatctttatagatgcaggtagaggtgaacaggaccctgtaatcctcacccaatttaatataacaaaagttataaaagacagcattcagctcaactttggagagtgtggcctagctggatctcttggatcattgcaaggtaccaccagcaattacttctgaaacccttttaatcttataccagtgttagctgtactatgtctaccactggctttttaatataaaagcacttatacgctctgcaaaaattccagttaagtatgtcaatcctgtaacgaagctctgcattgtccgcgtgtctcgcgaagaccaccagaaagtttgggctgctatgacgatggtgcggtgcattgggaagatccccgtttcgttcaacttgctcgacatgagtggtaagtggctcagactctggatgatggtacagaacaatgttattgcattgcctttttacgtggttgttttcaatcgaactggcgcttgctttggtgcacggcgaacattccaaaaacaacctatttctgtagttaattctgtcttcttgctgaagttgtagtattttgacagatgggactttgatttagaaaggattcatatatgcccatctctcataacggtcaaagttaacgagtgcgaataatcttcgtgtggggcgttttgctgttttgagtaatttactgaacttccggtgcaacatttctgccatctatgatggaggtgcgtaggagctactgctatagtagaaagctatagatttgtcactcggattcattttgattccctaatattttttagctttctggaattagatttctccttagaacacaaaacatagttgtgccagttattttcctgcttaaagtattgctgcctacatgtcaatttggacggtcagcttcatattctaaacacatgtcaatttggacggtcagcttcatattctatacaatgtagcgcttttgacatgttggatgttgcaataataatatgtagtccttgaccttacgacatgtgctgctcttttttctttatgtctgaactggccacggctccccctttttttctatctctctaggaagcatcagggcttgcaagaaagctgcactggagtgcgatgaagcgaaatttgagcaatacaagctggctgcaggcgtgcgtatcacggcagagatcacccagtctgtagagaagtgctttgagaagatcagaggactagagagctaagcagaagaattgacatcatgtccacccacactcggatcctaaaacctgctgaccctgcaccacatccgtgatcacgtcacaccacaagttgtgtgtccagcgcccaccacagcaacggcctcttgctgccagcagcctccgtgcctccagcagctctcctctccaaggaaaagtctgaagtccgcaaccaaacaagtgttctgcagctgctctttgccgttggttgaagtctgcaaccaaacaagtgttatgcagctgctctttgccgttggttggagttcttg

SEQ ID NO: 7012 - DNA, 8305 bp, Zea mays
  misc_feature (2046)..(2046): n is a, c, g, or t
  misc_feature (2452)..(2452): n is a, c, g, or t
  misc_feature (2760)..(2760): n is a, c, g, or t
ttttttttttttttttttctttttcatttttatgcaaaaaattaaataagacgagccagtcaaacaaattataaattgggacattgggagtataactgtttctaccaattctaccctgtaagttctacagaagaatgaaaaacaacggatacgtgttgttaacctgcgaaggaacaagagggcatcagtataacaggcaatctgaaggtggtgaagatttgttgaagactgatccaattgcatctatgccagtgctctgaggaaaatgtcaaggcttaacacctgacaacaaataattgcagttctactcttaagtttggcaatatacactatacatagtcttgtgaaagccttttgcttttgagtcacgaatcaaccagttgagcatgtgctaccaccatgctggactcattctgattcacccagcttctgccagcaggtttctcagcattcagtgcagccactctttccctcaccatctgagcctgctcccactgtcctacgcaagcatacatgttggacagcagcactaggtgcccggctgctcgcgctggctgcagttcaactaatctattagtcactttagctgcaagctcaaggttgccctcccttctacatccactcaggattgcaccccacgcaccctcgtttggctggaatggcattttctccacaagctcaagtgcttcattcaaccgtctccagcaacagagcatgtcaaccatgcatccatagtgttgtatctctggatttatcccgtaaactctttccatactttcaaagtaccaccgtgcatcatcaatcctccctgccagactgcatgcccgcagaactgccagcagcgtggcaccatcaggccgatcctgcattctctggaacaagtccagcgcctcctgggggtgaccatgcattgcaagacccgagatcatagtagtccaagaaacggagctccgccttggcatcatcccaaacaagcgatgtgcatcttccacagcaccacacttcacatacatatggatgagagcattgtccagcaacacagtcctccgctgccacccttccaagtccactcgtgcatgcacccaccgcccaagttctaggtcacccagctccgcacaggcttttatagcagggcaaccatagtcactgcgtcatccttaaccctcgcctttctcatcctccagaacagctccaccgcctctgctggggggggggcctacgtagctgaaccgatcatcgtcgtccacgacaccacgtccctcctgctattgggcatctcgctaaagaaccgcagtgcggcgtccacctcacggcatcgcacgtacgcggcgagcatgcagttccacgcggccaccgccctggttgacatttcgtcgaacgccttacgggcgtccccgagctgctgggccgacgcgtacacactaacaaggctggtcatcacgtgcccactatcgcctgtctgggcgagtactccgctcgcaagcgcgagcgcgtggagggcgcggccatgggggagcgccccaacgcccgcgggggcgaatgcggcgaggagggttgagaaggtgaatgcgttggggcgcagcccgtggcagcccacgaggcgggatagaaacgcgagcagggcgctgggcgtggagcctgacgtggcggcggtgcgaaggaggaggttggcgagggtgggggacgctggggaagggggcacagagaggatgaagagtgactctgcgcgggggaggtcggcggcagcgacggtgagggagaggagcttggcgaggaggaagcgcttatgggtgaagccgttgaggaggagctgtgcgtggagttggtcgaggccgcggcggatggcagagggggatgaggagcggctgaggtgctgcgcgacgaggaagaggcgctgctgcagcccgccggagtatgggatgtaccggggcaggttgggcggaacaagagcccggtggcgagtgcgattgctcggcatctttcgccggctggcttctggcccggcccccgggaatgatacgagtttcgttagctgacattaatgcntgcaattggaagtttggcgtcttggcgacctacggctacaatatcggcatgtttggtttatgtatttggagagtcaggctaacttggtccgtacgcgcagagcctgcatgcgcagcgcagctattctggtgggtatggccgcagcttggttcaagaccatcttttatataagctaatgcacgccatgtcaacaaaccattcaaccaaacaagaaaaaaaatgaaaaatcctctatcccatgacacataccgaacaaatgcaggaaaccaatcacacggtatgtttcttttgctagattttgttattttttaatggcacatcgtttcatgatttgtgattcctcaataatactggtaaggctcctttaaagttgatttcttgaaaaaaaaatctaccaaaccagagnctctttgacgtgctcttcttagaaaaggaggagcacctctaaaaacctaacaagaggcagaagccataaaaatgagtttttattggctcctctctcatgttttttcttttcaacgacgttatatcacagcaaaagctaaagaatgagctatatttcaaccaaacaggacagtctttctaaagcttttcccgataataatgtgggagctgtttttttaataagccagagctagaggtgaagtatcggatgatgagctctaccaaactgggcctaataactagcccactaataaaatatgctttactctntatcttaatttataattcgtttacatatttttaccaagtttaactggcttgtgttgttttttttaaaaaatatatataaaaaatcgaagttatacataaaatatatcatgtactaaaccatattacagtaaaaaaatattattataacgagcatatcaaatttgttaaaagtcaaatgaattacaaatcgtgtctaacgaattgcaacagggtagtattaggaatcttcggggtggttggactgtcatcttatggtagaacaaccccgtagtcaaatatggcagattgccgctgccccaatgcccctatgccgccgccctccacgtctgtccgcctcctcttctcccgccgccgccctaacgccccccgcctgcatccctgcagccgtcacagtctctccgcctccggccccgccgctgccgctgccattgcaccttcgtcccgcaaccgcgccgcgggcctcgccgccgccgttcacggcacggtcgcggccaagaacttcgcgcaagccatccgtttgacgaaatccctcgtccaggtctcccgttccttccccggccggagctctgctgccacagccgccggcgccggcgccgcattcactgctctctcctccacctccaccacccctgcccccgccctcggcgtgctcgtcatcgccctctctcagatggggctgctcgacgaggctttgtacgtgttccggcgcttaaggacgctaccggcgcttccggcgtgcaacgcggtcctggatgggctcgtgaaagcacgcaggcctgggtgcgcctgggagctgttcgacgaaatgcttagacgggggttggtgcccagtgtggtcacgtacaatactcttatcaatgcatgccggttccagggtactgtggccaaggctcaggaggtgtgggatcagatggtggcacagcagattgacccaaatgtggtcacatatacgacgatgatatgtgcactttgtgaagagggatgcattggcgatgctgggcggttgtttgacgctatgaaggaagcggggatgcagcctaatcagtatacatacaatgtgctgatgagcggtcactgtcagagagatgatgtcaacagtgcagttgtgttgtaccaggaattgctgaagagtggcctgaatccaaatgctgttatctttacaaccctgattgacggtttctgtaaagcgaagaggttcagtgaagcaaaaggtatgtttcttgagatgcccaggtttggggttgctcctaccgttcctgtgtacaacagtttgatggatggagcttttcggtctggaaatgcacaagaagcattggcactttatcaggagatgactcgcttaggtttgtgcccagacgagttcacctgcagcattgttgtgagaggcctttgtgatggagggcaaatgcatgtagcggacaggtttcttcaaggtgtgcaggaagatggtgttaatctgaatgcagctgcttacaatgcactgattgatgagtactgcaggattgggaatttggaggaagcgctagcaacatgcactagaatgactgaggtcggaattgagcccaatgtggtgtcatactcctccttgatagatgggcattcaaaacgagggaagatgcaaatagcaatggctatatacactgagatggtggctaaagggattgagcctaatgtggtaacatacactgctcttattcatggccatgccaagaatggtggcatagatgctgcttttcgtttacacaaggaaatgatagagaatggtatttcacctaacgctatcacagtgtcagttcttgtcgatggtctgtgcagagagaatagggttcaggaagcggtcaggtttgtgatggagtactcagggttgaagtgcagtgacattcattctgtcttctcaaactttacaattgaggaagaatgtttaattccaaacagtgtgatatatatgaccttgatatatggcctgtacttagatggtcaacactgcgaagctggcaagcttttctcctacatgagaaaatcaggtatgatccctgatagctttacctatacactactgatacgagggcagtgcatgcttggctatgtcttgaatgccatgatgctctatgctgatatgatgaagattggtgttaaaccaacaaggtacaagatagaatgccctgagatctggtcatgggcaccactgaatgacctccaaactgttgtaagttaagaaatggattttgactacatacttcagatttctagagcaaaagccagttcacaggttgtggaacgttttagtcaaactcagtcatcaatatggtagaccaatctgttacatctgtgcgaccattgtaagatcgttatttggaaagccctctgcttattgaccttgttctcaaggcaaatgaaaatttgaagccattggatttgatttttaattgccgccattttgtggtacgggctctgaacaaaacgagtactgtaatatgatcagcaacaacgctgattaacaggaactggagcagatagatggctgtgatgagggttgaatgtaaaccattgcaaatgacatgtgcacaagcccatctgcaaacgcacctggaagaatgtacatgtggaagcaagtatgcaacatatgctgcacttgcagagatttactgtggcctttctggttctgatgtggattgagagggattgccagagaattgaactaaaaatatccctagccaacccatgcgcaataaaaaaggccttatagatattttacaggtttaagtctgttggcaattggcatatgcactagagaggacgtccaatctatagttaggtgaatgtcaatttaactgttcacctgatacgactatcagtgatgatcatgtattcttttaaatgtgggtgatgatttattttgcccatttttacctgctatgtgattatgtcacagaagtgtgcatgacatttaccatgcatttcttgttaacagtgccagaatgcattcctttcattagcattatggacaaatagcactactatactagaaacaaatatctactactcccaaaaaataatttcaccattgtcactgactaaaccaagatctttgagtcttctttcctggtagtactcaaggccatctaattcctcctccctctgtttaaaaataccatcaatgtgctggagtactttcttttcaccggcccttactccaattgcaattgcaagtcttggctgcaaattctctcttcccgatagttcttcatcctgaattattccacacatgtttcattagattatttaattaagataaaaatgatgatggaaaagaattgcctcctctaatcaattggttaaccccttctattgtggtatgatagtcagcaagggctgatttgcaggcatctcgcatggcctgacatattgattcctcattgtcaggactcaatggcagttcaaggtggccccaaactgaattcctaaagagtgcttccaagagaaatgcatctgttccaccaatgcaaagtaatcgcaggtaagggagcatttgagggggaaggggttcgttgaggattacatcaaagtatgcggtttcccccagtccgtttgcctctgcaatgtcaagcttgtctccataaaatggatcagattcagagatttccagggtcacagtaaacgaatcccttgatggatttgattccacaaacccatagtctagtgccagttcagcattactcttgtccagatcgtactggatatatatctgtaaatgcaaatctcagtgctcagttacaaattgcacgttttagcttgtcacttgaacttgaagcatccactattgcatatagatgctgaaagccatgaaaacagtgcacctagtgcagaaaaatggaacatcatctgtacctgctgtccagatttaacattcactggtgttcgcaaggagaacatgagttccctaccaaaaagaccctttcctttgatctcccaacttgacccttctgaggtgatattaggactgtgattaacctgatttgcgaagcaagcaaaataattttaaagaatgcatttccaacattcaaataatgccttatttgaatccttttgacatggtaccttaagcatggaaattacaactaggaccatttaacaacaataagaagaatcgtagcaagtgggattagaatctggaaaacgccaatatgtattgcatattaccaaatcagcaaatggtatgagagcaagcttatctccgcggagctctggaaacacccttgatctgagcattccaaatgcccataggaaatcatcaaatgttatgctacctgggaacaggtccttatttgtgcttatgatctctgcttgaacactatcaaattcgctttgcacatactctttcacgcccactgtggtgcttagcaactgtgttcctgcaagtgacagaagtagcataaaagttaccgagagatcccagcacacaacaactggcaagaacttttgcattgcacactgaccttgtatctctaggagctcttcttcagacctgcactggaggcaccaagcgccactcaaacatcagaacgagaatagcgcagaactgcagaagcagccaaacacaaatggagcgatcggcgtcctctcactcaccagaagatggtggagtcggtctggcgcgggaggatggccaggtagggcgcccacggcgagtccgccccgcgcgcgacctcactgaggagcagcagcgcgacggcgacccagggccggaggccccctccgccgccgcaggcgcggccgatgtcggaggccgcgacggcgtcggcgtccatccagagcttcttaggcacctccgcgaccacctccccgcggggcagatcgcgcgccgccacgaggccgagaccctccggcacggcggctggaatggcttttcctccatcgcccgcgccatgagaggcgagccaccggcggaagtcctccatcgcagacactgtggccgttgtgctggctgccgcgcggggtcgtagctgccgattgtggtgcctcgatggcttcgtggggaggcggaggcgaggaggcggtcggcggggggagttggggagacgctgcagggggaggaggtggtgctggtagagcgtggccatgattccctgcactgcgcggcctgcgcctgcgacggaggtagtggtttggacgacgacggccgttggtttccatatccataagtagttattatggcgggagtggatatgatcagcggtgaaatgccgaccgagtccgtgccaataggtgttttccctctaggaaacaggaggttaattatcctgtagatgttccacgaattatctcaaaaatgattcacgaccgctcataagtcataggcagatgatgatcggctccttgtagaacacatatgagatgggtcgttcaacgaaattacacaattcagatactccgtccgatcagaattacagcttttagctcaagatgaacttctccaactgtagtatatatttataagaaattgttgacgcttttttggagcgccaaacactcaacaagaaccgga

SEQ ID NO: 7013 - DNA, 1750 bp, Zea mays
  misc_feature (592)..(592): n is a, c, g, or t
gccggccgggtcgggaaaaaagttcgtggtatttcttttctcccgcagacagtggcggtagaagattgggtgcgggagcgcgacgtctcagctgggctatccaggaatccagaatttacttcggtggcgaggatgtctgtgagccatgcgcaggacattgaaatatcgctgtgcgacggcaactcggaggacgagcggcggcggcgcaagatcggctcgctgcggcggaaggccatccacgcgctcaagaagcgagggaggcgtcgcgtcgactcccgcttcccgccgccggccatttccatcgaggacgtccgcgacgcggaggaggagcgcgctgtcgcctccttccgggagcggctcgcggcgcacggcctcctccccgagaagcacgatgactaccacatgatgctaaggttcctcaaggccagaaagttcgaagccgagaaggcaatgcagatgtggtcagagatgctgaaatggaggaaagagttcggaactgacaccatccttgaggattttgattttgaggaactggatgatgtgctacgctactaccctcagggctaccatggtgttgaccgccaaggccggncggtgtacattgagaggctagggaaggtggatccgaacaaccttatgcagatcacgtcagtggatcgctacatcaagtaccatgtccaggagtttgagagggccttcagggagaggttccctgcctgcacattagctgctaagaggcacattgactccaccactaccatcttggacgtccagggtgtggggtttaagaatttctccaggactgctagagaacttgtaaaccgaatgcagaagattgatagcgattattatcctgagacactccaccaaatgtttgttgtgaacgctggcagtggattcaagtggatctggaacagtgtgaagggcttccttgacccaaaaacttcatccaagattcatgtgctcggttcgaactaccagagtaggcttcttgaagtaatagattcgagtgagttgccagaattccttggtggttcatgcacatgtagtgacaagggtggttgccttggatcgaacaaagggccatggaatgatccttatatattgaagctgatccacaatttggaagctggatgcatgagggaaaccaccaaacccgtttctgagggcggagaaagaagcagctcttcctttcggttggaacagatgaaatggcagggcatgttaagcgatacatcaaatgctgaatcaggatccgatgttgatgattttggtccatcatttgttcataaagtttcaggctatggttgcttgactccggttcgtgaggaggtaaagggcacagattgtgcaacatacttgagctgcgatgatcaaagtcacccggatatggttcctgaattttaccatggagtgcaacggactactgaaatggtgcagaaacaaatggctgatttcaggcaatattccaccaacagaaggcctagtgaattagggaacggctctcttaatgccaatggtacagcagctgctcagaggggctgggaagacgtggcgaagctagttattacagccttgatcaagctcttctcctttatacggctgttcctttccagagccaccgagagtaggctatagaaggtccgtcgcactgccacatcactagcagcagataagccaaagccgctccgagccgttagcgaagaagaagtgcgcgcctgactgcagcgcctggacagtctcgagtcgc

SEQ ID NO: 7014 - DNA, 2507 bp, Zea mays
ctagcatttctttttctctccccacgcagacgacagtggcggcggttcgaggttcggtgcgagagcgcgacgtcccgctctccccgccggccttgccggcggtgagccacgcggaggacatcgagatatcgctgtgcgacggcaactcggaggacgagcggcggcggcgcaagatcggctcgctgcggcggaaggccatccacgcgctcaagaagcgagggaggcgccgcgtcgacttccgcttcccgccggccgccatctccatcgaggacgtccgcgacgccgaggaggagcgcgccgtcgcctccgctcactagtccccccccccccccggcttcctccccgacaagcacgatgactaccacatgatgctcaggttcctcaaggccaggaagtttgaagccgataaggcaatgcagatgtggtcggagatgctgaaatggaggaaggagttcggaactgacaccatcctcgaggattttgatttcgcagaactggatgatgtgctgcgctactaccctcagggctaccatggtgtggaccgcgaaggccggcccgtgtacattgagaggctagggaaggtggatcccaacaaactcatgcagatcacgtctgtggatcgctacatcaagtaccatgtccaggagtttgagagagccttcagggagaggttccctgcctgcacattggctgccaagaggcacattgactcgaccactaccatcttggacgtccagggtgtggggtttaagaatttctccaagactgccagagaacttgtgcaccggatgcagaagattgatagcgactattatcccgagacactccaccaaatgtttgttgtgaacgctgggagtggatttaagtggatctggaacagcgtgaagggcttccttgacccaaagacttcatccaagattcatgtgcttggttcgaactaccagagcaggcttcttgaagtaatggattcgagtgagctgccagaattccttggcggttcatgcacatgtagtgacaagggtggttgtcttggatcgaacaaagggccgtggaatgatccttatatattgaagctgatccacaatttggaagctggatgcgtgagggaaatcaaacctgtttctgagggggaagaaagaaacagctcatcctttcggttggaacagatgaaatggcagggcttgctaagtgatacatcaaatgctgaatctggatctgatgttgatgattttggtgcatcatttgttcataaagtttctgactatggttgcttgactccagttcatgaggaagtaaagggcacagatcgtgtgacatacttcagctatgatgatcaaagccacccggatatggctcctgaatcttaccatggagcgcgacgagctactggaatggagcaccacaaaccaatggctgatttcagccaatattctgccaatagaaggcctggggacagtgctcttaacgtcaatggtacggccgctcaaagcggctgggaaaacgtggtgaagctagtggttacaactttggtcaagctcttctacttcatccggcttttcctctccacagccgagaggaggctcgagagcatccatcgccctgctccaccagcggccccagcagcggcagaggagccaagacctcgcgccatcagtgatgaagaggtgtgcgcctgcctgcagcgccttgacaatcttgagtcgatgtgcagtcacctcgccgccaaaccgccgcagatcccagaggacaaggaactcattctgttgagctcgttcgagcggatcagatccgttgaggctgacctcgagaggaccaaaagagtattgaatgcgaccgtggtgaagcagaaggcactggtggagactctggaatccgtacaggagtcgtcgtctagagtcaagaagaggatgttctgttcataggacattgagccgagctgagcaccagcagatcccaggaaccatgccatctgcgtcgtcattaaccaacaaactgtgaagctgacgtgcgaagctgccagcagccggagcggagccgccattttgacctggccgcgaccacccacttcgtcagccctccgaggaggatgaaccagcctacaccaaaatggaagagaagaccgtagcacccatgtcgcttcctttcattcccacccgtttttgtagcctccgtacggttgtagttgtaccctgccttccggcgatcccgttttttgattggtgaattctctgctccggccggccgccgagcgccatgccaagtgctgtgttacatcttcttttccttggtgccgtccgaatggctggagtcgttcttctgtatactgatgagtacagagtagtgacccccgccgcaggagctgggctggggagaagcacggtggcgagcttggtctggctgcagctcctgtgctgtcgtctgtacatggcacagactgcttctggtggccctgctaatacagattgctatgaaatggcctgtttgcgttcaaaaaaaaaaaaaaaaaa

SEQ ID NO: 7015 - DNA, 2212 bp, Zea mays
gcaggatcgtttcaattcaactgagatggcaaaacttctgctcggggaaaaacagctaagaacagtcgggcggtctggccaggcggcgtgtgagcgtgtccgagatccacaggacgcaggacgctgccgatggcgaagccgaggaaaacccgcacctcggctccagatccgcccgtagccgccgttcggcttccgtggcacacaccggcgccggcggtccccacggccgttctgatctcgctcgctgccctcctcatccgcgtgctggtttccgtgggcccctactccggtcagggtgcggcgcctaagttcggcgactatgaggcgcagcggcactggatggagctcacactccatctcacgcccgccgactggtaccgcaacacctccgacaatgaccttgcctactggggcctggactacccgcccctctccgcctaccagagcctcctccacggccgcatcatcaacacctcactccccgaggccgtcgctctccgctcctcccgtggctacgaatctatggaatcgaagttgctgatgcggtggacggtgctgtcatcggatctgttggtgttcttcccatctgctttgtggtttgtgtgggcgtacatgaaacttggagtcggtattagtggagaggagagacgggaggggtggatgtggctgctagccttggtcctgatcagtccttgcttggtattgatcgatcatggccattttcagtataattgcattagccttggacttacgctcggagcaattgctggtgttttgtcgaagaatgagcttgttggtgcatctctcttcactctcgcaatcaatcacaaacagatgagcctgtactttgcaccagctttttttagccatcttctggggaagtgcctcaaacagaaatatcctattgtcgaagtaacaaaacttgctttcgtggtcttgggaacttttgctcttgtctggtggccatttttgcattcttatgaggctgtccaacaggttctctctcgattagctccatttgagagaggcatatatgaggattatgttgcaaacttctggtgtagtacttcagttattatcaagtggaagaaattgttcgcgataaagccattgaaacttatgagtctatctgctaccatactggctttcttgccttcattcgttcagcaagtcaagtctccaagtaatcttggcttcctttattctctgatgaacagctctttctctttctacctattctcataccaagttcatgagaaatcaattttgcttcctcttttacctgcaagtcttttagcactggaagaacctcggatgtacggatggttcgtgtactttgcccttttctcaatgtacccacttatctgccgtgatcagcttcttctacaatacatagctgttcttagcctattctttctgatatactactcacctggcggaagctacggaaagagatcaaacatttcatgcaaggcaaagttagttcttagcttgccatttttatgctcacttctacttcacattacctacctgcaaatagagcctcccaagaggtatcccttcctctttgatgcactgataatgttcgtctgtttttcacaatttgtcatcttagctgtgtacaccaactataagcaatggatgttggactcaaattctagatccataggtgtgaagaaggatctgtgattgaaaattttgactgctaattttacagagaaatccactgtccctttgtaaccttgtgtgtattcccttttaacattatttattgaatgaaatgcggtgcaaatccagacatttgtataaaatcagaactggaaacgccgccaatttaggtgatgtagactcaacactgcttttgtggcacatgttaggatttgtgacttaatgtcatctttcgaattgtttgtgcccttgaatatggcaacgctggtgtcctgcctggtgtaggtggctcggtgcatgtgtggaaattgtagcctctactgatctctcccagtttgaggcaactttccctaaaccctagtggcctagtctgtttgcttcccatgtgctctgaattctcccttttggatagagacctgttcaatttcagacagcgagtcgcgctgtttgatttggccgaatctaaggagcctgaattgatcggtgacggttggtagctcgattttcgggcggcacgctgtcaaactggcaggggtaccgaggc

SEQ ID NO: 7016 - DNA, 3148 bp, Zea mays
tacgcggggggagtttgcggtgccgtacgaggacatgctttctggtgcagagtctctggtggaggagatcgcgtcaccaagcgggagctcaagatcatcaactagaaaagaatcggtccgattggatgctgagccatatataccctatcaacaagttccagatgctggttctggcaggcactctgatgacgagcaatttcatccagtctcctttcctccagatggcgagcaaacgttcactatgtcatataacaagatcacccgaggaaggccagatgatcttgttgaaatgaccgcttgcatagtagaaccttcaattagctatgtggttgactcttgcaatttgtcaaatgatttagaaatggattatgtcccagtaatggacagtggcacaaatgctaatgttgtgaaagaaaagatgaacctaccaaacattgcagattccggcctggagtgtgctgatagtgcttatgtggttgatcatcagcaacatatcccaacatgccctcccatctctgaaaatatttgccaggatgaaaactacaataagaggtctagcacacattcagtgtcaagcgaggaagcaccttcccctgactatccattcttaagggtatccaacatcaaccttccagcagcacccatcaaagtacaaccaccaccgatgcccccatctaaattgcttaataaaaagggaagcaacgaaaatggagattctgatgtcaatcctaactcagttgctgctgctgctgctatgaaggaagcaatgcaatttgctgaagccagattaaaagctgcaaaagaattgatggagataaaaggtgtcagctctaaattccgtaagcggccagttcatcacaaaagcacaaaatcaactgaaattaaggaatacaatgcacctgaaaaagcacatctatttgaagaaaagctggatatgagaagattggtaaaagaggaaaatcaaagcaatgatatagctttgctggataaaaacacgggcagtgttgcacttgagcacagtgatcatgacaaaaaagggattatatcaccagggaggcctaaggagatgatgcaaaacgacagtgaactagaacaattaggagagtggacatcagatgctgatttttatgaattggttagcaatgatcagaaatgcagaactaatggagctgaatgcagagacaatggtctgatgacaaattccttagccaagcttgaccggtctgagaatgaaaaatcaggaggctttgcaggtgagtcaaaaaggtctaggaaattgtgggattgtaacaacagaacatgtctgcggactgaacacgtaaatcagggaaaagatggtataggttcattggaggttgaacaaaagaatactaagtctccagaagttacagaacatgtaaatcagcaaaaagatgctatagattctgtggaagctgaacaaaagactcctaggtcaccagaagtttctccttgtaatgaaagggtgacgtatgaagagccaaccaaaggaaataatgatctgatgacaaattcttccaccaagctcgaccagtctgtgaaagtaaaggaaggggtttttgcaggtgagccaaaaaggtttagaaaattgtggggcagtaacagtacaacagttctgagaacagtgcatgtaaatcaggaaaaaaatgctatagctttcgtggaggctgaagaaaaggcacctaggttttcggaagttcctccttgtgatgaaagggtggcatcccaagaggcaactgattcccgtttagaacaatgtccaggggtggggaattctctaggtcacgaaaatggtgcacaatttgagacttcatgcgtgaataatttaccttcagaggtccatgcagacccagaaatctccagttcattttcggaaccttgtttatcaggaagtcatgccaatggtaatgaaaatcattctgaaagcacagctcaggaaactgcatttgtaggaaactgtaaccaaaatgtcaacaataaagaggaacttgagcttccgtgcattgatgggttgccttgtacttcagcaagtaatcagattttgcaggaacattttaatgttattaatgctgatgaaaacaaggaaattgaagtgaaaatatcaaaattagaagggtcttccaaatcttatttgaattttgaggaagaaaagttacccagttttgttgatgaatcatgcctacagaacaaaaatgaaagagaaaatgaagtaaattcagaatcacccatccatgaaaagatgacaaagttcgggattgaggacaaaggtgatgcatatgaagattttcaagagggagatatggatcaggttgctggatctgctgaagaggaaggttatgttacttcaggaagtggtattgctaatgaaagcgaatatgaagaagcagaagatgatatatttgtaggagacatggaatcaaatgtaagaacatgtggtagttttgacaaagatccatatcagcgccaagaatcacaaggatcatggggaccccaagatttggataatagaatggacaaaatcagtgatacaatatctcatggaaaggaaagggagactaaagaatccttgctggagaatgttgaaaagacagcggcagaagaagtactaaaccatgactgcagggaagggcagaaatccatggaaaccgttgactacatgtggcccaaatatgtatgtgcagaatttaatgtaagtagtgacaaagatggtaatgtgtttgattctgctgatgaacttatcagcgacaatggcagtgattatgccatgaacatgagcacaatgtcaaataatctgcaagcttcgttttcagaagcatgcagtagcattcaacatctttctcaaaaacctcagtctatttctgctgagaaggctgatgaaagcactcctgttcttggaaatcttgaagtggattgtggagaagcaggtagaaaaattccaagtgaaaattgtgaagtctcagaagaagggcaaaatattggaatcgaaatggaagaaagaaaaagagaagacaatatatcaaatataaggttcatggatcagcaaccattttacttggacagtgacgttagacctaaggctgcagaaggtaccgcggccgcgaccacgctaaatccagagaagaggatctta

SEQ ID NO: 7017 - DNA, 4703 bp, Zea mays
gatgttctgacgtggcacttggagaagtctgacagttttttttcagtcagaagtgcctactggatattcttcaccagttcaccactgactgtaatcttttgtctggttaataaatttctctttacctgaaaaaagtacatcatccgtatcatgtcaacgcacactgattactatccgggtttcgtgtggcaggtctacagtcacagaacacgcgatccttctgttcggttgtttggaggctgttgaacaaccggctgtcaggtcgtcacaaagtacccgggcgggcaatagacgctccctttttgcagattctccggaacaagatcacagacagatcaacattggtagttatgcaacccctccaaccgcaactgtttttgcatcagcctctcctaccttgtctagtactagtagcaagttcaagcaagcctccacggctccactgctatataaacagtactgcccccagacccctctctactcaaatcacaaaccccgctacctcttaactcttcacacgcacaccgtctctcagtctcagacccacgtcgtcaaccatggtgagtccgtgagtgacatgctacgccagcttatagttgctagccatgcgcccaaacgtatgttgatacattcctgccaccattttctttgcgcgcgcgatgcaggttgctgacatgaaggagaacggcggcgcggtgttggcggcgggcgagaaggcgccgcaggtggtcgtcaagcgcggcgagccgacgctggtgccgccggcggaggcgacgccgacgggcgggcagtactacctgtccaacctggaccagaacatcgcggtgatcgtgcagacggtgtactgctacaagcccagcggcggcggcggcgacgtggcggccgcgctccgcggcgcgctggcgcgcgtgctggtgcactactacccgctggcggggcggctgggcgtaagcccggagatgaagctgaccgtggagctgaccggcgagggcgccgtgttcgtggaggccgacgccgcctgcgaactcgccaccgtcggcgacctcaccaagcccgaccccgccgcgctcggccagctcgtctactccgtccccggcgccaagcacatcctcgagatgcctcccatgaccgcgcaggtacatgcattaactgcatctcttgcacgtttccggttgaattgggcgtgtccgacgaggtggccggaaagggttggcttgtgccgttaatggcaggcctggctccgtggcccgtgcgccattttggtgaaaagcccaagcccgcgtggatgcccgtcgtcccacttttactgccgccgcgtgcagcggcagcaaaggaaccgtggagttattggttggaggttgacggggggggtgggggagctgaaagatgaattcaatgagatgcccctttggtctttgctagcatgggaaattgaagaccggaaatggaaaattcgctggtgcacctccacaccacaccactccacctcacgagctggcctacgtttggaacacgggcaggctcctcgatttgtttcgtggaattaactgcgctccaaaccggtgatagagcatcgtcttgcgagaaattggatggaagcatgcgtgtttttagaattcgtttccataaataaaataaccggtggccactagaaaaaacgatgaatgcttttctgacctctttcttattcctctgtgttttttgagagaattattcctctgtgttgcctcaaatgaaatttttgttatgttttcaattatttttcttataaacagaataaatttcatccatgtttgagtcagttatttaaatttgtctggtccatacttgggttcagtaatttaaaacttgtcggttattagtcaaccggcactcgcattggcaaaacccccagaaacatgaaacatggctaaattgtcctactgtacacttgtctatatacgcatgcctgtagtactcacctgatccagcaactgcaacctttctctatgtatagtgtttgttcaaagttttttctttgtcaataattttgttgatttcaaggtggggatggttatagccgactgtcgacacgtcacacatataagtctgtctgatttttctggttagaccgagaccactcaagcactctggttgcccgcaatgacttgaaatagttttcccggtagtgtcagatcaccaacccttacctataaaatcaaaccaaaccacagcaccttccctcttttgtcttctacatgtagtactcaccagccaccaatggagtgattttagttttctaccaactgaagttacaaataattaactattagttctagtgtattcaaacaccacctaagtactacttgattccagtcaatcgtgcatagagctattcgaagtcacaagacatcttttccaaaaatttcctcagatttgtcggtaaccagtgacgttaagttactcattcagtgggttaattgatgtgcaggtgacaaggttcaagtgtgggggcttcgcgcttggcctggccatgaaccactgcatgttcgacggcatcggcgccatggagttcgtcaactcgtgggccgagacggcgcgcggcgtcgctgagctcaccgtgccgccgttcctggaccgcggcgtcctgaaggcgcgcgacccgccggtgcacaccttcccgcaccacgagttcgccgagatccccgacgtctccgacacggcggcgctctacggcgcgcaggagctgcagtaccgctccttctgcttcgacccggaccggctggagcgcgtccgcgggctggcgcttgccgacggcgccctcggccgctgcaccaccttcgaggcgctgtcggggctcgtgtggcgcgcgcgcaccaaggcgctcgggctggcgcccgggcagcgcacgaagctgctgttcgccgtggacggacggcgccggttcgtgccgccgctcccgcggggctacttcggcaacggcatcgtgctgaccaacgccctggccacggccggcgagctgctgtccgcgcccgtgtcgcgcgcagccgggctggtgcaggaggccgtgcggatggtgactgacgactacatgcggtcggcggtggactacttcgaggcgacgcgggcccggccgtcgctggcgtccacgctgctcatcaccacgtggtcgcgcctcgagttccacggcgccgacttcgggtggggcgagcccgtcatgtcgggcccagtcacgctgccggagaaggaggtcatcctcttcctcgcacacggcaaagagaggaagagcatcaacgtgctgctcggcctgccagccaccgcgatggacgccttccaagagctcgtggacgagatatgactgattcatcggtgatgagcagcgatgacggacagggatgggttgctatacatacatatataatgcagggtgcgcctgctttggtttatgtacgaacgtgttaatattccttctatgttggtgtctaagtttaatgagcatatgagaaattgttatcgatcaaaaaaaaaaaaaaaatacacgcataatggaaaatagtgaggtttgttccttttattgtagttgaggatacgttaccttttactttttattggagagcgcattaacatacaattcagaattaatttttttgaaaatgaatagtaaatttaatataaaatattattggagatgattctgtacacatacatctcgtgcacatgctaagaatacaaaccgcgtatctaccgccagcagcccaagactccaagcaaagtagcccacgatgggccgtgaacacatcgcggccatggccatttcatatgtggcccaataagcaacacagtatgcaataattcagtcgagaacatgcgaagggttgccgttagggcatgtactagcgctagcgagagactccaagagacagctagaagaatgtatgatagtacaattatgaacctctaaatcataaatgtaattaagacacaatatgtatagatagtcgtatagagatgagctcttcgtaaaaagtccgtttcttgatttttttttcttcaacttagcctcctaaagaccccttaagaaatgcccaatttaattgggttgtacttaaaacgctgtaggatgctgctacgtctgggttaatagtttcactgctgaaccatacgtacacgactcgatggtcatggttgcatgcagtttgtgtgttcagtatagcgtctcaaactctgctgcatacaagagcttcacaaactcatccacgacaccgggcaagaggcaactctgctgcgtaccagtactatgccgaggtagccatgtacggtgccttggcgtctttattacgtaggagtattagctaacacctaacagagcaacaacacgtggcgtcctgcttggggagactcccatgattccatcccatcatcacccatcgatgcttatctgaacctgaatatgcacgaaatacttgctccactgtccacatctccctcgtcacgctagccagcgaggacgtctgaaacccacagctccacgtctgcgaccccacgtaatgcgcaagcccgacgccagttatcacgcgcattgacacatcatcagtgaacgggtcgcgcgcgcccgaccgcgacggcggcggcacacgttgccgacgagtggaagaccaaccgctcgcttgccgtgactgccatgccacacaagctagcgctagcgcacatcgagcgagggaacg

SEQ ID NO: 7018 - DNA, 3361 bp, Zea mays
ctgattcgaattacatcatccatatcaattatgtcgaagcatacatactgattgtatccatatcaattacagtatgtcgaagcatacatactgattgtatccatatctaacgcagaacacacgatattttcggaatttcggtgtctgctagctgcttcggttgtttggaggctggtgaacaaccgggtgttgtcgggtcgtcacaaagcaccccgaatgggcggtagagggtagacccctttctgcctattctattcaaatcccagacagagcaacattggtagttatgcaacccctccaaccccaactgttttgcatcagcctaagggcccgttcggttgacggggaatagaaggccggaattgttccggtccggattgtttctctaatttgtataagttttgatcaacaggaataattcttggttcaatccagcagaaacgaacgggccctaaccgatcttgacagcaagctgaagaagcttccaggggctccactgctatataaacactgcccccagagaccccctcttctcaagtcacaacaaacaccaccatccctttgctcagagcatcacactccctctctctcgcgcgcgctcacaagcacgtcgtcaaccatggtgagtgacctgctacgtcagcttagttgttaaccaagcacagcacatgttgacaacatgcatgtctgtgagtgacaccactgatctcgtcaccattttctctgcgtgatctgatatgcaggttgtcgagatgaaggagaacggcggagcggcgttggcggcgggcgagaaggcgccgcagctgggcgtgaagcgcggcgagccgacgctggtgccgccggcggaggcgacgccgacgggcgggcagtactacctgtccaacctggaccagaacatcgcggtgatcgtgcagacggtgtactgctacaagccttcctcgcccggcggcggcgaaggcaaggaggacgtggacgtggcaggcgcgctccgcgacgcgctggcgcgcgtgctggtgcactaccacccgctggcggggcggctgggcgtcagcccggagatgaagctcaccgtggagctgaccggcgagggcgccgtgttcgtggaggccgacgccgcctgcgacctcgacgccgtcggcgacctcaccaagcccgaccccgccgcgctcggccagctcgtctactccgtccccggcgctaagcacatcctcgagatgccccccatgaccgcgcaggtgcatacacacgacacgctgaccgcttcgcttgcacattaaccgcgtggagttattggttggaagttgagggataggccaggggaagttgggtcgccgtagtcccccctgggagctcaaaaataggagggtcttggaggggataattttttttaggcttttaaactagtccttagtgacataaatgccgctttggtttaaatctagcataggaaattgaataacggaaatggagaatttactgctccgccttgggaactcgactcgtttggaacacgtgcacgggcacgctcttcgatcagtttcgtggaattattactgcgctccaaactggtcatgggaaacggctagaaaagcatgcatgtttttagtaccgctttgtgtgtttgctttaaatgaaaactctgttaggttttgattcattttttttaaaaaaaatagattaagtttggtccatatgcggtttcagttatttaaatttgtttggtccatatatgggttccgttatttaaatttgtcggcgtattagtcaaccggcactcgcggtggtcaaacacacagacaccaaacatgcttagccgcctgctgccggccccataggcccagagtattccagaggctgtcgtactgatccagcaactgcaactgtgcaacctttctctctgccatgattgtagtcgacacatataccctgtctactacttcctgttaactgagacaacgcaagcactctggctgcctgcaatgatttgcaattgtttttctagtacaatgtaagatcaccaacccctacctataagtcaaaccaaatcacagcaccttccatcttttctctcttctatacccatgagtgaacataacaaatgtttctttaccacggtccacgggttaattgatgtggcaggtgacgaggttcaagtgtgggggcttcgcgctcggcctggccatgaaccactgcatgttcgacggcatcggcgccatggagttcgtcaactcgtgggcggagacggcgcgcggcgtcgccgagctcaccgtgccgccgttcctggaccgaagcgtcctgaaggcgcgcgacccgcccgtgcccaccttcccccaccacgagttcgccgagatccccgacgtctccgacacggcggcgctctacggcgcgcaggagctgctgtaccgctccttctgcttcgacccggaccggctggagcgcgtgcgcgggcttgcgctcgccgacggcgccctgggccgctgcaccaccttcgaggcgctgtcggggctggtgtggcgcgcgcgcaccaaggcgctggggctggcgcccgagcagcgcaccaagctgctgttcgccgtggacgggcgccgccggttcgcgccgccgctcccgcggggctacttcggcaacggcatcgtgctcaccaacgcccttgccacggccggcgagctgctgtccgcgcccgtgtcgcgcgcggcggggctggtgcaggacgccgtgcggatggtcaccgacgactacatgcgctcggcggtggactacttcgaggcgacgcgggcccggccgtcgctcgcgtccacgctgctcatcaccacctggtcgcgcctcgagttccacggcgccgacttcgggtggggcgagcccgtcatgtcgggcccggtcacgctgccggagaaggaagtcatcctgttcctggcgcacgggaaggagaggaagagcatcaacgtgctgctcggcctgccagccaccgcgatggacgccttccaagagctcatggacgagatatgattcattcgtcggtgatgacggacatggatgggttgctgctatacatacatttacgatgcagggtgcttatacattcttcaattgctcggtgttatagtacgaccgtgttaatactcgatctatgttgatgttgttaagtttagtggccatatgagaatttgctgtcgattgcaattgttctaatattaatggaaaatagtaaactttatttcctttcattcaaaaaaaaaaaattcccttctactccctccatttgtttttatttgtcgctcgttagtacacaattaaactaagtgatgtcaaataaataaaaatggaggtagtacttattaggtcgtgaccagcagatcgtgca

SEQ ID NO: 7019 - DNA, 1674 bp, Zea mays
actcaagtcacaacaaacaccaccatcgtctctttgctcagcacaaaagcatcacactccctctctctcgcgcgctcacaagcacgtcgtcaaccatggttgtcgagatgaaggagaacggcgtagcggcgatggcggcgggcgagaaggcgccgcagctgggcgtgaagcgcggcgagccgacgctggtgccgccggcggaggcgacgccgacgggcgggcagtactacctgtccaacctggaccagaacatcgcggtgatcgtgcagacggtgtactgctacaagccctcctcgccgcccggcggcggcgaaggcaaggacgtggacgtggcagccgcgctccgcgacgcgctggcgcgcgtgctggtgcactaccacccgctggcggggcggctgggcgtcagcccggagatgaagctcaccgtggagctgaccggcgagggcgccgtgttcgtggaggccgacgccgcctgcgacctcgccgccgtcggcgacctcaccaagcccgaccccgccgcgctcggccagctcgtctactccgtccccggcgccaaacacatcctcgagatgccccccatgaccgcgcaggtgacgaggttcaagtgtgggggcttcgcgctcggcctggccatgaaccactgcatgttcgacggcatcggcgccatggagttcgtcaactcgtgggcggagacggcgcgcggcgtcgccgagctcaccgtgccgccgttcctggaccgaagcgtcctgaaggcgcgcgacccgcccgtgcccaccttcccccaccacgagttcgccgagatccccgacgtctccgacacggcggcgctctacggcgcgcaggagctgctgtaccgctccttctgcttcgacccggaccggctggagcgcgtgcgcgggcttgcgctcgccgacggcgccctgggccgctgcaccaccttcgaggcgctgtcggggctggtgtggcgcgcgcgcaccaaggcgctggggctggcgcccgagcagcgcaccaagctgctgttcgccgtggacgggcggcgccggttcgcgccgccgctcccgcggggctacttcggcaacggcatcgtgctcaccaacgcccttgccacggccggcgagctgctgtccgcgcccgtgtcgcgcgcggcggggctggtgcaggacgccgtgcggatggtcaccgacgactacatgcgctcggcggtggactacttcgaggcgacgcgggcccggccgtcgctcgcgtccacgctgctcatcaccacctggtcgcgcctcgagttccacggcgccgacttcgggtggggcgagcccgtcatgtcgggcccggtcacgctgccggagaaggaagtcatcctgttcctggcgcacgggaaggagaggaagagcatcaacgtgctgctcggcctgccagccaccgcgatggacgccttccaagagctcatggacgagatatgattcattcgtcggtgatgacggacatggatgggttgctgctatacatacatttacgatgcagggtgcttatacattcttcaattgctcggtgttatagtacgaccgtgttaatactcgatctatgttgatgttgttaagtttagtggccatatgagaatttgctgtcgattgcaattgttctaatattaatggaaaatagtaaactttatttcctttc

SEQ ID NO: 7020 - DNA, 819 bp, Zea mays
atcggtccgcaagtcacaacaaacaccaccatctctttgctcagagcatcacactccctctctctctctcgcgcgcgctcacaagcacgtcgtcaaccatggttgtcgagatgaaggagaacggcggagcggcgttggcggcgggcgagaaggcgccgcagctgggcgtgaagcgcggcgagccgacgctggtgccgccggcggaggcgacgccgacgggcgggcagtactacctgtccaacctggaccagaacatcgcggtgatcgtgcagacggtgtactgctacaagccctcctcgccgcccggcggcggcgaaggcaaggacgtggacgtggcagccgcgctccgcgacgcgctggcgcgcgtgctggtgcactaccacccgctggcggggcggctgggcgtcagcccggagatgaagctcaccgtggagctgaccggcgagggcgccgtgttcgtggaggccgacgccgcctgcgacctcgccgccgtcggcgacctcaccaagcccgaccccgccgcgctcggccagctcgtctactccgtccccggcgccaagcacatcctcgagatgccccccatgaccgcgcaggtgacgaggttcaagtgtgggggcttcgcgctcggcctggccatgaaccactgcatgttcgacggcatcggcgccatggagttcgtcaactcgtggggcggagacggcgcgcggcgtccccgagctcaccgtgccgccgttcctggaccgcagcgtcctgaaggcgcgcgacctgcccgtgcccaccttccccaccacgagttcgccgagatccccgacgtctccg

SEQ ID NO: 7021 - DNA, 1850 bp, Zea mays
ctttattttcgtaccgtggattgtcaggcaggggtgcagtccgtccgtccgtcgtgagcgtgtagagatgacctgcatttgcaaacggtcaaaccaatcaggccacccacccaaggcgcaacggctacaactcccctacaagtgtccggcgccccttggtctgtctctgtccaccaccaccactagtccacgacggccgccagccatttcgccgcggcttccacttcgtgttcgttcccccaattgcgtctcctccttccaactccacgcgcttcaatcccacaaccgcgtcgccgtcccgatcccccctttctcttccatataaaaaaccctcaccaggtcccgggggaaacccaatccagaccccatccatcgattggaacccagatccgcaggccgcagcacaagagggtgggatcggatcggatcggagcagagcaaaggggacaaccgaccagaatccgccggcgaccaccatgggctccgcgagccgtgccgtctcgtgcctgtgctgcccctgcaagtgcctggcgtgcgggctcctgagctgcctgtgcagcatcctcgtctcgctcgccgtcgtcctgggcgtcgtcgccctcatcctctacttcatcttcaagccgcacatgatcgcggccaccgtggactcggcctcgctctcccagttcgcgctgtcggcgtcctccacgctctcctacgacctcaacgtcaccatgacggtgcgcaaccccaacacgcgggtggggctctactacgacgacgtccaggcgctggccctgttcagcgaccagcgcttcggctacgccccgctcgacgccttctaccagggcacccaggcgtccacccagctcagccccgggttccgcggcacgcagctcctccagggcgacgtcaccgccgccgagttcaggcaggagcagtccgcgggcaacttcgccgtcgacgtcgacctcaacgccaagctcagggtgaaggtctgggcgttcaaggtccgcgggcccaaggctaaggtcacctgcaagctctccgtccccgcacccggcgccgccaacgcctcgcccttccagcccaccgtttgcaaagtctggttctgattttccatgttgtgggatttagatttacctggtaggcattctactagtagtagtagataatgttaccagctgatgctgatgtcgattattgttttctttcgttcattcgttggtcgtcagtcccgctctggattttgctttatgtatatatatactgctctccttcattcgtaccagcactctgctctgctgtatacacttttgtttgctctcagtttttattactactgtagacaaatttactagttgtcccggctaatctcgtgattctttggacttgagatgattgctttgctgaaatattaatcgaattgttcggttgcaatcctcgctacgctatgaatgaacgaaacatttgtggtgctggctgttggagcttttgtttggcgtgctcaaccaaatcaaaaccacggagaagtagatatcgcacgcggaaagcttgccaccttttctacccctgaaaacagcaccgcaccaactcctttttccttctgccgtgtgcaccccatgatttttttcatttttttctaagaaaaaatagcttatttttctttaaaaaataaaaatcatttagaaaattagagttaccaaactagttctaattgtattattttctcaactccttttccttctgtcaagtgcactgtgtaattgcatctctaccttcgatcgatgcgcttggtaacaaaagaacaattgccacttccgttgatggattcagtcccagcatgttctcagcttcacatgcttcaa

SEQ ID NO: 7022 - DNA, 1763 bp, Zea mays
ccggccgggaggggtgcagtccgtccgtcgtgagcgtgtagaggtagagatgacctgcaaatggtcaaatcaatcaggccacccacccaaggcgcaacgggccaacggctacaactcccctacaaggcacgagaccattacctagaacatcctaatcgaaaaaccactagtccacgacggccgccagccatttcgccgcggcttccacttcgtgttcgttcccccaattgcgtctcctccttccaactccacgcgcttcaatcccacaaccgcgtcgccgtcccgatcccctcccctcccctccctttctcttccatataaaaaaccctcaccaggtgcatcaattgaaacccaatccagccccatccgtcgattggaacccagatccgcaggccgcagcacaagagggtgggatcggatcggatcggagcagagggggaccgaccagaatccgccggcgaccaccatgggctccgcgagccgtgccgtctcgtgcctgtgctgcccctgcaagtgcctggcgtgcgggctcctgagctgcctgtgcagcatcctcgtctcgctcgccgtcgtcctcggcgtcgtcgccctcatcctctacttcatcttcaagccgcacatgatcgccgccaccgtggactcggcctcgctctcccagttcgcgctgtcggcgtcctccacgctctcctacgacctcaacgtcaccatgacggtgcgcaaccccaacacgcgggtggggctctactacgacgacgtccaggcgctggccctgttcagcgaccagcgcttcggctacgccccgctcgacgccttctaccagggcacccaggcgtccacccagctcagccccgggttccgcggcacgcagctcctccagggcgacgtcaccgccgccgagttcaggcaggagcagtccgcgggcaacttcgccgtcgacgtcgacctcaacgccaagctcagggtgaaggtctgggcgttcaaggtccgcgggcccaaggctaaggtcacctgcaagctctccgtccccgcacccggcgccgccaacgcctcgcccttccagcccaccgtttgcaaagtctggttctgattttccatgttgtgggatttagatttacctggtaggcattctactagtagtagtagataatgttaccagctgatgctgatgtcgattattgttttctttcgttcattcgttggtcgtcagtcccgctctggattttgctttatgtatatatatactgctctccttcattcgtaccagcactctgctctgctgtatacacttttgtttgctctcagtttttattactactgtagacaaatttactagttgtcccggctaatctcgtgattctttggacttgagatgattgctttgctgaaatatatgaatcgaagcggaccacaaagctccagctaaaagaacccaaaaaagagggaccactgccccctgggcgtaatcccggtaatagcggcttcctgggccgcagtgttatccgcccacaaagccgctcaacatgcgagctggaagtataaagggaaaagcctggggcgtctaaagagtgagtttactcccataatccgcggggggctaacgggcgggttaactggcggaaaacctggcgggccaactgcatgaatgaaccgcccaaaacccggcgagacagcgtgtccgtattgcgggctctaccccttccacgccccctgagtaaatgagctcggcacctcggctgcagagagggttatcctttcactcgaag

SEQ ID NO: 7023 - DNA, 3672 bp, Zea mays
  misc_feature (2738)..(2738): n is a, c, g, or t
tcgaagaagggagagagaggcggcggcgacggctagggttacgcccgccgaagttgcccacgcgggaggctcttcaagcttatgttctataacatggaggaatccagtttcagcaaaccaactgtcaaaagacttttggaggacgagctacgaaagctaaaacagctgaagcttccaaatgatgaggttgagagaatattagctgacctgggacatggtgcctgcctggacaaaagttcaacccagaacagcaaagcgaagaagggagaccaaaatcacatcagaggtatcaccaccacggctgctccatctggatctttggatcccactgcttccaactgcatgaaagaagcagaagaaaatgagcttgaatttgccttggcagatttcttaggacggattcatagaaattgcaacaataatggggagttatgtacggagatgaaagccctaatccaaacaaagattgcagagctagataatcctccgtgcacatttgcttatgagcagcaaacttcacggggtgacgaatatgatactgctggtggcaaacatcgatgtagcagtagtaaaactcagcccaaaaaattcagagatgcgctggagatgctaagctcagacaccgaacttttctttcagaagtcaaattcacgtattttggagagcgcccaaagaaaccaaaacagactgatagggagcaatctagagcccacaaaaatagcagataataccgactccaacaaagatccaaagagtctgaaccagcatgagttggccaccaggagatatggtaaagagagcaggaatatctttttctggaagaaggaaagatcctcaccaaggcagactgcacaaggaaccagtagttctcagccagttaacaaaatagttatactgaagccaaatccaaggagagagatcggccatgctgtggctgttagttcaacccaagctccaaaactaggtgcaaccgagagctcaaaattttcaattaaggaggtcagaaggagattcagaatcgtgactagtgaagctacaaaaggaataccctcagtgtcagaagataacctccaaaaaggtcagcattggctcaacagttcagctttcacaataataaaagataccagacagctcgctgaacagacctcagaagggaaattctcatcttcagttatgaaggattttagatcatcaaacagcggtaggcaaaagaaaagaaaaaatgatgggccaaccgaaaaaaacggtagcataattacgtcatccaaggatgaatctgtcttctatgacgaggccaggaaacatctaacagagattctcaaggacaaaagacaaacaaccaagcagcacccgacacttgagatctcaaggtccttggtgaggatgctttccctccctcagtccagcacatcatcacctaggagtagccctagggcaaaagactgcatttacctctcacctgaagaggcaagcattcgtgccatatacaagtcaaataaagattttttagaagaagaaagccagtcgggagaatttccagaagaatgttgtgtgtgatcctagtgaagcgctgcatgagcaggctgttcaggaaaggtggtgcgtcaaagaagaaagtcaagaaacaacacaagaaggtgcagaacttgacactctgcgcactaaagaaattgacaagctggattgcatgggaaaaaatagcaatgcatggggcaccccagcaaagcaatgcacatataaaccatcacaagatatggtgggagaagcagagccaggacaaaggcatgtcaggacgtttccaagctcccctgagaacgactttgaaaaactggaatgccaagagcccacgactccccgaccgagtgcacagatcgaacagatatcacaattttctcctgatggaaaccacgaaaagcaagaacagccgagccctcaatctgttcttgatgtgttcttcctcgacggtgagttgcacaaagatatcttgaggacacgctacaacaccacaggggatggttcagaccaagggattttctgggaggacaagcatccgaggttatgttacataaaggaattgctagagctgtcagaattgtgtgcaaaccagaacttagaggtatggtatctagaagatgaattaatcagcccttgcttgttcgaagaagtacatggaggcaatcaaattgatggtacgaagcttttatttgactgcatttgtgaagctgtgacagaaatccaggacatatactttagaaaccctgcatgcctatcttctctcacacacagcataagggcacctcctccagcgggacaaaaccttatctcagaaatcaataagcgtgttgaacgccatcttcactatcgatttccaagcacattagaccagctggttaacatggatcttgaaggtggcagttggatggatcttggatcagaaagcggagaggtcgctgtagtaatatgggactgcacactagatgagcttttggaagaattagtttacgacctgtggatttcaggcttcaatctcgcagccggtaaccatctgtagatttggtagagtcataccgttaaatagaagtaacatgtttgtgtggcaaaatcctgtgatttggacatggagggctgcatgagtcgttcttaaaggcatgagcatggtacgggatgttcacccatgtgaatttcatcgtgaccctcaacatattattatgtgtctagtgtcagttaggcctagtttngatactctagtaatgagtaggatttgagtggattaagatgtattgagagagtatttaatctattggggatttacaccatctccaatccctctaaaacaccctaatcctaaagtatccaaactaggccttaggggtgacaatcaacacgttgacccactgggccgcgtcatgactctcgttgttcccgctacagcaccaagtgaagagacagggggaggagactggacaacataatccacctactcccctacacaagtcgatgagccaacctgcgccagaacctactccagagccttcacccacacttcacccacacgctgacaagacgtggcgaaggtgagtctagcctgaggagcctgcatggcgaccaagagaagattcctgtctaacgcaggagaagaccttggcccaccagttctatctgtcacttcacacttcatattttagtattcctaggtccacctcttagggtctagctctattgtacgtgctccctttagtctataaaagggagggcacttgcgtagcaaggagaagacaggcacggaccaaccctcgagctcatctagggactcgaggacggacaaacttacttgaatccccgtaggggcatctccaaccagtcttaggctttcttaagctctcatcaatacaactcacaagtggagtagggtaaacactacgatgcccccaaccactctaaactcttgtgtgttattgtgttcatccatctcattaggcaaaccctaggtcgcccctgtaggattaggtgggtgcattctaccacctaattggagttttctctctgacaattgttttcatatttgaagagggtagatcgatttcatccttaactcattaaccttagttagtgttttcctttcatttgtttataggatggcattaaaaggttcttcatggctcccttcgcgag

SEQ ID NO: 7024 - DNA, 4203 bp, Zea mays
aagatatgtccgtacaaatagatacaagaactaggccgagaaaaggactcctagagaaggctggaccaatccgacgaggaggtctaggatgagactattttgacatatccaaaactttattttttttatacttaaagatagctataatagatttaaaaaactgagaggtcatggaccactttgcccccctttgtggtcgcctctgcatttagctatgtataaaattttgtttgagttgtattgtatctctgtatgcctaaaaaatatagtttcatagatagtgctccctccgttcataaatatgatactgttgacttttaaaaaaagtttgaccactcgtcttattaaaaaataatgagttatcatttatttttgtgatttgttttatcactaaaggtagtttatgcttgacttaaaattttacatttttgaataaatattttgaataagacaagtcgtcaaagttttcgaagaaaatcaacagtatcatatatttgtgaacggatgtagtagctacttcgtggttgtgaatactgtatacccgttagttgcatatatgcactgcacgggaccaacaacagtacacatttggttttaaaatagcttttgcaatgatgaggatattgttcatggagtattgcgtacacatgtactgattttcatggagtattgcgcgggatccttatcctattttttatataccgaaccactcactccagccttgtgatgcatccaacgtcaaagaggtgtagagtggtgggtgtgtggcctgcccttcgatgtggacgagattattcgtagtaggagtttgtttacaagtaacatgccataactataactgccaggatctgattctataataatggtatactctcgcgttaaccgacgacgacgacgccgccttccatcccttccctccacgattcgcgcggcgcccatgtgacgcgacgacggacctcgccatcgagctcgctcctctaacgcacgtcaggtgtagcgtcgatcgatgaggccggcggatcggtagtttaagcgtccccatttaaccgtcctgtgtctgctctctggtgcctataaaaaccacgccccagcaacgcagtgctctccacctcacaccatcggaacacatagcagctggcaggaacgactgccaagcaagtccatcggtcgaggtcctagctagcgcaacgacgatggccaccgcgctctcctgcaaggccctcgcagtggccgcgctcctgtccgtggtgtccgtcgtcacctacggcgctcgcgcccagcagcagcccagccacaacgcctccgactccgagtcgtcgcaggacaggtccttgctgtcctacagcagtggctggctgcccgccaaggccacctggtacggcgcgcccaccggcgccggccccgacgacaacggtaaggatcaatcggcatatatatatatacccgtctctctccatatggatgtctgtacgtgtcgtctaaatgcctcttgctgttgctgaaccttgctaggtggtgcgtgcgggttcaagggcaccaaccagtacccgttctcgtccatgacgtcctgtggcaacgagcccatcttcaaggacggcaagggctgcggctcatgctatcaggtgggtacacattaacacgaagaagattaattgccctcaccatgcaggaccacgtgcagcgcgtccatcttcaacgatcgacccgctcgccacccgtgggctgcggctcatgctatcagatacggtgcctccggagcaaccacccggcctgctccggcgtgccgcagacggtgatcataaccgacatgaactactacccggtggccaagtaccacttcgacctgagcggcacggcgttcggcgccatggcgagttccggcctgaacgacaggctccggcacgccgggatcatcgacatgcagttccggagggtgccgtgcgacttcccgggcctgaccgtcaccttccgcgtgcagcacggctccaaccccatgtacctggccgtgctcatcgagcacgccaacatggacggcgacgtggtgcaggccgacatcatgcagaacaactccgggtactgggagcccttgcacgagtcctggggcgccgtctggcggatcgaccccagccgcccgctctgcggccccttctcggtgcgcatcaccaacgagtccggcaagcagctggtggcccagaacgtcatcccggccaactacatcgccgacgtcgactaccgctccttcgtccagtatacgaattaacccgaccggccgggcggggcgcccactgcatgagctagctcgatcggtcacctctgcgaccgtcgtacgtccgagatagctcgttgcttaagtgttcgtgtttagtggctgccgtcggcaaccgccggactgaggatttttaaacctcaattccggcgtggggtgtgtgttggtgtgtgtcttgaagatgtgtgggaaattagaggaggcgagcatcaatgcgctctcccgcccacggtcactctatcattaccggtgtgcggtgtgtaaccagcagaccatggatattggttaatactacatcagtgtgatgttgtttaactaaaaaaaaaaaaaaaaaaaaaaaaaaaaaatgcaactgcccggggaccttgttcggttattcccaacacacatgaattggatgagattgaaaaaattaataagaaaattgacttgtttgggattcaatttcatccaatctcactcaatccatatggattaagagctaaccgaacaagccctaaatgaattggctttctaatcaggttattggggtaagtacgtgtactttttactatcctatagtcgtacaggctgcactatagctgacttggagtgcacctcttttgttcagagcacagccagctacccatcacataatgacataacagagattgagatgactggttaacgacgtacgacaagctttttttgggctccgcttttctgataggactattgttaaagttcatcatggttttcacggccaccacaaaagggtgcagtgtatatatatttacagcgctactagtaagcgctttgatcgaaagcaaaggatactgcaaatctcccacccccagcaaaaaagtcgctttccccgccaaacgctttgcgcaaccgattccatatataaccgtcggccctcgaactaatcatgcatgcgcggatcttactttcatgtgggacctcgaggaaactgccgctaaaaagtactagtatgtactagtataaatcgtacgtatacgacggtcctactggattcgagccgtcattaggcgcgctaaaccccatgctaacatggctgacttgcaattaatagaggcaagcttggacgagcagatgactttaatgtcaccgtttgtcagtaaacgcggtcacgtgagcataatgctggttgacctccacgctacgacgatgatcgaggatggatctaacacgattctcgcggaacgcacatggacacgatgccatatagatggacctgttagtagaaccgccctttggggtggccaataggagtattgttttgcgtattagtaacattttatctctgcaaactaattgtgacaccagtctctatatgtttggttggatgtataagcaggggttaggggacgaccacagtttttatagtgtttggatgtgagttaagtagaacgagataaacatcggagtaattttttggtggcggcgtaatcccaaaacattgagagaacggtgttgcttccacctcatcctagtttgacctcaaacaaaacaaaaagcctgagaaccttgtgctccctaaacaacaacaaaaaactttgaggccttgttcgtttgtgtcggattgatgggtcggaacgattcctagccggattgcttctctaatttatataaactttgattagctggaacgattccgggtgcaatccgatgtaaacgaacaaggcctgaagcagcagtaacccaccaatcaaattgcttggcgctgtattatctgcacgcacaatgttgtatgtgtacggatacgctcgagatacgcaggtcttgcctaccacgcgtccagcatttggggccccaccattttatctcctctggtcggagcagcgacgataggtgatcgagccgacgaacgcaacgcgacgcgacgggacggggcagctttggcttgagccgcagccgcatgtgcggggggcgaa

SEQ ID NO: 7025 - DNA, 1576 bp, Zea mays
ttaaccctcactaaagggaacaaaagctggagctccaccgcggtggcggccgctctagaactagtggatcccccgggctgcaggaattcgacgagacccattccgtggcgccccgccggccgggctcacacaccatcgaaacacaaaccagcagcaggcagagcaacgactagctgccaggcaagccggccgggggtgctgcaagagtgcaacaaacaatggccaccgcgctctccttcaaggccttggcactggccgcgctcctctccatggtcgtcgcctctggcgctcgcgccgagcaacagttcaagcgcaacgccaccaccgcctcgcaggacagatccttgttgtcctacagcagtggctggctgccggccaaggccacctggtacggcgcccccaccggcgccggccccctcgacaacggtggtgcgtgcgggttcaagggcaccaaccagtacccgttctcgtccatgacgtcctgtggcaacgagcccatcttcaaggacggcaagggttgcggctcatgctaccagatacggtgcctgaagagcaaccacccggcctgctccggcgtggctcagacggtgatcatcacggacatgaactactacccggtggccaagtaccacttcgacctgagcggcacggcgttcgggtccatggccagctggggcctgaacgacaagctccggcacgccgggatcatcgacatgcagttcaggcgggtgccgtgcaacttcccgggcctgaccatcaccttccgcgtccagcacggctccaaccccatgtacctggccgtgctcatcgagcacgagaacaaggacggcgacgtggtgcaggcggacatcatgcagagcaactccggccactgggagcccatgcacgagtcctggggctccatctggaggatcgaccccaaccgcccgctccgtggccccttctccatgcgcatcaccaacgagtccggcaggcagctggtggccaagaacgtcatcccggccaactacatccccgacgtcgactaccgctccttcgtccagtactaatgatcgagctagcttggtcattgcttaagcgtttaattgtttcttctttatttaattagtggctgccgttgccgacatgcatgtgggggaaattggaggaggcaagcatcaatgcaatgtgtgctctcccgcccactgtcactataccgttattaattaccagtgtgtaaccagcaaatcatactacatatatggttatataatttcatactatacagtataatgctgtctggcctgtctgtctgatgagtctgaaaaaggattctctctttcgggtgcactccctttggctttattcaaccactttcactgctgcactttcagcctaaacttccagctagctcgctgtgtatagttagtagtactagcgtactctagcaatgtagctaggagtgcagcaatattatggcacactcacaactaactgtgtcagagggccaggggacccgtgctcataaatgaattgactttctaatcagatgattgggagtagtacatgctggtccgtagtagcaagggtaccgagc

SEQ ID NO: 7026 - DNA, 1351 bp, Zea mays
cattgggtcccccccggccgggcccacctacaccatcggaacacatagcagctggcaggaacgactgccaagcaagtccatcggtcgaggtcctagctagcgcaacgacgatggccaccgcgctctcctgcaaggccctcgcagtggccgcgctcctgtccgtggtgtccgtcgtcacctacggcgctcgcgcccagcagcagcccagccacaacgcctccgactccgagtcgtcgcaggacaggtccttgctgtcctacagcagtggctggctgcccgccaaggccacctggtacggcgcgcccaccggcgccggccccgacgacaacggtggtgcgtgcgggttcaagggcaccaaccagtacccgttctcgtccatgacgtcctgtggcaacgagcccatcttcaaggacggcaagggctgcggctcatgctatcagatacggtgcctccggagcaaccacccggcctgctccggcgtgccgcagacggtgatcataaccgacatgaactactacccggtggccaagtaccacttcgacctgagcggcacggcgttcggcgccatggcgagttccggcctgaacgacaggctccggcacgccgggatcatcgacatgcagttccggagggtgccgtgcgacttcccgggcctgaccgtcaccttccgcgtgcagcacggctccaaccccatgtacctggccgtgctcatcgagcacgccaacatggacggcgacgtggtgcaggccgacatcatgcagaacaactccgggtactgggagcccttgcacgagtcctggggcgccgtctggcggatcgaccccagccgcccgctctgcggccccttctcggtgcgcatcaccaacgagtccggcaagcagctggtggcccagaacgtcatcccggccaactacatcgccgacgtcgactaccgctccttcgtccagtatacgaattaacccgaccggccgggcggggcgcccactgcatgagctagctcgatcggtcacctctgcgaccgtcgtacgtccgagatagctcgttgcttaagtgttcgtgtttagtggctgccgtcggcaaccgccggactgaggatttttaaacctcaattccggcgtggggtgtgtgttggtgtgtgtcttgaagatgtgtgggaaattagaggaggcgagcatcaatgcgctctcccgcccacggtcactctatcattaccggtgtgcggtgtgtaaccagcagaccatggatattggttaatactacatcagtgtgatgttgtttagctacctctacccccatgctgcctcctaactaatgccactgccaggggaccttgttcggttattcccaacac

SEQ ID NO: 7027 - DNA, 812 bp, Zea mays
attgggacctcgagccggccgggaaacacccatcgaaacacaaaccagcagcaggcagagcaacgactagctgccaggcaagccggccgggggtgctgcaagagtgcaacaaacaatggccaccgcgctctccttcaaggccttggcactggccgcgctcctctccgtggtcgtggtcgtcacctctggcgctcgcgccgagcaacagctcaagcgcaacgccaccaccgcctcgcaggacagatccttgttgtcctacagcagtggctggctgccggccaaggccacctggtacggcgcccccaccggcgccggccccgtcgacaacggtggtgcgtgcgggttcaagggcaccaaccagtacccgttctcgtccatgacgtcctgtggcaacgagcccatcttcaaggacggcaagggttgcggctcatgctaccagatacggtgcctgaagagcaaccacccggcctgctccggcgtggcgcagacggtgatcatcacggacatgaactactacccggtggccaagtaccacttcgacctgagcggcacggcgttcgggtccatggccagctggggcctgaacgacaagctccggcacgccgggatcatcgacatgcagttcaggcgggtgccgtgcaacttccagggcctgaccatcaccttccgcgtccagcacggctccaaccccatgtacctgggccgtgctcatcgagcacgagaacaaggacggcgacgtggtgcaggcggacatcatgcagagcaactccggccactgggagcccatgcacgagtcctggggctccatctgg

SEQ ID NO: 7028 - DNA, 1214 bp, Zea mays
ctcgaggccggccgggctgggacaccaccctcgaaaaaacaaaccagcagcaggcagagcaacgactagctgccaggggtgctagcaagagtgcaacaatggccaccgcgctgtccttcaaggccttggcactggccgcgctcctctccgtggtcgtcgtcacctctggcgctcgcgccgagcaacagctcaagcgcaacgccaccaccgcctcgcaggacagatccttgttgtcctacagcagtggctggctgccggccaaggccacctggtacggcgcccccaccggcgccggccccgtcgacaacggtggtgcgtgcgggttcaagggcaccaaccagtacccgttctcgtccatgacgtcctgtggcaacgagcccatcttcaaggacggcaagggttgcggctcatgctaccagatacggtgcctgaagagcaaccacccggcctgctccggcgtggcgcagacggtgatcatcacggacatgaactactacccggtggccaagtaccacttcgacctgagcggcacggcgttcgggtccatggccagctggggcctgaacgacaagctccggcacgccgggatcatcgacatgcagttcaggcgggtgccgtgcaacttccagggcctgaccatcaccttccgcgtccagcacggctccaaccccatgtacctggccgtgctcatcgagcacgagaacaaggacggcgacgtggtgcaggcggacatcatgcagagcaactccggccactgggagcccatgcacgagtcctggggctccatctggaggatcgaccccaaccgcccgctccgtggccccttctccatgcgcatcaccaacgagtccggcaggcagctggtggccaagaacgtcatcccggccaactacatccccgacgtcgactaccgctccttcgtccagtactaatgatcgacctcggtcattgcttgccgcttattaagcgtttaattgtttcttctttatttaattagtggctgccgttgccgaccgaacatgcatgcatgtgggggaaattggaggaggcaagcatcaatatgcaatgtgctctcccgcccactgtcactctaccgttattaattaccagtgtgtaaccagcaaatcatactacatatatatacatggttatataatttcatactataaaaaaagtaaatgtgatgctaccattgtacctcggccgcgccacgc

SEQ ID NO: 7029 - DNA, 1164 bp, Zea mays
ccggccgctcacacaccatcgaaacacaaaccagcagcaggcagagcaacgactagctgccaggcaagccggccggggtgctagcaagagtgcaacaatggccaccgcgctctccttcaaggccttggcactggccgcgctcctctccgtggtcgtcacctctggcgctcgcgccgagcaacagctcaagcgcaacgcaaccaccgcctcgcaggacagatccttgttgtcctacagcagtggctggctgccggccaaggccacctggtacggcgcccccaccggcgccggccccgacgacaacggtggtgcgtgcgggttcaagggcaccaaccagtacccgttctcgtccatgacgtcctgtggcaacgagcccatcttcaaggacggcaagggctgcggctcatgctaccagatacggtgcctgaagagcaaccacccggcctgctccggcgtggcgcagacggtgatcatcacggacatgaactactacccggtggccaagtaccacttcgacctgagcggcacggcgttcgggtccatggccagctggggcctcaacgacaagctccggcacgccgggatcatcgacatgcagttcaggcgggtgccgtgcaacttcccgggcctgaccatcaccttccgcgtccagcacggctccaaccccatgtacctgggccgtgctcatcgagcacgagaacaaggacggcgacgtgggtgcaggcggacatcatgcagaacaactccggccactgggagcccatgcacgagtcctggggctccatctggaggatcgaccccaaccgccccgctccgtggtcccttctccatgcgcatcaccaacgagtccggcaggcagctggtggccaagaacgtcatcccggccaactacatccccgacgtcgactaccgctccttcgtccagtactaatgatcgacctcggtcattgcttgccgcttattaagcgtttaattgtttcttctttatttaattagtggctgccgttgccgaccgaacatgcatgcatgtgggggaaattggaggaggcaagcatcaatatgcaatgtgctctcccgcccactgtcactctaccgttattaattaccagtgtgtaaccagcaaatcatactacatatatatacatggttatataatttcatact

SEQ ID NO: 7030 - DNA, 1875 bp, Zea mays
cattgggtccccgggcccggccgcgaaatcccgctgttcgcgagccactccctctcacgagtgacgacgaaaccctaggccatggcttggcgcggcgccgcctcccgctccattatcgccgccgtccgtgctcgcgccgcatccccatcttccaccgccgcctcgcgcctccgctcgacggctccacttcccgccccctcgcgccggtccgtccccgccttcgctttcgcgaccgcgaggccgttggcggcgatgtcggggtccccggcggcggccgtggtgaagctcaccgggcactcggcgacgagcgtgcgggcgtgctgtgagctctcccagggcacttaatgcgcacttttgtccttaaatgcaaggattggattctttggaggttgcatcccttggaaactcatcgggcttgcgtccttttccatgcattttgcagagtacttagcgcctcgtgtgtcggcaaacggacagtatatctgctgtaacttacataaataatcatatgttagcctgctgctactcactgccccgcatcgattggaactaagttgatgtttggttcacataattgtataacgttaaatcatgtttgtttaagtctaaccttaatcggattccacactaaaaactgatattggcctattcaaacctattactgctgttatttatgttatattttgttttattttgcgaaccaaacggcactgtacaaattgttcctttgtacgagctcatgaaagaggaagatttttgtcctgcccgtatttgtattgtggttggttgatgttatctaatatattctaacaaatataaattgaggtgacttacggaagtcctggtccgggggggggggggggggggcaaaagagttcgagagccactcggtcgcttttgtctgcaaaatcttaggggtagtcaccatttggctattttgctcctcgaagagtggatactttatataatccaccttatataaatagggtagtttagaaaatagaaataactctataaatagaagggtgagctgattagtttagtatcacttactgtcattttgtttagagcactttttagaattcttagttttctctctaggtagtcaccagttgagtcgagtgatctataacgactttgtagctgtcgactgtgtttgtgatcttcaagtttaatctgagaaagagtcgtcaatatgatccacatgtttttgtcacttctccatctcagttttgtatccttgatgaaatttagagttgttttgatcgcttgttcttccctttccctctcttgtgtttgtgtgaagaactcttggattcttgtgaaagaatttggtttgggggttaattggtggtgagttgcacttctcaaaccactatgtacactcagttcttgtagtttttggtcgtggtttggaagaactcagattgaattcaaaatagaaaaccctatcaaaaccacaatcaaaatgagattttcgatctgcgctttgttttttgtgttgctggagttgattctccaccactagacaaatttccctttgcgcaaactgtttgcaaaacttgaggggattcggtgaagttttgattgtgcgacactgccactctcaagtccggcattgctagactaggagttctgatccttttccgctcaaacttcaccattcaccttttctcccaagtgtcttgctgcttgcaaaatttgagagcattctaggaaaattttgcaatccgcactgccactcgacgttttctcgtattttgactcaaaattttttactagaccttttggggttctctttggagtttctagtgaaagtttgggttcaaatcaagtctgtttgtcccggttgagacctgatctcctctggaagaa

SEQ ID NO: 7031 - DNA, 885 bp, Zea mays
  misc_feature (868)..(868): n is a, c, g, or t
aaaaacgcaaacgccattccgcaatttccgctgtccgcaatccactccctcctcccacgaaactcttggccatggcttggcgcggcgccgcctcccgctcaatcttcgccgccgtccgtgcccgcgccgcatcctcctcctcctcctcagcggccacgcgcctccgctcggcggctccaattgccgccaccccgcgccgcaccgtccccgcctttgctttcgcggccgcgaggccgttggcggcgatggcggggtaccccgcggcggtcgcggtgaggctcaccgggcactcggcgacgagcgtgcgggcgtgctgtgagctctcccagggccaaaatgggaaggatcggtgatgaagagattagacagaatgatttgtatcctattgtataaaatgatgaaatgacgatgatgcatgatgcttgggaagcagttttaaagcatggaaaaggcacttgaatgcacacttgtcttccaatgcaagggtaggatctctcgtcgggcttgcggcctttttcctgcattttgcagagtgcctcgtgtgtcggcaaacggacagtacacttgctgcaactaaaatataaacaagcctatgttagcctgctacgcactgtgttcgtgcatgttttcatttgaccttgtttccatgatgcttcgacgtgttacgcgtgctcgtgcttcttgctgtgtcatcactggtccacattttcttgtggaaagtgttcctttgtacgagcttatgaaaccagtgtgcacaagcgacggacggatttgtaccatccagaacgatagtgatccgttttactaactcccgaaaaaaaaaaaaaaaaaaaaaaaaaaaaaaaaaaaaaaaaaaaaaaaaaaaaantaaaaaaaaaaaaaaaa

SEQ ID NO: 7032 - DNA, 746 bp, Zea mays
ctaaaaccctaaacccccctacgccgcccccccctttccgctgtccgcaatccactccctcctcccacgaaactcttggccatggcttggcgcggcgccgcctcccgctcaatcttcgccgccgtccgtgcccgcgccgcatcctcctcctcctcctcagcggccacgcgcctccgctcggcggctccaattgccgccaccccgcgccgcaccgtccccgcctttgctttcgcggccgcgaggccgttggcggcgatggcggggtaccccgcggcggtcgcggtgaggctcaccgggcactcggcgacgagcgtgcgggcgtgctgtgagctctcccagggcacttgaatgcacacttttgtcttccaatgcaagggtaggatctctcgtcgggcttgcggcctttttcctgcattttgcagagtgcctcgtgtgtcggcaaacggacagtacacttgctgcaactaaaatataaacaagcctatgttagcctgctacgcagtacgcactgtgttcgtgcatgtttccatttgaccttgtttccatgatgcttcgacgtgttacgcgtgctcgtgcttcttgctgtgtcatcactggtccacattttcttgtggaaagtgttcctttgtacgagcttatgaaaccagtgtgcacaagcgacggacggatttgtaccatccagaacgatagtgatccgttttactaactcctgaaaccatgaaaaaaaaaaaaaaaaaaggccccta

SEQ ID NO: 7033 - DNA, 1966 bp, Zea mays
ggcgtccccaagcagagagtgggagcaacaaggtgagttccattccatcccatccatcagccatgtcgcagctggcgcctctgcccaaggtggtgatgggttcgctggcgttcggcgtgttctggatgctggcggtgttcccctcggtgccgttcctgccgatcgggcgcacggcgggggcgctgctgggcgcggtgctgatgatcgtgttccacgtgatcagcgccgacgacgcgtacgcctccatcgacctcccgatcctgggcctgctgttcgccaccatggtggtgggcggctacctcaagggcgccggcatgttcaagcacctgggcaagctgctggcgtggcggagccagggcgggcgcgaccttctgtgccgcgtctgcgtcgtcaccgcgctcgccagcgcgctcttcaccaacgacacctgctgcgtcgtgctcaccgagttcgtgctggagctggccgccgagcggaacctccccgccaagccattcctgctggcgctcgccaccagcgccaacatcggctccagcgccacgcccatcggcaacccgcagaacctggtcatcgccttcaacagcaagatcaccttcctcagcttcttcttcggcatcctgcccgccatgctggccgggatgggcgtcaacacggtcatgctgctctgcatgtactggaacgacctcgagggcgccgccgcatgcggcagccccggtgatgagaaggagatggaggccatcgaggaagggcggtcgccggcctcggtgctctcgctcaagagtagccccgccgccgccgccgcccagcacgtcgccctgcgccagcgccagaacggccgcggccacgacgcggacgatgacgaccccgactccatgatgtcagagaacatcccgacaaagcaccggtggttcatgcagtgctcggagcaccggcgtaagctgttcctcaagagcttcgcgtacgtcgtcaccgttggcatgctcgtggcatacatgctcggcctcaacatgtcgtggaccgccattaccaccgccatcccacgcgtccgcgttgacttccgcgacgccgagccgtgcctcgacaaggtgtcctactcgctactggtcttcttctcggggatgttcgtgacggtgagtgggttcaacaagacggggctgccaggggccatctggaacttcatggcgccctacgcaaagatcaaccacgtcagcggcgtcaccgtgctctccctcatcatcctgctcctctccaatctcgcgtccaacgtgccaactgtgctgctgatgggggacgaggtggcggcctctgcggcgacgatctctgcgtcggcggtgacgcggtcgtggctgctgctggcgtgggtgagtacggtggcgggcaacctgtcgctcctggggtcggcggcgaacctgatcgtgtgcgagcaggcgcgccgcgcgccgcgcaacgcgcacgacctcagcttctggagccacgtcgtgttcggcgtcccttccacgctcgtcgtcaccgccatcggcataccgctcatcggcaagatcgccttctagcctgctgccagtgtatgctgctaatagtgtactgattaatcagctagcagctagcgtcgttccgatgtatccacatgcatgcatggacgaggattcagcaactacaaacgtcgtcgtcgcgtggcatggcgactggtgctggtgtggtcgacggggcaagctaggcaagcaattaagcgcccctactacacactcgtgatttgcatgtttttttaagtctcagctatatctatatctatatctatatttgctgcatagctttgtcatatgctcaatctgggacgacgacgactgtgccgtaaggtcgatcgttaacagggattgcattgcgttaattgtcagatgttaagaaatgtgcaactaatgcgacaattaattaagcagcggatgctgaacgaagaacagttggccttgtt

SEQ ID NO: 7034 - DNA, 1585 bp, Zea mays
attggtacctcgagcccggcacgaggcgtgcccaaagccgtgtccatggcgcgccgttctaaaccctaaacctttcgacctgctttatactagacctcatcgagaatctcacgcgtcggcgaccatggcggcgtctccgtcttctccccatgccgcccccggagttagcggccagagcctgtccccctcagcgccgtctccccacctccccaactatttcatgtggagagaatttgtctggggaggaattgcaggtgcatttggggaaggcatgatgcatccagttgacactctgaaaacaaggcttcagagtcaagctataatgacaggggctaaggctcagaagaatatattccagatggtcaggacagtttgggcttctgatggtctaagaggtttttacagaggaatcagcccaggtgttactggatctcttgcgactggcgctacatatttcggtattattgaatcaaccaaagcatggttggagattgctaatcctaatctaagtggacactggtcacattttatcgctggagcgattggtgatacacttggatcctttgtctatgtgccttgcgaagtcatgaaacaaagaatgcaaattcaaggcacccaaaaatcttgggcatcagctgtagccaaaggaaatatttctcaaactcatgggatagagatgtatgggtactacaatggaatgttccatgctggctgttctatctggagagaccatggcttgaaggggctttatgcaggatactggtctacgcttgccagagatgtcccttttgctggtctaatggtcactttctatgaagcaatgaaaaagatgtctgagtatgggaaaacaaagtatttgccacacagtgatttgcatgttagcaactcctttgaaggacttgttctaggaggattggcaggcggctgtagtgcatacttgacaacccctttggatgtgatcaagacaagactgcaagtacaaggatcaacgtctaggtacaatggatggctggatgctataacaaagacgtggacttccgagggggtgcgcggcttgttcaagggaagtgttccgagaataatatggtatgttccggcatcagcattcacattcatggcagtggaattcctaagggaccatttcaacgacaaggatgatgcggatgcccatgaagtaacctccctgtcaatcgacacaaaatcagaagttgagaaatcagcttagcgttccttttcctatgatctatgaagcgtattggtatccctccccggtggaaattatccggcgggatctttctgccttgggcaacaaactatgtttcggtcatgtaaatgcggaggacattcattggcagctgggcggagacattgttgtgtaccagaaagaaagtaattgacaacaacatgatcatattgtggcagcaattttcttagatagatagatattggtgagtggatggaatgagagaagtgaacatgtaacgtttctggaacgaaagaccaatgccaccggtgtattagagcttctgaatgccattcttgcgtattgaaatattggatcgatttgccaaaaaaaaaaaaaaaa

SEQ ID NO: 7035 - DNA, 897 bp, Zea mays
  misc_feature (1)..(1): n is a, c, g, or t
nactcataaatgactctatgccaccccagggatcctgagaggggagtgaacattgtgaaggcaatgcagatccagaaagcctttctgacattgacgatgcagaggttgatgggtaccttcacaatgaggaagaaacccaatataaaaagattatctgggaggaaatgaacaaagagtaccttgaggaacaagcagccaaggaagctttggcagctgaattggcagctagagggattgatccagaagcgggaaagaaaaaacgaaaacgtaatgaaggcacgaagagctcgacacctgctgaaacaccagcagaagccacgtgcaacatgctgaaacggaagggacttggttcaaagatcaatgtgggagctgttgacgaattgtacaagactaaagatgaagttggcagcgcaaacaatgaagaagagatggagttcgacgcactgtttgggccggacaatgctgccggtgagacggtcgatgacggttacaattacaactatgggggatacgacgacgatggcgcagaaggctacaatggccttgatgacgatttcgatttctaggatgtaggagtagggcatttgcagaacggcaacgctgaccagcacgggcaagattcttcacgtgcacattatatatagttttttttggttaagtttcgacgattattatggagctcgattgggtagtcattgtatatttatgtttgaaactaggttctgcctggttgtagttgtaacggactaataagggctcgtttggtacagcttcagctcctgattctaagcgaggatctggaggagccgtgccaaacggatattttttaaactgattctcgtgtggagcctaaaaaaaaaaaaaaaaaaactcgagggggggcccggtacccaatcg

SEQ ID NO: 7036 - DNA, 5250 bp, Zea mays
  misc_feature (4898)..(4898): n is a, c, g, or t
acaagcctgccaaaccaaaccagccttccgccggattggaaactaccagatgctaccagcgctactaatccagcgtctcccaccgtaggaatctctcaattagcgacccgtgtcctgttgcacaattatatagccaccatttgagaagataggggggaggtggagcagagcgcaaggagaggggacaaggagggacgggaaggggaataagctgaggggaaggcaaggcaagcaggaatcggctgggttgcgcgccgacttcctggccgagtttttctagccatcggatcgaggcagtcccatcggcgaagacccggttccgttcggcggccatgcggttggtttctctgcttggtctgtcaggactctgatgggcatggttcatcctaggtttctggttgcttgctcggggtccaagctgtgcttcatctccagttgccgcggtagcagcgcaaagatgatgatgtcctttctccggaggcgtccggagcgtcgttccacgcttcctatattgattgagttcggtagatgattcttggacatcggttgcccgcccgccgcggctccgccgcggattctgaaggacttcaaaggtgcttgaatcagtacatcttaggtgctatcccagactaggctgcgatgggtttaccccaaccttcaacagtcgaggatgatgcgccaacagcactgcgcacctctatttcttgccctccacattctggaggagttagtgcctgtgatttggatgggcttcctgcgggaagctctagcagaagggtgctttcgtacccattgatatgtgattttgatagaaaggccacattagatgctcctaatgaatcaaatgggtattctaaagacggatgtgaatttggcgaacccgcagacctccatggactaaacattgattcaagaaatacaaattcttggtcttctcctaaattagtgccttctgtccatatgccggcaaggagggttgtgggctttgattctggttgtattggaggttctgatggggcagaaacggatatggtcgattcatctttggtcgacagaaattctcatttgccatttgatcagcatgaacttcaagcaaggaaaagactgttctctccattgaaaaatgtgctcgttaaacagttcaatggtgatatgctcaaccttccttctggtgattctagatttaggcattctgattcagccgataaactatacagtactggtttccaagataataaaaaagccaacacgggatgcatcaatttttttgaaacgcgggatactccagcctctaggtgctccagccggagcccagaatgggatgttactaggagcaattctaattcattcactgatggtcctttacttgggagcaaggattatatatcctattatgatcatctagcagctagtgcaaaattagcgcactctccgctttctctgtctcctctcagccctaaatatatgaacaaaattaaagtgacaggatctcaaagatatataatgaaagatcttgaggatgacttcctagatttaaaggaaactggaggttctggcggagctaggatgccggaggtatcaaaaggatctaacttggcccaggcgccactcggggtggtgacacctaaatggggttcattgagaagatatcaaaattggggccctgaatcttcccctacatctcccagaattggttatggtcggagtttgtctttgcatgtaaggaggtcacttgttggctcctttgaggagtctcttttatctggtcgatactcgtatggaaaagacagtcagacaattgatggtttcttagctgttctaaatgtcactggtggtagtttcttccccacaactcagaaacttccattctcagtaacaagcatcgatgaggatagctccttactatactattcttctattgatcttgctgggaggttgccttcgaataacaccaaaagcccaaagctccaaagaagctacagtaataatgattcgcggtcagcaaagagtcgtttacgcatccctgttaagggtcgcatacagctggtggtaagcaacccagagaagactccacttcatactttcttctgcaactatgacttgagtgacatgcctcctggaaccaagactttcgtgcggcaaaaggtcactctctccccctctgccttgccttctaatccagtggaagaaggaagcaagacttgtgatgttaattctggtcacaaatcttctcagtcagtttcatgtggaaatgaacctagcgaacggggagctcgttctgaatgctgcaacggtggacagaactgcaactcaaatgatgaatcagaaaaaggagatctgaaaacaagatgtcgatcattggatagtgattctaatgaatcaaataagtctagttctccaggaaataagaaagaccagtctgattctgatggttgctgctgtcaaatggataagtttggcatgggagaaaagaaatcatgctgctcaccttctaagatcaatgatagttcaggtggagctgtgcttcgttatgctttgcacctgcgatttctgtgcccctccaagaaaaaatcctcgaaatcaatgcttcgttgcaaatctgatctatcaacggcaccatatagcagcaatacgctacctgaggaagaacggaggttctatctctacaatgatcttagagttgtatttcctcaaaggcactcagatgcagatgaaggcgagctgcgagtggagcatgatttccccgccgatcccaagtactttgacataagcaactgatggttgcgctgctgcaccggacaataataatctgtaaatatgttatcatgactaacttggtcaccagccgtttcatcttttcaccaacaaatgtacaggtcaatgttccaaataaaatgcaccatttagttgtgcctatatgttctttcctcctgatttcgaaaccgtcagagggctgttctgtcatgtttctgaacactagctgtcacctgttaaaactgatgctgatatgtctgtctcttccttgccatggggaaggaattttcctcatacacagctccaactaggactccatacttgactcatctaatattataatagatcaacttaaatttatatgatcactgcacacgagtctaagaatacagtgatatagacattcataacatcaaataaaataacaagaatagaaaatgaatataagtttttgatgtagcccttctcattgcaggagtgtagcccttctcgttgcaggagaatgaaggggatgactcaagatgccaccgaacaaaaggtgttagagcagcagatggtggccgatccttaccagcgtctcattgctctagcaccttcgttcagtggcactgagtcacccctcatcctcttgcaaagagaagctacctcgttcggcgttgacttgattaaatctttagggtttgatgcttgttaatctctattatgcattgtaccatttatttagttttatttgtactatttactttcattttgtaggacactggtgtgctacaagtttgctaaaaatggaatttggttgttatatatattctgtttgtttaggttgagtcatattctttctttgttcttgtttctgtttgttcaaattttagacatatattcaagattagttttgtttgatgttatgaatgcatatatcattgctttcttatattcatatgcagtgattaggtaaatttgacttggtctattattgtgtcggaggggacaggtactgggatcgccattgggtcctcgatcctcgttggggttaggcacggagaaaattccttctctgtggtagggaacaaggacaagggtgcatggattttcttcaaaggtcttgtttagatactctagtatgcatcacaatccacaggtcttgtttagatactctagtatgcatcacaatccacatatgttgaggtgcattggaatgtaaaattaaattaatttatactccaatccatatcaatacatatggatttgggtggatactagagtacccaaacaaagcataaatggggcggttacgaggagacattcctagcaggaatttccctttttcatctcgaattaccctaagatgggtaagagtttgaatatggattatgttggtgcctctggtactggtatctcatgcgctacaatcaaactaggcctgcgtggtgcgtggtgcgtggagcgtggagaggacgggctacaagcccccacaatcttatctttaaggtgggctaggttatatctgtacatgtgggttggtctggcacaaaggcatgacccgtaaaagtatatctccaattatggatcgtgtcgtgctagacttgaccatcagcttacgacacggtctaaaattagttgtgtgtaaggacggtctaaataacctagaatgccttaacgtgtcggatcgacttatatacatacaatattaatacataaacagaaagtactatatatatatatatattgtggctatcacattaaaaacctttggtcagaaagaaaaaaagagtacaactagctcagaaataatattcaattctctgttcagtgtttagttgagtactacacagccacacagaatacatacagaatacatgtacaatgatcactattcctatctaggtactggttctcgaaggcctgttgaaactttagattctccaagttgtgctagttctgtgggctttgatgagccttagttaaatactaagtctatgtttagtgggttttgatgggtcttagttaaatgtgtcgtgccaagccgacccgtggggttgacttgaggccaagcatgacccacatattggaccgtgtcggtctagaccacaattaggttaggttatgccaggcttccaccgtgcctagaattttgtgctttgggncggcctattaggcacaacacaaatgtacccctatagacgatctctctaaagagacaagagaatgcgtggccacacgactgcgtatggggttcccttgccgcttaagtcttcattaggctcccttcctacaatcgtcctcgccaaatctgttggggttgtggttgggccacgtgttcctggtggcccctgcccctggcggggtctggcagcgtcacgagtccttgggctcctagggctttagactcttgggacgcttggcgggatatagttgtgcagtatctctggtggctttcgcccctagccgggtctagcagcgccacatggcctttgggtctgtttgattggactatcg

SEQ ID NO: 7037 - DNA, 612 bp, Zea mays
acaagcctgccaaaccaaaccagccttccgccggattggaaactaccagatgctaccagcgctactaatccagcgtctcccaccgtaggaatctctcaattagcgacccgtgtcctgttgcacaattatatagccaccatttgagaagataggggggaggtggagcagagcacaaggagaggggacaaggagggacgggaaggggaataagctgaggggaaggcaaggcaagcaggaatcggctggattgcgcgccgacttcctggccgagtttttctagccatcggatcgaggcagtcccatcggcgaagacccggttccgttcggcggccatgcggttggtttctctgcttggtctgtcaggtaggctggcgtgtggcgtccccctgattgatgtccaagtaagtgatcttggtttggagttctgcaattgctcttgtcgtgctgggctctgctcagttacttgttgttctgcggtagcttggtcttgcttattccgatcgacaataaagatagcaaagctgttcttcgtgttcgtccaaaaaaaaaaaaaaaacctttcttgcgcttatagcagcctgcctgtgaagaagtccctgtttcaaatccagc

SEQ ID NO: 7038 - DNA, 1508 bp, Zea mays
ctgtctcatatgtatgcattaaaaaaagttacccatatgcaatttcagcccaagcaaatttctagctcaagcattaaaatccaagttctccatatgcaatttcagaccatgcaaaattctagttcaagatggaagcagtatgctgaaatttaaaaaagaaccataattttgcaaatgagatcacaatccaaccaatgacgtctaaaattttaaaaagaatcatacttttgcaaaggagatcgcaatccaaccaatgacgtttggaattgctgcactcatcaacgactgcaaaacagataccaagctagttactgttagtggaaaaatagtacaatttcaacgcagaacatctcttcaattgatgaaaacacctttagctaaagtaaactgtaaatacagtactttgatacaatatcagtcatgttagctacaatgttcttttgtatcatctaatttaggtgcaaacgataaacattattgaagccgttcgctcagagcttgcggcggctgctgctgtagcagatggacttttttctctcagtgaaacactatggagtctgcagcaaccttttcttgctgccgaacaacttcattgtgatttcagacttcaggctatcgattatgaattttgcttttccatttctgatgcatcatacaattgtgtaatgcaggccctgatggcttgtttgagacgaaggaccaccactgagccctgattagcacaccttcaggagctggtgcatgcttaaaagagttatatggttgtttcagtgattttgcttttcccttgagacctatttgctgcaacaagaaataagaatgaccaaactcttgtattgacagtgaggttttaactgtgttagctgttaccggcttgtctatttttctttgccgtccacgccatatatggtcacctgtaagttggtcttgcccggtgtcaggaaacggcatcacaattatcaaaagctgttattgtattctgatggcttaagattgcaccctgtgctcgtgataatttgccgtatcaactatcattgtatcaaggcagaacgtaatggtttcttttgttttttttccagtaaacatgtaggttggacaaggtaatattttaatgttctctattgctagtgtttgtgaatcccagctttcggtttctagctgtgtagcaacggatcagaaattgtgatcaactgtagtttcagggaaagagagacctcatcgttcatctgcaaactctctattgctgcactaggaaaacaatgcttcgggcagtagcatcccccattttggtgataggatcataggacatctgacccccaaaaataaaaacacgagtcaaaatgccctgtgtacaaggtagtgataaatcaatatgcatggagaactagagttctccctgccccgggtaacatcgtgcattctcagctcgagatgcgttcttttttatcagaaggttcctgccttctgggtcttgttagcaggcttctctgctccaggtgcccctgcag

SEQ ID NO: 7039 - DNA, 800 bp, Zea mays
cctggccgggaacccaacggcccaccaaacccgcggattaaagcattgggtccctcgaggccggccgggagccacgctccccggaacgaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccatatctgcacatccgcaacaaggagttcccatggggccctgatggcttgtttgagacgaaggaccaccactgagccctgattagcacaccttcaggagctggtgcatgcttaaaagagttatatggttgtttcagtgattttccttttcccttgagacctatttgctgcaacaagaaataagaatgaccaaactcttgtattgacagtgaggttttaactgtgttagctgttaccggcttgtctatttttctttgccgtccacgccatatatggtcacctgtaagttggtcttgcccggtgtcaggaaacggcatcacaattatcaaaagctgttatcgtattctgatggcttaagattgcaccctgtgctcgtgataatttgcctatcaactatcattgtatcaaggcaaaaaaaaaaaaagcggcctgttaaaaagcggccgcaaaagcggcc

SEQ ID NO: 7040 - DNA, 765 bp, Zea mays
tcgccgccccgagccggccggcccccccgggccggccgggagccacgctccccgtaacgaacgacgcagcccaacccgttcccaccaaaccagcggcaccacccatggcttcggcggcggcgagatccggtctccggtcgctggcggtgcgcgccgcccctttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcatacccctatctgcacatccgcaacaaggagttcccatggggccctgatggcttgtttgagaagaaggaccaccactgagccctgattagcacaccttcaggagctggtggatgcttaaaagagttatatggttgtttcagtgattttccttttcccttgagacctatttgctgcaacaagaaataagaatgaccaaactcttgtattgacagtgaggttttgactgtgttagctgtcttattttctttgccgtccacgtcatatatggtcacctgtaagttggtcttgcccggtgtcaggaaacggcatcacaattatcaaaagctgttgtcatattctgatggcttaagattgcaccctgtgctcgtgataatttcttgtatcaactaccattctatcaaggcagaacgtaatggtttcttttgtttaaaaaaaaaaaaaaaaacgggccccc

SEQ ID NO: 7041 - DNA, 837 bp, Zea mays
  misc_feature (810)..(810): n is a, c, g, or t
  misc_feature (813)..(813): n is a, c, g, or t
tcgagggacccccgccgccagcccccagccacgctccccggaacgaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaggaccaccactgagccctgattagcacaccttcaggagctggtgcacgcttaaaagagttatatggttgtttcagtgattttccttttcccttgagacctatttgctgcaacaagaaataagaatgaccaaactcttgtattgacagtgaggttttaactgtgttagctgttaccggcttgtctatttttctttgccgtccacgccatatatggtcacctttaagttggtgttgcccggtgtcaggaaacggcatcacaattatcaaaagctgttattgtattctgatggcttaagattgcaccctgtgctcgtgataatttgccgtatcaactaccattctatcaaggcagaacgtaatggtttcttttgtttattttccagtaaacatgtaggttggacaaggtaatattttaattttctccattgctagtgtttgtgaaaaaaanaanaagaaaaaaaaaaaaaaagcggcc

SEQ ID NO: 7042 - DNA, 761 bp, Zea mays
gcacgagccaccaaaccagcggattaaagggggcttcgggtccctcgggcccggccgggacgctccccggaacgaacgacgcagcccaacccgttcccaccaaaccagcggcaccacccatggcttcggcggcggcgagatccggtctccggtcgctggcggtgcgcgccggcccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatctgcacatccgcaacaaggagttcccatggggccctgatggcttgtttgagacgaaggaccaccactgagccctgattagcacacattcaggagctggtgcatgcttaaaagagttatatggttgtttcagtgattttccttttcccttgagacctatttgctgcaacaagaaataagaatgaccaaactcttgtattgacagtgaggttttaactgtgttagctgttaccgtcttgtcttcttttctttgccgtccacgtcaaatatggtcacctgtaagttgatcttgcccggtgtcaggaaacggcatcacaattatcaaaagctgttatcataaaaaaaaaaaaaaaaaaggcaccaaaaacacgagaaaaattgccgtatcaactatcattctatcaaggcagaaaaaaaaaaaaaaaaaa

SEQ ID NO: 7043 - DNA, 773 bp, Zea mays
cattgggtccctcgggccccggccgggagccacgctccccggaacgaacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatctgcacatccgcaacaaggagttcccatggggccctgatggcttgtttgagacgaaggaccaccactgagccctgattagcacaccttcaggagctggtgcatgcttaaaagagttatatggttgtttcagtgattttccttttcccttgagacctatttgctgcaacaagaaataagaatgaccaaactcttgtattgacagtgaggttttaactgtgttagctgttaccggcttgtctatttttctttgccgtccacgctatatatggtcacctgtaagttggtcttgcccggtgtcaggaaacggcatcacaattatcaaaagctgttatcgtattctgatggcttaagattgcaccctgtgctcgtgataatttcctgtatcaactatcattctatcaaggcagaacgtaatggtttgttttgttaaaaaaaaaacaaaagcggccgcccctaggggcccct

SEQ ID NO: 7044 - DNA, 1492 bp, Zea mays
actgttgtggtcgccccctccgggccggccgggtgggtgaaaagaagcaaaaatcccctctcccccttctcgtcctcctcccgactcccacccaaaaaaaaaaaaaaacttcgaaggaggtttcgatcgcgaaaccgcccagggcccgccccgcaagtgcatggcagtgagcttcctggccaatgaggtgtcggacctgtgcatcggcaagccggccgtgaggtcgctcccgctctccgccgccgccggcgaccttgccgccgcgctccggagggtggcccgctctggcgcaccatcctgcgtcgcggtgactggaccagcgcgcgccgtcgtcggccgggtcggcctcgcggacgtgctctgcttcctgtgcaccgaccccgaagcgctcgcgcgccccgccgtcgtgttctccaagccggtctccgcgctcctgccgaaggacggcgctggagaggtccgccgcgtcgatccccgctcgagtatcttggaggcgcttgatgcggttctgagcggggcgcaggtgctcgccgtcccgctacgcgctggctggcgcaagaagcagctcggcggcggcggaggctccgccgccgccggcgacttctgctggctcacgcaggaggacctcgtgcgctacttcctcaactccatcggcctcttctaccatgtggccgcgcgctccgtgtcctcgctcgggctcgtgcgcaccgacttcctgtcggtgcgccccggcgaggcggccctgtcggccgtgcccctcatccgccgcgccgtcgccacggagacggcggtcgccgtggtcaccgaagacggccacctgctcggcgagatctcccccgccctcctcgcggcctgcgacgagacggcggccgcggccatcgcaacgctctcggcggcggacctcatggcctacgtcgactacttcgggtccgcgcccgagcacatctcgcgcgccatcaaggccgggctgaaggacaagggcctcgacgccatgctggcgctggttgaggacgagacgctatcgtcgttctcctccgcgtcctcgtcgtccgacgaagaggcaggccggacgcagctgaggcgcccgtcgtcggggagctacgggcggcggtcagccgaggagccggtggtgtgcagccccgcgagctcgctggtggccgtcatggtgcaggccctcgcgcacagggtgagctacgtgtgggtcctcgacgaggacagcgactgccgccttgctggcatcgtcacgttcgcggacgtactgagggtgttccgggagcaactgctgtgagatctggaagagtgtttgctgtttcctcgatcgcatcttgtggtgtaatgaaatggagaagaacatgagctcttgtcacggaccgagcgccttcgtttctcaaaaaacattttggtttggaccaaaaaaaaaaaaaaaaaagcttatcgataccgtcgactgtttaaacacaataaagttggaactggaggggggaaaggagtt

SEQ ID NO: 7045 - DNA, 1576 bp, Zea mays
  misc_feature (1)..(1): n is a, c, g, or t
ngaaaaatttcaccccccaacgcgccgcgggttgaaactaaaacccccctccctccccctcgtcttcctcacaaatcccacccaaaaaaaaaacgcctcccggttgctcgcctctatcctcattgaaaatctttgaaagaggtttggatcccgaaaccgccaagggcccgccccgcaagtgcatggcagtgaacttcctggccaatgaggtgtcggacctgtgcatcggcaagccggccgtgaggtcgctaccgctctccgccgccaccggcgaccttgccgccgccctccggagggtgtcccgctctggcgccgcagcctgcgtcgcggtgaccggaccagcgcgcgccgtcgtcggccgggtcggcctcgcggacgtcctctgcttcctctgcaccgaccccgaggcgctcgcgcgccccgccgcggtgttcgccaagccggtctccgcgctcctgcctaaggacggcgccggagaggtccgccgcgtcgatccccgctccagtatcttggaggcccttgatgcggttctgagcggggcgcaggtgctggccgtcccactccgcgctggcgggcgcaagaagcagctcgttggcgccgccgacgacggcgacttctgctggctcacgcaggaggacctcgtgcgctactttctcaactacatctgcctcgtctacaatgtggcggcgcgctccgtgtcctccctcgggctcgtgcgcgccgacttcctctcggtgcgccccggcgaggcggccctgtccgccgtgcccctcatccgccgcgccgtcgccacggagacggcggtcgccgtggtcgccgaagacgggcacctcgtcggcgagatctcccctgcccttctcgcggcctgcgacgagacggcggcggcagccatcgccacgctctcggccgccgacctcatggcctacatcgaccactacgtgtcgccgccggagcacatcctgcgcgccgtcaaggccgggctgaaggacaagggcctggacgccttgcttgcgctggttgaggacgagacgctgtcgtccttctcgtccctctccgcgtcctcctcgtccgacgaggaggcaggccgggcgcagctgaggcgcccgtcgtcggggagctacgggcggcgggcggctgacgagccggtggtgtgcagccccgcgagctcactggtggccgtcttggtgcaggccctcgcgcacagggtgagctacgtctgggtcctcgacgaggacaacgactgccgcctcgccggcatcgtcaggttcgcggacgtgctgagggtgttccgggaccagctgctgtgaggtctgacgagtgcttactgtttcctggctcccatcttgtggtgtcatggaattgagaagaatatgagctcttgtttctgaaacatttttatttgaagagtatgtgtttgcttgcttggtagccagttcagaattcagatgaacagctttggcattggtgcgttttcattaaatttcttcctattaacaaaaagaaaaaaaaaattgatgcggtaggttgtttgtgcttaaaactgtatcttgataaccgaaaaaattaatcattcttg

SEQ ID NO: 7046 - DNA, 794 bp, Zea mays
aaatcctttcccccctccagttccaactttatgaagcaaaaatcccctcctcccccttctcgtcttcctcccgaccccgaccaaaaaaaaccttcgaaggaggtttcgatcgcgaaaccgcccagggcccgccccgcaagtgcatggcagtgagctttctggccaatgaggtgtcggacctgtgcatcggcaagccggccgtgaggtcgctcccgctctccgccgccgccggcgactttgccgccgcgctccggagggtggcccgctctggcgcaccagcctgcgtcgcagtgactggaccagcgcgcgccgtcgtcggccgggtcggcctcgcggacgtgctctgcttcctgtgcaccgaccccgaggcgctcgcgcgccccgccgccgtgttctccaagccggtctccgcgctcctgccgaaggacggcgccggagaggtccgccgcgtcgatccccgctcgaggtaaggctcagcccctctccctctttctctctcctgggtctgtgcaaacgacgcgtgactggaagtctggaactggaagtttcctaagtatcttggaggcgcttgatgcggttctgagcggggcgcaggtgctcgccgtcccgctacgcgctggctgcgcagacaactccggggggggggggggggggcccccccggcggcgaaagaatttctggtggttcagggaggaagaacctcgtggcgctacttccctcaactccatcgggcctccttctaccatgtgggccgcgcggctcggtgtccctcgcttcggggctcggggcgcacc

SEQ ID NO: 7047 - DNA, 2485 bp, Zea mays
cttgcatgcctgcagcaaattttttcgcctcccaccccccaacgcgccgcggttgaaacaaaaacccacctcccctcccctccccctcgtcttcctcacaaatcccacccaaaaaaaaaacgcctcccggttgctcgcctctatcctcattgaaaatctttgaaagaggtttggatcccgaaaccgccaagggcccgccccgcaagtgcatggcagtgaacttcctggccaatgaggtgtcggacctgtgcatcggcaagccggccgtgaggtcgctaccgctctccgccgccaccggcgaccttgccgccgccctccggagggtgtcccgctctggcgccgcagcctgcgtcgcggtgaccggaccagcgcgcgccgtcgtcggccgggtcggcctcgcggacgtcctctgcttcctctgcaccgaccccgaggcgctcgcgcgccccgccgcggtgttcgccaagccggtctccgcgctcctgcctaaggacggcgccggagaggtccgccgcgtcgatccccgctccagtatcttggaggcccttgatgctgtcaactcctatccttcctccgctcttctcggtctgtgcaaacgacgcgtgggattcgttcgagattggaagaacgctaaggccgttcatcacgaggaaacacggttttttggtaaaaaaagaaattccttaataaaagctgcgatagaaatcgattttatgaggcaactttcatccctcatcatgattacttggcgtgctgactaggctagtgtcatttttcttttattttgggtcccaattccaagacagacgacagacgagcgttcatcctcatcatgattacttggagggtttgatctctgctctgtgctttgttgcttggaatatgcgaccccgattcgaacaagtgactgtcatgttctttactctcgtgatggtcaagaaaaagccgcattcgggtcagatcatccgagtcaccggagacaatctagtggtgcggctcggagtgggttccgggagattgcgacatgcacccctgtctctttttcagcccacaaatctcgcagttcttttggggtccgcttgtggctcgaaaacggcgccgctttgatcggagtcttggaatgaaaggtggaggatcttggcatgtggtttggaaaatgcgtgcgtctttattcgaatctttctttaaaatatcggcgattcttttgggatcttgcctagtatttttaatcactgcatgtattcccccgcttttgagctgaccagcgtggggttcctttctgcagtatcttggaggcccttgatgcgattctgagcggggcgcaggggctgcccgtccccctccgcgctggcgggcgcaagaagcagctcgttggcgccgccgacggcgacttctgctggctcacgcaggaggacctcgtgcgctacttcctcaactacatctgcctcgtctacaatgtggcggcgcgctccgtgtcctccctcgggctcgtgcgcgccgacttcctctcggtgcgccccggcgaggcggccctgtccgccgtgcccctcatccgccgcgccgtcgccacggagacggcggttgccgtggtcgccgaagacgggcacctcgtcggcgagatctcccctgcccttctcgcggcctgcgacgagacggcggcggcagccatcgccacgctctcggccgccgacctcatggcctacatcgaccactacgtgtcgccgcctgagcacatcctgcgcgccgtcaaggccggactgaaggacaagggcctggacgccttgcttgcgctggttgaggacgagacgctgtcatcgttctcgtccctctcctccgcgtcctcctcgtccgacgaggaggcaggccgggcgcagctgaggcgtccgtcgtcggggagctacgggcggcgggcggctgacgagccggtggtgtgcagccccgcgagctcactggtggccgtcttggtgcaggccctcgcgcacagggtgagctacgtctgggtcctcgacgaggacaacgactgccgcctcgccggcatcgtcacgttcgcggacgtgctgagggttttccgggagcagctgctgtgaggcctgacgagtgcttactgtttcctggctcccatcttgtggtgtcatggaattgagaagaatatgagctcttgtttctgaaacatttttatttgaagagtatgtgtttgcttgcttggtagccagttcagaattcagatgaacagctttgacattggtgcgttttcattaaatttcttcctattaataaggcagcactgtggcttgatgcggtaggttgtttgtgcttaaaactgtatcttgataaccgaaaaaattaatcattcttgaacataccatggttcagtgccctggtccttcacatggcgagcaggttctcccttgctgaacgaggtggcgaagctttagcgcccgttcaatgtacagtacaaccatagtcggatggttagttgttaaca

SEQ ID NO: 7048 - DNA, 2791 bp, Zea mays
cattgggtacctcgaggccggccgggaacagctgactttacttcgtaagctcagcttactcacaacaaccttcctctttaattgcgccctccccccggcggacccgcactcactctctctctactctcttcgtctgcgcccccacaaaaccctagacgccaccctcccccgccgcgcgccgccgcccgcggacatggatctccttcgctctcatctccacaaggtccggatccccgagccaaccaaccgcatccacaaggacgagtgctgcgtctccttcgacactccgaggtcagagggaggcctgtacgtggacatggtctcgttcctggggttcgggagggagtacgtggagtggaacttcgagaagacggggaaccccgtgtacctccacatcgttcagcgccggaagccggagcccgacgaggcggatcgcccgcttaagaagcccaccctcctcgctataggtgtggaaggaggttttggtgatcaagaaccagaatatgatgaaacttttgaaatagtcatcttacctgattttatctgtcttccatttccgtcagttgatttgccagagaaggttaggcttgcggttgataaagttttacttgctgaaagtgctgatagaaaagaacaactggctgcttgggttgctgacaaaaagaacattagtgcatatgctatggacctgcagcagctagacaatggtgttattgtgcctcctactggatggaagtgtagcaaatgcgataaaactgagaacctctggctgaatttaactgatggtatgatcctttgtgggaggaagctctgggatggaagtggtgggaataatcatgccattgaacattatgaacagactaaataccctcttgcggtgaagcttggaacaattactgctgatttggaagcggcagatgttttctcgtaccctgaagatgatagtgttgaagatccgctattagctcagcacttatcacattttggtatcgatttttcttcactccaaaagactgagatgactactgctgagagggaacttgatgctaacacaaattatgactggaatagaatacaagaaagtggaaaagacgctgagcttctgtttggacccggctatactggtcttgcgaatcttgggaatagttgctatatggcttcaataatgcaagtcatgttttcaatccatcctttcatatcaaggtacttcgagaaacagagtttgaaagctgcatttgcaactgcacccgctgatccaacagtagacctaaacatgcaactgacaaaactagcgcatggtttgctctctggtaaatattctgctccagcaaaggaggggcaagaagggatacgttctcgcatgtttaagtcagttatcactgcgaaccatcctgaattttcaagcatgagacaacaggatgtccttgaattcttccttcaccttattgacagagttgagaaggcaaaccctggagaccgtgagctaaatcctttttccggtttcaagtttgttgttgaagagagggttcagtgcccttctgggaaggtttcttacaacaaacgatctgacaacgttctttctttgagcataccactgcatgaggcaactaataaagagcagctagaagcttttaatgagaagaaagctgcaatgaacttggatggaaaagaagtgtctaatgaggatattgtcaggcctagagtcccattggaggcatgcttggcaagtttttcagggccagaggagattccagatttttatagcactgcattaaattcaaagactaccgtcactaagacagctggtttcactacctttcctgattaccttgtgctgcacatgcgtaagtttgtaatggaaacaggatgggtgccaaagaaactcgatgtttatatagatgtgccagatacaattgatatcacacatatgcgcagcaaaggattacagcctggggaagagctgctacctgaaggaggttctggtgacgacagtgccgagcctgctaatcctgttgccagtgaggttattgtaacccagcttgcaagcatgggcttcaactaccttcattgtcagaaagctgctattaacacatcaaacacaggagttgaggaagcgatgaattggctcctctcgcacatggatgatccagatataaacgacccaatatcaaaagattcacgtgcttatgagccatctgttgacgaagcaagtgttcaaactctcatctcctttggattccaggaagacattgccataaaggccctgaaagcttctggtggtaatatcgagaaagctacagactggattttcagccaccccgaagcatctacctcagcatctgctgattcttccactagcaatgtaaatgctgatgacacatatattccagatggaagtggcagatacaagctgatggcgttcgtgagccatatgggcacctctacccactgcgggcactacgtagctcatgtcctcaaagacgggaggtggacaatctttaacgacagcaaggtcgcagtatctgttgacctgcccaaggaaatgggctacctctatttctttcagaggattagcaactaggcacgtcacacacaacggaaagaatggtgggctgttaggatactgtcttgctgattttaaagcgaacgtttgctcacatcctgccatgctggttactgaatggtcaaccgggatatttgcttttttgttccttgagacctcgattggcatcttccggttacatctgtgcttttttattactgatttgcattggtggttaaataaaatcaa

SEQ ID NO: 7049 - DNA, 1957 bp, Zea mays
  misc_feature (658)..(658): n is a, c, g, or t
ggctgctctgattgcttgttaaaatacctgttgatgccatattttctgtgacagctcagatgttttctcgtaccctgaagatgatagtgttgaagatccgctattagctcagcacttatcacattttggtatcgatttttcttcactccaaaaggtgagttagggtttttatcatttatgatttatctgtgacatttatttaacttaatcgaacttttctagggagaagaaggcttatgtaatttagctctgttttgtagagctgcttgtgtcttaaaatatgtagaagaatcatatttggaataatagaacaacaacaacaaaaccttttatcccaaccaagttgaggcaggctagagttaaaaacccaatagaaccataagtcaaggttcgggtacatgaataactgtttttcatgcacttctatttaagactaaatctttgggtatattccatccttttaagtctcctataactgtcttttcccatgtcaacttcgatcttcctctcttctcattgttatagcgccttaggatccaactacacactggcgtctctggaggtgcttgttggacatgtctaaaccatctcaaccgatgttggtcaagctttttttttaattggcgctacccctagtctgtcatgcatatcatcattngggactccatcccttgtatggacacaaatccaacgcagtcgcaacatacatattttcgcaacggtctttgatagcagcccaagcctcccctgtgaagggatcatcaagatcagagaggtcatgttgttggtgtccgagagcttgaaggttcagagtgaactccctttccacagccgacccaaacaaggattcatataactccagggctgtttgctgttttccctcctgagaagtgaccaattgattaaccaccttgaacttggcgataaaattctggttgaaacaaatgttaactttgattctataagagcatggcagcttgtaacatggatgacagaaatctggaaaatctatggtaggacgtgattctgaattgaactagaggaatctataggttttcaagaatctattctgctgttgtacccgtttagttgagattccagatttttggcagcgaatctgatttagaaagctgaaccaaacacacccttattcttgcccgactttcatcaactagcactacatcgtttgcaaaaagcacactagaataatcatagtgacaaatatgttaagtactttgtcattttaggaactaggcttagatcgcattgagtatgcattgtagaatgctcgttaactacttgattgctttcttgaaccatttaaaattttcattatcagtagatactattgctttaggagctattgtaaactgagtattcatcaggcagatatatgttacagctgatgccataatacagtttttttcctgcttgacatgtacatagaggcaattttatgcttggccacattgtttataaatttgttcttgcagactgagatgactactgctgagagggaacttgatgctaacacaaattatgactggaatagaatacaagaaagtggaaaagacgctgagcttctgtttggacccggctatactggtcttgcgaatcttgggaataggtagcatgatttgacttcgtagaatactcttttgatctgataattccttgtaacaaatgatttagctatcatgtttctttcttttttacagttgctatatggcttcaataatgcaagtcatgttttcaatccatcctttcatatcaaggttgccttttacttttcacattagtttttgtacatagttacatttgtatttttccctttttctttactattccctttttcatttcaggtacttcgagaaacagagtttgaaagctgcatttgcaactgcacccgctgatccaacagtagacctaaacatgcaactgtaagtttatagccctg

SEQ ID NO: 7050 - DNA, 883 bp, Zea mays
acgaaacaaaccttcggacccttcatcctcgccttttcacgcgctcagcgatgacgcgttacaatgcatccttgtgctcctcgcgtccctcgccgctgccgtcgccgcagcatcctcgcacactcactcgctctcgcgttctgcctcggcctgccaccaccaccaccatctcgcctgctgctcgccaatggcccctgcctcgtcgccggttgcaggctcctccactcgctccgtcgcctccgccacatcctcgggatatgatgctctgtccccttcggatccggctagccgtcgccagggacacaaccaagcttggcctgggcgcgacaaccaggtccaaccgagccagcggccggggagatctgaaggggtgagggggtggggggacacgagcgcgcactctcggctcccgccccgcgggggaagcagagcggagacgggcggcgaaggcggaaggccatgaggtgttgggatttgggaggggtcaggtcaggagtggccgtcccgctcgtgaactcctgcgccaaacgcaaaactgtcggctgcagcctgcagtcgccggccggaactgggacgagtttggtttggtgatggtggcctgctcttggatcgagacggcccgattggatgaatgatcgcgtcgccgattaaataatcaccatctgattctattggttttaaatctactattgagtttgtgatttgtctttcttattttggttgtccagttactaaaacaacaaaaagacaacaatgtaatggtgggtgttctgaaggagtttgggaacatgctagcctatggtcgtctagatttgtcaattaccctctattttacaataaataaaggagatgattttatgttacatcaaaaaaaaaaaaaaaa

SEQ ID NO: 7051 - DNA, 1323 bp, Zea mays
  misc_feature (1272)..(1276): n is a, c, g, or t
  misc_feature (1279)..(1283): n is a, c, g, or t
  misc_feature (1285)..(1286): n is a, c, g, or t
  misc_feature (1289)..(1290): n is a, c, g, or t
  misc_feature (1316)..(1316): n is a, c, g, or t
agtcgcattcaggaacaacgatctttggcacggcggacggcggcgacccctccaactccccccaccttgatatcgccgctgctacgctgttatcaccattcgaagccatgagatctcttcttacccgcctcttcacctcaactcacattgtcatggcctcgtcttccttctcttcctctccatctcggcggttggtccacctcacacgccatctcgtctcctcttcttccggcgagctttcctcagtcggcgcccccgccaccgccgcctcagatgccgaccccgtgaaaagcccacgctccaccgcctccagggttcacgccgcggtgctggtctgcctcttcgaggaccctagcagtgggccacgggtcctgcttacaaagcgcgcttcctccctctcctcccactccggggaggtgtcgctacccggagggaaggtggacgatggagacgcagatccgaaggccacagctctacgggaggcgaaggaggagattggactggatccggcgcttgtttctgttgttacagttcttgagcctttcctatcaaagaatggcctcactgttgttcctgtcattggtatggtcccagataaagccttatacaagcctgtcttgaataaagctgaagtggaggacatctttgacgcacctctggagatgtttctaaaggacgaccaccggaggacaagacagatgaactggatgggcatagatatccccgtccagtttttcgactacgaggcagatggcaagaagttcgtgatttggggcttgactgcgcacatcctgacacgcgcagcggcagtcattttcgggaggaaaccatcattcgtcgagcttcccagacccaaatatgcaggtgcacctgttgctggcactggcaagtcgaatctctgatggagcataagctggatgtaaggggcctctttgggtttggaacttggtgcatgaaccttgtgattgtagaattatatatgtttctcactatgtgatggctggggaaggtaccgaaaattgcttggtatatttatctacagaatataagatacatgctcaactgtattttgagtgtagcacagcagacaatattggcacacttggtggatggtgctttgtaaaaaagaatgtatacaatgaactccagaaagtatactgtctcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnnnaannnnnannaannaaaaaaaaaaaaaaaaaaaaaaaaanagggggg

SEQ ID NO: 7052 - DNA, 2886 bp, Zea mays
  misc_feature (54)..(54): n is a, c, g, or t
  misc_feature (117)..(117): n is a, c, g, or t
cgcgatcgattccgatcggcctgatttccgtcacatctcgcaggtggtttcagngttgcgttcgaccccctcgacggctccagcattgtcgacaccaacttcaccgtcggaaccatnttcggagtctggcccggcgacaagctgaccggagtgaccggcggcgaccaggtcgctgccgcgatgggcatctacggccctcgcacgacctacattgtcgccctcaaggactgccctgggacgcacgagttcctcctcctcgacgaaggtaaatggcagcatgtgaaggacaccacgaccattggggaagggaagatgttctctcctggtaatctgagggcgacattcgataaccctgagtacgacaaggtactccgttactggctcctgttactgtcagtatttttttttcttcttcttaatatctgctacggctttctgtgcgcgcctaatcggtgctacaaatatatgtatcttcagctcatcaactactacgtcaaggagaagtacacattgcgctacactggaggaatggttcccgatgtcaaccaggtacatacgtatatatcacaaaaactttaaataattcacacccttagggcttgttcggttagctctcaatccatatggattgagtgggattgggtgggattaaatcccaagcaagtcaaagttcttctaaattttttccaatcccattcaatccatgtataataggaataaccgaacaaacccttagtaaaccacacagaaaaatcccgacacctcacaacccgtacgttcactcgatcggatcactagcttaattagtaatcaggagtagtacatgttccaaaaccaaacagatccatatatgattaacctgtcatgtcaactctctacacaccttgcacaccaaaacagccaaattttcagagaggacgacggcgcaaacttttgagaagaaagaatttggtttgacgttgccagtaaaatgtctcgggctgtagagtcactgcaagcccatgctagtgaacattgagctctgtgtaccagcgtctgctttaaagcaaggccacgccaagcaacacagcaattccctacagtgaccccccaacctcgctttcgctttaggtcttttcctatgccgctttcagtacacagaacctgcgtgagcaccagcatatatgcatgcatatgatgcctgtgagtatggtcgatgatgacgcagatcatagtgaaggagaagggcatcttcaccaacgtgacgtccccgacggccaaggccaagctgcggctcctcttcgaggtggcgcccctgggcttcttgatggagaaggccggcgggtacagcagcgacggcaagcagtcggtgctggacagggtgatcaacgagctcgacgagcggacccaggtggcctacgggtccaagaacgagatcatccggttcgaggagaccctctacggctcgtccaggctcgccgccagcgccaccgccaccgcccgcgcccttatctgaattactagaatccgggctcgtagatgctggagtacacagtacagggaaattgcccacttttttcatcaacttaagtttttagattaaacttttttgaaacaatcagacaggagatctgtcttatatattgatgaggagaaagatgcccaaaggcaaaaaaaaaaaagtcgatacaataacaagtaaaaaaaaaaatgcccctgcctcccaaccgcaaaccaaaaaacaacccacgactagcatcctatctaagttgaagccaaaaagtagtcaagtgcctcgcctggaccgccatccagactgtcgcctcacatttaatgaggttacaatctactggctactagaaaacatgcaatcaaaagtactcgtatttctttcctaatatattgtcccgttgacaaggatcagcaacattctaaagcctttttctattacagcccaacaacatagccaattctcccaccaatgcatcaacgtgggagataactcctagctggatggcttcataactccagggtacctacacatagagcacaagttagggtatggggccaatttctagaagctaaacggcccagtctaaatacaattttgaattgcttagctgaaaaacttgctctttggaacgcccaggtatgagtctgtgcaaatcgaggcgaaaaattacgccttatatgccgatttcactgtgtatcggtggtctgcaatgaatttctagctgaagatatctttggcctctggatctaaatggatcttttgaacttcgaaccaaaaaaattgaagaactcatgaaaacggtgagggtgtaattactttgaccaagcagagcgagatccacgatctagacattgtcttttaccgcctctaccaatgatttgctcttgtttcttgatatagtaaagagcctaagtgccacgtccttcagtctcagcccttctgccgaaactctgttccagaagagtactttagaaccatcagtacatcaccaatcctaatatccgtcgaaaccataaagagcagtctatcaataatagagcaaggtgtttccaaattgccccggacttttacatggcgaggtgcaataattctgccggttttagattaaacttgtggatacatgcaactcgaattatcgttatctatttttattttacgtacatatgagacacgagtacgtaagcctcaatttaaaaagagagttttggagtatgcgtgaatcatttatatctgttgtcttcgtgtttctaccgcgaagtgaattttgtatacggttgcattgcatatgcatgcatgtgtgcgtcgtccatgcaacaatgcatgcgccaatgcatgacaatactcgtgtcatcatcggatgtctgcatgcctcatctctcggtgtgtgtgtgtgt

SEQ ID NO: 7053 - DNA, 1429 bp, Zea mays
agcatcaggtttaggccctgctgccgtcgtcgagcgcccgggccaccgcacacctgaaagcaatggagatcgtcgccacgcgctccccggcctgctgcgccgccgtgtccttctcccagtcgtacaggcccaaggcgtccaggccgccgacaacgttctacggcgagtcggtgcgggtgaacacggcgcggccgctctcggcgaggaggcagtccaaggcggccagccgcgcggccctcagtgcccggtgcgagatcggagacagcctggaggagttcctgaccaaggcgacgccggacaagaacctcatcaggctgctcatctgcatgggggaggccatgaggacgatcgcgttcaaggtccggacggcgtcctgcggcggcacggcctgtgtcaactccttcggcgacgagcagctggccgtcgacatgctcgctaacaagctcctctttgaggctttggagtactcacatgtgtgtaagtatgcgtgctccgaggaagtccccgagctccaggacatgggtggcccagtcgaaggtggtttcagcgttgcgttcgaccccctcgacggctccagcattgtcgacaccaacttcaccgtgggaaccatcttcggagtctggcccggcgacaagctgaccggagtgaccggcggcgaccaggtcgctgccgcgatgggcatctacggccctcgcacgacctacattgtcgccctcaaggattgccctgggacgcacgagttcctcctcctcgacgaaggtaaatggcagcatgtgaaggacaccacgaccattggggaagggaagatgttctctcctggtaatctgagggcgacattcgataaccctgagtacgacaagctcatcaactactacgtcaaggagaagtacacattgcgctacactggaggaatggttcccgatgtcaaccagatcatagtgaaggagaagggcatcttcaccaacgtgacgtccccgacggccaaggctaagctgcggctcctcttcgaggtggcgcccctgggcttcttgatggagaaggccggcgggtacagcagcgacggcaagcagtcggtgctggacagggtgatcaacgagctcgacgagcggacccaggtggcctacgggtccaagaacgagatcatccggttcgaggagaccctctacggctcgtccaggctcgccgccagcgccaccgccaccgcccgcgcccttatctgaattactagaatccgggctcgtagatgctggagtacacagtacagggaaattgcccacttttttcatcaacttaagtttttagattaaacttttttgaaacaatcagacaggagatctgtcttatatattgatgaggagaaagatgcccaaaggcaaaaaaaaaaaaaaaaaaccccacccgcccccccgcccgtccgcccacgcgtccg

SEQ ID NO: 7054 - DNA, 2923 bp, Zea mays
ctatatatatatatatatatatatatatatatatatatatatatatatatatatatatatatatatgctaaaataatgtcattttaagttctcagacgatgttaaagctaaaaagtttcaatcaacctcaaatattgacatggactacagcaaagctctgttctcaaatatagcccataaaattatagctgaaagttgttaatttagacttgtttagagtccaaaatgtgttttacttttctaggttttgaaattttcaaagaacgtacattgaatgttcacatgatatggttaatataccgaagttgtggcgtggctaacctgatctacgagcatgttattcataagttcttgtgaagttgcttagagtctcaaatattagttttaaactcatatatgaggtctagctaattttttgtttttgttttttggaaaaaaacaaacattctctaatgggagataggtcctacaccaaaattgtatgataagatttagaactttatagttaaaacgtttttattatatgtatacagctgccatgcatgagcaacaatcagttatagcaattccaaaaagaatgtttattatatgcatgtgcagcgcgacgtctggggttcaagatgagtccacctgcttacctctcgttgacaccggtatcaaagtttgacctgttcacgtgccgaattggtgccaattacgcgtctggcggatctggcattctcaacaccacggtatatatggctccgacacgaagctgttctttttattcagcataattaagctgtcgtgcatacactacacatagttttgcttctcatgatgagtcgtacgtatacacaaatatatccccatcaccacaccaattactaataataattactggtaatttaattgtgtatgcagggaaacgggacactcacgctgcagaaacaaatcacgctgttctccaaaactcaagcaagaatgtcgtgggcccgctgcaagctcaggtctatggtatcgaggtccttgttccttgtcagcgccggcggcaatgacttctccgccttcagtgaaatgggcatgggcgaacaagacgccccagcctacatcagtagcatggtctcaacctatgtccagcatatcgacgtacgtgtgaggcgggaccatgcatcaaatctgtcattgcacattaattaaaggtctcgatgcaataattagtggacgacatcgatgcctgcaggcgttgtacaagttgggagcacggaaggttggggatcctagacgtgccagctatcggctgtaccccaggctccagagtccccatggccaacggcggatgcaacgtagcatggtctcaacctatgtccagcatatcgacgcgttgtacaagttgggagcacggaggttggggatcctagacgtgccagcgatcggctgtaccccaggctccagagtccccatggccaacggcggatgcaacgacgctgccaactctatggcgcagaacttcaacaaactcctaaggctcgaggtggcgaaagccgtcgcatcctccatgcccggcatgagatactccattgcaagcacctacaattttgtcaccgacttgatggacagccatctagtggctgggctccgggtggtcgacagggcatgctgcggatcgggaaaactgaacgccgcggtcatgtgcgcccagccaaacacgacttactgttcggatcgcgacgactacatgttctgggacatgctacatcctacgcaggcaacaaatgaacgtggggtggtcgccatcttctacggcccgcaggagtacgcggatcccatcaactttgcacagttggccgctgccacagcaaatgatgatgatgatataaatactgctatgaccgcaggcgtctatgccgccatatgataaacactatttatgtcgattggcatgcagctgcgacatgtcactacctgagtactatatacgtaattcagttggaataatgtacgttgtgtgcatcatcagtctctctctatatatgctggaaataaaatgaggacaagagaccacaagaaaatgttagaaaaagtgtcagttaatttccttaaatgccccctgcctcggacccgcggcaaagtctattttacactcggcaaaggctttgccgagtgtaacactcggcaaaaaacgctcggcgaactgtacgtcggcaacggtatctttgccgagtactttttgtcgggcactcgacaaagaatttgtcgagtgtcgtttgacactcggcaaagaaaagtcactgtcacggcgccaagtgccgtgacggtgacagatcctttgccgagtgtctttttggcactcggcaaagaggccaattttgccgagtgtctgctatcgtggccctcggcaaagacgggtccagtgggccccaccgccagtccctgtgccgagagctctcgtaggcactcggcaaaggaggactctttgccgagtgtctagtggaccggcactcggcaaagagtcctccagtgggtccctttgccagtccctttgccaagtgccttggcaacagcactcggcaaagatggctttgccggttcccaggtttccttctttgccgaatgccatggtcagcactcggcaaagatggctttaccggttcccaagtttccttctttgccgagtgccatggtcatagcactcggcaaagcgaccctttgccgagtgttacactcggcaaagtgaccaggatgtccctttttatttgtttttgctgtttcatccgaacaaacaaaagatatatatcattcacatcacattatatatcaatcgcatcacagaatgaacacatttatcatcaacaccatatatatcacaaagtctcactaatataagtctcacaaatataagtcaggatcatcacaaaacagatataagtctggatcatcaaag

SEQ ID NO: 7055 - DNA, 1564 bp, Zea mays
gcacgagaccattacccgcgagacccggcccgggccctcactccaaagccaacaaacagagctccaactcagaaagcatccgtcccttggcagcagcaacaagctactagctatgtgtgtttagagcgagcgaggggaaaaaaaagaaaacatctaagatatactccatcatcttcgtttgattaacccgcccagtaaagccatgggtactaatgatagagcggtcatttctctagtactcctcgtgtgcatcgctagccgctcgtccttgggtgccgctgaaactgacgttgagcagaagcgctcgtcagtcccgttgatgtttgtgttcggtgattcgctggtcgatgtcggaaacaataacttcctgccgccgcctgcaccccgtgctgcatctccgtacggcatcgacttccctgctggcacccccggcgccgtctcaggacggttcacgaatggctacaaccttgccgatttagtcgcgcgacgtctggggttcaagatgagtccacctgcttacctctcgttgacaccgttatcaaagtttgacctgttcacgtgccgaattggtgccaattacgcgtctggcggatctggcattctcaacaccacgggaaacgggacactcacgctgcagaaacaaatcacgctgttctcgaaaactaaagcaagaatgtcgtggggccgctgcaagctcagctctatggtatcgaggtcgttgttccttatcagcgccggcggcaatgacttctccgccttcagtgaaatgggcatgggcgaacaagacgccccagcctacatcagtagcatggtctcaacctatgtccagcatatcgacgcgttgtacaagttgggagcacggaggttggggatcctagacgtgccagcgatcggctgtaccccaggctccagagtccccatggccaacggcggatgcaacgacgctgccaactctatggcgcagaacttcaacaaactcctaaggctcgaggtggcgaaagccgtcgcatcctccatgcccggcatgagatactccattgcaagcacctacaattttgtcaccgacttgatggacagccatctagtggctgggctccgggtggtcgacagggcatgctgcggatcgggaaaactgaacgccgcggtcatgtgcgcccagccaaacacgacttactgttcggatcgcgacgactacatgttctgggacatgctacatcctacgcaggcaacaaatgaacgtggggtggtcgccatcttctacggcccgcaggagtacgcggatcccatcaactttgcacagttggccgctgccacagcaaatgatgatgatgatataaatactgctatggccgcaggcgtctatgccgccatatgataaaccctatttatgtcgattggcatgcagctgcgacatgtcactacctgagtactatatacgtaattcagttggaataatgtacgttgtgtgcatcatcagtctctctctatatatgctggaaataaaatgaggacaagagaccgcaaagaaaaaatgttagtataactcgagactagttcctcgtgc

SEQ ID NO: 7056 - DNA, 1620 bp, Zea mays
gttaaccgtaatcgatagtacactataaaatggataccgccttatttaaatttgttatcaccggtattcaagtatgaatcattatcattatcatttacgttatatttcgtgaacccaaagacacctacgtggttgtgttatcttaattgtcacgtactcccaaccaccatgttcagtacgaatgtcatgtggagaaagaagcgtctagctacctacctacccgcaccgaattgaacacagtaatacattccaataatcgcgtcactgtacgtgaagcagcgtgtatcacgttggatctaacactataaataccaccgggcggcgcgcgtcccgccccgctccggactccaaagccaacaaacagagctccaactcagaaagcatccgtcccttggcagcagcaacaagctactagctatgtgtgtttagagcgagcgaggggaaaaaaaagaaaacatctaagatatactccatcatcttcgtttgattaacccgcccagtaaagccatgggtactaatgatagagcggtcatttctctggtactcctcgtgtgcatcgctagccgctcgtccttgggtgccgctgaaactgacgttgagcagaagcgctcgtcagtcccgttgatgtttgtgttcggtgattcgctggtcgatgtcggaaacaataacttcctgccgccgcctgcaccccgtgctgcatctccgtacggcatcgacttccctgctggcacccccggcgccgtctcaggacggttcacgaatggctacaaccttgccgatttagtcggtatacacatatatatatttactacatgcatttatatatctatatgcatgcgcatgttttctttttttgtcatggatatggatattctttacaaatgctaatgaaactgcactctggctgttcaaatcctaaaccatatattgctttttatgtttagtgtgtcactgtaagattatatgtagcaacgacatcactttttttcatgcatcacatgtatatatggcttccatacgtgtaaaaaaaaaaaaagttattttcgtatgtagggatgtttatgtaatactatagtacattggacttcacagatccaagacactacaaagtaaaagaatcaaatttatattttctaattaatagggacacatacacatgtagggccggagtcgtatttgtaaataaatggtcagatagtctctagataaaaacaactaccactaccggaattcagctctttgccgaatatcaaatgatttgtcgagtgttttttccggcgaagagtttctttgccgagtgtgtttttgacttggggcaaagagtttatttgctgagtgtttttttgacactcggcaaatagttttttggcaagtgttttattttggacattaggtaaagtgtttttttgccgagtgttttttaacactagttaaagacaatttaaaaatcacattttaaagcagtaaattaattcaaataaaaaagttttcaactacaaatttgtataactcatcaagatgtacactttatattttgatcatttcttcatatgacaaaataaaagaaaatttgtttcattaaacctatatctctcgtagtttatgaaactacaaaagaca

SEQ ID NO: 7057 - DNA, 744 bp, Zea mays
atgcccggcatgagatactccattgcaagcaccctacaattttgtcaccgacttgatggacagccatctagtggctgggctccgggtggtcgacagggcatgctgcggatcgggaaaactgaacgccgcggtcatgtgcgcccagccaaacacgacttactgttcggatcgcgacgactacatgttttgggacatgctacatcctacgcaggcaacaaatgaacgtggggtggtcgccatcttctacggcccgcaggagtacgcggatcccatcaactttgcacagttggccgctgccacagcaaatgatgatggtgatataaatactgctatgaccgcaggcgtctatgccgccatatgataatcactatttatgtcgattggcatgcagctgcgacatgtcactacctgagtgctatatacgtaattcagttggaataatgtacgttgtgtgcatcatcagtctctctatatatatgctggaaataaaatgaggacaagagaccccagtgttagtatataatcagctgcatatgcatgcatgggaagcagttggtgttggagaatgtggcaggcagtatgtttattcgcgtcctatggatgaccttttacttccaaattctgttttcaatcggttttattttatacactatcggcatcagcttttttggtcgagtgtctgaagcacttgataacaaataaagctcggcgaactgtacatcgacagcggcttctttgccaagt

SEQ ID NO: 7058 - DNA, 947 bp, Zea mays
ggccgccgggataccgaccgccctcggtcatccgcggccgcatcacgccacgcgaccgaccttccctgctgcggcgtttcggaaacaaaacggagaagtgtcgtcccttgcagagggttcaggggtctggatatcctgacgaaactgactcgagccgatggggtgctgtggaagcgtaaatcaactttctccaactccactacagttttactttgctcgccgtgtcatggagtgccgtagatgacgaggaacatctggactacagctccggaagagtgaccatcataccagacctgaagtgttgggagcagaaattggaggaagcgaatgaacttggacagacagttgtggtaaagttcagtgcgacttggtgtggaccatgcaggaacgctgctccactatacgccgagctttccttgaagcattctgatcttgttttcgtctccattgacgtcgacgaactgccggaattggtcacgcaattcgatgtacgcgcaactccaacgttcgtcttcatgagagacatgaaggagatcgacaagctggtcgggggcaaccaggaagaactccagaagaagttcgatccgtactgccagtgacagtagaggcgatccatggccggattcgtctgtcagtataggatcagaacgagcatggccaaacatctgattggctgaaagaaggagcaggtcagaattttgcagccagttgatgagctctctctgcgagtgtctgcatctgcatagattcgaggaagtgaagcaaaggaagtaggatctctgtctagcataatgtaaggttagttagtgtgtgaaactctgcaccacattgttcaaagcattcccatacagaaaagttggtaacatcagttaccagatgactcccttttgatgcctccccctgccggtatggtatgcccaaggattaaataatgcgcaatatccaag

SEQ ID NO: 7059 - DNA, 3910 bp, Zea mays
tgtctgccaccaacatttcgacgttgctgaatgtggcagtgacttgtgacgaaggacgaacctgcaggctcttcaaactggcagctgccatccatccaggcacaaaaacctgggaaagcaattagaatttttatatatagagagagagagacaaaaacgagacgaaagcagtcagagctggtggatatattcacgacttcacgtacggcaagattagtggttgtggttggttggctgatgaagttcataaatccgagttgtactagaacagtgccgcctgcgcaatgaatggcatctaaatggtgtgggtgaggtctcttgaatgcgtggcacaagtggcagcagcagcaccccaattctgctgtgctgcctacaaaaaaaagtcattgggatgcagcagactgatggttgtgcggcggacgaagtcgcagggaaaccaggaggaaggctagtgcagagaatcagagctgtctgggtgaaagggcaaaggcaagcagcagagggaggccattacgtgtctccttcctccaggttcctctcggggctgccatggatttgctcagcagaggggcggtgttcaaggccctggtgttcctctgcttcatcagatcgtctcaaggtatatatattccgacttggacattactggatcatctatccagtttttttcttttcttagtcctcaagtggcacatatatacatcacacaagctgctgaatttgcaggaggagatctgaatctccctcccttggtgaaggcaagcaggttccaaagcgaggcatacgactacatcattgtcggcgccggcacggccgggtgcccgctggcggccacgctgtcccacaagtacaaggttctcctgctggagcgaggtgggtctccatatggcaaccgcaacatcacgttgctggagaacttccacatttgcctggccgacgtttcaccgcagtcaccgtcacaagctttcatctccacggatggcgtgataaatgcccgcgcaaatgtcctgggtggcggaacatgtatcaacgccggcttctacagccgggcgaaaccaaggtataccaatagcttcacacagtgcctgttgctgctgctgcatctgcatgctgaatgatttctagcttcttctcccagcttcgtccagcaagcaggctgggacgcagagctggtgaaccagtcctacccttgggtcgaagagaggatcgtccactggcccaaagtggcgccatggcaggctgcgctccgggacgggcttctggaagcaggggtctcaccatacaacgggtattcctatgaccacctctacgggactaaagtcgggggcaccatattcgacgacaccgggcgccggcacacggctgccgacctccttgctgctggaaaccctagcaacctccgggtgctgctccatgctaccgtcgacaagattctcctcgcaaggaagcacggcggggggaggaagcagccgagggctactggagttcggttcagagacgagaacggagcgcaccaccaggccttcctcacaaggaagaggggtagcgacgtcattgtttccgccggcgcaattggcagcccacagctactgctgctcagcgggatcgggccgaggggtcaactcagcaggcacaacgtttctctagtgcacgccaacgaacacgtcggggaagggatgtcggacaatccgatgaactccatcttcgtgcctatgaagagccccacgaagcagtccttgattgaaactgtcgggataacggacgctggggtgtttattgaagccagcagtggtttcagccagtccgacgatagcatccattgccaccatggaatcatgtctgctgaggttggtcgtcgtcgtcgtcttcttcttttcttcatcttctacatgcatatataaagtctccattcatcgcagattggacagatatctacaattccaccaaagcaaagaagtcttgatcaaatccaagagtacgtgcgtaacaaacatagcctgcccaaagaagtgtttgacggaggattcattcttgagaagatcgatggcccactgtcgactggcagtctggtgctcgccgacaccgacgtcgatagcaaccccagcgtgagcttcaactacttccagcatccacaggacctcaggcgctgcgtctacgggattcagacgatcgagaggatactcaagacaaaccacttcgctaaccttaccgccaacggtgccgggtacccgatggaaacgctgctcaatctgagcgtctcggctaacataaacctgatacccaagcacacggacgacaccacgtccttggagcagttctgcagggacacggtcacaaccatctggcactaccatgggggatgccatgttggcaaggtggtggatcgacactaccgggtgattggcatctccggcctccgtgtgatagatggatcaaccttgttcagttcaccaggaacgaatccacaggccacggtcctaatgatgggcaggtaacgttaactacagaatgaacaaacaactactacatatattattggtattatctgctaatggtgtgtatttgatgatcagatacatgggggtgaagattctaagggaaagattaggacgagcagctggagtataatggactttatccagctcatcaagtatgaatgtgacttaggaggagacaagtatatagtgatttttgaaagcgattcattaaatcgccaaacaaacaaaacaaaattaagccaggggttccatttgtattcttgctgctctcatatatatatgcatggtctatcacaaattcacaaatgtgtattattagttccacgttcatagaggattttctacattttgggcaacattattgcacactgtaataacataatctgacaaacttggactcagaagacaatggggcagagatcgatggcggcaggtccaaatcaggaccaaagctcaacatttatttgtattttcattgtgcaaccgtttgacttttttggttcaactgggaattccttaagtaagcataagtttaaccagttataagaaaagacgagcaacctatttcaacaccagatcgatgacgtgtgctcaaagtcaaagggtactttcgcaagcaaatcatatcagtttaagacatgtaagctagaaacaagatacctaatttaatcaggcagccgcgtgcacagaagatggtccctagtccgcacttcagaattgtgtcactctatttttttttacaaattacacggcacaatacagatgttcacaggacgactggactgactgttgaacacctactttggcaggcccgacggacggtccggtataatagtcacagtgcgtgccccacacggtccgacgtgttagatcgaaccatccgatattagatcattttaggctggagtcctaatttcttgcgagattttgttggactttgtataggaatgggtccagatcttatctataaatataaaatggtacgaccaattagaacatacacaatcgataaaaaaaatcaattatactttatgttcttctttatccttagattagatctagttttagtcctagttgtagtttatgttctttatgttcttctatatccttagattagatctactttatattcttctttatcctaatcttcaccccctcttcggctctatgtcgatttggggcgatttgggtggactgtcgactccaaagcaaccatagaatttctccttcctgacggggtcactccgggaaggcaagatctaggttcttcctagagctctctgcagagtcgtggacggtccgccacctgcaagtggacggttcacgctttggacaatccgaccatcagaatgctttggacaatccgaccatcagagtgggacgatcaacgaaccagtagaggggctccaaag

SEQ ID NO: 7060 - DNA, 5159 bp, Zea mays
tgtacacagaataaaagtttaaaatagaaaattagatgagaaataatgctgctgcagataccctaatggcaattccaaattcagcaaagagagcctgggaaaccagactctgatctcctagacagcgtggccaatccaaggtccacacattgcgcgggtccacacttgttttatatgattcgcccggcccgccggccgcggctccattgaccaatctgctccgggcaccatggagaggatcagtggcccgcgcctcgctgtcctgctcgctctcgccgtcctcaccgccgtcgccgcagcgaccacggacgaggtgcgcgcgcagtccacctacatcatccacctcgccccaggccacccggcgctgtccgcagcgcgcgacaacggcggcgacgaggcggccctccgccgcctcctcccgcgccgcctgcgcgcgccgaggccgcgcgtgctctactcctaccagcacgctgccacgggcatcgccgcgcggctcacgccccagcaggcggcgcacgccgcggccggggagggcgtcctggccgtgtaccccgaccaggcgcggcagctgcacaccacccacaccccggcgttcctccgcctaacggaggccgccgggctcctcccggctgcgacggggggcgcgtcgtcgtctgccgtcgtcggcgtgctcgacaccgggctctaccccatcggccggtcctcgttcgcggcagcggatggtctcggcccggcgcccgcgtccttctctggtggatgcgtctccgcgggctccttcaacgcgtccgcctactgcaacagcaagctcatcggtgccaagttcttctaccaggggtacgaagctgctctcggccaccccatcgatgagaccaaggagtcgaagtcgccgctggacactgagggccatggcacgcacaccgcctccactgcggctggctcgccggtggccggagccgggttctttgactacgccgaggggcaggccgtgggcatggaccccggtgcgcgcatcgcggcgtacaagatctgctggacgtctggatgctacgactccgatatcctcgctgccatggacgaggccgtcgctgacggcgtcgacgtcatctcgctctccgtcggcgccaacgggtacgcccccagcttcttcaccgattccatcgccatcggcgctttccacgcggtaagcaagggcatcgtcgtctcctgctccgccggcaactccggccccggcgagtacaccgccgtcaacattgcgccgtggatcctgaccgtcggcgcgtccaccatcgaccgcgagttccccgccgatgtggttctcggcgacggccgcgtctttggtggcgtctctctgtatgccggtgaccccctggactccactcagttgcctctggtgttcgccggggactgtggttcccctctgtgcctaatgggcgagctcgactcgaagaaggtggccggcaagatggtgctctgtctgcgtggtaacaacgctcgtgtcgagaaaggagcagcggtcaagctcgccggtggggtcggaatgatcctcgccaacaccgaggagagcggcgaggagctcatcgccgactcccacctcgtgccggcgactatggtcgggcagaagttcggcgacaagatcaggtactacgtccagacggacccgtcgccaacggcgaccatcgtgttccgcggcacagtcatcggcaagtcgcggtccgcgcctcgagtggcggcgttctcgagccgaggccccaactaccgcgcaccggagatcctcaagcccgacgtcatcgccccgggcgtcaacatactcgcggcgtggaccggcgccgcctcccccaccgacctggacatcgactcgaggcgcgtggagttcaacatcatctccggcacgtccatgtcctgcccgcacgtgagcggcctcgccgcgctgctccgccaggcgcacccggagtggagccccgcggcgatcaagtcggcgctcatgaccacggcgtacaacctggacaactccggggaaaccatcaaggacctcgcgacgggcgtggagtcgacgccgttcgtccgtggcgccggtcacgtcgaccccaacgccgccctcgacccagggctggtgtacgacgccggctccgacgactatgtcgccttcctctgcacgctcgggtactctccgtcgttgatctccatcttcacgcaggacgcatcggtcgccgactgctcgacgaaattcgctcgccccggcgaccttaactaccctgccttcgccgccgtcttctcctcctaccaagactcggtcacctaccgccgggtggtgcgcaacgtcggcagcaactccagcgcggtgtaccagccgacgatcgccagcccgtacggcgtggatgtcacggtgaccccgagcaagctcgcgttcgacgggaagcagcagagcctgggatacgaaatcaccatcgcagtgtcaggcaacccggtgatcgtggattccagctactcgttcggatccatcacctggagcgacggcgcgcacgacgtcacgagccccattgccgtgacctggccgtccaacggtggagcagcagccatgtagtagactgatgctgttgctactgtctaccgctgtgggaagaaggacagggccatgagcccatgagatccgaaatctccacgcctcctgcctgccataggaataatttcctcgactgaaccacgcaataattcagctgcccctatcgtggttgtggtggaccaatggaccatgcttgcagctctctcttttcatttaggggtaggttggttggagcagcgtatgtgattggctgcttgcaaggccgtgagggtgccatccattatggctcattggcgattggacgtgtatgaacaagtttgtaatgactagaaataatcattgtaccatgttttttctatgctggcgcgtttatagccaccatgctttgtgtatgtcacttgtgtacgcatactaaagagaaaagcatggatatggaccacctgagggctccttcggttattcccaatacacatggattggatgggattggaaaaaattgtgaagaagtttgaactgtttgggattcaaacccatccaatcccgctcaatccacatggattgagagctaaccgaacaagccctgagtgttcctaaaacatccacaatttgattctggtgccacaatttaggaacacccgagtgttcctaaactatccacacctgagtgtccatttggggaaaaatccaaattactactttgaagtatgccccaaatttagattaccacctaatctattaactagtctacttaactctcacaatttgcaaaaccgtctcccttttcaccttttaaagaaaactgaaaccagcgtcatgtcatcaaattggttcccattttctttaaaaggtgaaaagtgagacggttcagcaaattgtggaggttaactagactaattagtaaatagactagagctggtttggtgctcagagatcacgagtggatccaataatatggggatttcaccccatggattcacacgtgatcccttaatactatggagattgtacccatggattcactcgtggatcctgagtaccaaatcagtccttagaacttgggggcatactttcgaggtagtaatttggatttttttccctttaatttgcataccttatgtttaagcatagcctaatgttctggtgttatattactggtctacgtgttctgtactagaatcgcttgttctgtattggtggaacaacaaatcacgccacacaaatttggcaatatagacaaattcacgctcttaaaacacttgttttaagagtcttgctcagctgacaaccaaagctgcaatcagggctaagatagtgtcaaatgcatttaaaccttacaagcttgacgtgagtcaaattgcattgaccttggcatgtcattagtgtcattgttttattcttttgcagtgctggaaatatggaccggactttttgtcagcacgagaacggcctaaaaacatgagcctaaagcatggctcaacacgaaataatatgggtcaggctagcaaggtccgaagacatgcttggttggtctcaaatcctgatctgtgggacctcagcacgatctgcacgcatgggccaagcttaggtcggcatagtccaatgaagcacatattatttaatttctttaatttagtaagttatgaattttatgtggttgtaatatttagattcttttgtcaaacgatgctcacattgtttaatacatttaatttagtaagctatatatgaactttatgctgttttaatacttggactttatgtggtttaggccggtcttggaccgatacgatttaacgaagacatgatgtgctttagggctaggccagatcactgtttctattctttggactgacacggtaatgatctaaatctgtttgatacgaagcacgatgagtccatcccgacccaattctcaccactattacttcccaccgtgtggctaatttagttttagatggtagactgcatcagtcgaagattttctataacttatattgcatttctattctttttaagagtcgacagctgccctggcccgattgaagcctaattaggatagcataaaattacaaatttatagttcgaaaactcaaatttttaaaaaaactgtaactaactaaaaccgctacttataaaatatttctttaaggtacatgacgctcatcatgattatattggtccctttgtttagagagcaaagtagatgaagctgtaggagcgaagcggctctaaatcaagaatggtgccattccacttctctatctttgcgctgggcccaaacaaaaagtaaaatggttccactctactaatagaatctagaatgtagccgccccgtcctaaaaatctagaatagaaccgttcgactctcgtgtctctccaaccaagtgtctctctaaccaaatggattctaagatcctatataattctatatagaatagagtaaattttctccttttgacccactaatctagctcatccagattttggcgtcaactaaaacattagttagagcatctccaagagactcttcatttttatctctctatctgactatctatttaccttttataaagattacactttatacataacatctcaa

SEQ ID NO: 7061 - DNA, 2013 bp, Zea mays
gcttagcctgagtttgtccctttttacttggtcccttggttatatttaccccaaatctgtgaatatatgggtttaggttgtataaaacaaaacactgacactcttttatattttgaatataaggcaaaaattctgggccggccactgcccagatcccgccgacattctccaaaccaaccgtggcggcgatgaggaaggcgggggtgacctccgcctccagcggtggaggagaaggatggccgtgcggtggtggcctcaacctcggtgtgaagctgaacgtgctgctactgctgttggtggtggccaccaatctggtgtccctgtaccacctctccctccgcgccgccaccgtgccgccggtccttctccagcagcaacgtgacggcgacaaggatctggtcctgatccggcagctggaagccatccgcgcgggcgtgtcgcagctgaaccacctccgctcgtcgtcccctcccccgccgcttccgccggcggagcttgtcctctactcccgcctcgcccccgtcgcatccgcctgctccgcgcacccggagctcctccaccgctacatgtcctacactccctacgcgctctgccccgacgacgccctctccatcgccgagcccctcctcctccgcggatgccatccgctcccgcgtcgcaggtgcttctcccccaccgcatccgcatcagcatccaaactcctccccaccgaccccttctccccgcttcccgacgccgccgtccgatggcccaaggaggcgaagtgcaaatcgttctcctgcctgccgccgtcgctgggcttcgacgtggcgcgcacggaggccgcacggttcctccgcgcgcgcgggcccttagacctgacggccccgcagctactgcggctggcctcgctgagccgggcagggcccatccggcttgggctcgacatcggcggcggcacgggcacgctggcggcgcggctcaagaagctcgtcaacgccacggtgctgacgacaaccatgaatctgggcgctccctactcggaggcggcggcggcacgcggggtggtgccgctgcacgtgccgctgcagcagcggttcccggtgggggatgggaccatggacgtggtgcgggcggggcacgccgtgaaccgttggatcccggaggtggcgctggagttcctgtggtacgacgccgaccgtgtgctgcgcccgggcgggcttctctgggtggaccacttctggtgccggaggagcgacctggagggcgtctacgccgccatgctgcggaggcttggctacaagaccatcaagtgggtcgccgccgacaagagtgttgccatcggcggcaacagcagcaaggacgaggtctacctcaccgcgctgctgcagaagtccttcagttaggcagtgaacatcggggaaatgacacggaattcatccatcagccgaagaaggcgaagcaatacagtgctagtgcgattccggcagactcgcagcaatcagcttgtgttatcccactctagaatttctgctgcaacgtgcgtatgcgtgcaacaatgtaagcaaatggaacttaggctactctaacagatgcctcttcgcattctctatcttatcctctattctctgcaaataatatcaacaatgtcttctgcaaaaaaaaaaaaaatatttttcacacgctactggagataatcttaagttccatgtaatcttatgtggccaaaatccaatgattaagaaaaaagtaatcctataccaatttcatatattggccaaacaaagacaaaaatcctacacagaccacttttatgcttttggattcacattatttctttattaaatatagctctgctccatcatgtattccacacatatttgtccgctgacttctgctttagggctggttcgtttcaacgctaattcatatggaatgaatggtaagtcagtttaaatttatagtaaattaaaatctatcacaattcattcctatacactataatccacatggaattgaaataactgaattcga

SEQ ID NO: 7062 - DNA, 3533 bp, Zea mays
ctccgccacaatttcgcctgggcgcgccctagccccgcccttcttatccccgctcttccccgcctatggctgccgctgctacagctgacgcctccgcgcagcccctcccatggctctgcttgcgctacggttcgggccgcttctccctgccccgccccaccaccgtcgggtcctgcggaaccgatgccgagtccggatcgtcgcctccaatgcccccacccccgtgagggacgggggcgctgccgcggtggtgtggtttaagcatgatctccgcatcgacgaccacccgggcctcgccgccgccgtctcggagccgcggcgccccgtcgtgccgctttacgtcttcgaccgacgcatcctcgccggctattcagataaaatgctggaactgctgctatttgctctgaaagatcttaagatgacgttgaaatctcaagattctgatttgctcataggcctgggaaacgctgaagatgttgtgctgaagcttgtgaatgaggtacaagcaggtctcgtttttacagaagaagaagttgaatatagagtgcgtgatgttcttgccaatgttgaatcatctttatctaatgggtcattctcatggggaagccctcccaagatagtggcttggagtgccccattgtatgactataagaatctgggagcagtaccgacatcacatgacgattttttaaagaaaaaattaccattggccacacctcttgctgcggcgaccttgcctgctctaaatttggagttagacacaggttctctacccactctggaagaattaaaatgtttcctgaaagaaataacaccagaggacaattgggctcctctcaagagaatgcccgcaagatctatccttaaaaggacaatcagtcaaaggaagatcaaaagtaatgctacattaagcaccatcaatgaagaaaacatagatgatgctgccaccatggattctgttgcatcaggaaagaggattataaactcgaagtttgcatcagagaactcactggaagttagtggtggaacagaaattactttggatgctttggctgcttacctaaaatatcttgaaggcacaggaaatgctagttggcaagagttgcatgataaagtgcgtttagctgaaaccagatatggtgcttcattctacatcttgtttggtcctgcaattcaacttggagtcatatctaggaggaaagcttacactgagactatccaatatgaaaaagatcgcaatgcaggttttctatcaccatttgggtactcaacacctacagtaacatcagcagtagatgctatatgttcaatggagtggtattggctcttggcatcaaaatcccaagtatgcatcgaggggaaatattctataagaatttggagatggaagggttatcttgtacagtacacctttcttggcaacgaaggtccacctgttcttcttgtgcatggttttggagctttcctggagcattttcgtgacaatatagacaagattgctgctacgggccaccgagtttgggcaattactcttgttggctttgggaaatcagagaaaccaaatgtcaactattcagaacttttctggtctgaactactgagggattttattgttgaaattgtgagggagcctgttcatcttcttggcaactctattggaggttatctctgtgctattgctgctggtttatggccttctcttgcaaagtctctggttcttttaaactcagctggttcagttgttccaaattactccttcatcccactgagtgaagaaagacgaacatcatggatttccaggttgcaggcacagctccttttgctcttcttgaggtcaagggcagaaggcattcttaaagaatattatcctacaagaactgaacgggtggacaagccacttctggaccagattgtaagagcttcatatgatcctggtgctgcaaaagtccttgagagtgtattcaacttcaatctttcaattcctcttaacttcttatttgattcttttggagggaagatattagttatccagggtatgaaagacccccttacaaaatctgaggcatttgtcaccatgctccgagaacattgcagcaaggttcaaatcagagagttaaatgcaggtcatgctccacatgatgaagttccagatgaagtaaataccatactatgtaaatgggtggagcagattgaagttaagccagccctggagaagaccaaggcaatataggtaacatttagaattatggacaccctatccattggttgattgtttaacatgatcttcaggagcaccttggtacattttcagtgacctaccaaaacttgtgtgattaaagcattgtgaattgttagccctatacaaattgtgattaaagtattgtgaattgttagctatatacaaaacttggtacattttctttcagctgatgttgagatgaacatacatgtaccccaaaggacttttttttgggggtggggggtgggctagcatttgagcatgtttctgagtaagtttgcagagccgagatgcattctaagttgcacataacatgcctggttctgcttcttagggcttgtttagatagagggactagagctgatccctgttttatgggatgaaaagattgggtcagatccctgccaattcagacaagccctaaatgttgcttttgattaaaggctgaatctgaccggaaataaaccttggaccctcaacgacatataatctaaaatcacaatagttgcgcttgtgatcccattgtgcaagtaatgtttaatcatgctacttctatacttgcatccactgtactccactcctgcttgttttattgagacagcagcgtcacacaattattttttatctcacgccaactggtgctttatcatgtcatttatgtaattatgtgcaatcagcaatttcatgagagaagccaattgtaatcaccttgttgaactattctccagcaaggtgagctgctggaacttttagtgaaggatttgaactggatgtgttagtattcttttgttatagtgcagccgtgaccctctagagcttgatctgggttctaagtttaaacgtaggatcagagcagacccggacgcctggtttcaatatcagcacatgccatcataggctcacgacgacgaagaggtaaggcggttatttacgccgatattttttgagctgtcagtcatcacagtccctagtgcggctgtgttaatcagaagacactggattatatacgtatagattatataatagagagaccaagttcggtgtcgtagtttgtcaaatgctcccctttctgcttgcgtattgtaccccttcttttccgtactgaacaattcgtgctcggttgttcagtatggaacacacttgtcgacactggagcagggtttcgtttcatcatcctgcgtttgcattacatcagttgtgcagttccagttccatttccacgccaatctactaatcgctggtgcttccatcctttcgcggtgccatactgtcatgaaactgcaggcatgcaagc

SEQ ID NO: 7063 - DNA, 1561 bp, Zea mays
ttggtaaattgacgtcacattataaaccagttcagtaatgataacagaagtttcaacaccttaacagcaacatactgcagccgagagccaagtgcctaaacagcataacataaatctatcgccagtaacaaactcggcaataactagcagcaaccataactcctcaacctttcatagctttcgaaataagaaaaggtaatattttcgagaaccataattcgtcacattcggccaatctccaaatcaagagcttattcttcctcctcagcctccccgggccggccggtcccgcatgccccgaacagttgaagctactagcgtgtagctagggaagagaagcgcgcgagtagctagcagacgtacgtaggcagaagcctagctgggtttgaagggccccgatcgatgatcccctacgcgactgcggcggaggcggagggagcactggggcgcaccatgacgtgggctgagacagcatggtacgagtactcggcggtgatgccagattcctggctgcactgccacaccacatttatcctgttcgtcatctacagcatcgccccgctgcccctgctactcctagagcagttcgctccgtccgtcgtgctgccgtacaagctgcagccccgggtacggctgcccccggcagcctccctcagctgctacatggacgcggcctgcatctttccgctcgccgttggccttcagttcgtctcctatcctgcggtcgccaagatactaaggacccgaatgggactgccgttgccgtcggtgagggagaccatcgcgcagctagtcgtatactctctagtggaggattacctcagctactggatgcaccgtctgctgcacacccagtggtgctacgagaagatccaccgcgtccaccacgagttcacggctcctacaggcttcgccatgtcgtacagccactgggccgagaacgtcgtcctttctatcccggccttggccggcccagtgctcgtgccatgccatgtcaccacgcagtggctatggttctccatccgcctaattgagggcattaacacgcacagcggttaccatttcccgttcagcccttgcaggctgattccattctacggaggggctgcataccatgactaccatcactatgcaggaggccgtagccaaagcaactttgcacccctgttcacctactgtgattatttatataggacagacaaaggctacagataccacaagctaaagcaagagaagctgaagagtctagcagaaaatagtgcggataaaggaggcaactactcattcgacgaagggaaaaagaacagatatttttgtgcctgagcgtacgaagaataatcaaggctattacttcgtcctgttcgaagggaagatttgcaaataaataattcgaatttactgcagaagctcttgattggtcgacgaacaaatatattgttgcaatccgtttcgtgtattctatatatctaatatgaaacttttttgtcggaatatatggatcatcccgatacattactttataagtaatgaataccacataagtttttgttggaagatggtc

SEQ ID NO: 7064 - DNA, 1334 bp, Zea mays
ggatgcaatcttctggttggccatttggcaacggcaacccagaagattgcatcccatatctaccacctcttcagtctcctcgcgccaacgaccacatcccaccgaacaccgatcaaggtaaacctgttcgctgctccgccagaagccgaggtcgagctgttcacggcagcgagcatgcaccacgatcccaaccccttcgacgagggcgccgacgagaaccccttctcgaatggaggcggaggagcgcgtggcggaggcgtcaagccgcagtacgggttccggccgacggagcccgcggggttcggcggcggcaggggcgatgcgaccaccgacatccctctggacaccatgaacgattcgaagggcaaggcgaaggagctgtctcagtgggagtcagatctcaggaggagggagtcggatatcaggaggagggaggaagctctcaagagcgctggggtgcccatggaggacaagaactggccgcctttcttcccaatcatccaccatgatattgccaatgagataccagcaaacgctcagaagttgcagtatcttgcgtttgcgagctggcttggtattgtgctttgcctcttttggaattttattgctgtcatagtctgttggatcagagggggagattctaaactatttttcctggctaccatctatggtatgcttggcatccctttgtcctacttgatgtggtatagacctctgtaccgagcaatgagaactgacagtgctttcagctttggatggtttttcctttgttacctgctccatattggtttttgcatatttgctgccattgctcctgcagttgtattccgtggaaaatcattaacgggtatactggcagcgatcgacaccttttctgatcatgcaatagttgggatcttttactttgtcggatttgccttgttttgcttggagacacttgtgagcatatgggttcttcagaaagtatacatgtacttcagagggcacaagtaggctatggaagcacttgcaatagtcaaccaactaccatctcatctgattgccatgtggttttgtatgttaggacaacgtatatttttccgtttgcattgtggagggtaagtacgactatatgtataattttcggtttgcatggtggagggtaaatacgactatattgtagcgtctctctcgactgatctgtttttaaccccaattctttgctcatatacaaattgtgctttgtatgcacttttgtttgctaccaaggctgcacattgtatgcacttctgttggtgccttaaacgggcggacaaatattttatttgacactaaggaaaaaaaaaaaaaaaaaa

SEQ ID NO: 7065 - DNA, 3975 bp, Zea mays
  misc_feature (270)..(270): n is a, c, g, or t
  misc_feature (774)..(775): n is a, c, g, or t
  misc_feature (1020)..(1020): n is a, c, g, or t
  misc_feature (1027)..(1027): n is a, c, g, or t
  misc_feature (1218)..(1218): n is a, c, g, or t
tatgaactgcactatgggtgctccagtcccacccaaaatgatgaactacaagataaaagtgagcggaatgtatttctctgatgaactcgttggacataccactagacacgtcttgcaagcattgagttgatctgtgcattttacaagatctctaagtgccatgtctaatgtggtctcctatgctacatcgaacacatctggggcactatagagcagaagtgcgcatttgacatgctgtcttagtgtcctatataggtctagtgggccatntggcgcctcactgaacatgtctagttcaccataaccagtgcacaccagacaccaatgcgtttggatgaaaattgtaaagtaaatacatgccgacttcgtacctagcatggtgtcatatttggtgcatcatgcaccaaacacaccgaacatgttcggtgcctactgaaaatatgcactacgagcatttttctcatcatttctgaagcatgtgaactctcaagtgttttgccaaacataatatagttatcattttctaaagtattttcaataaatatttttccttgctcccacgtgtgtcacttacacttatatgcaatgcatatgattccaacacccaggggcgaagccaggatctaagattagggggggggctaaattagattaggggggttgttagaagaattttttttgtatcgtttacatgagaattagctaaagaaactaacaatccctatagaattaggggagcattatggggacattgcccccctgtcatcgccccgnnaacaccgagtggcactagatcattgagttatctagttatcacctcttgatagtatggctacctatcttaaaatcgatcatgcaccctattgtgttttgaatgagcttatacttttgcatgtagtccttgtactttgcttttgttctttttttcatgtggagcacttgattattctttttggtcatcgtcgttctttttatgcttgctaatcttgctcaaccttagatataaactttaacacattncattctnaacatttagaatagatgctagctagcctactagctatctcaattagcagaatcacgcataaagctgtcaatggtctactagcttatagcggtgtcctatgtcgtggtaatttctaggccttccaaattaatgtgagcagctaacattttcatgtttcgattggcaaacaatttgcttgcggctaaaaatanattccggatcttttaggattttcttttttatttattgtgccactcttagcagctgactactagtgagtagctaactttttctctctatttcttttttttttcatatcattctaaatctaacgtgacatctattattgtaatccgcatacttgctcttactcaattcatttcaaacgcggcataaagattattcgccataaagtttcatgcgatagacactaaaattctccccggcccacacgctaaacacaccgcccccgaaaacctttgccgcaattggtgatctccacgcagcaccgatagcaaccccgtaaacgcaagtgcaggcgagaaggcaaccgaggtcagcgttgccggtccatttggttttgcaccgagggaaaagtaaagtaatatacgtacgtgctctaccactggtctacggccggtctaccaatagcggcgtcacgcctgtcagtgtcgtaatattaatttgcttccgtccgttgcctggcacacttgagagccttgccattgaacccaaccttggacggaacggggttcggcgggccggtcgacggagtttgaacgttcctgccgtgcacgacggacggcggccgcggcgacgactcgagcgccgccgatccgtcgcccccattcccatccgacggcgagccaccaataatcacggacggcgacgactcgtcgacccattggatcggagtactccacgttggaatttgggtggcctgaaattccaaagcaaagtggtttcatattgcgagtttaaattggtatagaccaacttttatagttacacttattcttatgtttgaatatagataaaataacagagcagagagcacacgtgcgtatccgtatatttttcacgtgaattgtgacttaccgtgacgtgacagttctagccatccttcactaatcttttttttgactattttgtatttgagaattaatatatattttattcccattatggtgattaattggccgactgctagttaatgcatgggcgagttaaagggaaacgtttccttaagggcagccgcgcgcgaggtttccatacacacgaaaattctcttccatttttcctttttcatgctttggagagccgtgctgtggcgattgatttgccttgtcttcactgatccttttccttggtgtgcacttagagaggacgagcaaatatctccgaaccgttgccatccaaaagccgttcgacgacgatttgtctgacgaatgaatctacatcatcgatctgcttcgtctacttttctgcttgatcaacctaaacatggacaaacctaatataagtcaatatatttgatcttgtgggatcggagtgggaacatgcttgctggaccaatggaacaagagcacatgcatggtagatggcatttgctgccgggatcgacaacaaggtggttgagtcgtttctttcggtttgtttatgaagaaacgagcaggtcatctaacacgaaggcgtgttcagtcggtgtcttcttgcacgaatctgaaacatggcaatccactgcctgacagctagactgcagcaacagacgtgggacgacaggttttacctgaatatgttattgcttacggtcaaattcttctgctctctttctaatgtttccttaacgtccctcgtttcatttttttttttttttttcaagcaatgaaattatttcataaaggctgcaaaaactgcacaaaagtcgatcatatatgtcaaaagaaaaactatgttaatttctctgtgttgttctctttgtatgtatgtatgtatgtatgtgactgtgcagttacagcgtcaaaattttctcctaaaactaattaagcagcatgtatctgtatgtatcagctatccacacatctgatctaaacgtcgaaccaaatcttcacaaaaatgaaaagaaatctcgtttcgtccctcggccgatcaaaatggcctcttgagtcccttgaagtcgacggtctcgacgcactcgacgctgcctttggagccgttgagcatcttgagcagctcgctggcgcgctccttggtgacgccgccgcagccgacctgcagcagcagcagcagcttctggaacgctcccacgcggagcgcctcggcgcggcacgcggcggcagcggcgtcgcccgcgcggcagaggcgccagagcgccgacacggcgaaatccggggccggcccgcgcacccggaacatcttcttgacgagcacgggcacggccagcgcgtgcgcgcgcgcggccgcgaggccggcgtcggcgcacagcacaccgtccagcgcggccagcgccttctcgctcgtgcccttgtcggcgtcgacgagggcctccacgagaaccgacaccgcgccgcactccgcgaggcgcgccgccgcgcggtcggaggcggcggcgaggtagtaggccgtgacgagcgcggccttggtggcctgcgtggacacggggttccggacgaggtcgacgagcgcgtcgcacatgcccggggtcctcaggacggcctcgagggtgtgcgcgtctgccgacgacgcgacctcgcggagcacgacggcggcgccggcccgcgctgggagctcgccgtgggacatggcggagacgagggacttgagcgacgccggggaggcaatgcagcggcgggcctcgtcgtcgagcgggaagaacacggtgagcgcggccaggacgtcgcccagcgcgccggcgcgctcgccggcgaggcgcccgaacgcggcggccagcgcgcgcgcggcaccggccg

SEQ ID NO: 7066 - DNA, 1082 bp, Zea mays
cattgcctcccggccggccgggccgggaccagcgcagaatcagcaaacgcgccattgacgcgcactcgtagtcttgactcttgcgtgcttccctcgtcttctcggacgttccgttccatcgccatggcggaccagcttagcgaggagcagattgccgagttcaaggaagctttcagcctcttcgacaaggacggcgacggttgcatcacaaccaaggagctcggaaccgtgatgcggtctctcgggcagaaccccaccgaggcggagctgcaggacatgatcgccgaggtggacagcaacggcagcggcaccatcgacgagcaggagttcctgggcctgatggcgcgcaagatgagggacgcggagtcggaggaggagctcagggaggcgttccgcgtgttcgacaaggaccagaacggggtgatctccgcggccgagctccggcacgtgatgaccaacctcggggagaagctgagcgagcaggaggtggccgagatggtccgcgaggccgacgtggaccgcgacggccacatcaactacgacgagttcgtcaaggtcatgacggccaagcgaaggagcaagaggacggaggagaaggcgacgcgcggcaagaagaagccggcggcggcgccgtccgacgccggcaagcgtggccagaaatgcgtgatcctgtgagccggagcttcggtcgtccagtacatgctggtgctgcgtgcgtgtcacccgctcgacctctgcttccggcacaccagctgcgggaagctccacttctgctgttctgcaggtgaatgtagctgtttgtaaacttatcagagcgtgtttgggagcatgattgaatgggaaccccctcagttcctccaatccaagggattttagtcatctcgatctcctctaatctccttgcccccaaacaaaccattaaataagaaaaacggaggaagtaactgtttgccaatcttgtacatgtgctcgtgtgtagccttagtttcgggctcataggtcagtggtaaaagcaatgtcacaacagaatttgtgatgaatatttaactatcacaataagaaacaatctgatttttacgacc

SEQ ID NO: 7067 - DNA, 2362 bp, Zea mays
gtgtgtattcgatccgtttccacccctgctcatagtactaatggaaccaaatatagctttagagtgattaaattttagtcaccttgctttagttcatgattcaaagtggcctttatcgaggaaggcaaactaaaattacgcgcgggttacatggactttttcgttctaccgctgtaccgttcaacgtcaggcacgagaccattacctagaacatcataatagaaaaaactatctctctcccattcatcatcctctccgaatcgctgtcagtcgccaaaccctagctagctcctcctatcgggagagattcgatctcgcccttctcgccgtgggaccgtcggcgcatggcctccggcggcaaccccaacccaaccggcgctcccacccagccgcgcccaatgcatcagcagcagcagcagcctcaaacgggcggctcaccggcaacgcccatgacccaccttcgccctccctccctcgccggctcccccttccagggcctcttccacacgccgcccacccacaaccccgccttccagatccacatgggtgcctcgtcctcaccccagactccgctcatggccgccactgcaggatcggccaagcgccccccgcaaaagccccctgtccggcccctggcacccggctcaacctcgtcggccgcagcggcctcggcggctgccgcgtacaaggctgcggccgcggcggcggccgttgccaactctgggggcgtcgacctcacccccgccgcgcggcgcagcaagaagcgcaaactccccgagaagcagctccctgaccgcgtcgccgcgctgctcccagagtccgccctctacacgcagctgctcgagttcgaggcccgcgtggacgccgcgcttgcgcggaagaaggtagacatccaggaggcgctcaagacgccgccctcgctccagcgcacactccgcatctacgtcttcaacaccttcgctaaccaggggcctcgcaccatcccaccacccaagaatgctgacccgccaacctggtcgctcaagatcattggtcgcgtgctggaggacggcgccgagctggatcctgccagtgttgtgcccaagcacaacccagtttatcccaagttctcccaattcttcaagagggtgacgatagcgctggacccgtctctgtacccagagaatccactcatcatctgggagaatgcacgggcagctgcccagcaggaagggtttgaggtaaagaggaaaggggataaggagtttgttgcaaacattcggctggagatgaactacagccctgagaagttcaagttatcacagccgcttatggaggtgcttggggtggaggtggacactcgtgcacgggtgattgctgccctctggcagtatattaaagcaaagaagcttcagaacccaaatgatccttccttcttcatgtgtgaccctcaattgaagaaggtgtttggggaggacaagctcaagtttgcaatgttgtcacagaagatatctcagcatctgtctgccccaccacccatcaatttggagcacaagattaagctgtcagggaatggagcacatagcagtgcttgctatgatgtgctcgtggatgttcctttcccgctgcagaaagagatgatggcgttccttgccaacacagagaagcacaaggacattgaggcttgcgacgaggtgatatctgcttcgatcaagaagatccatgagcaccgcaggaggagggcattcttcctgggtttcagccagtccccagtggagttcatcaatgcattgatagcttcccagagcaaggatttaaagctggtcgccggcgaggcgaatagaaacattgagaaggaaagacgtgccgacttctataaccaaccatgggtcgaagacgccgttataagatacttgaaccgcaaaccagctaatgagggcccaggtggtggtgctggtggttcttgaggcatggatttctcctagtgcggttttggtgtagaaacaaattatctgttctgtattgatagtaaaaatcagatgtatttgcaaagagaattgttcagtgttgtgaaaggatgttcaggctagtggaggttgttatgttcctgtctgattattgtggaagtataatgccaagtgctgaactgcaccataatgttgcttggcgtggccctgaaaatagtaagcctaaatgacattataaggaaactggaatgcaggagtatgagagtagcttttccatgattccttgagctggaagaagcattgaggtgtggttaccttttgtcaagaagattttcttactcttttctttaagaaacttctggtttcaggtagtagttgtaacacccactttgtaataatagagaaacaatttctcc

SEQ ID NO: 7068 - DNA, 2501 bp, Zea mays
  misc_feature (62)..(62): n is a, c, g, or t
ttaaagctaagccccgggcaggtactcttcctgtattccttggttttcccacgcgtccgtgngaccatagcgctggacccgtctctgggcccagttaatccactcatcatctgggagaatgcacgggcagctgcccagcaggaagggtttgaggtaaagaggaaaggggataaggagtttgttgcaaacattcggctggagatgaactacagccctgagaagttcaagttatcacagccgcttatggaggtgcttggggcggacgcgggcgctcgcgcacgggtgattgctgccctctggcagtatattggagcggggaagcttcagaacccaaatgatccttccttcttcatgtgtgaccctcaattgaagaaggtgtttggggaggacaagctcaagtttgcaatgctggcacagaggatatctcagcctctgtctgccccgccacccatcaatttggagcacaagattaagctgtcggggaatgaagcgcatagcagtgcttgctatgatgtgctggtggatgttcccttcccgctgcagaaagagatgatggcattccttgccaacacagagaagcacaaggacattgaggcctgcgacgaggtgatatctgcttcgatcaagaagatccatgagcatcgcaggaggagggccttcttcctgggtttcagccagtccccagtggagttcatcaatgctctgatagcttcccagagcaaagatttaaagctggttgctggcgaggcgaataggaacattgagaaagaaagacgtgccgacttctataaccaaccatgggttgaagacgccgttataagatacttgaaccgcaaaccggctaacgagggcctaggtggtggtgctggtggttcttgaggcgtggatttctcctagctattttagtgtataaacaaattatctgttctgtattggcagtaaatttcagacgtattagtgaagagatttgttcagtgttgtgaaatgatgttcaggctagtcattgtatgtttatgttgtgttctatattgtcaagtgctgaactgaaccgtaatgttgcttggtgtggccctgaaaatagtaagcctaaatcacattctaaaaaactggaatgcaggattatgatagtagcctttccataattcctggagctggaagaagctttgaggtgtagatgccttttgtcatggacattttctatctattccaggatcttcttataagccatattattctttctttaagaaccttttgttttcagattgtagttctttatgatctggtctacgcactatatttataaacaatagctattctgatgcaacatttcaaagcatgacacctacaattactttttagtttgtcttcagtgtgcaggatgaagaataatctttctacacatctgatgatactgacgcacctcctaaagatccaaaccaataatgttagccagacaattactgacgcacctcctaaagatctaaacatctgatgacctgtcaaatagaccatgtcttgtccgctcatgaaaaaaggtacaaaatcctcttcatctgggttgaatgtgacaatgcacacatacgactaagcacccatacaacaacaagagaggaacttttgttcccaagcaagttggggtaagctagggataaaatccaacatgacaagctaaaaaaacaaaagggggtattagtaatattgaaaatagtagtattgattatggtaaacggatacgcaaacgcgcattcacgccccacgcacgcgcctaaacccttgattcaagtgaattcggatagagtttagcttttcaggggagctttaatatttatttttgacctgtagctaagctcagtcaagccaactacataccaattcaggttttagtctcaagttgggattttgttagtgctctgctcccaaatataagcctatcccatccttcttgggactataagcgaaattatttgttttgttctcaattgaagccaagctggtttttaataatgtgtttggttcggtgtcaacgagggatgggacgagatcaaccctcggttgaccccgtcccttattttttgagggatgtcaccatccactattttttaggaatattacttgaccccgactctaaacctccaaaccaaacatgagtcaatttagaatgatcccacctcatccctcttcatccttcctcgtccatccatccaaacactacctaagtgattggcttgttacactccttgttacattcaacagcatggttctttggttcttgttagtccttagatggaccaccagtgttagtatgatcagttgcttcaatagaccaatacttgtaccttaatgttcaccctgatttattcgagacagaatgtccactctaatttttagagctgtggttttcaattatgcttttcttgtgacgttttatcaactttttatcacatctaatacttaaccattacagacctaatgttgttattgattttgcactaacattggaa

SEQ ID NO: 7069 - DNA, 2327 bp, Zea mays
ttttccagaagcagccgccgccgccgcctgactaccggctagcgcagcgcattccttccccccatcgaatggaacaagcaagaagccgcatcccgcgcacggcgcacccgccggcccgaccgcgaaccaaaccagaagctgggcgccacgcgtggtttggcgaatctactccaccgagagaaggcgagaacccaacagcaccgaggctggctcgctacgctattcttagagcatctctgtaatattccctcggcatcttccccttcccgccccgacgcccggtatataaaggccgcctccccccccgcccgcccgccatcgatccagtgcaaacaagctcgctcgcaagcgcaacccacccacgtctacggtctaccacacgaagcatcgtagccagccagccagctaaacccacaccacacatggccgggatcgtggtggtgttcgacttcgacaagacgatcatcgacgtggacagcgacaactgggtggtggacagcctcggcctcaccgacctgttcgagcgcctcctccccaccacgccctggaacacgctcatggacacgatgatgggggagctgcacgcgcggggcaggacgctggccgaggtgaccgaggcgctcagggcggcgcccatcgacccgcgcgtgcccgccgccgtcagggccgcgcacgcgctcggctgcgacctgcgcgtgctcagcgacgccaacgccttcttcatccacaccgtcctggaccaccacggcctgctcgcctgcttctcccaggtcaacaccaaccccagccgcgtcgacgcccacggccgactccgcatcgggccctgccacgacccgcgcgcggcgccgcacggctgcggcgtcggcacctgcccgcccaacatgtgcaagggcctcgtgctggaccgcatcctccgcgaggccgaggccgaggccgagaccgcatcctccgcgaagccgcgcgtcatctacctgggcgacggccgcggcgactactgcccggcgctgcggctggcgcgcacagacttcgtgatgccccgcaggggttaccccgtctgggacctcatctgcgaggaccccgcgcgcctgcaggcggaggtgcacccctggaccgacggcgccgagctggaggagacgctgctgcgcctcgtgcggagggcggtcgtggaggacgccgcgctgccgccgccgccgccgccgccgctcgactgcaagctcgagtccatgcccgtcgccgcgcaggacggtatgcccatcgtgccgctgggcgtcaagaactgatactgtctctggttcagaattgaggtcgccggttagagctccaacaaattccgggcgaggcacggcgtaccgttagtagcgtttcactaattttgtgcgtctgtggtgtatccgtcctgatcgagtctgttgctgctgaattggttacgactcgttgtatcttactaaaaaaggtaaagttaataatggattagacatggtactatttgtttcttggtttcgaattaaagctagctattcagactacagcatcctgcaatcgaaatatgcagagacaaagagatcttagagttcctttggcgtcggtagtccaccccaaaagctccttagacgatgtagagacgaaaattggagattggaaaactacaacttaatctttgaagccaattaatggatactacaaatgccttcatacacttcagatatggctaatatagcatcatcaaggcctaaacacttcaacataatgtcactaagagtttgacgatagaattcatcaccaatgagaacataattaaaagttgtccaccaaatgctcctatctgttctaacattaggatcccgtaaatatgtgatcaggggtatcctccaatcaagtgcatcgacggtactattagctgaattagctaaagccatcattgtagcgtctctatcaacgtcatacggtccaatgacatcactcgcacagtccgcaacatgcaatatggatggtccggtgacctcacccggacggtctaacatttgcatccttggcatattcacatccctgtctatcaggatttttaggaagatgaaacttttctttgtttattcgatgcccaaagcttcttgtgccaagctattagatctaacattatagttctaaatatacagtgaatgtcaaattcatcaaatgaacatattatgtccctatatttttcgagataactatttaaagtaacatctaaacattgatattctcccgaaactagtagaaacgtctcctaggtaccttggggatagagatgaaaacggtcagaaacaagtcggtaaacactaaaaccatta

SEQ ID NO: 7070 - DNA, 1794 bp, Zea mays
gcgttccgcaccacgcccggccgggggacagcggcaagctggccaccgcgtcaccgcctctacagccccaggctccactgctaaacgccggtaatggcccaggctccggcgcgcgccgcttccgccgtacgtctcttcgacgcgcactgccacctgcaagacccccgcatcgcggccgtcgcccctgcccttatacgagccgccggcgcatccggcgtcgcacgcttcgctgtcaacggcacctccgagaaggactggcacctggtgaagcagatggccgaggatcacccagccgtcgtcccctgcttcggcctgcacccttggtgggtacccgagaggtcgccggattggatgaatttgctccggcggttcttcgccgaaaccccggaggcggctgttggggagattggtctggacaaaggttcacatggaaaaaccatcaacttcggagaacaggttgaagtgttccagcgacagctcgaactagctaaggaattggagagacctgtttctgttcattgtgtgcgggcatttggtgatcttctggaagtattgaagcaaactggacctttcccagcaggcgtgttgttacattcttatatgggatctgcagaaatggtgtctgcccttgcaaatttaggctgttacttttcactatctggcttcttgacaggcatgaaatccactaaagctaagcacatgctgaagtcgattcccctggataggattcttttagagacagatgcacctgatgcattaccaagattggacaatgtttctgtatcaccagtccatgttcacagttcagatgcagatactgaaaagcatcacatggattcagagtcacaggctgctaatgcatcaaatgagtccttgaaccatccagaaaatatccatattgttttggagtatgttgcatcactccttgaaatgccagagtcagaattggcggagctgagttacaagaatgctaccaagctgttttcttatcctggctccaaagttcaacatgaacctgaagacatctaaatcgggttcaacactaccttactcactgggtcctcccagacacaatgtttgagaaactgaaatggctgtacatcactgttaatattggtgaaataaaacagataccgaatcaaagtagtgcaactggtttccttcaaaaaaaaaaaagtctctgattttttgtttgacgagaagtacagcactagttagcaacaagacatccaaatcagtggtatccattgtttccatgttgccattgaatgatgaaccgtagagaaaacagccagcgttcctttttcctactggggcagtagtttttggccctgaaggttacaagagagagagagacgctgattttgccttaaaaatagtaacctgaaaacagtctgcgtaatgaggatttagttgatagtacctctagttttttatttgatgctggttagttcaattttgtactaaaaatcgtcaaataaaatcagatggagtactacattgtaggtttcagtggcaacgtctgagttctgacttgataacctgttagcagagttgacttgcatccctacaggctacggtctacagggatgggctggttctggttgtaacgaaacagagcgagaggagggacatagggcatgtttgttcagcttttttgtgaccagcttttccaagaatttggctgtatagagaatctggctgtatagagaatctgagtatcattaggattacgtgcggaggaagataaagttgtccatgaggctcagatctataaagcgacggattactact

SEQ ID NO: 7071 - DNA, 952 bp, Zea mays
attttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttggtcgtacggcacctcaggcagctcaccgctgacccaaataattaaccatggcatccaacaagattgtaggggtgcctgttgtcttcatcctcgccttgctccttgtttccggttatgtggaggcggaaatctgcgcaaggcctaatcctcattatcctggcgcatgcaggagcaataaggactgtgcaggctcgtgcattcagcaaaacctcggcaccagcgggtactgcaagggcagtgtcccccttttcaaatcatgctattgtacctttgaatgtcccatggaggacgaggcagaggagggagggcactagtcgtgagccgccatctgcatgactaaattcaaagtatctgagtgtttatgcaattgacctgtggaataaggcgggcaaaataaacaatatatttgtacacatccatgctttaagaaatcgtgtgaaagcaattaagagatatgaacaaaactgttattatttgatgtgaagtcactacaacaacaacaatacaaatctttccccactg

SEQ ID NO: 7072 - DNA, 644 bp, Zea mays
  misc_feature (13)..(13): n is a, c, g, or t
  misc_feature (580)..(581): n is a, c, g, or t
  misc_feature (610)..(612): n is a, c, g, or t
  misc_feature (620)..(623): n is a, c, g, or t
  misc_feature (632)..(632): n is a, c, g, or t
gggtaccctccgnggtctcggcccgggccggggaccccaaataattaaccatggcatccaataacaagattgtagggatgcctgttgtcttcatcctcgccttgctccttgtttcctgttatgtggaggcggaaatctgcgcaaggcctaatcctcattatcctggcgcatgcaggagcaataaggactgtgcaggctcgtgcattcagcaaaacctcggcaccagcgggtactgcaagggcagtgtcccccttttcaaatcatgctattgtacctttgaatgtcccatggaggacgaggcagaggggggagggcgtctatcaggcgggcactagtcgtgagccgccatctgcatgactaaattcaaagtatctgagtgtttatgtaattgacctgtggaataaggccggcaaaataaacaatacatttgtacacatgcatgctttaaggaatcgtgtgaaagtaattaagagatatgaacaaaagtgttattatttgatgtgaaacgtcttcatttggacaaaaaaaaaaaaaaaaaaaaaaaaaaaaaaaaaaaaaaaaaaaaaaaaaaaaaaaaaannaaaaaaaaaaaaaaaaaaaaaaaaaaaannntttttttnnnntaccactgnttaagggcgaat

SEQ ID NO: 7073 - DNA, 905 bp, Zea mays
gggtacctcgaggccggccccacgcgaacgaagagagggaaaacaagtgtggaagagggaaaactggaaaaggcacagcaaaccgagaaaatggcggctcggcgtgggcgagagtgggacggggacgagcagggcgcggcgctgccaacgccggcgcccctcggcgcgccggtcgtctgccttctcagctccgccggagacctagccgccggcgccttcgtaggctccctcgtcggatacggaaaaggtttgatcacaaaccaaggcacgaaggcttgtcttagcattgctggatcttctgcaaagacatttgctgctcttgctggtgtccaaagtttcatcatgtgcttgctaagaagactgcgtgggaaagatgacatgatcaatgcgggtatggcaggttgttgcacaggcattgctttgagctttccaggtgcgccccaggcaatgttccacagctgtgtcaccttcgcagcattctcatgcataatggacggtctcagcaagcagcaggcagcaatggcactcacacttgatgtgaaatctccaactgtcaagtatgaggagggccgggtcatcccaccattcactcttccgccgcttctggatgcattggatcctctaggttcattctgccagacccttatcaagcctaagcattaggagtgcgctgaggcttgttaccccaaaaaggcagtttcgatctatagtttggcactgtatgctctataaccgttctgaatttgtctccagtcatgctgttcaagtttggtaactgtagtggcgctataggacatatgcccattttttgtcaatggtacattttttatgaaacttgctgaagagattataaccataagattgttcattggtgaagatttgatagtacaaaaaaaaaaaaaaaa

SEQ ID NO: 7074 - DNA, 1136 bp, Zea mays
ccgggattaaatcgcccacaattccctgtcctccgcggctccgcctcgatacggccgtctcctccccgctttgctccccacgaagcaattctaaatcctcgcgcagaagatcggatcctccgtcagatccgcatcggtgcttgccctccctgctcggatttctggcagccctttcctaccccctgaattcctgtgcggattccctcccctgccctggcggttgctcctgttgcctggtgggaacttgagagttgagaggaggggttggtgggggtggaaggcgctcgtgacccggcccgtggagatggctggcgtgaaggagccgatcgaggtgaagttccggctgtccgacggcaccgacatcgggcccagcaagtacgatcccaacaccaccgtcgccgcgctcaaggagttcgtcctcgcccggtggccgcaggataaagaaatagctccaaaaactgtcaatgatgtgaagctcatcaatgttggaaggatactggagaatagcaaaactcttgctgaatctcgtgtcccagttggagaagttcctggaagtgtgattacaatgcatgttattgtgcggcctccccaatctaaaaacagtgagaagcaacagtcaaactctccgaagccaaacagatgtggatgcacgatattgtgacgttgatgcaagtagcaatgtgtatatcggtgtccacagagatcaatcacaagttcatttagcaattgattcaatctattcttcacaaccctgaagttcatttagagatggtgttacggccagtcacatatctggcttgagaaattgatgcttgcggtcgtgttcgagtgtgcaaggagttcacagggtcctggtaaaaccctgaaatcggtgtggactcaaggaattggatgtttgctattctgtaatgtgtggagacagtgataccagaagtgagttgctgcatagttacatcggagacaattcttttttcgtaactcggttgcgtgtatcagtatttctgttttgtaatagaaaaaggttgaccggctattgttggcataaagtggtaaggaatgggggtcccctaaggaatgctgtggtttgacatgggaagatgaaagtgaataatgagtaccattctggttcacctttt

SEQ ID NO: 7075 - DNA, 9781 bp, Zea mays
  misc_feature (9520)..(9520): n is a, c, g, or t
  misc_feature (9586)..(9586): n is a, c, g, or t
atacggtttcctgcatctggtgtctggtcgagtgttttgaatatcactatcaatgtttcactgcctactactctctgttatgtgtgagagcgaatattgtcttactgttgaatattaaatattgattcactttttcactgttgaatgttaaatcttgctctcttgaatattaaatatcctactctactaccgttgaatattgtttcactgttttgggtagttcgctattacccgaactcgtacccgaaattacgggtacccaaaattacgggtacccgaaattacgggtaagagttcgggtatagatgttagaaggccgaaatataaaaaacccaaaaaatccggcccaaaataccgggtaaacccgaacgcccagccctacttacgctcctgcatgactgatggcccgtggatgtatcctggaagtactgttctagggaggacgactaagggcatagccaaattctgtatcttaacagatatcaaggaataagtgtaaaaaaaagagacagtatcttaatgaatgaacgtttctaacacggttctctaagtttacacatagttatgtccatacaactcatataaataagtcgtatctttaaacttaaatacattgagtttatgaatgagtttcgtagatgtatttagcgcttaaagaaccacagtataatatctagattgtacatgcgtcgttgtcatccatccatacaataaaaaagatgggaggtaaataaccggacagatgaaacagctgctcgtcccatgtgtgtccgtcgctactgtctgtcctccctccccgtccccgccggggcacggtgcgtgtgactgggcgtgcgaaacgtgatgcacgcgaggcgtacgtgcctgtgcttgtgcggcaccttgttgtgtacaaaaaggctgtcacgaaataaaagcatggcgtatccgtcactcaacctccggactcgaattctcaagggggaaaaaaggccatcccatctctctatgggattctttgtttgggattatatatatgcacacacatataaaggagtacatataaagcagtaataatatttataacactagataataactacacgcttgcctgcagtatatttttctgtcaaaatattcgtgctaacccgtagatgtcacggcaccgtacgtggagttgatccatgccgatgacgacggacggatgcatggggtagaaggtgtggatggacgactcatgcgtatcacccgccgtctggacgagtccgatccgccacctttgcatccgttttttttggaaaaaaatttgttgcagccggcctgaatttttttttcttttttttgggtgcgggggagggcctcctagcacgacacggcacggagcgtcgtcgatgataatatatatactcaagacgaccgaccgatcgagagccgcgtacgtcacgtgccgcgcgccacgccatgccatgccatggcatggcattgccagtgccaactgccaagccaaagccacgcacgcgtccgtttcaccgtccggcggcctggcctccgctgccgtctccgcaacttaccaccaccggtgccgccagtgcgctgtgtgtgtgcctcacgcgtcggcacccacccaccagtccaccaccaccacccgctccagtcacagcgagcgagcgagcgcgggccatggccgagtccatccataaataccccccctccagcttcccagttcccactcctctctcctttcccctccgcttccgcagacggccaggccaacgcaaccgctcctgccatccgcaccagtccccccctcccctccctcccggactcacccggccgccagcggggtaagtcgccggcgggctttctttgcatgtttatttatgtaacccggcccggccgaaacaaaacccccggccgcgcgcacgccaagattgctgcccccacccccctggcctccgctcaaaccaccgctcgacttctcctcgtgtaggtttggccgcttcctcctcctctgcggcgggagcgggacaacagacacaggggcacagaggaaccggcgcggggcggcgcaatgggggacgctgcggcggcggggaccctgcacaagagctacttcgacgtgctggggatctgctgcccctccgaggtgcccctcgtcgagaagctgctgcggccgctgcccggcgtgcgcaccgtcaccgtcatcgtcccgtcccgcaccgtcatcgtgctccacgacgccgccgccacctcgcccgcgcaaatcggtacgccacgccacggccacgcccttccccttcagtctttcttcttcttgttctgcaaccaccgaccgtcgttccgtttccgcctcgccacgccacgccacgcgcgccggtgtctggctcctcgctcgcccctacctcttcgccgccggagacgcggccggaccgccggacttggactactgctacctagtactagtccccggccgcagcccgctgcctccccgcccgactccacctgcacatacggccgacgaacgacgttattaataaatcaatcatagccgcggccgccgacgccgacgccaatcccacacgacacgcaatcctgcgcgttttccaccaccactcctcctcctcctagccctagaataaaatcacacacgcacaacaacaacaaaaaagaaaaaggcagaaaaatgatcgtactctttgttcatgcctaagcagcaagagcatccgggctgggaatatgtttaccaatgcaggggatcacgccaaaagatcgttcctttgcaaagcgacacgcaaagaagctcgtctttttatcccttcctccttttccggggaccgctactataatagttctgtagcagactagcagcagggcttgtccatttttttttcttttcttttgggaacgtgcgggcctgcagtgccagtgctgggcggcgtcaccgtagcaagcaatcatatagcatggccgttactgcttgctgctgtttttttttttccttactgcttaccatggagtcagcagtggccgcgagacactccagtccagttctgcaccaccaatgctctcgagcgttcaagaactggatcgccggtgcgaaaacaaagcgaaacagaagaagaagaagaaaatgtcggtggcgtggacggagatcgtacagactggtggttgctgtcacggggatgcgatagcagatagcacacaacagatttcccacctgattgatgccaagacaagtcgtcgatcggtctccacctctcaggcgcggtcgggttgaaatcgccaagaccccctagttttcccaatcgtccctaacaacatttataaaaccaaaaaaagtgaattttttttgccggtttcttttttactacaacaacaacaactgcatgctctctacatatggagttgccggtttctttctttctttctatctttttgctgaaccttggttgaccggatttcgttcttgaacatcagtgaaggcgttgaaccaggcgaggctagaggcgtccgtgcgggcgtacggcggtgggtcggacgggaggcaggcagccggcagcaagagatggccgagcccgtacgtcctcctctgcgggctcctcctcgtcgtctcgctcttcgagcgcctctggcctcccctcaagtggtgcgcgctggcggcggcggccgccggcctgccgccgatcgccctcaggagcttcgcggccgcgcggaggctcaccctcgacgtcaacatactcatgctcatcgcaggtaaacacaatcccagactgactgactgacacggatggccggccgatggcgtcgtaatcatctgttgctgttgctcatgcaaagcccccgacagatacccgcgcgcactctgggtctgggggctaggctaataattccgcacgtatacctgtccatgtccatgtccatgtgagtgagcgaggatggatgggtgtgtgcagagaaaggggagccgcgcaacctgttttttttttcttttctttccctggaccaatgtgatggctccgtagtggggagggacgagggagggcagcacagacccggcaccaacaaaagttcctgtctcacctgcctaacctttccactgcactaataagcctttttcctttcctttcctttcctttcgaataaaatacaaaaaaacacacacacacacaggcttgttaactgttattgtattcacaacactcgcttgtttttctgttctgcttaacgtctgtctcggtttggtctgcttgcagttcccggggcgatagctctcaaggactactccgaggctgggttcatcgtgttcctgttcactacggccgaatggctggagaccagggcgagccacaaggtaggtagacacctgcttccgtctcttttttcagcagttttgttcttgcattgcatttgcatacacaacaagtaatgatagtggtgagacctcttagttctaaatgactgtttggcacgcacgtcacgtacgtatgtaggcgactgctgggatgtcgtcgctgatgagcatggcgccacagaaggctgtcgtagcagagacgggggaggtggtggcggctcaggacgtcaaggtgggcacggtgctagccgtcaaagccggggaggtcgtgcccatcgacggcgtggtcgtggacgggcggagcgaggtcgacgagagcaccctcaccggggagtccttcccggtcgccaagcagccggagtcccaggtctgggccggcacgctcaacatcgatggtatataaatatatatatcacacaacagcactccgccgtatcatgcgtgtcccggccggccttcgggtcctgtcgtgattctgtgtggcaggctacatcgctgtcaggacaactgccatggcggacaactctgccgtcgctaagatggcgaggatggttgaggaagcacagaacagtaggtcccgaactcagaggctgattgatacgtgcgccaagtactatacgcccggtaagaagccaaatatacgagacggttcctacgatcagtgcagatagttttacttttctagatgtttattaccaacgcaaatagttagttacacaagacggcggctccttttccttactgttcgtcgtcatcttgttggatcttgtacgtaccttcagctgttgtggtcatggctgcgggggtggcggtggttcctgtggtggtgagagcgcacaacctcaagcactggttccaactggccctggtcctgctggtgagcgcgtgcccgtgcgcactagtgctgtcgacgccggtggccaccttctgcgctctcctgacggccgcgaggacggggctcctcatcaaaggaggggacgtcctcgaaaccctggccaggatcaagattgccgcctttgataagacaggtacgatcactcgaggggagttcagcgtcgaggagttccaggcggttggcgagcgcgtcactacgccacagctcctttactggtgagtgcgtgccgctgttgtcctctgtgcatgcatggtctgcgccttgcgcagcgttcctcaaatttgggtgtgtaatgtgagctcgacttcatggctgctgcagggtctcgagcattgagagcagatcgagccacccaatggcgtctgtgctggttgattatgcccagtcgaagtcagttggacccaaatctgataatgtcgccgagttccaaatcttccccggtgaggggatttacggtgagatcgatggggaaggtgtgtatattgggaacaagaggattttgtcaagggcctcatgtgaaacaggttggttaacacatatagtagcaagtttttttttttgtttcagggatattaattaacaattatcaactctaaaaatgtttgtgttttgtccttcacccatattgttgtctgactggattactggaacatggttgcattagccatttaactaaaaagaaaggattttttgtgtttttattctgtaacaaacaaaacacagtttctattgaactttttttttgctgtaaatactgcaactttcatatttaacctatgaataactccatggccctttctttcttctctagttcctgacatgaaagatatgaaaggagttaccgtcggatacgttgcctgcaaagggcagttaatcggagtattcactctctcggattcctgccgaactggatcagatgaggccatcagggagctgaggtcgctgggcatcaagtcagtgatgcttactggggatagttctgcagcagcttcatatgcacagaaccaggtaagaaaagaaaaacacatggcagtgttggtgctgtgcacttttatcatttctatacagtatggcagcttataataccgcggcttgtcttctgtcttctggcagcttgggaacatacttgatgaggttcactctgagcttcttccagaggacaaggtgaggatcgtcgacgagctcaaggcaaagcatggcccgactctgatgatcggcgacggcatgaacgatgccccagcgctggccaaggccgacgtcggagtctcgatgggggtatctgggtcagcggttgcgatggagacgagccacataaccctgatgtcaaacgacatccgccggatcccgatggccgtccagctggcgcggaggacgcaccggacgatcgtcgtcaacatcgtcttctcggtgatcaccaagcttgcgatcgtcgggctcgcgctcgccgggcatccgctcatctgggcagccgtcctcgcggacgtcggcacatgcatgctggtgatcatgtacagcatgctgctgctgagatcggaatcgaacggcggccggaaggtgaagaagtgctgtgcctcgtcgcagcatgggtcacactcacacgccaggaagaagcattgtgtctcccaccactgttcagatggcccgtgcaacaagtcgacggcaggctgttccaaggaatcgccgtctgctggtaagcatgcttgcagtgatcatggccatgcccacacccactgcaaagagccgagcaaccaccggccggaaaggcatgcctgtcatgatcacggccacagccataaccactgcaaagagcccagcagccatgtggttacagaaaagcatgtctgccatgaccacggcaacacccatagccactgcgaagaggcaggcaaccagctgctgcttgtagagagccacggttgcaatgaccatggccatgggcatagccatgaccgctgcaaagagctcagcagcccgcgcttcaccagcaagcacgagtgccatgaccatgagcatagccactgcaaagagcccaagactccgtgtgctgacagtgaggctgcttgccatggccatggccatggacacgaacatcggcactgcgaaggggacagccactcacacgctacaggtgagcatggctgccatgaacatgatgcgcacagccactgcgaggagcacggccattcagacaccgctgttgagcatgcttgcgagcatgagtgccatggtgagcaccaaactgtgcacgctgtggaaacacaccactgccatgaccacgaccatgagcacggacagcatgagcttggggagatcgaggaacctgagaaggactgccacgaccacagccaccactgctgccatgagcctcacggcaaggacaaggtcgcggccgagccagttgaagaggtcacgatctcaatcgctgccctgcccaaagacgaaggccaccaccacagcgaggaacaacacaatggggagcactgcaggaaggcgaaagactgcggcggcggcggcggcgctgctcccaccgactgcgctgcgagcaagaactgctgcggcgtcaaaggtggagacgcctgctcgagcgtgcaggccgcgcgtgctagggagaccggcccgtgctgccggagctacgtgaagtgccccaggacggcggcggcgagcaggagcagctgctgcggccacagcatgctgaagctgcccgagatcgtggtagagtagtagtagtactgtagtagggtggaaattccaccgtgggagaagggtgtgcacatatgaacaagcaactgtgaggtgagtgtgactcgccggcgtaaatgtagactaagatcgccggtgcagggtgtttgatctagtagtctagttactatataggtttgctggagaaaaaaatgatgtaggattttgactgagcagagcagggggtctgaaaggtggaaggaagggctctgcttggttttcctgcacactgctcctctgtttgcgtcttctgtggcggcggcggcaatggagactgtcacagacgaaggatgtcatgtgactagtgccggccggggccaacactaatattcaggaactatccatatccatttcggtcccttttaaaatgggagtttctttttctagcccctacgttttctattttagaataaattgatttatgtgactgcgattgcgttttagaataaattgatttatgtgactgtggctatgaaattactgggttctaaaatttctgtgctacggcccgatcgtgaaaaaaaaatactgggttctaaaacggcccttcgaccttaggggccgatacagaattagagagtaggaagagccaagcaatttatcaatactataaagtgaaggtatatacacacgcgtagatgtgtatatagatgatcaagtaactccacttaaaataatctcatatttaattttatagatgtgttttgataaattttgtagctaaaagacttttttagtggttgcagttgagacttttacacaatttgacaaggtttttttattaaatcacagtcataatctgcaaatgatagtaaatactctagatggttgtatactgggttcgaagcatcaaattcgccgcacacggtacacacgacacctatccggtgagaaaaaaacattgattttattagcgacagatttgacgcttcaaaaaataagacaaatttttacttaaatttattttgaactacacctatcctgtgagaaaaaatcattgattttattatttgcgacaaatttaacgcttccaaaaacaagtaaataaagaaatttattttgaacgacacctatccggtgagaaaattcattgattttattattagcgacaaatttgacgcttcaaaaaataagccaaatttttacttaaataaagaaatttattttgaacaaaaaaaattatatgatttatgttatatgtgtatatataacacattatgggaaggttagggagaagcccatgaccgctccccttggctcagcctgaagcattaggatattctacacaggccctttaaagttaggatttttcaaagattttgcatggtactaaaatccactctaacaaacacacaaccaatgacatgtttggatacattcagctagtaattagctcatgttttccggtaccaattagaaagacttaataaatgttaataatggctaattggtggttacgattgattagtccttattagttaataattatcttatatttaatttatttatgtgagacatgtcaatttttagttctatcctcaaacagtactatgtgntgtttgaatgcattagagctaataactagttggctaaaaaattattagtagaattagctagctaangaaatgttagctaactattagctaatttactaaaagtagcttatagctaaattattagatagactgtttagatatctaactaattttagcagctaactattagctttagtgcatttaaacacctctgtattaaaaatgatcttgttcattgagacatacaactttctattaggaacccacctgttctgtttgacc

SEQ ID NO: 7076 - DNA, 2129 bp, Zea mays
agataccatgttgagaagagttaaaatctaactttaaccagagttgtgactgatattagtaatagagttagatgtgtcaaggcccaatacttctggggcaacacacagtacatttcaacggtatcaaataatttaccctgtttatttcaatcaaatgaacaaattaccattacaaacaaacacaagctaaattcaaacaaaacctgcgcttgcatgtactctggggaacaaaactaccccaggttcattttgtcttttttttcaaaataaggaaaactatggtcatggtacccacgctcacgcacctcacagatcgctgaattgtttctggaatgtgggattgatgcacgcaaatattgattttttctttcgctttgttccaaacaggaagtttcgcaacggtacccttgtccgacttggaaaatgcttgaattgtttctcgtggctactttcggtctctggccgcgacaagcgttgggatgaaatctcaaaactctcacgtagcccctccagagcatggctaactttggcttgaagccccctcatgtgttctgatgctgcctgcatctcgccctcaatcttgctggtagattgctgcatgtttaggacctccccttgaaacttggcagcttcatatggtgtaaacctggctctgtccatctccaagctaccacgcagggcttccgctatctcctcttgcattctgcaaagagacgcagatttaagctgcacttcttgatcgagaagcgcgctctgctcaaaccatacatccagttcagttcggagctctctcaacttcttctcagcaggtccgggctctgctggagtatctggttctctagacttattatcttccatttcgtcctgtgcctcctggtaccttctgtcaaactcctgcatgcgatagcaagccatgctataccttaccaggaactgcaaattttcctccaccaaagcgtcaatgtcgtttctgaacctcgtcattttatgaagtgacgtgtggttaggtgtctcgatgttactagaactgttttcctccacggcagaaatatctctacccaaagtggcaattgatctgtcaatttctctaaaagatttcaaacttaagaatccgtttgagttaccacctgctttacttggaggcacctctgaggaatccaggagatcccttagtgaccgaatctcaacatacttcatggaatttgcattccttaactcccgtataactgcctttgtttcttcaagatgctcctggtttctcctttccagttcgctaagcctcctctttgtttctttgtagttccgcagaactgaagtacaatcagctagtagtattgcttctttaccttcaagcccatcaggaagaaattcttgccagctaggtacgaagtcctcccccatcaaaccagactttacaccctgactccttcctccatggttgttcgacgtagttgcttcgcttgcaagctctctgccatgtgaagtcttcttctctgaattcgtcggaacttgctcattcgctccccctggcgcacagatagaagtttcatccctcacttctgaggaatatctgttcttcatatcatggacattatcaacatgacctaatgagatgcaatcatcctctttaagcaatccaacttggttgcattcgttcgaactttcaatattttgtggcccatttagttgcccggcccggccggccgcgtcgtcaacagattttgcttcatctgcatgccccatgtgcaggctcttcttatcagcaccactgaaacaagtagcttttggaaatgaggattcttctacagaatcgtattcctttaacctgtacaagtctgaggaagcaattggactaatctgcccactggtattttgtgatttactatctccaagtccttcctcctggattacactactgctggaaaaagaatttccatcatcaatatttccctcagcgacttccattaatgactgagaagcttcattagagtcatatctcctgtctaaatgatccatactacctgagtggaagagatgagtctgtccgactattcccaatggatattcacctctcataatttcaccattagggaagtttctactttcgttcctcagtttctgattgaact

SEQ ID NO: 7077 - DNA, 2021 bp, Zea mays
gggcaggggcatccaattagctcccagattaaggtccacatttgccaaacccaaaacaagaagggtggttttgacaatgtggcttctcagttgaatatgcacactttggtttaattggttagttgaaattttacccccaggtgtgactatcataaatgacccttttgagtgagagaatggcagtacacatttagcactgaacttttggctaatgaaactatgagatgcaccagaatcaaacagaattaaagcaggttgattataaactgaaaagataccagtcatgataggagctccctcaggtacttcctccagagtagtgaagttgagcttcccttgcctgacttgtaccttctgctttcttcccttgtcttgatttggtgctggcatctgcctctgctggttcctgggacaattcttggcatagtggcccacattgccacaagtgaaacacttgttcccattgccctggcagaactgctgctgctgcggaggctgattgttccttggagcgggagctggaaagaggttgggtgccggctgctgctgctgaggtggcctgatcacccatctgcctgcctgctgctggaaacccctgctctgattgtgagaaacaatccggaacctctgggcctgagcgcatggtgctgccattggtgcctttctcttcttctctgcccggtgagctacaatgcaatcctcctgggagatggccaggttgaccaactaattgaagctatcatcccggacagtgttgagtcgttcccgcagcttggtgttaagacccctgcggaagcggtctctcttcttctcatcagaatcagcatggtaccctgcatactagcataggtcgttcaaggcctgcgcatactgcagtaccgtgcgggttccttgattaagcgccagaaattcattcagcttccgatcaagaatgccagctgggatgtggtgtcctctgaaggcagtcttgaattcctcccaagacacttcacgatcagcggggagcatagcacggaagtggtcccaccaagtccgagcagggccgcgaagctgctgtgcggcgaagcgagccttggcctcatcagggcagtctcccgtgaggaggggaaacttggactcgacgacgcgaagccacacgtcggcgtccaacggatcctctgccttggtgaacaagggtggttgcgtgctcagaaactcctggtaagttgccattgccggaggtcgctgatgctggcctccaccatgctgctgagggtggggctggcgctgcaagagctgtcgcagaatctcattctgctgggccatcagctcctgcactgtgggagctggaggaggtggcgggggaacctgctcgttatgcccgcgacgctgcctagctgccatctgaaaacagagattgtcgccattgttatcccaactcacagtttcgaacgacaagatatcatctcatatggaaggaaaaatgccataatcataatattaggttcgaaatgaagataacatggtgacaaacatcccacagatttcaaaagttcacagggttacatcaatcaggggaaagtacccataagcctagtccaaaatctgacattaactaagctcgcataggtttctatccgcctaaaagtgtcgaagtgactgcttaaccctgagcggtggaagcgacactggatacgggtgaaggaggcatcgcggaggtagtcccattggcaccaggggctggtcctagctcctcgggagcctcttctccctcgcttccggcttcattggcctccatctccagggggtgctcgtccgtctggtcattcgcttcctcgagttccctctgcacatcgtgaagctggttctccaagacatcaatagtgttgtctcggatctccacctgctgctccaaggtggtgatgcgctggctcagcctctccacctgcatatccttctctaccaactcggtggatagatcgaccacaaaatcttctcgactgtcgagagtgagcttgacagtttgagcgggttagcagacg

SEQ ID NO: 7078 - DNA, 3068 bp, Zea mays
ccggccgggattcgttgagtgcgcgcgcggcgcggcgcggcggcttgccattacccgtcctctctcttaccccgtcgtcctcttcacctgcaattgagcatttgcttgctccccctccccgacaaaaaccccctgtcccgtcgagcctcgcatccctagttccctacaagcaaggaaggaaacccgggcaacacgacaccggcggtgccagtgccacggaaaattagccggctccctccccgacgtccggcggcggccgagcaacggtgctggctcccaacatggagacatataccacagacgacgcgcttaccattatggggtttggaaaattccaagcgcttgttcttttctacgctggaatgggctgggttgcagaagctatggagctcatgctcttgtcgtttctcgggccattcatacgagaggagtggaacgtctccccagagaacgagagcctcctttcgagtgttgtctttgctggcatgctgctaggtgcctgtgcttggggctttgtttccgacaaatatggacggaggactggtttaatattttcaactctatttactagtggaatgggttttctaagcgctttatctcctaactacttatgcttggtggctcttcggtttctggttggagtaggagtgggtggcagccatgtgtttatatcttggtttttggagtttgttcctgcacaaaatcgtggcacttggatggttattttctcccttttctggactctcggcacgatcttggaagcttcacttgcatgggtcgtattgccagcattgaattggaggtggctgctagtcttcaccgcccttccatgcttcctcttgcttcctttctttggactaacacctgagtctccgcgctacctttgtgcacaaaatagaatgtctgatgccacatctgttctagagagaatggccaacgcaaaccaatcagctcttcccccgggagttctcacgtacaatagacaaacaaaatgtgaccacgacgttctcgctcccgagagtgaatgtcttcttcctgtcagagagaaggaatgcacagttgacaatgccaagagctccgaatctggcagtcttgctgcactgcgcatgctattatcgcgcgaactgctcagatcaactctgcttctttggtttgttttctatgcaaattcctttgcttattacgggttagtattgctgacatcgcagttgagtgatgcaaataaaagttgtgcatctggtgtgtcttttggtctgcgccaaaaggaaatcaatctttacaaagacactttcatcactagtttagcagaaatcccaggtttatttttgtctgctgttcttgttgattggtttggtcgaaaagcttcgatgtggtctatgatgttcgcatgctgtgctttccttggaccacttgtacttcaacagactgagttgttgacaactattcttctatttggtgcccgtgcatgtgccatggggagctttacagtcttgtgcctttatgctccagaggtgtatccaacatttgtccggtcaaccggtgcaggaattgcgaccgccattggtaggattggtggggttgtttgccctctcgttgctgtcgccatgctgcggagctgccatcagatggaagcactcattgtgtttgaggtgatattatgccttgctgcagttgcctgcatgttcttccctgtagagaccaagggccgtggaatggactgatgcaatatcaggcttcagcatctagatgagcttgtagttcatcactgtttgttttatgccatcattatgtacagagaatatacatgtaacatggtgtggatagttcctcaaaatatgtgcaggactttccaaatttgtaagacagattttgtactgaaagacagctggttctgtactgccaaaacactgaaagacagagttgtattactcctcagcatttcttgcaagccagaacctttttggccaaaatacacgagttttgcaggtactccagatcattttgtaatatgtattaacgtctttggatgagctcataataagtttattaatttttttcttgaggtaatgctactgctcaaatattcagcgatgaacgtaggggttctagatccattcatttagttgcaaatgacggaccgctgataccaaaaaagccaagacaacccagcattgcttatagttaataggggtaggaaaatgattggaaataacagcagtgatgtttggtcacaaacttatgtaactgaattgactactgtgctaaactcaaacattcattattcgatacgtatgtagtttttccccacgaggtgtggaaatatgtacatactgaccttaggcggcgacaggtcaaacacatttagcagaattgttatcggcctgtcaagatagcgcaactatatttctaaatggtagaggtgctgaaacaagttctttcaactctttgtcaaaaccagggtccaggggtaccagaagggatctgggatgtggtgtcctctgaaggcagtcttgaactcctcccaagatacttcacgatcagcggggagcatagcatggaagtggtcccaccaagtccgagcagggccgcgaagctgctgtgcggcgaagcgagccttggcctcatcagggcagtctcccgtgaggaggggaaacttggactcgacgacgcgaagccacacgtcggcgtccaacggatcctctgccttggtgaacaagggcggctgcatgctcagaaactcctggtatgttgccatagccggaggtcgctgatgctggcctccaccatgttgctgagggtggggcgggcgctgcaagagctgtcgcagaatctcgttctgctgggccatcagctcctgcactgtgggagctggaggaggtggtgggggagcttgctcgttctgcccacgacgctgcctagctgccatctgaaaacagagattgtcgccattgttatcctaactcacaatttcgaacggcaagatatcatctcatatggaaggaaaatgccataatcataatattaggttcgaaatgaaggtaacttggtgacaaatatcccacagattt

SEQ ID NO: 7079 - DNA, 2449 bp, Zea mays
gatcttcttcaggggtaactccgtcatagagaaagcacacgactgagtagaaccccgactaggcagaattaaagtgaaattcccgcagaacggagaattaacttccacggtacggctggctacatcaagcacaacttggtgcaaggtcatccaatttgcccctagaataatgtccgcattttccaatcccaacacaagaagagtggttttgacaatgtggcttcccagttgaataggcacactttggtttaattgattagttgcaattttacccccaggtgtgactatcatgaatgacccttttgagtgagagaatggcagtttgcaattagcactgaacttttggctaatgaaactatgagatgcaccagaatcaaacagaattaaagcaggttgattataaactgaaaaggtaccggtcatgataggagctccttctggcacttcctctagagcagtgaagttgagcttcccttgcctgacttgcaccttctgctttcttcccttgtcttgatttggtgctggcatctgcctctgctggttcctgggacaattcttggcatagtggcccacattgccacaagtgaaacacttgttcccattgccctggcggaactgctgctgctgcggaggctgattgttccttggggcgggagctgggtagcggttgggtgccggctgctgctgctgctgaggtggcctgatcacccatctgcctgcctgctgctgaaaacccctgctctgattgtgagaaacaatccggaacctctgagcctgagcggatggtgctgccattggtgcctttctcttcttctctgcccggtgagcaacaatgcaatcctcctgggagatggccatgttgaccaactcattgaagctatcagcccggacagtgttgagtcgttcccgcagcttggtattgagacccctgcggaagcgatccctcttcttttcatcagaatcagcatgataccctgcatactggcataagtcgttgaaggcttgcgcatactgcagtaccgtgcgggttccttgattaagggccaggaattcattcaacttccgatcaagaatgccagctgggatgtggtgtcctctgaaggcagtcttgaattcctcccaagatacttcacgatcagcggggagcatagcacggaagtggtcccaccaagtccgagcagggccgcgaagctgctgtgcggcgaagcgagccttggcctcatcagggcagtctcctgtgaggaggggaaacttggactcgacgacgcgaagccacacgtcggcgtccaacggatcctctgccttggtgaacaagggcggctgcgtgctcagaaactcctggtatgttgccatagccggaggtcgctgatgctggcctccaccatgatgctgttggtggggctggcgctgcaagagctgtcgcagaatctcattctgctgggccatcagctcctgcactgtgggagctggaggaggtggcgggggagcttgctcattctgcccgcgacgctgcctcgctgccatctgaaaacagagattgtcgccattgttatcccaactcacatttccgaacgacaagatatcatctcatatggaaggaaaaggccataatcataatattaggttcgaaaatgaagataacatggtgacaaggatcccacagatatcaaaagtttacagggttacattaatcaggggaaagtacccacaagcctagtccaaaatgtgatactactaagctcgcataggtttctatccgcctaaagaaatgtcaaagcgactgcttaaccctgagcggtggaagcgacactggatacgggtgaaggaggcatcgcggaggtagtcccattggcaccaggggctggtcctagctcctcgggagcctcttctccctcgcttcctgcttcattggcctccatctccaggtggtgcatgtccaagtggtcattggcttcctcgagttccctctgcacgtcgtggagctggttctccaagacatcaatagtggtatctcggatctccacctgctgctccaaggtggtgatacactggctcagcctttccacctgcagatccttctccaacaactcggaggacaagtcgaccacaaaatcttctcgactatccagggcgagcttggtattttgagcgatgttagcaagatgtgccaaagcgtcgctctgaagggcctgaaggcggtacaacgcactcatgcactgaacagtgaccctcccaaccaagtcaggatacattgctcacacgtccttcacgtggctcacacggttacaccacatggggtcatccttcttatcagcaaggaaaagtcccaaggggtgcatcaccatctccaggggatggtagccacagaaagtcgtcagagtcttcatgacggctgcttcagtggtgtcgtccgtcctgaatccaatcatctcggagtcaagggaacacc

SEQ ID NO: 7080 - DNA, 2772 bp, Zea mays
  misc_feature (404)..(404): n is a, c, g, or t
  misc_feature (412)..(412): n is a, c, g, or t
ctttaacttatataattggctcaactcaaaattttaaacttttcattcccttttgctcattttcttggattttgttcatggggttcacttagggttcttaattagggttgcacattcttatcctttaagagactcaattgtcttgatcatgacacttttaagcacatacttggtgaattctttcttacttaagttattttgatgctcatgcttactttggttcacataaaataatggttcttggtttggctttttaagagaaaccctaggtgacactggggtgtcacaggtcatgataggagctccttctggcacttcctctagagcagtgaagttgagcttcccttgcctgacttgcaccttctgctttcttcccttgtcttgatttggtgctggcatctgcntctgctgnttcctgggacaattcttggcatagtggcccacattgccacaagtgaaacacttgttcccattgccctggcggaactgctgctgctgcggaggctgattgtttcttggggcgggagctggatagcggttgggtgccggctgctgctgctgctggggtggcctgatcacccatctgcctgcctgctgctgaaaacccctgctctgattgtgagaaacaatccggaacctctgagcctgagcggatggtgctgccattggtgccttcctcttcttctctgcccggtgagcaacaatgcaatcctcctgagagatggccatgttgaccaactcattgaagctatcggcccggacagtgttgagtcgttcccgcagcttggtattgagacccctgcggaagcgatccctcttcttttcatcagaatcagcatgataccctgcatactggcataagtcgttgaaggcttgcgcatactgcagtaccgtgcgggttccttgattgagggccaggaattcattcaacttccgatcaagaatgccagctggaatgtggtgtcctctgaaggcagtcttgaattcctcccaagatacttcatgatcagcggggagcatagcacggaagtggtcccaccaagtccgagcagggccgcgaagctgctgtgcggcgaagcgagccttggcctcatcagggcagtctcccgtgaggaggggaaacttggactcgacgacgcgaagccacacgtcggcgtccaacggatcctctgccttggtgaacaagggcggctgcgtgctcagaaactcctggtatgttgccatagccggaggtcgctgatgctggcctccaccatgatgctgttggtggggctggcgctgcaagagctgtcgcagaatctcattctgctgggccatcagctcctgcactgtgggagctggaggaggtggcgggggagcttgctcattctgcccgcgacgctgcctagctgccatctgaaaacagagattgtcgccattgttatcccaactcacatttccgaacgacaagatatcatctcatatggaaggaaaatgccataatcataatattaggttcgaaatgaagataacatggtgacaaggatcccacagatatcaaaagtttacagggttacatcaatcaggggaaagtacccataagcctagtccaaaatgtgatactactaagctcgcataggtttctatccgcctaaaaatgtcaaagcgactgcttaaccctgagcggtggaagcgacactggatacgggtgaaggaggcatcgcggaggtagtcccattggcaccaggggctggtcctagctcctcgggagcctcttctccctcgcttcctgcttcattggcctccatctccaggtggtgcatgtccaagtggtcattggcttcctcgagttccctctgcacgtcgtgaagctggttctccaagacatcaatagtgttgtctcggatctccacttgctgctccagggtggtgatacgctggctcagcctttccacctgcagatccttctccaccaactctgtggataggtcgaccacaaaatcttcccgactgtcgagagtgagcttggcagcctgagcggtgttagcaagaagtgtcatagcatcgctctgaagggcctgaaggcggtacagcgcactcatgcactgaacagtgaccctcccaaccaagtcaggatacattgcccacacatccttcacatggctcacgcggttacaccacatgggatcatccttcttctcagcagggaagagtcccaaggggtgcatcaccatctccaggggatggtagccacagaaagtcgtcagagtcttcatggctgctgcctcaacggtgtcgtccgtcctgagtccaatcgtctcagagtcaagagaacgccaacccggctgaaggggatgagcctccaaagttagccagacccgacaacgaggtacccgatgctcctcatacaactgcaccgtgtacaaagggggcgtagggtaaccggcggagttaagcacttcccacaagatggaaggaaagccatcgcgagaaaggaagtcagaactgaaacgagagtctcctccactggcgggggtgggtgaattcatctgcggaagggaatcaagataaagattatggtggaaggaaaaagaaaaagagagcccggatgattttaaagaaaaggggttagctcaaattttaattcctctttgtgttttataatgcatgcatgctggaaagaaacgctgcctctcaaagaggaaaatagggtgcctttttagggcatcctaaatataagtattggcccaccagggcactaattaattagccacctatttccccctctatgcc

SEQ ID NO: 7081 - DNA, 852 bp, Zea mays
cccccccgatcgacgcgcacaacacagcgcccacacacacacagacagtcttacgcgacgacacacacgcaaggcggacggacatggatatgagaggagggcacaacatgggcggcatggcaccgccgccgtcccctcacggcggcatgcggaagcgctacgtccacatgaccttcttctggggcaagaactcggagatcctcttcacggggtggcccggcgcgcgcggcggcatgtacgcgctggcgctcgtcgccgtcttcgcgttcgcgctcctgctcgagttcctaggctcccgccgcctggacgcgctcctctccgccgcggccggccggcgcgcggcagcggcgggggcggcgcgcacggcggtgtatgccctgcgcgtgggtggggcgtacctgctcatgctggcgctcatgtcgttcaacggcggcgtgctcctcgttgcagtcgcgggccacgccgctggcttcctggcgttcagggccggcctgttcggcgaccggcgggcgcaggtggagggcgacggcaaggatgaggtcgcgccggtcgtgtgctgttaggctcgtccgttgtcgcccgcggcggtgcccatgacgattcggtgggtttgtctatgtcaacggtgcatgcatcgttcgggccggcgcgttcaatggatccgtgttgctgtttggttgaaatcaagatgcatggcgatcgacatgcagttgtaagcttaggtttcggtgataaattgtgaatctcttggctgtatcctattcagacatagtcttcagtcacaccaatgccatagccggcggcttgtccgcttctgggtatgaatgtcaaacagtgcgggccgcccgttta

SEQ ID NO: 7082 - DNA, 1499 bp, Zea mays
agatttcacctcctacgtgccgaatggctcctgtgtctcacgacaatgattccgattcgagtgatagtgacgacaacacaatcatgctggccactcttcttaccctatgcatcgaagctaccaggcgtaggcgcaggcagtcttctatccctcgccgcgtgattgctagggatcattttgctggggagaaccttatccgccatcactacttcggcctcaaccccgtgtatccagctcatgtgtttcgccgaaggttccgcatgagtcggccattgttcctccgtattttgcaaggcctccagcagcaggatagttacttcactcaacaggtcgacgctacaggcctcgccggtcttggaccacttcaaaaagtatgtgcagcaatgcggatcctagcttacggcttacctactgatgccatcgacgaatatatacagataggcgagtctacggctagacaatgccttattcatttctgtcgcgcactcattgccgactgcagcgtgtggtaccttcgaactcctaaccaggccgacattgcacgcatcatgcaacatagcgagtcgagggggtttccaggaatgctggggtccatagattgcatgcattgggagtgtaggaactatcgtggtcgaaattctagacctaccatgatacttgaggcggtcgcatcgtacgatctatggatttggcatgcttttttcggcatgcctggtacaaacaacgacatcaacgtgctacataggtctccggtttttgacccaatgacaagcggtcaaatgccccccgtgcattacacagtaaacggacatgcatacaactttgggtactacctagccgatgacatataccctcgccgcccgacttttgtgaaagccattcggcacccctgggaggaaaagaagatctatttcacgcagatgcaggaaagtcaccggaaagatatcgagcgcgcattcagtgtgcttcaagcacggtgggcagtgctacgtggtcttgcttacagacgggatcgtaaccgtctaaccgagatcatcactgcttgcataataatgcacaacatgatcattgaagatgaaggggagtttgctgccaacaccgactttggagacaatgcttctgccactgcacattgcgaactcatacaagagggaaggtcggattgggtcatcgatcactttgatctacgtcgccaggaacgattttgcaatcttcaaaatgatcttgtcgagcatttgtggaccaaacgtgggagtatgtgatgaaacttgaaccttagtcctttaaatgatgtggctccgtagtgtatgttccatgtgtgtggtggtcattgtgttatgtttcatgtgtgtggtagtgggtgtgctatgttccatgcgtgtcttagtttgagttaggggttctgtggtcacgggcaatgagtacgaattcatttactcttagtggtcaaatgtgtactcttcagtatgaaatcaaatgtggcaccatctatgcaagag

SEQ ID NO: 7083 - DNA, 2142 bp, Zea mays
attagcactcgtttctttatcaagttttcttttatgtatagttcaacaaaacaatgccataatcgcagttgcgttgcatgacatttatgtctacatgaaaagagacaacaaagttagttacaggttgtgggtaagaaactaagaactgatttaggccaacgagaccttattactctgccctttcacctcgcagctcgttattattactgggaatttgtagctgacaaagcttggtcagctaatcagtttccgccagcataaagtcgcagttcatcttttatacatgaactggcaccttattcgttttttttttattatctgtcagaaaccaaactatattcttggaagcatgttagagaccatgcatggcaaaccttattactctgatgtttttggtcattctcatagtcgacaggttgtgcgctatctcctagcaaactcgcataagatgatattgtgttgattcccttgacaccttgtctttgaaccaggtgtttgcatgctttctcaggaaaaacagctgataggttaagactcatcttcagtagaggctttcacgtttttacgctggtaacgggggaaaagcattcgcctgatcttcttttcagctgaacgttcagagagcgcctgtgcattgaatgaaaatcgaacagtcttaacttccaagccagaaaaggctcttacatcaataccaaggctgtcaacaccaatcaagcttgcctcctcgacagtgaggccctttttccggcgacagagcgacctgagagccgcggcacactgatcactgttttctttgatccgttctattatcgatgaagcagaatttgcaagaatatctggttctgaatcttgaaaatcttgtggatcaatcttaaactgctttccatacatggaaaacagttcaattgtcattatctccagcttgtagatcattgaatcagttctagtttcagcatgattgaagtcaaatcttgatttatcatcatcaatgaggcgattggttccagaaactggccgagtttctctgttgtattcatcggtttcatttactttccggtcagatgaataaccaccattgtcaccatgaaacatgctcctcaagtaagactcttcctctatgaaagcaggtctcagatatcctacaatagagagaccgtttgatggactatccatcttctccccattattattatgaatggcctgtgcagtaaaagagcaggtaacgtgattgcctagttctctgcaacttgagagatttgatgagggacacatttagagctatgctcttgtgaccacttatgctcggagaaatgctttggtaaagtttttactctacaacagactggcacatgagagttcagaacaaattaaaaagttcggattggcatatatacaaaagctaaatatattctagttttagcagagtttttatcccggccggcctcgtgggaaaagggatactccgagaaagacatcaaactgttgccaatctttcttttgttttactgatatttgctatccctcctgaaagataccatattctgaagctaacatgagaccatcttgattttctatctttgccttttttttcagaacttgatatgggcaaccggagtggtctggagactgcaatctaaagtgcatgatttgaaggttcacattcaaatcgtgcatgatgtaagctgaattcaatgaatcattaatagcatctttattgaagggcaagcctggtgcagtggtgcgaagccttctcactgagccaaaggtcctagttcaatgcagcctctctgcaaaatgcaggagtaaagcttgccttgattattccttgtctagaccctactcatgtgggagccaccagaacgggccactgcccactgggtctgtcctttcgttaatagcatctttatcagcttgaccattttcactattccaagtgctgctggtttgtggtgtctgcactcttcaaataattatttatcgcttacctttgtcaaacatttggcaaagtaaatcggatgtattgcacgcattgttgcaggcatcccccactctatgagaatatcagttatttctgtatcaatcttggtgtggtgctcatcaggaacgtccataaaattttcaccatccatgcccacgcgtccg

SEQ ID NO: 7084 - DNA, 2164 bp, Zea mays
gacagctaaaagcactcgaaactttatcaagttttcttttatgtatagttcaacaaaacaatgccataatcgcagttgcgttacatgacatttatgtctacatgaaaagagacaacaaagttagttacaggttgcgggtaagaaactaagaactgatttaggccaacgagaccttattactctgccctttcacctcgcagtcgttattattactgggaatttgtagctgacaaagcttggtcagctaatcagtttccgccagcataaagtcgcagttcatcttttatacacgaactggcaccttattcgtttttttattatctgttagaaaccaaactatattcttggaagcatgttagagaccatgcatggcaaaccttattactctgatgcttttggtcattctcatagtcgacaggttgtgcgctatctcctagcaaactcgcataagatgatattgtgttgattcccttgacaccttgtctttgaaccaggtgtttgcatgctttctcaggaaaaacagctgataggttaagactcatcttcagtagaggctttcacgtttttacgctggtaacgggggaaaagcattcgcctgatcttcttttcagctgaacgttcagagagcgcctgtgcattgaatgaaaatcgaacagtcttaacttccaagccagaaaaggctcttacatcaataccaaggctgtcaacaccaatcaagcttgcctcctcgacagtgaggccctttttccggcgacagagcgacctgagagccgcggcacactgatcactgttttctttgatccgttctattatcgatgaagcagaatttgcaagaatatctggttctgaatcttgaaaatcttgtggatcaatcttaaactgctttccatacatggaaaacagttcaattgtcattatctccagcttgtagatcattgaatcagttctagtttcagcatgattgaagtcaaatcttgatttatcatcatcaatgaggcgattggttccagaaactggccgagtttctctgttgtattcatcggtttcatttactttccagtcagatgaataaccaccattgtcaccatgaaacatgctcctcaagtaagactcttcctctatgaaagcaggtctcagatatcctacaatagagagaccgtttgatggactatccatcttctccccattattattatgaatggcctttgtcaaacatttggcaaagtaaatcggatgtattgcacgcattgttgcaggcatcccccactctatgagaatatcagttatttctgtatcaatcttggtgtggtgctcatcaggaacgtccataaaattttcaccatccatgtaatcactgaaatcactaatcgccacactactttctccaataatgggtccatccattccaatcaaaactgtcacaggattgtttgcagtatcatcttccaggatgttctcactgtcaggtacttcaaagaaaatgtctccatattcatcaataacatattgaaactccgaccaagaaacatgtccatgaggttcattgtgtaccctagcaggaaatacaagcaaccccttgctatttgcctctactactgttctagctgtttcaatatctgtcagcaacaggtccttcttctttggacgttctttaacttcttcaagagggtgataaccccgatctctcgtgtactttgaatctggcattgagtctgaataatcagcagccacgcgaaccttgattagggatgagtcttgatcagtttgcagccaccagggctgaattgatccaaaagggtttcggcagcggaaacttagattagataggtcatgaaatcttcgggtgtcaaatggggttttaacccagcttaaggtggctcctgacgccattgaacacttttcagcagaggccactgaatgagctctgcaaaaccaaggctggccacctgaaacgagaggaaaaaacaagggccgcaggaaggatcaggcggagcagagcagagccgcagcgtgcggcggcgagagcggcaaccccctgcctctgctgcaggacggcggaacaccccagggaagacggatcaccgcgcagacttttcgggtaggaggttctaggtaatggtctcgtgcgcgctgctctctgcccggttccccctcttccctttgg

SEQ ID NO: 7085 - DNA, 2092 bp, Zea mays
tccggtgaaattgttttaaaccctaaatcacataattgagctacggatagtaaattaaaattcaaagactcaaccaaaagcacatttgatatggaatgatcattcgaaatagcaattttacccaagcctttaacctttcctttgcgattatctccaaatgtgatactatcataatttgagcaatcttcctcactcatttgggtgaacattttcatatctccggtcatgtgttgagtgcatccactatccaacacccaatgattccctcccaccttgtagttcacctacaaaaggaaatcaatctcttttaggtacccaaacttgcttgggtccttggatgttagtgaccaaggtctttggcacccaaatagctttcttcttgttgccaacaattgaagtaccaacaaatttagcatgaacaccttttgcattatgagaaagaacataacaatgctcaaaacaagtggaggatacattcttgagcttaggacaatttttcttaatatgtcccttcttgtgacacttgtgacacactttgtcacattctttcacaaacaatgtcttttgctttataaaagcattctttcctttcttgggaacatatccaagaccctcacggttaagtgagcaccgttgacttcccaatatgaaatccaatttagcctttccaccatatgccttctctagatcatgagttagagcatttactctatctactaacacttcattctcaacaatgatttgtgattcatcaagagcaatattatcattcataagagaaattttgcatttatcacaaatagagttagtaggtagtggttcacttgtaggactatcaagtaagtcacaagtgactccaacatcctcggtgaccaccacaacttcatgcacaatagatgagttttgagcttccgcaagcttctcacaattctcttttagatcgttgtgagaggtcttgagctcctcaaaagacacttggaggtttttatacaattccttcaaggtcttaaatttttctttttctttgtgcatgtagtcatcggcctcacctaacattctaacaagatcatcatatgaatagccatcatcatcaacatcatcatcatcatttatatcatttaaatcggtgatgatttttaccttagcatctccctttgccatgagacaatggggggatgagaagagtgagggagcttccttgatggcaattccggcattaagcttggatgaggtgtcatcatcatcatcatccgagctatcatccgagtcccattcaactaggtaggctttgccatctttcttcttgttgtagaatttctttttcttcttatcactttcatctttgcccttcttcttcttgttagggcaattcatggcaatgtgaccgggttccccacactcaaaacattttctatcattgaaagcatttcttcttgatgtttgacctcttctaggttgacctctcttcatcttcatgaagttgttgaatttccttacaaatagagccatatcaccatcactctcactttaattttcttcatcaatactatcttctttttcaattgccttagaggctttagctttgagagcaattgattcattcttcactttctttgccaaacttatagcatcggcttgagacttcttgaatatatcttgagtaagaatttcccccaatacttcggttggagaagttgtagatggatcacttcttactaacattgtcacaatggtcttatatttctccagaagtgatctaaggaacttatgagtgaagtccacatctggtacattaaaactaagtcccttgagttcattcactatctcatttaaccggttgaacatattggatacactctcatcttctttcataataaattgctcaaacttccctttgcacacatatagcttggcactcttcacaattgtagttccttcatgaatttccattagcttaatccaaatctcatgagcggttgtgagattcttgatacgattgaactcatttatatcaagagcatcatagaatacattcattgcttgatcatttgtgaggatattctcattgtcactaacggatggttcatcttcc

SEQ ID NO: 7086 - DNA, 3656 bp, Zea mays
caaaagaatgtgggcccaaataaatccatgtgaagtaattccaaaggtcgatgagtggacatttgacttttatttggatgagtgtttgccacttgcttcccggcttgacaagagctacataatttgttcctctccaacttcacatcttttaagccacgaactaagtcatgcttggttaaccgattgagttgcttcattccaacatgaccaagtcttctatgccataaccaacctagtgaagcttttgagaataggcaagttgtgagctttgcctcattagatgagaaatcaacaagataaagattttcatgtctaaaacctttaaacttaagattgctaccatcaacactagagataataacatcttcaaccgtgaaattgcaacaaaatcctaaatcacataattgagctacggaaagtaaattaaaattcaaagactcaaccaagagcacatttgatatagaatgatcatttgaaatagcaattttacccaaacctttaacctttcctttacgattatctccaaatgtgatactatcataatttgagcaatcttcctcactcatttgggtaaacattttcatatccccggtcatgtgttgagtacatccactatccaacacccaatgattccctcccgccttgtagtttacctacaaaaggaaatcaatctcttttaggtacccaaacttgcttgggtccttggatgttagtgaccaaggtctttggcacccaaatagctttctttttgtttccaacaattgaagtaccaacaaatttagcatgaacaccttttgcattatgagaaagaacataacaatgctcaaaacaagtggaggatacatttttgaacttgggacaatttttcttaacatgtccctttttgtgacacttgtgacacactttgtcacattctttcacaaacaatgtcttttgctttacaaaagcattctttcctttcttgggaacatatccaagaccttcacggttaagagagcatcgttgacttcccaatatgaaatccaatttagtcttaccaccatatgccttttctaggtcatgagttagagtatttattctatctactaacacttcattctcaacaataatttttgattcatcaagagcaatgttatcattgagagaaattttgcatttatcacaaatagagttagtaggtagtggttcacttgtaagactatcaagtaagtcacaagtgactccaacatccttagtgaccacctcaacttcatgcacaatagatgatttttgagcatccgcaagcttctcacaattttctttgaggtcattgtgagaggtcttgagctcctcaaaagacacttggaggtttttatacaattccttcaaggtcttaaatttttctttttctttgtgcatgtagtcatcggcctcacctaacattctaacaagatcatcatatgaatagccatcatcatcaacatcatcgatatcatcatcatcttttatatcatttaaatcggtgatgatttttaccttagcatctccctttgccatgagacaatggggggatgagaagagtgagggagcttccttgatggcaattccggcattaagcttggatgaggtgtcatcatcatcatcatccgagctatcatccgagtcccattcaactaagtaggctttgccatctttcttcttgttatagtatttctttttcttcttgtcactttcatctttgcccttcttcttcttgcttgggcaattcatggcaatgtgaccgggttccccacactcaaaacattttctatcattgaaagcatttcttctagatgtttgacctcttctaggttgacctcttttcatcttcatgaatttattgaatttccttacaaataaagccatgtcaccatcactctcactttcattttcttcatcattgctatcttccttttcaattgcctttgaggccttggctttgagagcaatagattcatttttcaccttctttgccaaacttaaagcatcggcttgtgacttcttaaatatatcttgagtgagaatttctcccaatacttcggttggagaggttgtagatagatcactccttactagcattgtcacaatagtctcatatttctccggaagtgatctaaggaacttgtgtgtgaaatccacatccggtacattaaaaccaagtcctttgagttcatttactatctcattcaaccgattgaacatatcggatacactctcatcttctttcataataaattgctcaaacttccctttgcacacatatagtttggcactcttcacaattgtagttccttcatgaatttccattagttttatccaaatctcatgagcggttgtgagattcttgatacgattgaactcatttatatcaagagcatcataaaagacattcatggcttgatcatttgtgaggatattctcattatcactaacggatggttcatcttctttcaatacaacaaatccatccctgacaattggccaaatttttccacccattgctctaagatgcattgacattcttattttccaatagtcataattattcccatcaaaatgcggtggcttcccaatgtgcacattgttgttactagccattttgtcccactccgggatgattagatccacaaacaatggagtcctcggctctgataccacttgtaggatctaggacaccggctagaggggggtgaataggcggttttgactaaaataaaaaacactaggtaaatttaatcaatataacaagaggaataaattctctagtgacaataagtaaacaatgtatgagaaacaactacggtgattgaatacttgaggaacaatatgcaaaacactaattacttgcaaggcaataagtaatgcaagaaggtagagacaccgaaatttatcccgtggtatcggtgatttgccgatcacccctaatccacgttgaggtggacttcaagctctcacttgctcctctatcaagtcacggcttgatctttcgttgctgtcgggtgaatagacggttttgactcgattccactaatgtcacctttgccgctccggcgaggtaggcgcgaacccctcacaatcaacaccgcgacttctccacaatcttcttggagagctcgacggagacaatcacccgagccgtctaggaggcggcaacctccaagagtaacaagccaacgacgcttgctcggtgtaccacctagtgcctcaaggatcaccaaatgatgcaaatgcactaggaaccctcaatctctcactagaatgcaatctcaagcaaagagtgtgagagagtgagttggaggatcacaaatgagctcaatgtgtgcaaggaatggccaagagaggtctctcacacgagctacccttctatttatacccctccatcaaaatccaaccgttatgtgcaaaaagcacatgttctgcgcacacgcggacggtccgcgccctagggccggacggtccgccgtacacataacggctataattcccgtttgaaaactgtcagaactgtcagaaaaggtaggtccggacagtccgccctctaaggccggaccgtccgcgacctggcagcatgaggcacccgagcctcggtccaagaacagttaacacgcgcggaccgtccgcctataaatccggacggt

SEQ ID NO: 7087 - DNA, 3025 bp, Zea mays
agaagagtgagggagcttccttgatggcaattccggcattaagcttggatgaggtgtcatcatcatcatcatctgagtcccattcaactaagtaggctttgccatctttcttcttgttatagtatttctttttcttcttgtcactttcatctttgcccttcttcttcttgcttgggcaattcatggcaatgtgaccgggttccccacactcaaaacatttgctatcattgaaagcatttcttctagatgtttgacctcttctaggttgacctcttttcatcttcatgaatttattgaatttccttacaaataaagccatgtcaccatcactctcactttcattttcttcatcattgctatcttctttttcaatttcctttgaggccttggctttgagagcaatagattcatttttcaccttctttgccaaacttaaagcatcggcttgtgacttcttaaatatatcttgagtgagaatttctcccaatacttcggttggagaggttgtagatagatcactccttactagcattgtcacaatagtctcatatttctccggaagtgatctaaggaacttgtgtgtgaagtccacatccggtacattaaagccaagtcctttgagttcatttactatctcattcaaccgattgaacatatcggatacactctcatcttctttcataataaattgctcaaacttccctttgcacacatatagtttggcactcttcacaattgtagttccttcatgaatttccattagttttacccaaatctcatgagcggttgtgagattcttgatacgattgaactcatttatatcaagagcatcataaaagacattcatggcttgatcatttgtgaggatattctcattatcactaacggatggttcatcttccttcaatacaacaaatccatctctaacaattggccaaatttttccacccattgctctaagatgcattgacattcttattttccaataatcataattgtttccatcaaagtgcggtggcttcccaatgtgcacattgttgttactagccattttgtcccactccgggatgattagatccacaaacaatggagtcctcggctctgataccacttgtaggatctaggacaccggctagagggggggtgaatagacggttttgactaaaaacaacaatactaagtaaatttaatcaatacaacaagaggaataaatttactagtgtcaataagtaaacaatgtatgaaagacaactacggagattgaatacttgaagaacaataagcaaaacactaatcaattgcaaggcaataagtaatgctagaaggaatagacaccgaaatttatcccgtggtatcggtgatttgccgatcacccctaatccacgttgaggtggacttcaagctctcacttgctcctctatcaagacacgacttgatctttgagccaagtggacaagaaatcactcaatacctcgattccactaatgtcacctttgccgctccggcgaggtaggcgcgaacccctcacaatcaacaccgcggcttctccacaatcttcttggagagctcgacggagacaatcacccgagccgtctaggaggcggcaacctccaagagtaacaagccaacgacgcttgctcggtgtaccacctagtgcctcaagaatcaccaaatgatgcaaatgcactaggaaccctcaatctctcactagaatgcaatctcaagcaaagagtgtgagagagtgagttggaggatcacaaatgagctcaatgtgtgcaaggaatggccaagagaggtctcacacacgagctacccttctatttatagtcccccatctaaaaccaaccgttatgtgcaaaagggggcagttctgcgcacacgcggaccgtccgcgccctagggccggacggtccgccgtacaccataacggctataatgaccgttgaaacatgtcagagcagactcaaaaggtgggtccggacagtccgcccttcaaggccggaccgtccgcgacctggcaatttcaaacacccgagcctcggatcaaacggagttaacacacgcggaccgtccggctataaatcccggaccgtccgcgacctgagacagtactgtccggactggtcccccggaccgtccgtagtacaaatcaataaaaacacacagtccctgtccaaaaacgagttagacacatgcggaccgtccgcgcctcacaggcggaccgtccgcctataattcagggactgacccgaagccaccttcctctggtcaggactgcggacggtccggccctaaggcccggacggtccgcagtgcaatagaacacagtgccaacacaaatggtcagacttcggaccctctggaggatcgcggacggtccgcccccaagggccggacagtccgcgcgaccaagacttctcaaatttcaaacatgcttttgaatgaacttttaactcacgaaatgagaagcgctgttagtcctcatgcaaatgcaactacttgatgctctatgaggcactaagttttacacagatctaagtcattgacccctcttaatagtacggctatccagcctactaatccggtcaggtatcttctctaaactcctcaagaccggcaaaagtaaaacctatattatacctttgccttcatctgatccacaaccaatgcgtatgactcttcaacatttcctgttctatgtggtccaaccctgcattcttatttctccaagaatcgttagtccacaagtagttgtcattaattaccaaaacattaccaaaggggcctagatgattcacaatctccccctttttggtaattgatgacaacaccacatagtgtattaaagagaagtttagtttctccaaatctctctcatacctaaggtataagatagatcttggagatgagtttcataggacttatcttgatttgaagttctgtccaagagatagataaatcccaataaaaactcagtatgcaagaaagggctccccctaagtgtgtgcaggattatttgaagttg

SEQ ID NO: 7088 - DNA, 2013 bp, Zea mays
accgtagcgacgcacggtcagctaactagttagtctttgcttgagtttttaggggtttgtatagtaacaactttggttgattccacatgtaatatgttcgctggaatatatgaaacaattttacctttttctagctagttccgttagactgttatttggacttggatcatttaaggacagagactgtaacacatattaaacatcacctttgagtttttacttgcttcagatggatcacgctgacgacgcaagacttcagaacgacaacgcatccatgcgaaacagtactctgttcttgataaaacgaaaactgaaactggaatataactaagctttcttattccaatctgagtacaggaagctaacgtaggtatatatatacccaataaaccctcaactgaatctatccagatcctaaccgggctaacacttcctaatctaatctaatctaatctaatctaatataatctaatcttagacagctcagggacagatccctgacagaactaacaaactccggagaggccgcggtgacttcctggctactgccgtcgggcgccggcgaggagccgtcatcctccttcgttggggacgtcttcatactcggactcccagtcatcgccctcctcgctggggatgtcatcatgctccgtctcctcgtcgtcgcccccctcgctggggatgtcatcagactccgactcctcgtcgtcgccctcctcgctggggatgtcatcagactccgactccccgtcgtcgcaagcatcctcgtcgtcccagtagtcctgctccaccggcaccggcgcccggcagtaggggcacgtccggttcacggccgtccagcggtccaggcacttgcggtggaacgtgtggctgcacgccagcttcacggacgttgctccgccgaccaggtactccttgtagcatatggcgcactcctcgaagaccgcgccgggcggcagctcctcgtcctcgtcctcgtcctcgtccacgggcgcgccgacctccacggtcatggccactggcttgcggtacgagttgctgcggaccgacaggctgatgaactccgccacgctgggcgcgcactccaggggcagccccgcggccgtgaccatctcctccacccgctggggctgtctgtagaggacgaagtcgccggtggagcacgtgaagcggcgggtaagctgggcggtaacggctgatgccggcgtcggggcctcgctctgctgcggcagcttgttgaggaagtcgatggtgatgggcgggatgcggaacagccagtaattgtccacggtgaggtcgatgacggtgttgaggtggagcgccatgccggggcacggtagcgcggtgagctggatgttttttgagtagctcccgtccggcccgtgggcgtagatgtaacgaggagtcatggacatggacccgagctctaggtgcaccgatggattgagtagcagtagtatatggggcttcttcttcttctttttgttaatggaggaactagtatatggggttttgaaacaacaaaggacgtgtagtatttatagatcaggctagcaggacatctcccgtacaccgtggccgtatcgacgcggagtcccgcgggcggactagtctattagaatagataagacatatctgatagtcatatcagtcacgtgtataacaaacttgcaaccaccggatattgaaagcctaagctagattagattagttttcaggtgttacggttcgtaatctgttaagggcggagacgtacgttcgatgtttttttttttaaaaaaaaatcaaactttcatcttacaacattataagtgttcttaaaataagggatgtgtccagatacttgtttggatgttacatttttggacttctttctctgttaacgaataaaaaagatacaaaatctattatgcaaatatgtacttttttagcattgaatttgttaagatacataaaaagtaacatcaaatgtgtcatatatatattctcaaaataatagatataaaattcaga

SEQ ID NO: 7089 - DNA, 2464 bp, Zea mays
aaaagtgttcctctttcttggagcctgcagacgaatggtgcagcggtgaaggcaggaggaggaggaggacataggaggggataggagccgccgcagacatggctggcggggtggccgttggggtcgtggcgctgttcttggctgcagcttcatttggggctttcgccaccaccctctcgtatgctgtgaatgccctcaacgtcttctacacaaccatgaattcgccgccgcagctgacgaattgggtgtcccaaaatggggatccctgtgggcagtcgtggctgggggtcacctgctcgggttccagagtgacagcaataaagttatctgggatgaggcttaacggcaccttgggctacaacatgaaccagctcactgcactagttcagctggatatgagcaataataatcttggaggcagtgacattccttataatcttcctccgaatctccagaccttaaatcttgcagtaaataacttcactgggactgtaccttactccatctcccagatggttgcacttagggatttaaatcttgatcataatcagctctcgaacatcaacgatatgtttagtcagctcacaaatttaacaacgttggatctatcatacaacacattctctggtgatatcccacatagctttaactccttgacaagtttgaaaacactttaccttcagaacaacaaatttaacggcacaatagatgttctcactgatcttcctcttactgacttaaatgtcgaaaacaaccaattcacaggttggatacccgataaactaaagggaatcaataatctccagacaagtggaaactcgtttaacaatggccctgctccaccacctcccccatcatcatcatcaccaccatcgacaaatacccctcctccctctcggcagcatgctgttccaagtagcgctggtaaaaatgccccatctgaaaatggtggaaaacactcgaaacttggtggtggtgcagtagcaggaatcataatatgtttgctggttgttggcgcaatagttgcattccttgtgatcaaaaggaaatcatggaggttatcacagggacaagaccctgaacaaaacgaacctctcagcccttttgcttctggacttaaacagatgaaatcaatcaaatctatcaaaatcgtatcaacaatgggcaaagaagaattgcagaagactgtttcgatgagtttgaagcctccaacaaaaattgacctgcacaagtcctttgatgaaaatgataccactaacaaggccatctcaaggaatgtaagcttgtcttccatcacaatacctgcatacacagtggcagaccttcaggttgcaacgggcagcttcagtcctgaaagttttatcggtgagggatcggtaggccgtgtttacaaagccaaattcggtgatcagaaggtcatggctgtaaagaaaataaacttctctgtatttccaagccatccttcagatttgttcattgagttggtcgcaaacatttcaatgttaaatcatccaaaccttgctgagctcgctggttactgctcagagcatggacaatgcttgctggcatatgaattctaccgaaacggttctcttcatgatttccttcatctgaaagatgaacacagcaagccattgtcttggaacaaccgtgtcaagattgcgcttggatctgcaagagcattagagtacctacatgagacttgttcaccctctgtggtccacaagaatttcaagtcatccaacattttattggatggtgagctgaccccccacctctctgattctgggtttgcaggccttcttgcaaaccaggaattccaggaatcggatgagaactcaggatacagggcacctgaggtgatcttggctggtcagtactccctgaagagcgacgtgtacagcttcggagtcgtcatgctagagcttctgactggccggaaaccgtttgacaggacccgaccgcggcctgagcagtcactggtccgatgggctactccgcagctgcacgacatcgacgcgctggaccagatggtcgaccccgcgctgcaagggctgtacccgtccaaatccctctcccgcttcgccgatgccatcgccctttgtgttcagcctgagccggagtttcggccgccgatgtcggaggtcgtgcagtcgctggtgcgcctggtgcagagggcgaacatgacgaggatgcacgagagccagtcgcggcgccacggcgaatccggcggggactacgagttttgagcgagacaaaactgtgcctttgcctagatttttttcttctaaaagtataaaaatagttataaactctccttgagagttttgaacttcaaatattcacatatagtttcaaactatattagataggtagtagttcagaataagtatttatctgaaataagtattggttcacatttgcctttgcgttgcaggcattttgttttgctaaagacaccccc

SEQ ID NO: 7090 - DNA, 924 bp, Zea mays
  misc_feature (50)..(50): n is a, c, g, or t
  misc_feature (140)..(140): n is a, c, g, or t
accatcttcggatccagtaatgatataggggagctcaggatggaaacaancagcagaaatgttatgtgtatgcccttcaagtgtctgaacacagcttttcgtctggtaatcccagacctttgcagtggagtcatcagaancagtaatcaaatagggcctgtctcccccagtcgagctcgcatcccgttgctgtcgcttttgatgtccatcaagtgtgaagtttggatctggagaacctaaactccatatctttgtagtgcggtcaagagatgcacttgcaaaagtgttaatatcctttgggttgaaagtaacctgcatcacatagtgtgaatgtccctcaaaaatttgagtgcacatccaccctttatcccagtcccacagttttattaacatgtcatcagatgatgacagcacatatggtagagttggatggactgcaacacatctaatgtaatcagtatgagcctcaaaaactttgactttgtccatggtattgtagttgtagacgcgaatgaacatgtcgtctgcaccagctacaacccattgtttccttgaaataaattttgccgacctcactggcagttctgaaacttcaaatgatttcaccattgcctgtgcttgataatcccagatgcagacactccccgagtacagactcgacaggatccatggctccgtggggtgcaaatccaccgacttgaccctctccgaccgttgagcgaacttccgcttgatctccaacctgagcggcatggtggtggtggtggtggtggtggcggcgccggcggcgaggacggcgcggggtcgccgctaaaccctagagatcccccagcgacgatggagtggtggggcgcggcgaagagggagcgaatccgacgcgaacccggtggcgcaggcgcggagccaggaccggcgagcggcagt

SEQ ID NO: 7091 - DNA, 1628 bp, Zea mays
aggcgccacgatgagttgttatagataaagcagtctccaacccaaattccagttctcagtcgctcattgacctcatgaagcagctcaaaagcatcttcaacgccttcttcgtccacaggctttccaccttctagataagaagcaacaatatctctattgtacttgaggatgtagaatgatgtatcacttgctattgcaactaggtcaccactatcagcccagtaaacattcttaacattcacatcgattcggcgtattagtctacaatcagcccagtcataaaagcagatgaagtcactagaacacattgccaacaataccccaccataaatacgctctgctgaaaatgaagggcggatagttttcttctcctgaaacgatttactgaaaatctttattcttgatgtactttccctaattgcatattctccttctgatgaccaaacaaattccagtgcagacccaaatgatctattcctccaggccagggcagtataaattatgtactcgccatctccacatacaacaacgaaccgtccattagggttatgcttcaagctctgtgggtacaaatcacagcttcctaactcttttacagccaagggtaatctttctccatctgtggcttcaaaacctgcaccgactgtcttgatatttacagtttgtatttcattatgtttcgcccaaatgattttcccaccggtatccatacttgctatgggtacttcacggcccatttttatcataatggtcccctcatcataaccaatcaccatccttctagaccccttcatgtatccaacagcccagactctctcaaggccatagtttagtgtgttctcaagtctgtaagttgtcgaatgccatatacgaactgtaccatcttcagatccagtaatgattatagggagctcaggatggaaacaaacagcagaaatattatgtgtacgcccgcctggggtctgaacacagctcttcgtctggtaatcccagacctttgcggtggagtcatcagaaccagtaatcaaatagggcctgtcccaccagtgaagtagtcaacacagttgacacccttttgatgcccatcaagtgtgaagtttggatctggagaacccaaactccatatctttgtagtgcggtcaagggatgcacttgcaaaggtgttaatatcctttggattgaaagtaacctgcatcacatagtgtgaatgtccctcaaatattcgagtgcacacccaccctttatcctagtcccacagttttattagcatgtcatcagatgatgacagcacatatggtagagttggatggaccgcaacacatctgatgtaatcagtatgagcctcaaaaactttaactttgtccatggtattgtagttgtagacacgaatgaacatgtcgtctgcaccagctacaacccattgtttccttgaaataaactttgccgacctcactggcagttctgaaacttcaaatgatttcaccattgcttgttgcttggtgtaagtgttatccgtgatatcggtgtatcttttcaccttcatcttagaagactcaatttcttcatacttactgcaacatttgaaatatgcagatcaaagagcagtttaaaaaaaagcaaaaagaagg

SEQ ID NO: 7092 - DNA, 3237 bp, Zea mays
ctgcagcgttatcagctgacatgcgcacattctgcgagacgattagtttcagagagacggagagtccaaaacaaacatgagaattaacgccgtgcttaatttctggagcaccccaaaaaaatcgaagcaggcagtacggggtagttaaaggtcttccctcttccggtcaaagccggtcaaggggcaacaataatgatgaatgaagccgacacgcgggcccgcgccttccttgtcacgcgcgaccgtggccccacccaccaccaccaagcacccccgcggtgacggctgacgcgcgtgcccacctcacctgacgcctgctgcctgctggtggtccctctcgtcagcttctgaccccgtgtgggtgtgccccgtccgctttttgccggctcgcgccaacgcccaccaaaccaaaccgaaaacccatctttgtggaacatatatatgccggttgtcaatcaggtcaagattagtattcactaaatactactgtaatagcatatcacagttgtttctttccacaattttagaatcaagagtggctgagcgtgtgctgttgttggatggtaccacgagactgcgcaaaatctcttcagttcgagaacaaaccgaccaagttcaagccaagccttgaacgaaaaagattaagatcactatagtgctgacatgacccaacaacaaatacctaagcagctgctcgacacagtacgtacgtactgctggtgctggtgccggtgcccgtgcgaaagcgaggagcgagcagacacctgtacaaaagaaatacaggcaggaataccaggggcggaataccaacaagcggcggtttatatacatacgccaccagcatctttaacaccaccgctgcgctaatccgccattcaaacgagattagcacaaaaaaaaaacaataaacaaacagaggaagcgccgcccgcgctggcagtgaggtgagctcgccctcctgctcctgctcctgctcccgcagctgcgctgtgctgccatcgctttcccctcctcccagtcccacccccagattcgcatgcgcgcttccctctccaccgccacaggcacagcgtcagcgcctagcttagccagctcgccgccgcaatggcgaccgcgtcggaggacgaggccgcctcggaccgctgcagcggcagctacagccccagcgccgatgtcagcgagtccgagacctccagcgactgctccgcgcccaccacccgccgcttcgcctcctcctcctccgcctccgcctccgcctccgccaccgtctcccgccgcctcgcgtcctcctcctcgtcgctgcccaccccggcatcggccgccgccttctacctctccaagccaccctcctccgacctctccgagatcgacatgatgaaggagcgcttcgccaaactcctgctcggcgaggacatgtccggcagcggcaagggcgtctgcaccgcgctcgccatctccaacgccatcaccaacctctccgccaccgtgttcggcgagctgtggaggctggagccgctcgcgaaggcgaggaaggcgatgtggacgcgggagatggagtggttgctctccgtctccgactccatcgtcgagctcaccccctccatccaggagctccccgaaggcggcggccagttcgaggtcatggtcccgcgcccgcgcaccgacctctacatgaacctccccgcgctcaagaaactcgacgccatgctcctcgccatgattgacgggttcaaggggacggagttctggtacgtggacaggggggttatggtcgaagacagcggggggccattcccgtcctcctcctcgtcatcgtcttgtggccggccgtcggtgcggcaggaggagaagtggtggttgccctgcccacgagtgccacccaaggggctgtccgaggattcgaggaggaagctgcagcaaagcagggattgtgcaaaccagatactgaaagcagccatggcgattaacagcgatgtgctcgcagagatggaaatccccgaaatgtacctggagacactgcccaagagtggtaaatcttgcttgggtgagataatttaccgatacataacagctgagcagttctcaccagaatgtctactggattgcttggatctatcatcggaacaccacacactcgaagtggcaaacagaatagaagctgccatccatgtttggaaactgaaaggccaaaaaaattcgacacctcaagccagatcaaagaaatcttggggtggaaaagtgaagggtcttgtcggagataaggaaaagagccacactttgtctgaaagagctaatggtctattgcagagcctaagattgagatatcctggtctgccacaaacctcccttgacatgaacaagatccagtataacaaggatgttgggcagtccatacttgaaagttactcaagggttctggagagcttggcatttaacataattgcaagaattgatgatgtgatttatgttgatgatgctacaaagaaatctgctgctgccgagtctgtttcgatcttcaatcgtggcaccggtgtgccaattcagaagaggatctctctaagcccattctctattcagaatacgccatatgcctctccattcgcaacacccactttctgctcctccaccccagttacatgcagccctggaagagtacagcccccgttaaacaaaaccaatctaggaaggccagaaatcaaggtcgagaagcttttttctggtgatctagagaaggtctggacatatgctggaaacctgagcgctaggaaagacgctggcgatgctcccgagagagactgatgggcgatggaggaaggtagacttgttatggaaacattatcgctatttagcagcgtactcgttcgtgtttatactgcaaggctgggttcatcagcaagtgactgaattcctcctcctcctcctgctgctgctgctgctgctttttgtcgctgaaggtgttggtctgctgcctgttagtttttgtatatgcatgtcaatgaatttgatctggccctctttaatgctcactactattgtactgagagttgctgaccacatctgagcagacccagtttcctccggttcatctgccagtgagctctgcacagcagtcgactgcagaaaggcgatccagatgagatctagatgagaactagatgtgtcaaatgataaaacggtacgacatttgtatattgcgggtaatcaatccaattgacaaatcgtcagatcttttctctc

SEQ ID NO: 7093 - DNA, 2153 bp, Zea mays
aaatgagctcgctctcctgctcctacaggctgccctcgcgcccggccgggccggccagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccaccgtctcccgcctcgcgtcctcctcctcgtcgctccccaccccggcatcggccaccgccttctacctctccaagccaacccccgacctctccgagatcgacatgatgaaggagcgcttcgcgaagctcctgctcggcgaggacatgtcgggcagcgggaagggcgtctgcaccgcgctcgccatctccaatgccatcaccaacctctccgccaccgtgttcggcgagctgtggaggctggagccgctcgcgacggcgaggaaggcgatgtggacgcgggagatggagtggctgctctccgtcgctgactccatcgtcgagctcaccccctccatccaggagctccccgaaggcggcggccagttcgaggtcatggtcccgcgcccgcgcagcgacctctacatgaacctccccgcgctcaagaagctcgacgccatgctcctcgcgatgattgacgggttcaaggatacggagttctggtacgtggacagaggggttatggtcgaggatagcgggggtccgttcccgtcctcatcctcgtcgtcttgtggccggccgtcagtgcggcaggaggacaagtggtggttgccctgcccaagagtgccgcccaaggggctgtccgtggacgcgaggaggaagctgcagcaaagcagggattgtgcaaaccagatactcaaggcggccatggcgattaacagcgatgtgctcgccgagatggaaatccccgaagtgtacctggagacactgcccaagaacggtaaatcttgcttgggtgagataatttatcgatacataacagctgagcagttctcaccagaatgtctcctagattgcttggatctatcatccgagcaccacacacttgaagtggcaaacagaatagaaggtgccatccatgtttggaaactgaaaggccaaaaaaagtcgacacctcaagccaaatcaaagatatcttggggtggaaaagtgaagggtcttgttggagataaggagaagagccacactttgtctgaaagagctgatggtctattgcagagcttaagattgagatatccaggcctgccacaaacttcccttgacatgaacaagatacagtataacaaggatgtcgggcagtccatacttgaatgctactcaagggttctggagagcttggcatttaacataattgcaagaattgatgatgtgatctatgttgatgatgctacaaacagatcagctgctgctgagtctgtttcgatcttcaatcgtggcacaggtgtgccagttcagaagaggatctctccaagcccattctctattcagaattcgccgtatggctctccgttcgcaacacccactttctgctcctccaccccagttacaggcagccctggaagggtacagcccccattaaacaaaaacattctaggaactcaagaaatcaaggtcgaaaagctcttttctggtgatctagagaaggtctggacatatgcaggaaacttgagcgctaggaaagacgctggagatgctcctgagagagactgaagggcgatggaggaaggtagacatgtaccgacagccgacagatcctgtaattgctagtagctagatcttcctgtacagaagcagcatgagtatttttttttgttctttttgtagcgagccgatcattgtgtgctctgcttacaatgaatggatgtcacctgatctgaacagagaaacttgtagtttcagctgtagtttttttgtctggattggttggattggctgtttagcagtgtactttttcgtgtttatactgcaaggctgggttcagcagcaaatgactgaattcctgctacttctgtagcaagccgatc

SEQ ID NO: 7094 - DNA, 2395 bp, Zea mays
  misc_feature (1744)..(1744): n is a, c, g, or t
  misc_feature (1747)..(1747): n is a, c, g, or t
  misc_feature (1749)..(1749): n is a, c, g, or t
  misc_feature (1756)..(1756): n is a, c, g, or t
  misc_feature (1758)..(1758): n is a, c, g, or t
  misc_feature (1764)..(1764): n is a, c, g, or t
  misc_feature (1766)..(1766): n is a, c, g, or t
  misc_feature (1771)..(1772): n is a, c, g, or t
atttcgtgaaacaatgacacccaagctcaagccatgccttgaacaaagatagagaagatcactagtgctggaatgctggattcacacctgcgcgaaagcgaagagcgagctgagactgagacacctgcacagaaaagctggatgacacaggcacatacgcacatcctacagaaatacaacgcgcccacggtacatgatcagtagtagtaccacaagtggcagtgttgagcacgaacatcaccgccgcgctaatccaccattcaaacgagattagtaaaaaaacaaacggggagctcagagaaaaaggaataaacaaatagaggaagcagcgcagtcggaggaaatgagctcgctctcctgctcctacaggctgcagttgcgctgtgcctgtgcttccagttccatcgctttcccctcctccccagtccccactcccagatgcgatttccctctccaccgccacagcgcctagcttagccagccagccggcggccatcgccgccgcaatggcgaccgcgtcggaggacgaggccgcctcggaccgctgcagcggcagctacagccccagcgccgacgtcagcgagtccgaaacctccagtgactgctccgcgcccaccacgcgccgcttcgcctcctcctcctcggcctccgccaccgtctcccgcctcgcgtcctcctcctcgtcgctccccaccccggcatcggccaccgccttctacctctccaagccaacccccgacctctccgagatcgacatgatgaaggagcgcttcgcgaagctcctgctcggcgaggacatgtcgggcagcgggaagggcgtctgcaccgcgctcgccatctccaatgccatcaccaacctctccgccaccgtgttcggcgagctgtggaggctggagccgctcgcgacggcgaggaaggcgatgtggacgcgggagaaatggagtgcctgctctccctcgctgactccatcgtcgagctcaccccctccatccaggagctccccgaaggcggcggccagttcgaggtcatggtcccgcgcccgcgcagcgacctctacatgaacctccccgcgctcaagaagctcgacgccatgctcctcgcgatgattgacgggttcaaggatacggagttctggtacgtggacagaggggttatggtcgaggatagcgggggtccgttcccgtcctcatcctcgtcgtcttgtggccggccgtcagtgcggcaggaggacaagtggtggttgccctgcccaagagtgccgcccaaggggctgtccgtggacgcgaggaggaagctgcagcaaagcagggattgtgcaaaccagatactcaaggcggccatggcgattaacagcgatgtgctcgccgagatggaaatccccgaagtgtacctggagacactgcccaagaacggtaaatcttgcttgggtgagataatttatcgatacataacagctgagcagttctcaccagaatgtctcctagattgcttggatctatcatctgagcaccacacacttgaagtggcaaacagaatagaaggtgccatccatgtttggaaactgaaaggccaaaaaaagtcgacgcctcaagccaaatcaaagatatcttggggtggaaaagtgaagggtcttgttggagataaggagaagaaccacactttgtctgaaagagctgatggtctattgcagagcttaaggttgagatatccaggcctgccacaaacttcccttgacatgaacaanatncngtataananggatgncnggcannccatacttgaaagctactcaagggttctggagagcttggcatttaacataattgcaagaattgatgatgtgatctatgttgatgacgctacaaacagatcagctgctgccgagtctgtttcgatcttcaatcgtggcacaggcgtgccagttcagaagagaatctctccaagcccattctctattcagaattcgccgtatggctctccgttcgcaacacccactttctgctcctccaccccagttacaggcagtcctggaagggtacagcccccattaaacaaaaatattctaggaactcaagaaatcaaggtcgaaaagctcttttctggtgatctagagaaggtctggacatatgcaggaaacttgagcgctaggaaagacgctggagatgctcctgagagagactgaagggcgatggaggaaggtagacatgtaccgacagccgacagatcctgtaattgctagtagctagatcttcctgtacagaagcagcatgagtttttttttgttctttttgtagcgagccgatcattgtgtgctctgcttacaatgaatggatgtcacctgatctgaacagagaaacttgtagtttcagctgtagtttttttgtctggattggtt

SEQ ID NO: 7095 - DNA, 1036 bp, Zea mays
gaccttgtgaaataagttttagagaggtcaattcaactacaactttagttgaacatcttgatcttttcaatgatccaaagctgaacactcatagagtacacaacatttatagctttacatgttctctttctctctaaaaccaacactacatgacgttgaactgatgatgcgcctcacaacgatggctaatgcgttgaagaattctcatctttgttgccatctcaggttctcaatagcattttattctctgacgaggaaatcaacatgtcatcaattcttagccttcctacctctcttagcaagttgggctttcatcgtaccctttttagggcccttttctacaaccttcaccctcttcggtgccttccccttttagaccccttcatgtatccaactgcccagactctctcaaggccatagtttagtgtgttctcaagtctgtaagttgtcgaatgccatatacgaactgtaccatcttcagatccagtaatgattatagggagctcaggatggaaacaaacagcagaaatattatgtgtatgcccttcaagtgtctgaacacagctcttcgtctggtaataccagacctttgcggtggagtcatcagaaccagtaatcaaatagggcctgtcaccaccagtgaagtagttaacacagttgacacccttttgatgcccatcaagtgtgaagtttggatctggagaacccaaactctatatctttgtagtgcggtcaagggatgcacttgcaaaggtgttaatatcctttggattgaaagtaacctgcatcacatagtgtgaatgtccctcaaatattcgagtgcacacccaccctttatcctagtcccacagttttattagcatgtcatcagatgatgacagcacatatggtagagttggatggaccgcaacacattctgatgtaatcacggtcgcccgcgcggacgcgtgctttgtccatggtattgtagttgtagacacgaatgaacatgtcgtctgcaccagctacaacccattgtttccttgaaataaacttt

SEQ ID NO: 7096 - DNA, 1576 bp, Zea mays
ttgggtacctcgaggccggccggggctactatgtgttacatttggcaggaaatttctctaattcagcgctcccagttgatggcctgttcggggtccctggggcccggccgggcaggggaataagctacccagcacagcagtcagcagtgtatacaattacattcatgcacacgatggcactcagcactcaggacttgctcgaagctcacgtcgagctctggcaccagtccctgtgctacgccaaatcgctcgcgctcgcagtggcactggacctccgcatccccgacgcgatccaccaccatggcggcagcgccacccttccccagatcctcgccgagactgcggcccacccaagtaagcttcgcgctctacgccgcctcatgcgcgtgctcaccgtctcgggcaccttcagcgtcgagcaacaaccgccagctggtggtgatgattcgaccgtcgacgcgccggacgaagctgtctacaggctcacggcagcctcccgcttcctcgtcagcgacgaggtgagctcggcgaccttggctccctttgtgagcctggcgctccatcctatcgctgtctctccgcacaccatgggcatctgcgcgtggttccggcaggagcagcgtgaaccgtccccgtatggcctggctttccaacaaacattcccaacgatctgggaacacgctgacgacgtaaacgccttactgaacaaaggcatggtcgcggacagccgcttcctgatgccaatcatgctcagggagtgcggcgaggtgttccgtgggattgaatcgttggtcgacgtaggcggtgggcatggtggcgccaccgccgccatcgccgctgccttcccgcacctcaagtgcagcgtgcttgacctcccgcacgttgtcgccggcgctccgtccgatgtcaacgtgcagttcgtcgcaggcaatatgtttcagagtattccacctgcaaccgctgttttcctcaagaccactttacatgactggggtgacgacgagtgtgtcaagatattgaaaaattgcaggcaagctatatctccacgtgatgcaggagggaaggtaataatcttggacatggtagttggatacgggcagccaaacataacgcatctagagacacaagttatgtttgatttgtatattatgacggttaatggagctgagcgcgacgagcaagagtggaagaagattttcatagaagcaggattcaaagactacaaaatcctaccaatccttggtgcactatcagtcatcgaggtctatccatgaatgcttgctgagcaaaggcctccacaataaattgaagaatctgaaagtgctgatagtaatccatgaattgttctttttactatatacactttgaagcacatcgtcgtgtgtgcttccacatgtgatacgatatgtaaacgatgtgctatatatattacccatgctctcgttcgatgtagatgctgggatcataggtaaatctactatatatgccagatcttaataagataatatggaagcgttttgcttctaaaaaaaaaaaaaaaaaagcggccaagaaaaaaaaaaaaaaaaaagcggcc

SEQ ID NO: 7097 - DNA, 1679 bp, Zea mays
  misc_feature (23)..(23): n is a, c, g, or t
cctcgaggccggccgggccgggnagtcacccgcaaccaattagccattggccagcacagcagtgtataggcatagctacgtacgtgggaagtgggaacgatggcactcatcatgcaggagagtagtagccatgatttgctccaagctcacgacgagctcttgcaccattccctgtgcttcgccaaatcgctcgcgctcgccgtggcgctggacctccgcatccccgacgcgatccaccaccacggcgccggcggcgccacccttctccagatcctcgccgagactgcgctccacccaagcaagcttcgcgcccttcgccgcctcatgcgcgtgctcaccgtcacgggcatcttcagcgtcgagcaaccaccagcaggtggtggtgataattcaaccgtccacacgtcggacgacgaagctgtcgtcgtctacaggttgacggcagcctcccgcttcctcgtcagcgacgaggtgagcacggcgaccttggctccctttgtgagtctggcgctccagcctatcgctgcctgtccgcacgccctgggtatctccgcgtggttccggcaggagcagcacgagccgtccccgtatggcctggcgttccggcagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccgccatcgccgccccccgcccccccccccagtgcagcgtgcttgacctcccgcacgttgtcgccggtgctccgtctgatggcaacgtgcacttcgtcgcaggcaatatgtttgagagtattccacctgcaaccgctgttttcctcaagaaaactctacatgactggggtgacgatgagtgtgtcaagatattgaagaattgcaagcaagccatatctccacgggatgcaggtgggaaggtaataatcttggacgtggtagttggatataaacagtcaaacataaagcatcaagagacacaagttatgtttgatttgtatatgatggcggttaacggagttgagcgtgatgagcaagagtggaagaagatcttcattgaagctggattcaaagactacaaaattctacccgtcatcggtgacgtatcagtcatcatcgaggtctatccttgaatgctttgtgaacaaagacctccataataaactgaagaccatgaaggtgttgatagtatattatgattttttatttgtattgtacacttgattctttgagtatttgtaatgacaagctgagtaattgtgtttttttgttaatgtggtcttatagtgcacattacacatgatgtatgatatgttacttgccctcattttggtgtagatgtgtgttggtcaagtagtcgataggcaactctattatgcttggcatcaataagacaacatggaagcctatgatttgttgtgtcatggcaacaaggaaaattgtggtcttggtgaaaaatgcatatgttttcagaatgtaacagaaaaggcaaaatcacatcgacttgtgcacaaatgacttctgcaagacaactctaataagtatgtgttggagattattgagcttggcccatttaatttacaat

SEQ ID NO: 7098 - DNA, 1494 bp, Zea mays
ctcgaggccggccgggccgggacacaaacccagcgctatcgagaaagagaattaggtagccacaacgacgatggcattcacagaggagagtagccaggacttgctccaagctcacgacgagctctggcatcagtccgtgagctacctgaaatcgctcccgctcgccgggccccggggccggtgggcatggtggcgccgccaccgccatcgccgctgccgtcccgcacctcaagtgcagcgtgcttgacctcccgcacgtcgtcgccggggctccatccgatggcaacgtgcagttcgtcgcaggcgacatgtttcagagtattccgccggcaaccgctgttttcctcaagacggctttacacgactggggtgacgatgagtgtgtcaaaatattgaagaattgcaggcaagccatatctccatgcgatgaaggagggaaggtaataatcatggacatggtagttggatatgatgagtcaaatacaaaacgtctagaggtacaaattttgtttgatttgtttatcatgatggtcaatggggctgagcgcgacgagcaagagtggaagaagattttcatccaagctggatttaaagactacaaaattctacccgttgttggctccctgtcagtcatcgaggtctatccataaatatttggtgtgaacaaaggacgccaaaacctgaagaccgtgcatgtttgtgctgatgttaattattactatggtccgatcgaaaattggtctttactttgtgagcttgtaataagctgatgagtaacttgcttgtttccttagcgtgaggtattgtggtgctaattacatgtggtatgaaaatatattatataatatatatatcacaatagtaaattggcgaactttcgtgaactgaaataattttcgtaggttttcagtttagtctaggaaaattggttaaattctgtcaaccacagcgcagtcgacagctattaactaatttctatcaaccactgcatagtcgatggatattattaactaatttctgtcagctatgaggacgagccgacaaaaaataataatttttgtcggttgtactcagatagccaaagaaaattaatagctttcatcaccttcttcatcatggccaatgtaaattaagcaagttacaacgtccaatcactcctgcctctgtctcccttctcactctcgcctcaacctctcgccactcctgcccgccgtctctcttctcactctcgcctctatctctccatccagccgcctcaccctcacctatagatgtttaaacggatggcacagctcagtccgaccacagttgagtctgaaccatttgagctccattatttaaccgtgttggaccgtgccgcttgacgggcctcgattcttgcacgagcacggcacgaaaacatctcgataatgccggaccggcccggcaagcacagtccagttacccatttgtatcagcccgagcatactatcacacaaatccatttaatcctac

SEQ ID NO: 7099 - DNA, 4293 bp, Zea mays
ctacaaattatactacaaaataaaattactcacttagccgatggtgagatcggtgtggccgctggtgggtgacgtagggctggacgagcgttggagccgacgaggcagtgggggcgaggtgggcgctagcgtgggcgggcgctgatggctccgtcgaggatggctcccgcccggcgtaacggcggtgctggtcaagtggcttacgtgcgaaatgaaacggtacggtcgggcgccgcggacttaaaattctttatttccgacggcttgtatgacagtccaacgatctgtctgacagctgtcggcataagcgtcttgccgacggcttatgacaagccgtcgaacgtatgaacttatgtccgacacagataagggcggtcgtcaaaaaaaaccgtcggacataagttgaccgtcataaatttcccattttggtgttatggttactggatacgtcatgtctaagcatcagcggcaaaatcgcctttggctggtgaaaccgttccccggctcgtggagctgctcaacaagccgtcccaaacgggcacagcttcgaagaaagaaccattattaaaacattgatcgattgatcgattgatgcatgtgcatggatgctacgctgcagtcgtagaaaagcagaacactataaataaacaccaggttccatccgtctctgcagtcacccacaaccaattagccattggccagcacagcagtgtataggcatagctacgtacgtgggaagtgggaacgatggcactcatcatgcaggagagtagtagccatgacttgctccaagctcacgacgagctcttgcaccattccctgtgctcccccatcgcccgccccctccccggggcgctggacctccgcatccccgacgcgatccaccaccacggcgccggcggcgccacccttctccagatcctcgccgagactgcgctccacccaagcaagcttcgcgcccttcgccgcctcatgcgcgtgctcaccgtcacgggcatcttcagcgtcgagcaaccaccagcaggtggtggtgataattcaaccgtccacacgtcggacgacgaagctgtcgtcgtctacaggttgacggcagcctcccgcttcctcgtcagcgacgaggtgagcacggcgaccttggctccctttgtgagtctggcgctccagcctatcgctgcctgtccgcacgccctgggtatctccgcgtggttccggcaggagcagcacgagccgtccccgtatggcctggcgttccggcagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccgccatcgccgccgccttcccccacctcaagtgcagcgtgcttgacctcccgcacgttgtcgccggtgctccgtctgatggcaacgtgcacttcgtcgcaggcaatatgtttgagagtattccacctgcaaccgctgttttcctcaaggtaccatccgtcgtcactgctgactgctccctcctccatggctccatttctcaatgtgtttgcattttgagatccatggtcaaacttcaaagttttgactatcgttttgtcttgtcttgggcgagatgcctctcccgtccaaaaataatttaaaattttattttacagtatagagtaacgatatctataacaccgatcatgcttacgctagccctatgcttctcgatgtatcaatgatactaataataatgctatattttaaaagatttgttcaaataaaatagtttgactttagaacaactctataattttattcagactatgttttgtagggatttagatataaatcccctcataaaatattttgggtaatcaattagaatcagtttataaaaccgttttgtttgtgtgggtggattcctatttccacaaaatgcattttatataaacaatcgtataaatgaaaataagcttcaaaaaaattctgaacttcgagtggacaagaaaaaatttaaatataccctattatattttgttgcacttagaaaatcataatttaagaaaactatgatcactagtgtatagcaaacactgaatcgtcccgaaactagtctaggaacttttgacatatatgtatatagtgcaaaatagaagagtcctttcaaatgtttctagaacaaaacactatgcaacacttctatttaatttggcagcgattctaatgttccaatattaccaaatgaacccttaatttgggacgaaaaaagtagaagtaaatagttctaacatcataaacatacatgttattatctttgaatccaaacaccaagaacccttttgttcatcatctatcaattaacttgatgaaatctatgccagaaaactctacagcccgccggtgccggtgagtgtgtcaagatattgaagaattgcaagcaagccatatctccacgggatgcaggtggaaaggtaataatcttggacgtggtagttggatataaacagtcaaacataaagcatcaagagacacaagttatgtttgatttgtatatgatggcggttaacggagttgagcgtgatgagcaagagtggaagaagatcttctttgaagctggattcaaagactacaaaattctacccgtcatcggtgacgtatcagtcatcatcgaggtctatccttgaatgctttgtgaacaaagacctccataataaactgaagaccatgaaggtgttgatagtatattatgaatttttatttgtattgtacacttgattctttgagtatttgtagtaacgacaagctgagtaattgtgtttttttgttaatgtggtcttatagtgcgcattccacatgatgtatgatatgttattttctctcattttggtgtagatgtgtgttggtcaagtagtcgataggcaactctattatgcttggcatcaataagacaacatggaagcctttgatttgttgtgtcatggcaacaaggaaaattgtggtcttggtgaaaaatgcatatgttttcagaatgtaacagaaaaggcaaaatcacatcgacttgtgcacaaatgacttctgcaagacaactctaataagtatgtgttggagattattgagcttggcccatttaatttacaataaaacccaattctgtcttttgtcattttctataataatccaactctgtcttgtacgataagttggaaactaaattgactagatcataagctagtcattttctttcttcttgcgcgtgtttatcatgagtctaatcccatatataattgagaggcgttctccgtgaaagaaatgagaaataactaatccactacatgttgtagttttagatgagggagtcctcagtgttgtgccaccttagggccctccgtccatgagggcgatgtgatggttgtggtggagagagttatctttgaaacctccttcgtttaaagtacatgcatgggttgggacaaattagattttaggcaatggatatgtgtctactcgccgagttaatctgcattatgacatctacggacttcaatggcaccacaaaaacacatcttcaaccaatctagagtgaccctcgtagtaagtaaagaccagttcctcgttcatgtttatgttagatgcattcaagatagatttaattattctaggttcggccggagtacttatattgtgcgtggttatcctaacaaactctcatgaaactgttagatctctcaccatatatatatgaaggagtacgaccgattgagatacacaatccaattaaatcaatccaattaccttatttatgattatgcattaggtctagcgtagctttcccaatctcaatcctcacctctgtacacgctttgtgtggcctatcgacccagagcaactctacgatctctcctcccgacgagggtcctcccaggagcaggagacaagatataggttatcccgatagcgagctctctacgtcgacatggacgatctggcaccctatcatggacgatcaagtgctttaccatagacagtccggcatccgccaccttgtagagccgactccaaattcatgtatatttagcccgagggttcttggcatttggccccctaaaggtgccaacaatattaaagtaaacacgcacaagtgcatttttgccatactagagagttagcgcggtgatatatatatatatatatatctagatttagaaatttattgttgttggtga

SEQ ID NO: 7100 - DNA, 1516 bp, Zea mays
acccacgcggccgccagtggccgcccgggccgggagtctcacccacaagagacacaaacctagcgcaacaagcaatcgaaaaagagatttggctacaaccaattaaccatattggccagcagtgtacgtgggaacgatggccctcatgcaggagagtagtagccaggatttgctccaagctcacgacgagctcttgcaccattccctgtgcttcgccaaatcgctcgcgctcgccgtggcgctagacctccgcatccccgacgcgatccaccaccacggggccggcggcgccacccttctccagatcctcgccgagactgcgctccacccaagcaagcttcgcgcccttcgccgcctcatgcgcgtgctcaccgtcacgggcatcttcagcgtcgtcgagcaaccaccagcaggtggtggtgatgattcaaccgtccacacgtcggacgacgaagctgtcgtcgtctacaggttgacggcagcctcccgcttcctcgtcagcgacgacgtgagcacggcgaccttggctccctttgtgagtctggcgctccagcctatcgctgcctgtccgcacgccctgggtatctccgcgtggttccggcaggagcagcacgagccgtccccgtatggcctggcgttccgccagaccccaacgatctgggaacatgctgacgacgtaaacgccttgctgaacaaaggcatggccgcggacagccgcttcctcatgccaattgtgctgagggagtgcggcgagacgtttcgtgggatcgactcgttggttgacgtcggtggtggccatggtggcgccgccgccaccatcgccgccgccttcccccacctcaagtgcagcgtgcttgacctcccgcacgttgtcgccggtgctccgtctgatggcaacgtgcagttcgtcgcaggcaatatgtttgagagtattccacctgcaaccgctgttttcctcaagaaaactctacatgactggggtgacgatgagtgtgtcaagatattgaagaattgcaagcaagccatatctccacgggatgcaggtgggaaggtaataatcttggatgtggtagttggatataaacagtcaaacataaagcatcaagagacacaagttatgtttgatttgtatatgatggcggttaacggagttgagcgtgacgagcaagagtggaagaagatcttcactgaagctggattcaaagactacaaaattctacccgtcattggtgatgtatcggtcatcatcgaggtctatccttgaatgctttgtgaacaaaggcctccataataaactgaagaccaagaaggtgttgatagtatattatgaattgttatttgtcctgtacacttgattctttgcgtatttgtaatgacaagttgagtaattgtgtttttgttaaaaaaaaaaaaaaaaaagcatttcaagttacaagcgtaccagtggcggacctagaaaacttcaaaatcctgggcatttgatttgcgaaaaaaaaaaaaaaaaaaaaaagggtta

SEQ ID NO: 7101 - DNA, 1411 bp, Zea mays
cccccgccgccggcactcgcgacgagtgaattagctatagccagccgtgtgtcgaacacgacacgcgataatggcactcatgcaggagagcagccaggacttgctcgaagcgcacgacgaactcttccaccactgcctgtgcttcgccaaatcgctcgcgctcgccgtggcgcaggacctccgcatccccgacgcgatccaccaccacggcggcggcgccaccctcccccagatcctcgccgagaccgcgctccacccaagcaagcttcgcgccctacgccgcctcatgcgcgtgctcaccgtctcgggcgtcttcaccgtccagcaagagcaaccaccagacgcagacggtggtggtggtgctgattcttcaaccgtcgacgcgtcggacggagctgatgtcgtctacaggctgacggcagcctcccgcttcctcgtcagcgatagcgacgaggcgagcacggcgaccttggctccctttgcgaggctggcgctccaccctatcgccatctccccgcacgccgtgggcatctgcgcgtggttccggcaggagcagcacgacccgtccccgtacggcctggcgttccgccagatcccgaccatctgggagcatgctgacaacgtaaacgccctactgaacaaaggcttgctcgcggaaagccgcttcttgatgccaatcgtactcagggagtgcggagacgaggtgttccgtgggatcgactcgttggtcgacgtcggcggtgggcacggtggcgccgccgccaccatcgccgccgcattcccgcacgtcaagtgcagcgtgcttgacctcccgcacgttgtcgccggtgctccatccgatgcctgcgtgcagttcgttgcgggcaatatgttccacagtattccacctgcaaccgccgttttcttcaagacaactctatgtgactggggtgacgacgagtgcatcaagatattgaagaattgcaagcaagccatatctccacgggatgagggtgggaaggtgataatcatggacgtggtagtcgggtatgggcagtcaaacatgaagcgcctagagacacaagttatgtttgatttggttatgatggcggtcaatggagtcgagcgcgacgagcaagagtggaaggagatgttcattgaagctggattcaaagactacaaaatccgaccagtagctggcctcatgtcggtcatcgaggtctatccatgaattctttgtgaacaaaaggccggctgccataatataaactgaagaccacgacgtcgtcatggagctgagcgtgttgttttttagactactaggcacttgagcctctgagaatttgtaataataaataagctgagcaacagcgttctgtttaaaaaaaaaaaaaaaactcactcgccaaaaaaaaagataaaaaaaaaaaaa

SEQ ID NO: 7102 - DNA, 778 bp, Zea mays
gctcatcacaagctgtcacaaactcagcacacaatcacactgacacacacaccaccaccacggcaccgctagtgagaagcggagcgggaggacacgcggcgcggactgcgatggctcgtgcgctcggcgcttgcgtgctgctcgccgtcctgctcggtgccctggcgccggcggcggccgcgcgcgcccacgacgaccagggcagcggggccggcatacggcagccgagcggcgagtaccgcgggaggaaggtgggggccaggacggaggtgcgggacgtggagggcgacggcgaggtgcaggagctcggccggttctccgtcgccgagtacaaccggcagctccgagaaggtggcggcggcggcggcaggctcgagttcggcagggtggtggcggcgcagcggcaggtggtgtcggggctcaagtactacctccgcgtcgtggccgtggaggagggcggcgcggggaacggcggcgagcgcgtgttcgacgccgtcgtcgtcgtcaagccctggctcgactcgcgcaccctgctcacgttcgcgccggcggccgccaagtaagcgcggcgctaccaccggtgtagacgtctagtgtagaaaaaaaagtctgcccttctcggagaccatggacgctgaataaagtcttgtgtgttctgtataagcgaagcgtactagagagtgaagatggacgaactctgcgctaccgcgcgcagatcgatgtttttttttgaaaggctgttgcacaaatagaggagacaagagtctgagactgagag

SEQ ID NO: 7103 - DNA, 8088 bp, Zea mays
  misc_feature (507)..(507): n is a, c, g, or t
  misc_feature (2568)..(2568): n is a, c, g, or t
  misc_feature (4889)..(4889): n is a, c, g, or t
  misc_feature (5109)..(5109): n is a, c, g, or t
ttgagctgctgcgacggtggggaggaggcgggcgcctgggttttatagggtggtggtgtggtggctcggcgacgggcgggcgcatgacaacggggaggagggtttattccctggattaaccgcggcgttaggcgcccccggagacacgacactactattattgtttgagaaaacggattagagcctggaatatgctctcccgatggaatggcgctaaagatagtagggcctttccggctaattctgtcatgacgcgctgggactggtagccattccggggacccaatggctggcacaggcacgctacaatgtctaaattcttgttaccgtgcgcactgcccccttttttttcctgttgttctgtactatacatatgtttccggtacagagatttgcagtagctgttttgcgaagttgtaggcacgtgattgtagcccataacgccgtcttcgtatttaagtgcgtgccctaccctaccctcagcatttttgtacagtgtttagaagngaccctccaaaaggatcaacacgcagcatcttctggagatcctatcctgtagacggggcaagtgactaggcacccagattaactgataatcatcgtcacgtcacgttcgtatgccgagactcgacggaggcgacggaaagaaaggtccatggtggtggacccgtggaggggacaaggtgagcacacggtggccacaccgccacagttggtaactgcgttgcgttgcgtggcggggctgctgcggatatgcggcggaccaggtcagcgcgtgccaggtgccgtgtgggacgcctgcccgtaccccgccgcatgtgtctgggctggctctggctggcccttggcgctgccgtgggggcgtcgctactagtactagccgtgcgcccgagccgggtgccgctgacagggaccttgccctttcgttctcgaggcaacgggcgccctgcccactgcctcctgggctcccggtgccccacctgcacctgcctgcatcgtgtatctactccgcattcgcgacttgcgaggtggcagaagtcgcgatcgctttgagaactctcgtgcacgaggacggaggcatgtgtcgggggttgtcgatcccgatggagaggtgggccacgagaaggttgcccggcggttgcggcgactccctcgtccggcccaccaggccaccaccaccaccaacccagttccggtccatgcctccgggttaacctacccacgcgtgacgcgtagcaagtagcattgcatccgggagggcacgtacgtgctgcgtgacctgcgtccagcagggcgcccggaccacgggctttcgccgcgagacccacggtttcgctttcgccgcccgctccgcctgtttgctattgccctgcggctggtcactggtggctgcccaagtgcccagccccttcgcggtttccgccgaacaaccagccccatgcaggaggcgggaggcagcccgagcccgatacgtatcgcactcgcacgggctcgttccccggaagagcgagcacgcgcgcggcgcgggccggccgcgccgaggctcgtgtcgtgtctgctgcgtcatggccgcgttgcgtgcgtgccagttctacgtactagaaatagagtagtagtactactagaatggaacagtccggtccacttgttgtgctctggctagggctcataatgagctataaattttgcactataagatttaaagatcgaatcgagttagaattgtgctctatttttagtcatttttaaactataatttatttaggacattgacatcttgtgaagaaccatttgaatcaccatacattaccccgctctggcctctggactccgggaccgcggccggatgcaacgaacctgctcgctcacccgagcgcgcgacgcggctttgtacgcggacgttgtaaccgcagagtactgagtacatgtacatgcatgtgtcatgtgtgtgcatcgttcagctcgacgtacggcttcgctagctaaacaaggggcatgtgcgttacgcgtgcatccggacggcaaattggttcgatgcaggcacgcgtagcttgctgcaagtgcactgttgatgaagtgagttatcagttagctagctttattgatccatcatctgtacctattataaaatagagagagacgaccaccaagcgaggtagggtgttcatatataaaaacttagtgctattctacatccctaagtgtagaataataccgaatacctacacctggtaactaaaactagtaacgaatatcactatgtgctagtttagaaacgagaaattagctcatccaatcttctcctgtttgaacctctcaaactattcctaaatgtttgttgcaagatagtagttcacgtaagtaccatctttacaaatatagagtaggagtttaatcgtccatcatcccctccttcacccacacgtagttgagtgttcaccacacaccatcgtgatattatatgtttctgttgctacgcacgagcactcacctaatataaaaataagtatatttatcatgcaccaaatatatatatatatatatatactggaacaatgcacaagcaantaactagtagaatattaaatacaactaaatattactaagttctattcagtataaaagtttgacgcaaaatattattccaagggcaaattcttatatgtcactgtaattttacttagtaccttatatttgtcgtcataaacgtcttaatctcttttatgtcacttggatataatttcttacccttgcatgtcatcctcagtggtgcagaagggattaagacatacaatttcttacccttctatgctactagcgatgccatacaaggataaaaaattatatccgggtgacacggaatagattaagacatttgcgatgacacggaagacagtgacagtgtataagaaattgcatgctacacaaacttttgataaatgtatgctcctccatgtatgttgatctctcatgtccttacatttcccagtttattgtgttcattaacacttgtggattgatggaaccatgggcaccgctcataaggtgtttgatagaaagtgcagcttaatggagtctcattttctggatgatttgacagccaatggctggacaatatggcttaggacatgaaaaaccctgagactatggttttgttttccaagtataaaatacagttaagaaattacatgattcaactccgagcctctgaatcataaatgcagttaagagataaattgtatagagaatagtgtatagacgtgctcttcacgaagagtccgtctcttgtatttttttcaactaatctcctagaacctagagactcctcaaaagactataataaataaggttgtacatgctcttagttctttgattcataatcaatatggggcggtttctggacactaaaaatttaggcatcttttgaaacgcaggaatttcatagtgatggtataagaatttaataggaattagttcaaaaaacgcagatgcaggattcagaaataatcctttgttctaagtcctttaatttgctggacaagcttaagtatggttttcagtttatcaccgccgcgctgttagtaatcctttcagtaaggttgcgcgctagttttctagtagaacttaaagtaatgttacggtttggggcgggggagaaattacatgtttttgtatgtataaagaaaaagtcgaaattgttttcaacttttcatgatactgtctcccaggagcaaactgctcggtccttttccgttcctttcggatcagatatgatcctctttgcttggactttgccaaagggaaactagctagcagcaggaagcactaatagtgatggattagtgctacacgtgtaaagcgaagcagtgaacgctaaaggagatgagataatgtgtatctcgccttgtgcatagtttatttgatttgggattatcaagcacagatctgcacaccaatgatacctgccttttttcaattaacaaattccttcacctaattggggtctacaggaaacagatcccttaatcacaagagaaatgatggtctcttgacacgttctaaaaacgatgtatatgtgatcaatttgtaacgcattgcttatgtgttcaaaacttatataatagagttgaacggcctatataaaaattctagacatctgtcaaggaacactgccgctctaaataaaaatacccatatgtcatgtcacctagtttgtgggctgaaccagcagaatggccgagaaatagccatgcgtgtcgttggggcccggcccacttccggttacgttccatcaacatttgaagtgataaatttctagctatgatcatgagcactatctgatgattaattcgtggccgtgcaattattcggctgtttatatatgaagccgtacttgtcctcgggcccgctggtcgatacaataacgatacattccttctgattctgatgggccggatttggacttctattattccgttcatctgtgtggagatgtatctccctccgatccgatccacagtgagcaacagtataagaacgcaaagaattaccatgagtataagaacgcgcaaagatttaacatgcgaacaggaagttctatcaaatttataggaaaaaatattgattttattatagtattaaataagcattatttgagtaatcataaaatatgttttttatagtaaagcattttgaggaacctgaggacttcctgcctcgtccatttcctctcttcgaggaagacatgcatggccgatgtcctccttgcgtcattgccgaggggcacgcccttctatctcgtctagaagcgttggactaggcagttcatggtgtttgttggctcctttcatttcaaggtcctcataaaaatcaagggcatccccttcctnggcacatcatgcaagagggatgtatgcagtggcggagccaggaagtgtagggcctgatataacactaacaaatatttatatcagttagaaaatcttaaattatacaaatgcatagataatgacacatgacaatgaacgaattatacgaattttctcattccttcataatatatttgggcccatataatttttttggcccaagagtaatgctaagccctantggccctatacctgtctccgccactggatgtatgtgcatatttggtcactgcttgatgcatcacccttcccttattcctgaggagaaagtcgtcgtcattccaaagcccattgtgtcgttcgtcgtcgacgtcgagggtccagctacacattcaactgaggacgaaggtcatgttgttgaagtagggatagtacttggatagtcctaactaactggcttataccctttggtttggtcgtagggtgctcgacattattgataccctaagcactcaccgatcaggggagtccgaagcaccgtaaagacctatgtctatcgtcggtcttgtgtgctgtgcctcttttgattttccaagcagaggcatgggtcattgctctactgtcaaaggtaaattgttagtaggtctatatgttctagtggttagagattaagagcaagattccaaaaagatatagcacaactacagaagcgagcaaagaacaccttgctttcacagactgaggcaagcaagcagctagtaagagatccaaatacaacaataaaccattgtttttttagtttctggcccgacaaggtgaggcaagagcaatcgagacctccaaacattgaaacacgcccggagggagaggaaatggacacgagctgactgtgttcatcattgacctcggaatcagtgtgatatagcgtgggattaagagttcagcatagtcaagcctgtataattacgggtgcaactaggcaagcagctgagctgagcaagggccggggtgatacagagccggagccgtggtgccggtcactccggccgccgcacagcaggtggcgccgcgacaaaaccctcagtttgttggtcacaaacaacccctcgccacgccacgtcatcgcccatcaggagccgaccccacgcaggacgcagccccgtctacgcggcaccacgccctcgcaagcacgcccgacgtgtcctccgctccgatgccgtcgtccctatccctcccgcgcgccgccgcctcgggacgcgcagttcatgcacccactgcgcgccgcgccgcgtttggccgcaccacacagagccttccaaaactggcgacgcctttccgttccaagcaggcgagctgccgcctcccgctatggtatataacggcgacaccacagcaccgcacactgcgtgcgcgcgcgctcatcacaagctgtcacaaactcagcacacaatcacactgacacacacacaccacaccacggcaccgctagtgagaagcagagcgggaggacacgcggcgcggactgcgatggctcgtgcgctcggcgcttgcgtgctgctcgccgtcctgctcggtgccctggcgccggcgccggcgccggcggcggccgcgcgcgcccacgacgaccagggcagcggggccggcatacggcagccgagcggcgagtaccgcgggaggaaggtgggggccaggaccgaggtgcgggacgtggagggcgacggcgaggtgcaggagctcggccggttctccgtcgccgagtacaaccggcagctccgagaaggtggcggcggcggcggcaggctcgagttcggcagggtggtggcggcgcagcggcaggtggtgtcggggctcaagtactacctccgcgtcgtggccgtggaggagggcggcggcgcggggaacggcggcgagcgcgtgttcgacgccgtcgtcgtcgtcaagccctggctcgactcgcgcaccctgctcacgttcgcgcccgcggccgccaagtaagcgcggcgctaccgccggtgtagtgtagtatctctggtctacccttctcggagaccatggacgctgaataaagtcttgtgtgttttgtataagcgaagcgtactagagagtgaagatggacgaactctgcgctgccgcgcgcagatcgatgtttttttttgaaaggctgttccataaatagaggagacaagagtctgagactgagagagaataattaaatcgctgtgcttctataacaaatcatgctgttttgttcaccagagatcccgaattatgattattcagtttctatataaatttgaacgagtgatcgagtttcgattgaactagtgagcactaatctggataattttctagctagtctaacgaaaataagcctacatccaaaaaatttagttttttagattagaggttaatgaaaataaatctacgctcatgaaaaataggtgatttttgttgttatagtttcgttgacatctaacttttacagactaatggacaagtcggtaattgcagtcgtgttcttgccaacggcaattacctaattttcaatcggcataagatatctaattgcagtcgtgttcttgccaacggcaattacctaattttctaagggcctacttcatttgcctcagtttagggcctactgagttcttggtgcaaatgtgcacttgatccgtcgattttgggggaaattggttatgtgttcatctttgttcttgatcggttgatttgggtcgtggaccttgaaatatcgagcccctgtgtttctgtgatctccatttcgggattagggttagtgtttttctaaaacctaaacctccatttttcttattcttcttctggttcttagaaattaagattaatatctatttaacccgagaccctaacctaatctattttttgtgatatgcttttttctacatacacttcttctctgatcttattcgctcagggtgagagggcaaggatgaactctttgggcccatccacatgttgcccgagagttgttcttaatttaaaatggatttgggaatctagggtcactaaggtggttccgatgccatttattgattccaataactctaggatgttgtctaagaccctaaaaagcctatccgaatgccaaaacctttgtgatgtgtgattcctaaactaactgtaaggtcaaatctaaaccataccttttgtttgtgttcatggccacaatgacgatgtcgtgcgg

SEQ ID NO: 7104 - DNA, 2739 bp, Zea mays
  misc_feature (2112)..(2112): n is a, c, g, or t
  misc_feature (2115)..(2115): n is a, c, g, or t
  misc_feature (2119)..(2126): n is a, c, g, or t
  misc_feature (2171)..(2171): n is a, c, g, or t
  misc_feature (2190)..(2190): n is a, c, g, or t
  misc_feature (2650)..(2650): n is a, c, g, or t
gcacgagaccattacctagaacatcctaatcgaaaaacccatctccctcagcagtcagtcagcaggactcagcagcactatctcccaccccccatccttcgctactctttcgttccttctgatcgccgctatcctcttcagccccgactgaggaggcggccggcgctccccaggcacgcacgagttgacgggtccagcagcggcctcgggatcttgccgccagctgcagcggcaatccggtccgtccgcccaggaaaccagtgctgtcttaggtattgttgattcatgattcttgattccgggaggcggtttcgtgttgtgacagcccgatcttgcggttcagcagagagccaatccgctgggcttccgtggatatacatatactggtctgagttgtcaagtccttgacctgatcatatcagttttgcttataaggatgggggtttacctcagtactccaaaaactgacaagctatctgaaaatggagaaaatgatagacttaagtttggtctttcatctatgcaaggatggcgagcaaccatggaagatgctcattcagcattgctagatcttgatagcgagacagcattctttggtgtttttgatggtcatggaggaagagtcgttgccaaattctgtgcaaaatatctgcatggtcaagtcctcaaaagcgaagcctattcaactggtgacctaggcactgctgtccatagagctttcttcagaatggatgaaatgatgcaaggacagagaggttggcgagaactatctgcacttggagacaaaataaacaagtttagtggtatgatagaaggattgatttggtctccaaggggcagtgattcaaataatcaacaagatgattgggcttcagaggagggacctcactctgactttgctgggccaacatgtgggagtacagcgtgtgtagcattaataagaaacacccaacttgttgtggcaaatgctggtgattcccgatgtgttatttcaaggggtgggaaggcatacaatttatcgagggaccacaaaccagagcttgcagctgagagagaaaggataatgaaagcagggggcttcatccatatgggacgagtaaatggaagtttaaacttgtcaagggcaattggagacgtggaattgaaacagaacaaattcctgcctcccgagaagcaaattgtgacggccaatcctgatatcaacgtcgtggagctctgcgatgatgacgactttgttgttgtagcatgtgatggcatttgggactgcatgtcaagccaacagctggtggattttatccacgagcgtataaacacggagagcagcctgtctgccgtgtgcgagagagtgctggacagatgcctggctccatcaacgatcgctggagacgggtgcgacaacatgaccatgatcctggtgcagttcaaaaaacctgtcgatcggaacaagaaggccgaagcagcagggcaatctgccagcaatgtggacgaagccaagagtcgtgttgctgaggagtgaagcatggctggcactcaccagggcgcaaccatttgctttcataaggcaggtgaaaaaaaggaacgaagaaacctgcagtgtacgtatctcaactgtacgtggcatgccatgcaaatcctgcctaagttaccccggacaatggcattgcctagtgcagtggtggatcttcagatcacaacctttcttgtgccagctttcggtcatctccactctccagccctcggaaccatggctgagtctgtctattctttgtgtggtgtgtagcattcctcgtgttttcgttgtccaaaatggtgtcaaatccagttttttgttgcgagaatgaaccgtgacgttagtgtgttttgctggcggttaggtgcaaaatactcgaaacctgaattgcccgctcgctatttcgggttgtaagtatatgatgaatctgattttagttgcatggtgtacccatcttatctgaaaataatgaaagatctgtttgtggttgactaaaaaaaaaaaaaaaaaaaaaaaaaaaaaaaaaaaaaaaaaaaaaaatgggggggggggccccccccccgggccccccttaaaaaaatttaaataaaaaagggggttcntanaccnnnnnnnngagaattctttgcgtgctgctgtaactgtaaggggaacaaacaangccctgatgacccaacctntaatggtaaggaacacaacaagctcgagccatgagatatcgcaaggtttgctggctggcaacgatggccttctgctgtttcttgccccggtttgacgcgtcggatttgtaattgcccctgattgccattgtatatatttatacacacacggggtgcttttaagatccgttataccggcaacacccactttctactcttatagaacttccctctagtccgcctttaccgagttcattgccaatattattacaccccgctttgcctgcccctgaatctctccccacagtcgcgcttagcgccccctcctgggcctgaccaccgagtaggaatgcccccccccctatgccccccccatgctaaaatccttgcgataactcccccgcccgtttttaccccccgtcgccattaggcccccaactcatttccccctctccccaactccactctccgcccattccgntccataattccccccgcctccttagcccccgccctcgataacatttctttttacccctcccccccatccctatattccccaaccgcaaa

SEQ ID NO: 7105 - DNA, 1884 bp, Zea mays
gtcactcactcgtaggtggcttccacccatctccctcagcagtcagtcagcaggactcagcagcactatctcccaccccccatccttcgctactctttcgttccttctgatcgccgctatcctcttcagccccgactgaggaggcggccggcgctccccaggcacgcacgagttgacgggtccagcagcggcctcgggatcttgccgccagctgcagcggcaatccggtccgtccgcccaggcttccgtggatatacatatactggtctgagttgtcaagtccttgacctgatcatatcagttttgcttataaggatgggggtttacctcagtactccaaaaactgacaagctatctgaaaatggagaaaatgatagacttaagtttggtctttcatctatgcaaggatggcgagcaaccatggaagatgctcattcagcattgctagatcttgatagcgagacagcattctttggtgtttttgatggtcatggaggaagagtcgttgccaaattctgtgcaaaatatctgcatggtcaagtcctcaaaagcgaagcctattcaactggtgacctaggcgctgctgtccatagagctttcttcagaatggatgaaatgatgcaaggacagagaggttggcgagaactatctgcacttggagacaaaataaacaagtttagtggtatgatagaaggattgatttggtctccaaggggcagtgattcaaataatcaacaagatgattgggcttcagaggagggacctcactctgactttgctgggccaacatgtgggagtacagcgtgtgtagcactaataagaaacacccaacttgttgtggcaaatgctggtgattcccgatgtgtgtatttcaaggggtgggaaggcatacaatttatcgagggaccacaaaccagagcttgcagctgagagagaaaggataatggaagcagggggcttcatccatatgggacgagtaaatggaagtctaaacttgtcaagggcaattggagatgtggaattgaaacagaacaaattcctgcctcccgagaagcaaattgtgacggccaatcctgatatcaacgtcgtggagctctgcgacgatgacgactttgttgttgtagcatgtgatggcatttgggactgcatgtcaagccaacagctggtggatttcatccacgagcgtataaacacggagagcagcctgtctgccgtgtgcgagagagtgctggacagatgcctggctccatcaacgatcgctggagacgggtgcgacaacatgaccatgatcatagtgcagatcaaaaaacctgtcgatcggaacaagaaggccgaagcagcagggcaatctgccagcaatgcggacgaagccaagagtcgtgttgctgaggagttaagcatggctggcactcacaagggcgcaaccatttgctttcataaggcaggtgaaaaaaaatgaacgaagaaacctgcagtgtacgtatctcaactgtacgtggcatgccatgcaaatcctgcctaagttaccccggacaatggcattgcctagtgcagtggtggatcttcagatcacaacctttcttgtgccagctttcggtcatctccactctccagccctcggaaccatggctgagtctgtctattctttgtgtggtgtgtagcattcctcgtgttttcgttgtccaaaatggtgtcaaatccagttttttgttgcgagaatgaaccgtgacgttagtgtgttttgctggcggttaggtgcaaaatactcgaaacctgaattgcccgctcgctatttcgggttgtaagtatatgatgaatctgattttagttgcatggtgtacccatcttatctgaaaataatgaaagatctgtttgtggttgact

SEQ ID NO: 7106 - DNA, 1039 bp, Zea mays
cattgggtacctcgaggccggccgggaataaccatttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctggctctgatgtccgccctggtgactggtactgctcctgcggcgcacacaacttcgccagccgctccaactgcttcaggtgctctgcctacaaggaggaggctgccggcgcctttgatagtgacatgtcacgctcacgcggctacgccggcttcggcagcggcgctgccgcccgtaccaaccgccccggttggaagtctggagactggatctgcaccaggtccggttgcaacgagcacaacttcgctagcaggatggaatgtttcaggtgcaacgcgccacgggactccggtagcgctgccacgacgacctacgaaaactacttgcactgaggtgtaggtagagcaaagtttacagctatagcgcgcgtcgacgaagcaggagcagcagcagcagcatgaattgaagaggagtcctcatcatcacatcataagggagcagcagtagatttaattgcaaaattaaagacacccgcgatgcatgccctatcactagttttgttccaccggtacccctaccgcgcgtttcttttaagatttggttccccatttatctggggacagtagaccccagatgagacctatgtttgctgtttcattttcagttacgttcgtctccgcatgcatgtttgcgcttggatctgatgtaaccccaaaacgcttgcttcacaagtactattaactagttctgttgccttcctaaaaaaaaaaaaaaaaaaaaaaaaaacccgagagtaaaaaaaaaaaactcgaggaagggcgccggtacc

SEQ ID NO: 7107 - DNA, 1184 bp, Zea mays
attgggtacctcgaggcccgccccggaggaaaagcaagaaagtcatacacatacacacacgcatccgcagcactccctcctcggtccctcctctgcttcacacagaccagtgcgcgctcaattcccccctctagcgcctccaccgcaccaaaccggtccaacgggacctatgctctagcctcagagcaaaccaccgcctgaattgggcggcaattgggggaggattcgcggcaggcagggcgcggatccgttggcgggatgattgcggctgtcaacagagtgccggcgggctggggcgaggatgagatgtccgtgctgccgcggcacaccaaggtggtggtcaccggcaacaaccgcaccaagtcggtgctcgtgggattgcacggggtcgtgaagaaagccgtcggcctcggaggatggcattggctggtccttactaatggaatagaggtaaagctgcagcggaatgctttaagtgtgatagaacctccgactggcaacgaggatgatgataaatttgattgtgaaaacatgcagtggaatagttcagatatggcctccgatgatgcactatcaccaaagccacagcggtcacggagcaggcagcataggggtttccacagaaaatccatcagccgttcaatgtcatgtgactcccactccaagacgtctgtttcatcttcctcaagagctcacacgaaagttgacctaagcaagctagaactgactgcactgctgagatattggcgtcacttcaatctcgatgcatgtcctaatccatccagagagcagttagttgatgctgttcaaaggcacttcacagcccagcaattggatgagttgcaggtcattgtcggctttgtgcaagctgcaaagaggctaaagacgactatgaaagtggcctgactgtgaagcctgaacttcaactaacagattcaagagaggatgtagcatgtttgatgaatgttgccgtgctatgtaatatatatgcatgaagttctttagattcaggtggctaggttaatggacaactagactatgttagcctcatctgatgtagatatgcagtatcctgtctaaagatgtttcaacctctagctcagttctttcctgctgactggatgtggattgaaatgacaagtttaaaacaagttattttgtcatccccaaaaaaaaaaaaaaaa

SEQ ID NO: 7108 - DNA, 1243 bp, Zea mays
aagaaagtcacgcagtcacacgcatccgcagcactccgccactccctctgcttcagacagaccagtgcgcgctcaattaccccccgacccctaccgcgtccaccacaccaaaccgtttcacccggacctgcccccaacaccctgctctatcctcatagcaaaccaccgcctgaattgggcggcaattgggagaggattcgcggcaggtagggcgctgatccgttggcgagatgattgcggctgtcaaccgagtgccggcaggctggggcgaggatgagatgtccgtgctgccgcggcacaccaaggtggtggtcaccggcaacaaccgcaccaagtcggtgctcgtgggcttgcacggagtcgtgaagaaggccgtcggtctcggaggatggcattggctggtacttactaatggaatagaggtaaagctgcagcggaatgctttaagtgtgattgaacctccgacaggcaacgaggatgatgataaatttgattgtgaaaacctgcggtggaatagttcagacttggtctccgatgatgcacaatcaccaaagccacaaaggtcaaggagcaggcagcataggggtttccacagaaaatcctttagccgttcaatgtcatgtgactcccaatctaagacgtctgtttcatcttcctcgagagctcacacgaaagttgacctgagcaagttagaactgactgcactgttgagatattggcgccacttcaatctcgatgcatgccctaatccatccagggagcagttagttgatgctgttcaaaggcacttcacggcccaggttgataaaacaaatttaacttctgactccagtaacttgcatcactatggtgtgaggtcctgacagtctgctttgttgtgttaattccaatatatgcttttgcccatgcggaagcaattggatgagttgcaggtcattgtcagctttgtgcaagctgcaaagaggctgaagacaactatgaaagtggcctgacagtgaagcatgaagttcaactaacagattcaagataggatgcagcatgtttgatgaatgttgccgtgctatgtaatatatatgcatgaagttctttagattcaggtggtaatggacaactagactatgttagcctcatctgatgtagatatgcagtatcctgtctaaagatgtttcaacctctagctcagttctttcctgctgactggatgtgaatcgaaatggcaagcttaaaacaagttctttttgtc

SEQ ID NO: 7109 - DNA, 2117 bp, Zea mays
cgcccccgcccgccactcaagcactcccttccgctgaactaactcccgtcccgcgctcacgcccaaaaaaaatttctccgcttcccgccctcctccccaatggcctcgccggcgaagcgtgccaagccctcgtcgccggccaagccctcgagtgcgccgcctcaggaagaggcgaccgccgccgccgtctctgaggaccccgtcgtcctcctccgccgccgctgggaacttgcatccgtgctccactttctcagggtgtttgagccggtgatcgaggcgaacttggggctatccgcggatgagatcgagatggcactcgcgtccaacaaccgcgacctagctcgcatacacattgcccttttgaagggaatacctccagttaacaaacatctaaaagatgaggatggatggattattgtaactgccaaaaagctaacagattggtggtcatgggttgctgaaggagcaaaccctttcagaaataattcagggtatgagtaagtctactattgcatttgtctatgatgattttattgctacaacctatttgtgtttgcaggaaagaagtcgagatgtataagcagcaagatccaatcaagcggttgttgatactaaaagcgctttgtgaagtccgatctgagcaagatgatgcggtgtggtatgttaatgatgaaatgaagaaaggaactcatatttccaactttcggaaagataaactaggcagtggcagtagttggactacatactggtatgacggtgattcaactattggccatagattatacacagaagacgtaacagttaattttaagcagaattggatgggaaagggtggccgtttgacaaaaccagttaccaatatttactgggaaacagttgcaactaaccttgacgagtttcttgaaatatcagagaagttatccagaaagggtcgtgctgaatctgctatggcagattatcttaagacagaagttattccagctgtggagaattttcaaaagaaaaaagagagacgtttaaaacggcaggagaagaaggacaaacttttagcttttactaacacattccaaacccgttcattgcgggaacgtcggcctgtcagctacaattactctgattttgatcgttccatcgaggaggcgataagagctgtacagaaaggaaaagtacaaggttcacgtgaggcaggaacagaagagaaacctgcttcacatcatggagacaaaggtgccgatggaagatctgacatcaattctgaaaacaacaaaaatggaggacaggaggatgccaagtacctaagtgacctgagctctggcgacgaggaagacggagactacagtgacaggggtgtcagctccgctgacagtgacggagacaataatgcttctgattcctacaagagcgacatggaggaggatgtgtctgtaccacgcaagagaacccgtcttgctgcccgtttggcaaatgacaagcctcggccagggcttcgtcggagccaacgaaacatgaaaaatgatgaagagactatgcatccaggtcaggtcacccctccaccaatggcgaagaaaacactgaggcaaaggcccacgcctgtctccaagcagcctgacattactttctcgagctctgaagatgatcttgcacaggttgttgcagactcagaggatgaaagtgggtaatttggcagaggttcggttgcatgcggtattttggattttgccttgtgggagccggttgaattccacaggtttagcgtcactaggcacttccatagtttcacttctaccggctggccggaatcagacgcagacagcaccggcgttttccccatatccgatgagttatcttcacgaagtcattggggcacctctgacccacttgtatggtgatttgtacatatgcatttagacactatactgcgatgcatcaccactggagcacccaaaaatcttgctgatgaaatgcttctgctgtgaaaaaaaaaaaaaaaacattcgaagggaaatggtgcttatgttgccttagacagcttgcctctctaacttaagataagcaggtttatgtcagcctgcaatattttatgttgattgccaaaaaaaaaaaaaaaaaggccccta

SEQ ID NO: 7110 - DNA, 1271 bp, Zea mays
  misc_feature (1081)..(1081): n is a, c, g, or t
ctcgaggccggcccgggcattgggtacctccaggccggccggaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgacgatgaaatccgtaacgataactggggatattgaagagattggagagaactcttatgatgccatttccatgtccgtgaagaaccaataattttcctgtgccctgaattgggtggtttccatagcatgtgcacggggtttgggtggaatgcctacagaatcgactgtgtcaagctttcttgattccgtagaaacatgttttgtttgacctcatcatagaggatctccgcttttatcgtacaaagattgtgatatgttcttagcttctttctacctgaataagaggatttctgcagacccttttccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttaaaaaaaaaaaaaaaaaaaaggggggggccnctgtcccagaaccaaattttactaccgggggttggaaagaaaaaattttttttttggggccccaaaattaaattaactgggcgggtttttaaaacggtggtatgggaaaaacccttgggttccccaatttaattgctttggaaaaaatcccctttttcccagtgtgggtaataacaaaaaaggccccccc

SEQ ID NO: 7111 - DNA, 1269 bp, Zea mays
  misc_feature (1250)..(1250): n is a, c, g, or t
agagagagaggtccgagagcagtgagtgggagaggaagagagccagccacagaatagtgagtgagagagatagagtgctcattcatggtgcggcaagaggatcagtagcagtaggaggaaggatccattaggaactaggaacaccacacgttgcattgcattgcattgttaacttgttagttagatcgtcttcgtcatcccctgattcctggtttcttggaaaggttttttcttcttcttcctcacttcttttcgtcgtttgggcaatggaggtggtgctgggttccgccgctcgccgctgcctggcttccactgccgtcgccgccgcgcgggctctgctgcagagggtgagcggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttagcccaggttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgacgatgaaatccgtaacgataactggggatattgaagagattggagagaactcttatgatgccatttccatgtccgtgaagaaccaataattttcctgtgccctgaattgggtggtttccatagcatgtgcacggggtttgggtggaatgcctacagaatcgactgtgtcaagctttcttgattccgtagaaacatgttttgtttgacctcatcatagaggatctccgcttttatcgtacaaagattgtgatatgttcttagcttctttctacctgaataagaggatttctgcagacccttttccttaaaagactttctgtgaaaaaaaaaaaaaaaaaaaaaaaaaaaancacaaaaaaaaaaaaaaaa

SEQ ID NO: 7112 - DNA, 820 bp, Zea mays
  misc_feature (597)..(597): n is a, c, g, or t
  misc_feature (656)..(656): n is a, c, g, or t
  misc_feature (663)..(663): n is a, c, g, or t
  misc_feature (772)..(772): n is a, c, g, or t
ccggaccaaatactcctctctccacttaacgagcaccaccagttccttgttcggtcggaacgcagcgcagcggcggggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttngagaagtaccctgaactcaggaagaagtttgacgatgaaatccgtaacgataactgggngatattngaagagattggagagaactcttatgatgccattttccatgtccgtgaagaaccaataattttcctgtgcctgggaaattgggtggtttccatagcatgtgaacgggggnttttggggtggaatgcctacagaatcgactgtgtcaagctttcttgat

SEQ ID NO: 7113 - DNA, 689 bp, Zea mays
cgggatggccaagttgctcgtcaccgacgaggcgcgcaaggaatcggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgatgatgaaatccgtaacgataactggggatattgaagagattggagagaactcttatgatgccatttccatgtccgtgaagaaccaataagtttcctgtggcctgaattgggtggtttccatagcatgtgcacggggtttgggtggaatgcctacagatcgactgtgtcaagctttcttgattccgtagaaacatgttttgtttgacctcatcatagaggatctccccttttatcgtacaaagattgtgatatgttcttagcttctttctacttgaataagaggatttctgcagacccttttcctctaaaaaaaaaaaaaaaaaagcggccaaaaaaaaaaaatatgttggatgtgtggaaaaaaaaaaaaaaaaaaggccccta

SEQ ID NO: 7114 - DNA, 2144 bp, Zea mays
cggacgcgtggcgagcaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaacgcaagtatgtcggggtgctgctgccgtcctcaattatagaatctaaaaggcgcgttttctgtgaacatcaaggatattctaaagtgtttgttgtactctgttgattatcttttttgcaatgtgaaaagttttctggtctgttgattttcaagctactttctagtttctgtctaaagattcatactcatggatatcccatatatctctgattctcagataccaatgtgtttttggtctgagcatctggtataacaattgccccagtgtttgtaaaactatactgttagatggacaagttattatatgtacccccattagtatttctattggatacttgtgttgccatatggtagcattttttttactacaagctatggaaatgtaaggctatgtatcataccttggtctattaagaatacgttactctgtacacatacacctcagtttgttgcgatggatgccctacactagtccttggtatatttgctatagtgtgcctgtttggcagacctacgctctatgattctatagatctgttagccgattctctagtagagtgattccctagcaagcgtgcatctatgtgacgaaaaatgtttcacaaatagtctacgaagtgattcctgaggggtcggagagtgtggatcaggttgggagcggtggggagcagtttttttttttggctcccactatagtacaaaacagagactagattcactcagctcccaccatggagcagttcagttttttttcgtttggctgcgcagaagtgattctcgctgggagcagagctgcgggagctttgccaaatgcttccctgaatgtacttcacacgatgattgttggtcctgtgtatgccatttttttctatataattctgttctctttgtccactttctgaggtagtaaacttgaaataaatgcaggcatcgagatcccgaagtacgtcgacacagttactccccagtacaagccaaagtttgatgctgtggtcagcagctgttgctctcacacttttgtatttttaagtttattgcctgaaaatctattctgttttttgtgttttctatcttgagttgctctaccaacatttcctagatgagtgcatccaatttttttagttcccgtattaactccttaccttattgctgatgtgcttctttttggttcttatatttatgttacctgtagattgctgaattaaaggaggctgagaaagagcatcagaaggagtcagaaaggatagagaaggaacttgctgaaatggaggaaatgagggtaggggatattcttcagtgttcatataattccatttccagaatcattagcatttatcgtcatttttaaagacaccgtaccctttcgctttaatatcttgtttatgtgtacagaaaaagatcagtacaatgacagcagatgattactttgagaagtaccctgaactcaggaagaagtttgacgatgaaatccgtaacgataactggggatattgaagagattggagagaactcttatgatgccatttccatgtccgtgaagaaccaataattttcctgtgccctgaattgggtggtttccatagcatgtgcacggggtttgggtggaatgcctacagaatcgactgtgtcaagctttcttgattccgtagaaacatgttttgtttgacctcatcatagaggatctccgcttttatcgtacaaagattgtgatatgttcttagcttctttctacctgaataagaggatttctgcag

SEQ ID NO: 7115 - DNA, 1067 bp, Zea mays
cctcgaggccggccggggtacttgcgctctcgactctaagcttatcctttgttccgtactgctcgtctgctccccgttcacccctctccctctctctctctctctctctctctccactttcctttcctggcagcgacgagtgacgacagtggcaggcgggcgggcgggcgagcgtcgacggcgttctctaggtcttcgttgtccccttcaccggcggctgccaacgccctttgccaggtcttcgttgtcaccttcgccggcgactgtcacggccccttcgccagctcttcgtctgccccttccccggtaccgggactgaagataagatggctgccttgccattggccaccgcagaagcatgtgatgctaatgctgctttaattatgaatggtgatcttcgttctctccaacctatcttccaaatctatggaggccggcagatttttgctggccctgttgtgacactgaagatctttgaggataacgttctgctccgcgagttccttgaggagaaaggtcacggcagggtcctggtggttgatgccggtgggagcatgcgttgtgcagttttgggtggcaaccttgcccagctgatgcagaacaatgggtgggctggaatcgttgtcaatggctgcatcagagatgtcgacgagataaatggctgcgacgttggtgtccgggctctgaattcacaccctatgaagtctaacaagaagggcgtcggtgagaagcatgtccctgtgacctttgcagggacaagaatctgcgatggagaatggctctatgccgattccgatggcattctcatctcaagatcagaattgagtgtgtaggcctgttcttatgttatgtgtgaacttgtaataatgtatagctgaattacatgactagcgggaatactttggacgttttgtcagtatcgtttggaatatattcctttgaaaattattgcatcaggcatgtgaattgtgactaaactgtgtacctcaccatatcgtttgggagatacaccttttgaaaatcattgcatctggcacgcgctctccgtcttcaccgggtatctcacc

SEQ ID NO: 7116 - DNA, 2411 bp, Zea mays
ttttttttttttttttgcgagctgctaggtgtacagttggatttggatgactttcttctgtgtcgatcgcggtgtcactgctatttgtagaagaggagtgtgtagaagagctggttccaggtgtccgggaggccgggaaggcaccagtggctgcagtcaacggagccggcgccggggttggcgcgctgcgccggcgagaagtcgccgctgtatgccgacgggtgcgcgtccttccgcatcgccgacagcgccgtgatgtcgaggagacggacggggctcttcatgccccgcagcacggcctggatcacctggtcctggcccgaggcctggccggtcgagttgagcccggtcgccggtgccgtctcgccgtagcagttcttcgacaccgggttgggccattccttcgagctgtagtgcgtgggcgacatggactggaagaagacacgggtcttggcttgatcgaggttgaggtccacccagctggcccaggtggtgaggccgcgctggaacgccacagtgcggtccatgtcctcgtagtatcgcccagactcgcccatgtagtcccacccctgcatcgagctggtgtgcgtccaccagtggccggagttgaaggagagcacgtcggcgtcgcgccacgactcggcgttctcggagatgtcgtccagcatcagcacccgcttcccctggaccacgtcgatgtccaccaggtacggcgcgcggtagaaggataccgtcacctggtactccaggaacttgtaagtgtacaaagggtccgcggagacgagctgcgccggcgactgcggcgccgcggcgtgcagcaggcagacgagcgactcccactggttgcgccccagcgagtcgcccacgaacatcaccgtcttccccttcatccgcgtcaggaagtccgcgccatcgaacctcggtagctcgcagccggccggcttccagaggtaccggaggtagtcggagtccgggcggccgtagagctggcagttgaactccgcgtcgatgagcgggcagttgtacccggtgtacgccgccgaggccgagctaccgccgtcgaggacccagctgccgctgaagacgtcgcagccgccggcggccagcccgggcgtggcatcgtgccggtggcgccgcgccaggccgacggagagcgcagaggctgccgggagagagaaggcgtggagcaggacgaggacggaggaggacaacgcgacgacgccgaggacggcactcttcctgcgggacggcagcatcgtggcaaaacaaaagagaggagaacggaagcaaagccgcctttctgatcgccccttttatgctgctgctcggttaatcgtgtaatcacgagtccagaatccagatagccgcgagtaatctatctagctgcgctaattctcaggagttcgattgaagaggaggtgtgcatgtgagggtaagaattgccgctagaccccgactggagttcacgtgagcgtgttcgagatctcgtaagtagtttgcacccgtatggaatccgtggattcgttgccttgcccggtttgcccttcggcgtacgtcggtgtaggaacatccaaagattcgcagcccatggaattcgtgctttcttggaaatggaacatactttgcatatctcgttttcaaaggggccaactagatagatggccatatgttattacggtttccatttatatctgagtatatagagtatataccacgaaaacacatgtgttttgttggtttattcttatcccatgttcagttattcctatctcatttggattgcatgatattagaaaaaattttataaaagtttttgacttgttcggaactgaaactcattcaatctcatccaattcatatgaattgagaccaaaacatttaagcccttaggtgggtgtgaatgctgatttgaagccaataaccacggttcgaattcttatttgtgcatagttttagctttttaaatgtggaggtgttgaatttatgatccaaattctgaagaaggctgcaggagatcgtcacctcattgtaaatctcttgtgatatgtaatcacccaaaaaatagtgatattgttactggccggcgaccgtggtttttttttcttcgctttggaggagttttccacgttaaatctgtgtcttctctgtttttgatctactttgcgtcgtattgattcataacaggaggagcacgaaaaagttaacataatagaagaggatgttactacggtttccatttatatttaactatatagtataaaacataaagacatatgtgttttattggctagatgggtttagagtaaacaatcatggttcaaatcacaattgatgcatcatctataacatatggtccaaccgaatcagccagcggtcccgccagtttaaccagctcactataccgtaaaagg

SEQ ID NO: 7117 - DNA, 6349 bp, Zea mays
ggatatacatggatatagaatacattgcatatctattctaataaggtgttcaaatcatgcgctacagtttagcacgtctaaaagaatcttgtcacttttttactagtcaatgatgagggagacctacatagtagaagaaaaattttatcacaattgtttttagactgtcaccggggggagaggatccccacctgattttcattccggtctttttgcccaaagcggctagagtttacagcaagctagcagcattgtagctagcatagttacaggggggggcgaagcaatgatgagattacataataggattagaaaacaccaacaaccaagcacctaatacttgtgcctctttcctgttgtgcctgtacgcccaagcttttgcttcagaagcgcattttatcacaattgtggctacaaatcaaacacatgctaacttagtcaaatttgtccaattttaggcgtgacaaactatgataagcgagacaacatatacactcgcgacatgatactcagggtacgaagttttgagtcatagcagtgaacgcaggggcgaagccagaatttgagtttgaggggggtaaatcagattgaggaggctgttaaaaggtattttatattatttacatggtgattagctaaaaaagtagtagttcctatgaaatttggggaggattaggggggacgttgcccccctctgcccctccctggaatcgcccctgagtgaacgagttttcatgtatgcttttcacacgaaatcgaagaatttttggtggtaataaagagaccaccgaaagttaactgttacagatccgttaaaatgttaagttatttgataatgtcataatagtgagtaaacatctatgttaaaatggtttcatgacaaattataaaatgtggttgtttcgctgtgagaaatacaccagcatagattaggggttgcgtcttcgataatccacgccatgggatacattattcatcttaggattttgcacctgcttagttgagcttattacttgctgtaattacatttttgcttgtgctttattagtgtggctgtactattcctaaagtagcttagattagttgataaggtttgtctccaggtcgcaaaaagctctatggatttggatagtaattagagaacaacttaaatggacacatgctattagttgttttaatttatctagtgtagtttttaagtaaaatcatttattaagcttttagcgcacgatccattttacctctctaatagcttgttcggttaaaataaattaaaggagattaaatatcttgccagtcaaaattaaataaaaacatatttgatccctcttaatactcttcgatcactatgcaaccgaagagaatctaatatatagggttcaagaccccattttccacgattcaagaataggtgatgatgggaatgataaaattcgtgctaggtcgttgtattgggcattcattcttagattagatgtgctttgagtaagaactaaagcaaatgttggttgttgtacgagttcagccagactccatgtgttctgcatctggccaacctatatgacgggagatgctccctagctgcgttctaacagagcctggttgaggtgtgccttttgcatgccgtgaaatgatatactaactaaacataggatgctttaagactccacggatgcagctgcatgagaatagcatggaatcaaacacacggttagtaaatagattgttgcagccccacttttgggttaaacaaagtaacactcttttcaattcagttgcaaagctaatactacatcacaaaacatagtatcaaatatgcattctgtatatttgcaaaaaaaaacactatttatgtagaagctctactttggcgccctgaaacaaagagaagttaaaatgcacggcgtgagcaagtatgagacttgtttttctttaaaagcacgacaagagaattatcgtggctgaaatatattatatagggaaaaaaccacctacaaaaaaggacaagaaaaaaaaggggaggaggaggacaaccaaagccacccaccccaaaaacaaaacgacacacagacaaaaaaaaaatacacacactagcactccatccctgcagcagaccgttgatagaaaatgatctatttgatgaggtgtggaactgccggaacttacttctccaaattctggaaagtttttctatttctgtctttccaaatcttccaccagacatagatcatggggccgtcagaacctacactcatgcttcacaacttttagccgaatatttccccaccatttatacaatccttgtcggtccacgctatggagagcattaagatcgaaccaagggagtaaaaggttcaaaacatccttggtgaacacaaagtctttgaacagatggtcaatattttcgggcttttgcccacatagcttgcaaattggggcatgcaaccaaccccggcgcaacaaattgtttggcacgagaattttctaatgcagcaaagtccataagaaacgatatttaagttctgtttttgccctccaaattggcaggagcctaagcctagacagattgctctgggcaaggtaagcgcttttaatagtatacacgtcgtcatccggactccggagtccacctccaacttatatgggaagtatgacgtatggaaggttacgaaacttgccccaacttatatgtcagtgcgtgcattcctttaatccttttgtgtataacccttagattcgtaagtagccaagggtacgtagcttgttgcatgcaaagcagaagatctactatctattgcgaaaaatggggcgtccagtacaattgtgcaaatgccatgtacgttcaattgatgccgagattgtacgttcttcacttttatttaaacgttatcgacgcatttctcccgccaactaattgtgtatactcctgtgatgcaacgacgtcacaatagttttacacacaaacacaacgaaaaaaaacgaatggctggcgagctgctaggtgtacagttggatttggatgactttcttctgtgtcgatcgcggtgtcactgctatttgtagaagaggagtgtgtagaagagctggttccaggtgtccgggaggccgggaaggcaccagtggctgcagtcaacggagccggcgccggggttggcgcgctgcgccggcgagaagtcgccgctgtatgccgacgggtgcgcgtccttccgcatcgccgacagcgccgtgatgtcgaggagacggacggggctcttcatgccccgcagcacggcctggatcacctggtcctggcccgaggcctggccggtcgagttgagcccggtcgccggtgccgtctcgccgtagcagttcttcgacaccgggttgggccattccttcgagctggtacagcgcacagtcgcacacacagcacaaaatggccgaaataaaaggcgatgaacgaactgatcgaataaaaaaaaaagacacgacaggacacgtgcctgaacatgcgtatgcgcgtccggacaaggacgccgctgggctcgtggagtcacgggtgagatgagaatagtacctgtagtgcgtgggcgacatggactggaagaagacacgggtcttggcttgatcgaggttgaggctccacccggctggcccaggtggtgaggccgcgctggaacgccaccgtgcggtccatgtcctcgtagtatcgcccagactcgcccatgtagtcccacctgcatccaccgaccaccaagcacactctcactacagaccggaggggattgccatgtgcagttctactctaccgtccgtacccctgcatcgagccggtgtgcgtccaccagtggccggagttgaaggagagcacgtcggcgtcgcgccacgactcggcgttctcggagatgtcgtccagcatcagcacccgcttcccctggaccacgtcgatgtccaccaggtacggcgcgcggtagaaggataccgtcacctggtactcctgctcgatcgagcaacgtgtttagattagattagattaggccccatctcttcggccaagcagcctagctggtacatgtgtttacacatgacataccaggaacttgtaggtgtacaaagggtccgcggagacgagctgcgccggcgactgcggcgcggcggcgtgcagcaggcagacgagcgactcccactggttgcgccccagcgagtcgcccacgaacatcaccgtcttccccttcatccgcgtcaggaagtccgcgccgccgcgcctgatgtcacgttgtcccagcggcgccgcggccggcgtcacgccaagcggatggtcacccacgccacgtccccagaccggtgtggcacgccggcgcccacagcgtcgatgaggaggaggtcggagcagcagtagccgtcatgggcagtgccgcagatgtggagcagtcgaatgagaggctagacgggctggagcatcacagcaggctggtgtcgctgttggccggtagccgctcctcccccaccggcaccggggggggcttgtgacccaaggatctgttcccgggggatgtggtgtttgcgctcgtcgatgatctcgggctcaaccactccaaggacccatatgccatggggttatgcaatccaaaggtctccatcgccgatttcattttgtagacaaataagttagctcttctgatgacataccatttatagattgccaacgatctgaaggcatatatgaaggcttgttatctcttctgtgtttaattgatcagtgactttgatttggacctggttatcagcttgttatttctatctgaattttctcgctttatttgtactacactcgtgttaattatgtgagaatgatttgtgtcactatggtgttcatctgttattttatactattatatgtattcatctgtcatgttgctgaactcctgttgtcaattgcagaaggaaattcctgcttgagccaattatagaaggccctgatatttgtcaaattgatggttgtagtgttaaattggaatacaagaggaggcaagtcaaatatggtttgtgtgacagcacgttactaacttactctactatatctgcatgagaaaggatgaaccctgtttgcatgtatactaattaatctacggattcattaatgtgtgaataagattttatttaattatgacagcaaacgtgacatgccattacaatttcgtttatgcaaaaaagtaagttgcttacagtttagcctttggtttcaatttgcactttatagaattatactggcagaaaataatagttctctttttcatagcagaactatagtaaacatctgcctgccgctgattttcttagccaactttaaaaaatctggtttactatttttttatgtgtactcatgttaccttggcagattactgggttaacgaacaactcatattttgatggagcacatgaggttcgacattatgtcaggaagcattcggatcttggtcgtattgtgcttgaagttgctaaggtatataatgaatgtcatgaaggattgttttctcttaatcccatattgtgtgagatactaaatatatgtcctgaaaacaacttacgtgcaggactcgcaaatccccggccaagcaaactgctagaaatcttttcagaggtggagatgatgaagatgatagtgctgatgccgacacaaatgatcctgctgttcctcggtaactccactttattcccagccctttagagatgatatgaccatcttcgttcggccattttcccagcactggtctataccgcaggtcgatgcataaacaactgccttagaaaaacatagttttgaaggataaaactgaagattaggaatgacaacttaaacagtcatcatagctaacaactgaagatgtaactgtgttgatccaaactgttttacatctgattaaatctacagaaaaaatattcttcttctttggacgagagagagtgtattttgtagtcactctaagcttacaactgtcttcgatccatcacattgaattgtcgttgaagattctgccaggataaacagtggccctgcctttttaactataataataatgtcggttagtacatttgactcttgtgccttgtcccctgccgacgctgcagtgctttgctagattagtaaagattactcttaccaccagatgtggagcctaaccggttggtagggataccaatggtgctcctctgttagtccatcatgcacctgaattctataacagtatatgaatgtcttttaatctgcaggtcattaggtagagtaggagttgggcatatggtgtacatctccggtttgacttgtgccttgagttcaacaaatatgtaagaagcattttcctttatgtta

SEQ ID NO: 7118 - DNA, 801 bp, Zea mays
  misc_feature (22)..(22): n is a, c, g, or t
  misc_feature (764)..(764): n is a, c, g, or t
gcgtccggccagtgggggctcnaaggccgagggaggtttggtaagcggcgggtgccgggccgcccgcgccggtccgagcgcccgcactctcaccagtcaccaccccctcccctcttccgtctgtcccccgcttgccgccaccgccgctgcccgctcgcgatccttcccctttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgccccggacggtcgatggcgcgggtggcgctccggttgggcgcccgcgcgctcgcggttctcgtcctcgtgtcagtggctctgcttccacttgtcagttccgacgatggacacaaacactgcgagggtgttgtcaggggctgggcggattcctccacggggcgcgtgaaggacggggacaaactgagcctcaaggatttgctcttcttcctccacattcctaggactggaggccgcacctactttcactgcttcctaaaaaagctgtatacaaatgcgcaggaatgcccgcgttcttatgacaaactacggttcgacccaagccatcctgattgcaagctggttgttagtcatgatgactatagcttaacttccaagctgccaagggagagaacatctgctgtctcccctctaaggcacccagttgaccgtgcatttagcacatatgagttttcagntggaggtgcagctagattcctggtcacccaaacttac

SEQ ID NO: 7119 - DNA, 1928 bp, Zea mays
cttcctaaagaagctgtgtacaaatgcgcaggaatgccctacatctgtatgacaaactacggatcgacccaacccatcccgttggcaagctggctgttagtcatgatgactatagcttaacttccaagctgccaagggagagaacatctgttgtaacaatactaaggaacccagttgaccgtgtatttagcacatatgagttttcagttgaagttgcagctagattccttgttcacccaaacttaacttctgcaaagttaatgactacccgtgtgttaaaaaagtctcgtgctgtcagtactttggacatctggccttggaagtacttggttccttggatgagagaagatctgttttccaggagagatgccaggggtatcgacaaagttcatagtagtaagaaggttaatgcatatgatgtggaggatatggttatgccgttacatcagtacatcaatgatccagttgcccatgagatcattcataatggggctacctttcagattactgggttaacgaacaattcatactttgatggagcacatgaggttcgacattgtgccagaaagcatccagatcttggtcgtattgtgcttgaagttgctaagaataggctggaccagatgctgtatgtaggacttacagaggatcatgaagagtcagcgaggttgtttgctcatatggtaggagcacaggtgcttttacaatctgggacattgagtttggatctcaaggaagatctgcacagtgagactgactcacacccatccatggtggagcccggggatgaagaagcaagcgaacatctgaataacacacatggttggcaaaataatgaagccctgaactctaccagcgacgaacaaggaaaaggaaatatgactgtgggtaaactgatggaagcttatgaaacttgcatcgctaaactgcggaagtcccaatctagccgtcgtaaaatatcactaaagaaagtggaggaagcaaacttctcaaaagaggcacggaagctggtccccgaggcaattttgaaacaaattatctcgctgaacagccttgacatggaactttatgaccatgctaagaaaatctttacccaggaacatctgatgctgaaagctcagcaatccatggcggggcagcacagacagttggcggaacaagaggagggctggatcggcacgatgtgcagcgacgggacttgctctccctgggtggtggtcttgctgggtctagggatcaccacgatcctagttttggccacattagctgtaacgacgagaaaaagaacgtctaaacttaaggtttaaccagaacttttcatgagacaggtctctagattttggtgtacagtctgatgaatgccccttagcaatctttcggggcagaggtgctagcgtgcgcagaatcatcatgtactaactcgtgcggtcgtactggtatcttcacacaatttgagatgccgcggtggtagtgtggacgtgtagtctaaattgccactccataagaaaaaagcagcgacgttgtgcgaaccaaaggaaacgacgagtctcgtgggacacctacgcttcaacttacacatgttcttcctgcctgatgagaaggtaggaaggcgtggtatgtcgttgtcgtcgagttgcagatacgcatcctggctggccaagaacccgacccaaaacccttccaaaggtaatgcaattaataaggcgtggggtgccccccaaagtaagcgtggtatcgcccccctggattctgtcctttccggtcttctctaaaagattttatcccctatatctattttctctccaacaacatcctttaaatcacgtcttctatatgtaaatatctatattaaagatattttttaatttttaaattttgtacatacatgtttgtcgtactctcaaatatattgtacatattttagtttt

SEQ ID NO: 7120 - DNA, 2387 bp, Zea mays
  misc_feature (173)..(173): n is a, c, g, or t
cttgctcctcctggactagggttcatggatcccgacaccgccgtggcctccgcagacggggggccattcctagagttcgtagactatgccatctccatgctctcctcgtccgctggcgacggcgatggctatgagtctccgggggacgggccggcgccggcgcggccgccctnggggtgggcggtggcgcagctgctcaagtcctgctgcgcctactccagcggcgtcaccgccgccatccttctctccgacctcttccaatcttggacagaacagcggaaatccctgaccctgaagaggaaggtcaagctgcccaaacttataaacacgaagaataagaggaggaggcttccaaatactgtcacgatcgattctatccacgagaagaacttcctttctcccaatagtgtccttgaagttgttgtcattgccgtgtttgtccttcctggtacaaacatatacatgcttaccttgggagacatgtggagcgcatccacaatcgacatatatctacaccgaaggtactatgactgcataggacaaaatggtatattgaagaagggtcgagaagttatgctcacaggatgttgtcttcgtacagccatggagggatctggccatgctcgtattttgccaacagaatacatggtgatgggactggatgaggaacaagatgaagatgccttgctacttgctgcacaattttgcaactattcattctcttctttgattctagaggaaagtagaaacaatgttccgtactcattttatgccaggattgaaaagattgagtccttggaaccatttagatgcgcagaaagaatgcagataattcttgaagacaatgacaatgcgaagatgaagttagttttatggggagagcagacttcacttgcaaatctgtgcagtgtagggagcatgcttgcactggacagacctttcatagcaaattttatagacaataatcatgaggattctcaggaactgtgccttgaatatggcagtgcaacacaggtttacatggtgccaatcgctcaacaagaggaacaggtgccttttacacctacccaagtaaagagccaaggacctcggctgtcatgtgttctgactgataatgtagcttcgcaagtaacattaccacgtgatttgtatggttcagttgatttcagcaaatacccgtttcgagcatatgtaagtgaccttcatgataaaatggtgggaatcagtctgtttggtaccgtaactagtgtttgcaaagtaagcacatcagggactacgttctatttggagttggaagacacaacaggagttgttctgatgaagcttatctttgttggaccctggtcattaggtagagtaggagttgggcatatggtgtacatctccggtttgacttgtgccttgagttcaacaaatatccttgaagtctcatggcgtgaaaaggagccagggtctctgtttgttaacttaagcttgctgccagcactcctaaactcatcgtgcctgcataatttatcacccttgtcagatcttccccgttcgacaaacagaacacatatatcccatgttcggttagatggcatcgattgtgacagtttaaaggtgtcgctgttccacaacatttgcggcagtgttgtgaatgaacattcaggtgtactccagtgttcattctgtaagtgtgcctgcgaaagtgtatgtgcgcgtggctttcagctgcacttgaccatcgcagacgacagtgcggatgtcttggcttggtgcgttgggcaaacggctgtcgagttccttcagatatctcctgacgaatacctggagctccccgaggatgaacgggcaatgtatctctacactctccagaacgaaagctttgtggtggctatcgcgaataccaggaagcgagtcgatggatgtgctgtgggtgatgaagccgtcccagcttgggagatcacgagagcccagaaatgcgaatgagttcgtatagcgctcgagaaagaaatgctgatgctgaaaagttactgtaacacgtgtttcaacctccgtttttcatcaaccaattcgtcgttcagcaatgcagccatatgcatgagttgtccattgactccaaatgatgctttagcacgacggttaggatgggtttttcgttgacaaagtccgaaagtaaaatgtcgacgaaggcatagcgtttaactttaagatgggttcactactaaaaaatttcggttgttcttcattcatgttgacaataggttatttgcttggcaacatagtcagccgagttcagatttatctgaaactgtgccttttacatctagggacttgtacccagcaaacaaacgttgcagtgctttgctggctacgttttcaaaggacagttgcttgtaactgcc

SEQ ID NO: 7121 - DNA, 653 bp, Zea mays
aaacaacgccgcgacgagaagagagaagagggcgggcatcggccagtgggggctcggaggccgagggaggcgaggaaagcggcgggtgccgggccgcccgcgccggtgccgaggccctcaccagtcaccaccccctcccctcttccgtctgtcccccgcttgccgccaccgccgctgcctgctcgcgacccttcccccttttaacgctcccgcggccccgcgtcgtgctcccttttgtcgccgctgccttcgtgcccgtactcgcgggttctcctcgctcctcaatctccgcgcctgggcgcggcgttcgccgccggatctgggcgcgggacggtgccccggacggtcgatggcgcgggtggcgctccggttgggcgcccgcgcgctcgcggttctcgtcctcgtgtcagtggctctgcttccacttgtcagttccgacgatggacacaaacactgcgagggtgttgtcaggggctgggcggattcctccacggggcgcgtgaaggacggggacaaactgagccctcaaggatttgctcttcttcctccacattcctaggactggagggcgcacctactttcactggaatgcccgcggttcttatgacaaactacgggttcgacccaagcccatcttggatggccagctggtt

SEQ ID NO: 7122 - DNA, 1952 bp, Zea mays
aattcggcacgagggagaggagagcagagggcagtgggggggctcggagaccgagggaggcgaggaaagcggcgggtgccgggccgcccgcgccggtgccgaggtcctcgagtcgaccccttacgtctgtcccccgcttgccgccacccgctcgtggtccttccgtttccgtttcctcccccgcatccctttttaacgctcgtcgtcctccaggccggccccgctgtgttcgtgtctctcctcgctccccgatcgctgcccctgggcgccgcgttcgccgccggatctgggcgcgcgacggtgccccagacgaaccgatggcgcgggcggcgcttcgattgggcgtgcgcgcgctcgcgctcctcgtcctcgtgtcagtggctctgcttccacttgtcagttccgacgatgggtacagacactgcgagggtgtcgtcaggggctgggcggatgcctcgtctgggcgcgtgaaggacggggacaaactgagcctcaaggatttgctcttcttcctccacattcctaggactggaggccgcacctactttcactgcttcctcaaaaagctgtatacgaacgcgcaggaatgcccgcgttcttacgacaaactacggttcgatccaagccatcctgattgcaagctggttgttagtcatgatgactatagcttaacttccaagctgccaagggagagaacttctgttgtaacgatactaagaaacccagttgatcgtgtatttagcacatatgagttctcagttgaagttgcagctagattccttgtgcatccaaacttaacttctgcaaagttaatgactacccgtgtgttaacaaagtctcgtgctgtcagtactttggacatctggccttggaagtacttggttccatggatgagggaagatctgtttgcaaggagagatgccaggggtgtttacaaagttcatagtagtaagaaggttaatgcatatgatgtggacgatatggttatgccattacatcggtacatcaatgatccagttgcccatgaaatcattcataatggggctacctttcagattactgggttaacgaacaactcatattttgatggagcacatgaggttcgacattgtgtcaggaagcatccagatcttggtcgtattgtgcttgaagttgctaagaataggctggaccagatgctatatgtaggacttacggaggatcatgaagaatcagcgaggttgtttgctcatatggtaggagcacaggtgctttcacaatctgggacattgactttagatctcaaggaagatctgcccattgagactgattctcacccatccatggagcctgaggacgaagaaacaaacggacatctgaatagcacacatggttggcagaataatgaagcgatgaactctaccaacgacgaacatggaaaaggaaatatgactgttggtaaactgatggaagcttatgaaacttgcattgccaaactgtggaaatctcaatctggccgacgtaaaatatccctaaagaaagttcaggaagcgaacttttcaaaagaggcacggaagctggtatctgaggcaattctgaaccaaatcatctcattgaacagacttgatatggaactttatgaccatgctaagaaaatttttactcaggaacatctgatgctaaaagctcagcaatccatggtggggcagcacagacagtttggagaacaaaagggttggatcggcgcaatgtgcggcgacgggatttgccctccttggatggtggtcttggttgttctagggatctccacgatcatagttttggtcacattagctgtaacgacgagaaaaagaacgtctaaacttaaggtttaaccggaattcatgaggcagtctatagattttgatgtatagcctgggacaaaaaaaaaaaaaaaagagcaactccaataagtataataaaatatagctcct

SEQ ID NO: 7123 - DNA, 2653 bp, Zea mays
gcacgagaccattacctagaacatcctaatcgaaaaagcctacacgcccccgcctcctgccctctgtccacatcctcgcctctccccactagttcgctcgcgtgatggtggtgcgggagcagcggaacaagggttcgtcgtcggccaccctgtgacaccccgcccacgcccccgcggcggaacctgcaaacccggaggccggagctccgacttcgtcggccatcgaccgcgtctgatcggcgctgggacctgccgtccggacgaaatcggtcagcatgacggggcccaatgagaaggcggcggcgggaggcgggggtggcgagaggcgcaagtacccgatccacgtggaggactacgagctgtacgaggagatcgggcagggcgtcagcgccatcgtgtaccgcgcactctgcaagccactcgacgagatcgtcgccgtcaaggtggtcgacttcgagcgcaccaacagcgacctgaacaacatcgttcgtgaagctcagacaatgattttgatagaccatcctaacgttgtcaaggcgcattgttcatttgcaaaagaccaaacgttatgggtggttatgccgtatatggctggggggtcctgtcttcacataatgaaatcagtgcatcctactggattcgaggaacccatcatcgcgactatacttcgtgaagtcctgaaaggtttagagtatcttcaccatcatggctctatacatcgagatgtgaaggcaggaaatattctagtcgattctcggggtggaattaaacttggggactttggagtctctgcttgcctttttgattctggtgatagacagagggccaggaatacttttgtgggaacaccttgctggatggcgcccgaggttatggagcaactacatggatatgatttcagagcagacatatggtcctttggaattactgcacttgaaacttgctcatggtcatgctcctttctctaagtaccctcccatgaaggtcttgctcatgacacttcagaatgctcctccaggtcttgactatgaaagagataagaaattcacgaggaacttcaagcaaatggttgctatgtgtttggtaaaagacccttcaaagaggccttcggcaaaaaagttgttgaagcaaccatttttcaagcaagctcgttccactgattttattgcacgaaagcttttagaaggattgcctggccttggtgttagatatcaagctttgaaggaaaaggatcaacatttaatggctcaaaagaaaatgtctgatggaaagaaagaagaaatctcgcaggatgaatacaaaaggggtatcagcagctggacctttgacatggatgacctgagatctcaagcttcattgggcacagaatgtgaagacagtaccttatgcaaagattcagatatatctttctatgacttggacagtttacaggatcaagcaccagaagggccacacttgttgagagatttctcaacgaagtatgatgctgacattgaaaatgatatgacaaccaaagataagtcagccgtttcatctcctgatcagcctgctagcttagtgaggaatgcttctatgcgtgggatgcccataaacggttctttcaggaaagacaactctacagaaagcttcgatttggaatgtcaagagaaacatctggacattgttccgactagctcatcccctgaaaggaagttttcttttagttcttgctcatcaaatgggctccttttgtccaaagagagctctaaacagcaaactagcatccacaaccttgacaagtgtaatggagggcatttgcatgtatcagatgaaacatcttctgaagctgctcctaagacacataaatcagcagaggaccatgatgatagatccaaacctccacttataagaggtcgatttagagttatacctgggcatgttgactcaaaggctcaaccacctggcctacagaagtgtcacagcatgcagacaatttctcgccttccatcattaagtataccctcttccgcagaagttgcatcaaccattattggtggctccttctacatgcagctatatagtattctacagacaaatatgcttcagagggaccaaatacttaacgcgatgaagcaggtgagtggttgtgctatggcttcaccaggcgtaccttctatggcttcaccgtgtatcccttccacaagtcgctcgacatctccatcaggtgtaccatcagttgacagatccatgctggaagctgcacaagaaagggagaaagagctgctgaatgaggtcttggagctgcaatggcggttattgtgcacacaagatgaggttcagaagcttaaagcaaaggcagcgcagatctgatgctgaagctgttaagggagcattaagggcgcgtcatgataagatgatctgttcatgcggttttcaaatggctatttagcataggagagagatacaaaattaaggattggtgtatatttaaaaaggtgctagtgatgctcgagtgtccaatcctgtctaagcaggacattaatttcgtacaatctgtgtgtttgtgtttatgggtggcatggcgctgtgtttttgttggagcgcaattcccaggttgggacttgggaaagatagcttaacatgcctatgggttttaataaaaaaaaaaaaaaaa

SEQ ID NO: 7124 - DNA, 2199 bp, Zea mays
  misc_feature (2001)..(2001): n is a, c, g, or t
  misc_feature (2019)..(2019): n is a, c, g, or t
  misc_feature (2050)..(2050): n is a, c, g, or t
  misc_feature (2080)..(2080): n is a, c, g, or t
  misc_feature (2097)..(2097): n is a, c, g, or t
  misc_feature (2111)..(2111): n is a, c, g, or t
  misc_feature (2133)..(2133): n is a, c, g, or t
  misc_feature (2141)..(2142): n is a, c, g, or t
  misc_feature (2155)..(2155): n is a, c, g, or t
  misc_feature (2182)..(2182): n is a, c, g, or t
ctagattaaattaaaactgataatacctaattttctaataagagagagataaatttttatgggagacgatagagtttcatagggctacaactctatatatagagttacctagtttaaaatcggtgtgtggtagtattggccttagtcactgaaaccaaatagggggttagtgacttttagtcacgaaacacccttagctcagcaggttccaaaaattcaaatctcactcctaatcgggttcagctatttaaatatataactttcgttgtcttgaggccctctatgtaatgtgtgagattagagaattgagaaaaagagatcccatttgaatacccattattaaaatcatttaaatttccattcatccctctccatcgtcccttacacgccctgcatgcggcttggccacttgtttccaagcatctgcgtgtatgtcatgtcgtcacttgatcctcgtaagtcgtaacctacacggctccggctctccctgcgtggttctggaacattgtgccacttttcgtcgacgggacggccaccttgctcttgcctaccctaccctgcgcggcggcctggccatccacgtcggcggcaacgcccccatcgtatcaccggccagtttgccggtctgtgcgtgagatcctgcctcgctccacgtcgcgtgctgtactgcttatccatcctgctctgctctcgccggcctgcgcatgcgcctcaatcaccacaacctacggccgtgaatctcacgccgacgtggcctccgccgcggccgcccacctcgtcgtcacgggcgggcgagccacctctccccgaggctctagctccccacgcctataaaagccggcccttggggcccctcgaggccggcggggaaccaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccaccccaggcgcgcgtcgcgctttccctgtacggctgctgctccaggcatctgcgctcgcgccgcgccagcgcgccttggccgtgaccgtgagggcccagagcgacgacgccgaggccgagccaaaggaggaggcggcggcggccaccaccccggcgccaaagtccaaggcggcggcgacggcgagccccgggctgtgggacgcgctggcgttcagcggcccggctcccgagcgcatcaacggccgcctcgccatggtgggcttcgtgtcggcgctcgccgtcgaggcgtcccgcggcgggggcctcctctcgcaggccggcagcgggtccgggctcgcctggttcgcggccacggctgccgtgctgtccgtggcctcgctggtgccgctgctcaggggcgacagcgccgaggccaggagcggcgccgtcatgagcgccgacgccgagctctggaacggccgcttcgccatgctcggcctcgtcgcgctcgccttcactgagtacctcaccggcgcaccgttcatcaacgcgtagaggcggttcagtccaagccagtgcttatatattttggaagttggaactgtgtatgctagtcagctatagcggcaccatgcccgtagtaggagcctagctacagttggacgagctactttttattgggatttactagtcttgggccatttacttctcttcttattaaagtccactcataaatcagaaatccaattttatctgacgggaataagggcggaagacactagtcaaagttgtttaggctatccacactcgtacaaccctaaatttttactctaaaaataatattctatcctgaccagcgagtttctttactccataccacaattctccgcactcatatttactctatatctaaccctatccctgggaacacactacacgtcctccacgtggtccaaccaggcgggcgcggcatcggntgccgtcctcgtgcacanggatagagcagcaccgtacgagcggtaagantggcgtacgccgcggtgcatgcatttccangcgtttcaattccgtgnaggtatgccttggntaaatttgggggcttccatganggtggggnnttacattaaatcngttaaggtttaaatgattaatggattnttaaaaaaaaagggggc

SEQ ID NO: 7125 - DNA, 2041 bp, Zea mays
tcacgttccaactttattgtgtttaaacagtcgacggtatcgataagcttttttttttttttttttgtttcgttctgcagtctaaactgacaagcatttttcacaaccaccagagcaataataagcacgaagaaatcaaatgtactagaaagacagcaggttagcatgcaagatcacggtgtctgacgcatgcgccgcgaagttaaatgtgcaatcaaactctaaggaggtagatgctaagctccgggccgccattgccgccggtgctgctgtcagggttcatcatgtagaatgcctccgagtcgcgggagcccacgacgcgctcaaagcgagcgcgcatgtacatgacgtccccctcgccgccaccgcacgccgccggtatgacgcccgcgcccatagagacgggctccagcgcgcgcagcacgcgcaggtctgcggcaccgcactcgcgccgcaccgcgtacccgcagcccttgccgttgcagtacgcgcgccacgccttctcctcgaccagcttcctgcacccaccggcgccgccattggttgcggccgcggcgctcgggaaggcgcaggcgcccttggcgcggtcgcactctagcgcgatgcggacgaggcccgaggccatctcgcgcaccagcgacgccgtgggcgcggcgagctcgagcagcagcgcggggcacgcgcgcgggtccacctggaacgcgaggtgcacgtggccgcggcggcggccgtagagcgtgcccgtgatccgcgctccgagcccgacctgtcggtgccgtccggcgatggccgcggcaagcgccgcgcgcagccgggagaccgccgcgcggcacctcttgccccgctgcttcggtggaggtggcgccttgggattgggcggcggggatacgaagtcctccgagtggaacgacgggcagctggaggagaacgccatggtcgcctcgtcctcgtcggcgtcctccgcgcccttgccggagctgtcctccccgccgccggctgcggcgccatggctgctgctcttgacaagaaccggccacttgaagttcctccgggagaaggaggagtcgtgggggctcttcgccatgatggtcctcatggttcctggtgtgggactgtgggcgagggtggtattccaagtccgtggtctccgagtgcagtaggatgatggactatggaggcttcgtatactgcgagcgagattggtgagcagaacccaccaaactaagcagtgagcacatccacagtccacagaagcagacaggggagaagagagaagagaagcgcaaaagcttctcggctttgtcttgttcccaggctggctctgctcttgctctgatgtgctgtgttttcatgtagaaacggtagacaacaagctgcagattctggcaggctgtgactgtgagcagtgctaatccatttggcaaacaattttaccgttttcgttacacaatagatgatacttttaacctttagacatctactgatcttactaaagtattttagtaataataatatttataaaaattgaaataagacaaatagtcaaataaaacatctaaaaataaaatattatgtattttaagacggagggatagtgatgtgctgatggcaaatagacggcctagacatgtgacggcacgacccattagactcagttaataaattggaattggattgtgtcggaccagcgccagtgctatagtcagtccagacatgacacatcaatctagtaatcgtgtccggccggtcttgttagcacgcatgacctattataactggctgatattgtaaatatatataattataatttaaaaataatgaatataatcggtggcgtggttaagattttagcaatgggtggttcagttttattttttccacaatacaagtgcaacaatcgataaataggtatataataaaaaaaattcgccaaatataatatggttaaataaaaaggttgtacgatcattaacatattagaaatataaagtataaaactcatcggacatcttaaaataaaaaaatataaaaagttagcaaa

SEQ ID NO: 7126 - DNA, 1050 bp, Zea mays
cattgggtacctcgaggccggccggggtagcggtgagacgagccgtttaaataggtgtcaagtggaagtgcagtgatgtatgcagctgaggcatcctaacgaacgaacgatttgaacgcatacctcgaggccggccgggaacaccactacaactcgacaccgagaaaagcgcagcaaagcaacgcaaagcccacgccgctacagtgctctcttgcctgccgctacgagccaacgactcgaacgcatacactccaatggcagcgacggtgatggcctccatgagccccctcgcctccgccacccccggcgcgcgtcgcgctttccctgtacggctgctccaggcttctacactcgcgccgcgccggcgcgccttggccgtgagggcccagagcgacgacgccgagccaaaagaggaggtggcctcctcctcgccttctccgtccgccaccccggcgccaaagtccaaggcggcggcgacggcgagccccgggctgtgggacgcgctggcgttcagcggcccggctcccgagcgcatcaacggccggctcgccatggtgggcttcgtgtccgcgctcgccgtcgaggcgtcccgcggcgggggcctcctctcgcaggccggcagcgggtccgggctcgcctggttcgcggccacggctgccgtgctgtccgtggcgtcgctggtgccgctgctcaggggcgacagcgccgaggccaggagcggcgccgtcatgagcgccgacgccgagctctggaacggccgcttcgccatgctcggcctcgtcgcgctcgccttcactgagtacctcaccggcgcaccgttcatcaacgcgtagaggcggttcagtccaagccagtgcttatatattttgggaactgtgtatgctagcgggctagcggcaccatgcgcgtagtaggagcctagctacagttgaacgagctactttttattgggatttactagtcttgggccatttacttctcttcttattaaagtccactcataaatcagaaatccaattttacccgaaaaaaaaaaaaaaaaaagcggcc

SEQ ID NO: 7127 - DNA, 979 bp, Zea mays
cctcgaggccggccgggccggatccccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccaccccaggcgcgcgtcgcgctttccctgtacggctgctgctccaggcatctgcgctcgcgccgcgccagcgcgccttggccgtgaccgtgagggcccagagcgacgacgccgaggccgagccaaaggaggaggcggcggcggccaccaccccggcgccaaagtccaaggcggcggcgacggcgagccccgggctgtgggacgcgctggcgttcagcggcccggctcccgagcgcatcaacggccgcctcgccatggtgggcttcgtgtcggcgctcgccgtcgaggcgtcccgcggcgggggcctcctctcgcaggccggcagcgggtccgggctcgcctggttcgcggccacggctgccgtgctgtccgtggcctcgctggtgccgctgctcaggggcgacagcgccgaggccaggagcggcgccgtcatgagcgccgacgccgagctctggaacggccgcttcgccatgctcggcctcgtcgcgctcgccttcactgagtacctcaccggcgcaccgttcatcaacgcgtagatgtgttgtgtattttggaactgtgtatgctagtcaggcagtcagctagcggcaccatgcgcgtagtaggagcctagctacagttggacgagctactttttattgggatttactagtcttgggccatttacttctcttcttattaaagtccactcataaatcagaaatccaattttatctgacgtgataagttccgaattggatcgtaaaagtggtaatcgagccaattttatatattttattctctcc

SEQ ID NO: 7128 - DNA, 1004 bp, Zea mays
ttgggtacctcccggccggccggggaacaccacactacaactcgacaccgagaaaagcgcagcaaagcaacgcaaagcccacgccgctacagtgctacagcgagcgagcctcttgcctgccgctacgagccaacgactcgaacgcatacactccaatggcagcgacggtgatggcctccatgagccccctcgcctccgccaccccaggcgcgcgtcgcgctttccctgtacggctgctgctccaggcatctgcactcgcgccgcgccgtcgcgccttggccgtgaccgtgagggcccagagcgacgacgccgaggccgaggcaaaggaggaggcggcgccggccaccaccccggcgccaaagtccaaggcggcggcgacggcgagccccgggctgtgggacgcgctggcgttcagcggcccggctcccgagcgcatcaacggccgcctcgccatggtgggcttcgtgtcggcgctcgccgtcgaggcgtcccgcggcgggggcctcctctcgcaggccggcagcgggtccgggctcgcctggttcgcggccacggctgccgtgctgtccgtggcgtcgctggtgccgctgctcaggggcgacagcgccgaggccaggagcggcgccgtcatgagcgccgacgccgagctctggaacggccgcttcgccatgctcggcctcgtcgcgctcgccttcactgagtacctcaccggcgcaccgttcatcaacgcgtagatgtgttatatattttggaactgtgtatgctagtcagctagcggcaccatgcgcgtagtaggagcctagctacagttggacgagctactttttattgggatttactagtcttgggtcatttacttctctcttcttataaaagtccactcataaatcagaaatccaattttatctgacgtgataagttccgaattggatcgtaaaagtggtgatcgagccaattttatctattttactctctttgtcctagaatataattcgttttagact

SEQ ID NO: 7129 - DNA, 3489 bp, Zea mays
  misc_feature (1570)..(1570): n is a, c, g, or t
ctgcagacatgaacacactagagtgtcggcctagcgaggagcgcccgctgcacaggcgttccatcccccccgtaccacgagtgtccctggtccgggggaagcacggcactcgtagcactactagtctgtcgtggttcttcttgcgtcgtgaaacttggtttccgagacgggattcacgattcagatccaaagaaaatgcagcaaaaaaaaaacatgcacaaggactgccgaaaggacagtcagctgagctactgtacgtcagaccacagcacgtcggtatggggctatgggggatggtacaggcccactataaaagcagacagaatttgagtcttttgagagcaacatggtgacctgtcctgactgcccaacatgacgtcttttcgttccaaaactccatcgccaaaaacttttgcacgcagctggtttaaattacaagtcctaattatatactccacgaatcaatgtttaaactctacatgtaaatataaagatgattgctctataaaaatgtactgatacgagtgatgacaagcgccacagtgccagtagcatagagtaccatatggggtatttacctctatgactacttgactagagtatgcatcattaacacaagaattacactttacaatcaaaagaaaaagcgatttgcccgtatattttgagggaagcgaaggactccgtaaacactcttgcgcggcgctagctagcgtccaacaagaggatgctttttcttgaacaattggtatatgaggatatggagaggggaaactattggagaacgcactgaatgtgagggcaatcttttaaggagaaatgttaagattaaagaaatgttaaaatagaatagaaagtacatttaggaggagatgagcctgaaggcaacattaatacatatatcagggctaaggctatccacactcatacaaccctaaatttttactctaaaagaatattctatcctgttcagcgagattctttactctatatcacaattctccgcactcatatttactctgtatctaactctatccctgggaacacactacacgtcctccacgtggtccaaccaggcgggcgcggcatcggctgccgtcctcgtgcacagtggatagagcagcacccatacgagcgctaggagtggcgtaccggcgcggtgcatgtagtttccagttcccgctgcagtcccgctgcagcgtattgccttgcgctaaaactttagcgtgcccttcccagtgcatggctgcgggcagactaagtgccagctatgctacaatacgagacatactattgtttttttatcccatatgagcgctatacggaatcagttacatatacagtagattttaattggtatacgagcacaagagctacaaatcatatcacaggtgagcttaagaagttgacagtctaagataaatataaagagacagactaattataaagatgatgagtaaacagcgagataatttattaaacctaactaattcgtgattagcagatgttcgtataagcagatcacgaactaattaggctaataggtttgtgttgccgttcagttcttatntatttaattattttttataattaaaatataattaatactttaatctagcatcaaacattggatgtgaaaggaagggacttagccactttatcaaacaccccctagaagtgctaacagctacacctaggtgcctactaatccattttcacagcttggcatgcacagaaaaaaacgatcagggccgaggtgcagatgtcactgccactgccatggcggccgatcagactctgaggaggtagacgctgagctcgggcccgccatgaccatgagcgccgccgccgctaccgtccggattcatcatgtagaaggcctccgagtcgcgagaccccacgacgcgctcgaaccgcgcgcgcatgtacatgacgtcgccctcgccgccgccgcagctggcggcggggatgactccggcgcccatggacacgggctcgagcgcgcggagcacgcgccagtccgcggcgccgcactcgcgccgcaccgcgtacccgcagctcttgccgttgcagtaggcgcgccacaccgtctcctccaccagcctcttgccggcgcccggggacggggacggcagcgcggcggcgggcgaccccctggccctggcgcggtcgcactccagcgcgatgcgcaccaggcccgaggccatctcccgcaccagcgccgccgtgggcgccgccagctccagcagcagcgccgggcacgcgcgcgggtccacctggaacgccaggtgcacgtggccgcgccggtggccgtagagcgtgccggtgagccgcgcgcccatgcccacctgtcggtgccgcccggccacggcgttggccagcgcggaccgcaggcgcgacacggcagtccggaccttcatcctcctcctctgccccgccgccaccgccgccgccgcttgctgctgctgggccgacggcgccggcttcagcggaggggacacgaagccatcggagtggaaggacgggcaggcggaggagaaggccatggtcgtctcgtcgtcgtcctccgcctccgagctcttcatgtactcctcgtccccgaacgtcgcggcgccgtggctcttgctcttgccgaggacgggccacttgaagtggcgcctggagaaggagagcgagtcgtgcgtgttcctcgccgcgatggttctcatggtgcgtgactttgctgtcttgtccttctacttcgagctagctcaagctttcctgaagcaagcgaagcgaagcagagaaatgctgcgatacaatgcagtgcaatggaccctgtgctttgcttggctggagctggagggctgctgcgtagcgtgcttgtgctgggctgtgtgcgcgaggttatatccaaggctgagctgaactgtaggagggcaccaaagcacagtccatggcgctaaggcttttgtactgggaaggaggctggtgagcagaacccaccagtactgagcaaacaggacagaggaggaagatgagagagaaagacagagcaaggagggtcgtttctttttcttttatctccttgtgttgctgtgtctgaaggctctgggccggtgggccctgcaggcctgccccttgtttctttttcttttttttaaggaactggcacttgtttcttgtgaggaaatggtagacaggaactgagattgtggcagcggggggcagggttgagagatttatggtttgattacataatcggtggggccttgagattgcgtgtggatgcgggacagagagagtgacaagagaggccgtgcctgctttgaatctctgctgccagtgacatgactagtactctgcacatgtgaatgagaatgttggtggttgatgatgatgcactgatgaaacataatgccgagattagaaaactcataccaagatgatcatattgttcaggttccgaacaaacgtggacttgatcacctgatctttatactgcctccg

SEQ ID NO: 7130 - DNA, 2737 bp, Zea mays
gcacgagaccattacctagaacatcctaatcaaaaaagctcagctcagccaactgctggagtggtagtggttgcttcctctctcttctcacgtcaccatgatcgataagactagctagaatataggtggctggcagtggcagtggcagcgctatcctatatagtgccccccggccggtgtgctcgcctcgggagctagccttggaagaagaagcagagagcagagacaccgttgcgtagagggaggaggagtgcttcttcgttcgtcgttgcccaaagcagcagcagtcacttggaattggaccagagcggcgccgagcgctgccggccggccggccgacctctgtttgtagcggcggcagcaccagctctcaactgctcaagcaaaccaattaaagcagccagcagtctgtcacacacacaggcggaaccgaaccggccaatgtattcttcgtcgccggcctgggagaagcgcgtgagcagccaagagcaggagccactcttttgcaattgcagctgcggcaggaggtttcacaggccggcggtcatctgcaggacgccgcactgatggcgacggcggtctcctgtccctactcctcgtctcgcgccggcgcccctgcactgctgctcgtcgcgcttcttcttgccgccgccagctggacgaccaccgccgcggcgaagaacgacacgcagaggttccggcccggcgacgagctccggcggtaccggagggtgcaggcgctgctcaagaggctcaacaagccggcgctgcggagcatccagagccccgacggcgacctcatcgactgcgtgccggcgcacctgcagccggccttcgaccacccgaggctgcgaggccagaggccactggtggcgggcccgccgccggcgaggcccaaggggaatcgcctccgcgacccgataaggaatgacaccgcggaggccgccggcgtccagcagctgtgggcggcgtccggggagtcgtgcccggaggggtccgtgcccatcaggcgtgtcacggagtcggacgtgctccgcgccagctccgtcaggcggttcgggagggcgcccgcgggcagggtgcggcgcgactccgtctccggcggccacgagcacgcggtggggtacgtggccggcgacgagtactacggcgcgaaggcgagcatcaacgtgtgggcgccgcaggtgagcacggcgtcggagttcagcctgtcgcagatctgggtcatcgccggctccttcggcaacgacctcaacaccatcgaggccggctggcaggtcagcccggagctgtacggggacaacgcgccgaggttcttcacctactggacgacggacgcttaccagaccaccggatgctacaacctcctctgctccggcttcatccagaccaacagccgcatcgccatgggcgccgccatctcgcccacctccgcctacaacgccggccagttcgacatcagcctgctcgtctggaaggacccgaaccacggcaactggtggctggagttcggctcgggcgagctggtggggtactggccgtcgctgctgttcagccacctggcgtcgcacgcgagcatggtgcagttcggcggcgaggtggtgaacacgcgcgcgtcggggtcgcacacggccacgcagatgggcagcggccacttcgccggggaaggcttcggccgggcctcctacttccggaacctggaggtggtggactgggacaacagcctggtgccgctcgccgccggcttccacgtcaccgccgaccaccccagctgctacgacatacagggcggcgtcaacgccgtctgggggaactacttctactacggcgggccgggcaggaacgtcaggtgcacctagctagtagcagctatagctcttcgtcatctcgtctcggcccgttaacctgatgtgatgatgccgctagctaggattttctcttcttccatatattgcccacaaaaaggttaattaatttctcaaatgcgagagtcacggatcatgtagttttcttttctttttgatttcctattttcttggtggtctctgaacgaaacaaaagggtgaagggttaagctcagttcaaacgtagtccagttcatcaggtcgtagcgacgatgatggtcgtcgagttgtaacgtacgtaaaagccccctgaacaatatgtagccacaaggcacaatctagcagtatatacacgcattgttttactcctttccaaaaaaaaaaaaaaaagaaaaaaaaaaaaaaaactccgctgatcgatgatcatgaagaaaaaacaaacaaaaaagaagaagaagaagagaacacgaggtagtaccgcgcttggacgctaagcaacggagcctcatatgcaatgcaaggtattgcaaatcaagtacgtcgacctcgaaaagctagtaaaactgtgcccgcggccggccaacgtttgaagcgcgagctcctagctagctagaagcaatcaaatacctcggtgaaataaacaaccgcgatcgcgttaagcgaataatataatgtcgttactgctgggacaaggaataagaaactcatgagacgacagaattagtcggaatgccatgtcatatatgcctctataggatctagagctgtacagtagccttgcaaggggggtacactttttagataatggaaaagcagttccggccttctcctccgtagagggtccgagccaacaacaacataaaacagcattcacacgaccacagagtcaaaac

SEQ ID NO: 7131 - DNA, 2652 bp, Zea mays
cagcccgcccggtcggaagcaacatagaccggatgtcacagtgaccaccgccctctagctcgtcgcctcgtcggcgtgcccagcttctggtccagcgcgtcgcctccgctgctgctgggcccgacgcccaactaccgtgccgaggtcccaggcaggaagcatcttggcgtacgtgccgccggcgacaagcacccaccacaccagtcaaatgaatagttgatttcatttcaagcaattcctgaacaactatattacagtcatgaagtcgttagccaagcaagagacacagccaaaaccgcggctcattgtgcgccttggtgtattccttgcatctcaccacattctgttcagtgttatatgctgctatgcaggcattatcgcgctactactccttccttcacttgcaaaaaacacatacctctcggagaatgctcttatacctggctctgcaaatccattattttctactgaagatgccattgaagcaaacagatttatgaaagcaattgaagctgtggctagagactcaagcagtgtaataggcatggcaaatttcatagcacaacaaatagaagatctaggtgcagaagtgtgttaccaaaagtttctccctcatggcaagaattttcaccctctgaagttcttcacctccatgacaaatgatattgcaattcaacctaatggcactgccaccaattttgggataaatactatcggcattttacgagctcctcgtggcgatggaaaagaagcaatagtgctggttactccttataattctcaaagagttcagtcgaatgaattattatcgctggctcttggtttctctgtcttctctctcttaagtcgagcagcatggctgtccaaggatgttgtgtggttatctgcagactcacagtttggagagtatgctgcagtctctgcatggctaaaccagtatcataatcccgtgtttttgagtcactcagtggtgtcacataccaagatgtacggtgcaaacaatatatatgatggtaattcagaaaaaacagaagccacggctttcaaacgtgctggaacaatggctgctgctctcatatttaaagttggggaaaccagaagatacagtgacagggatagtgttacgatttatgcagaggcatctaatggacaaatgccaaacttggaccttctgaatgtggtgcactatttggctgttcacagacaaggttttcgtgtgaacatcgctgcatttagttctttgttgagctctgcatggctcagggttattgctgaaattttgcatactattggtagtgtgttaagaaaaataaatcctgactggaagcttgatattgcagtccctgattatgtggaagggactgcaaatctagctaactctatgtacaaccaggctcttggagtgcccacagggtcccatggtgctttccgtgattatcaagttgatgcggtttctttagaattttcaccaacatttcatgtcaaaaatgagaatgctaaatctttgtttcttctgaagggtggaaggttaattgaaggagtggcacgttctgtgaacaatctgcttgagaagttccatcagtcctttttcctgtacttccttacaggtccaagcaagttcatttcggttggtgtgtatatgattccgtttgcattgcttttggcacctctcccaatagttgctgctgcccttgctgatggcagtagaagcatggaaaaaacagcggataagttgataggcgacggtaaaacagatggcattgctgatatttcgcagaacaagggtggatcatggaaatggcttcgagctgcaaaagtattgcttgttgtccaattatgggcagtacttgtttcactacttccatattacattactcagatacctgatgccacacctacgcaaagcacactcatttgggttgtgctctccatcgtcgtactgatctccctatctgtcttgtttggctcaccatactcaactggtgttgaatggaaacttctgaaggctaccatgatcacttccatctccatcggattggggcttatgtcgataataaatttcgccactgctcagcttggtgctctgatagtgatcccaatgtgtttgttttctcggcctctgaaggcatcagggatgaatttccttcctcgggcagttttgttggcttcaaatgtagcttttgctgtgttgggttttcctccagttgcgttgctgattatgaaaggagtgtccaagggatcgaggtcgtggacaatagatgttggagatttctgggtatggatggagttcctgtgggaatggagcagcgcgacgtatctttacctatttcttgtacatcttccctgctggcttttgtgcgtccttgtgttcctgcacccatgtcaccaatcagaatataagctgaagcaggaatagctgtttggcatccatagtcttgtctttttggatggtaaatcttgtagactagtgtagaaatttctcactttcacaaacttttggttacccataattcggaaattattcacccagttggagacgacttgtagacgatgtatcctgcctaatgtactgtctgcaacattttcgaaggcatgtttttaaagctgcttgttgcagtaattgatttctaaaaaaaaaaaaaaaaaaaaaag

SEQ ID NO: 7132 - DNA, 1909 bp, Zea mays
acttcgctgttttatagtttgcatgatttgctagagagttcgtatggtctgaaatcatctatacatatgagttctatggagtcgctaactattttcttgccacttgtggccatggttggtcaaacagcgctttaacaaatatattcagacattcgggggagactattagcaggaagtttcatgaagtacttcagtgtgtggtgtgtatgtgcaaggactacatcagaccaattgatccaaatttttccactgtacatagtcgaattgctggtgatcgaaggatgatgcctcatttcaaagattgcattggagcattagatggtacccatattaatgccacaccgccgccagaagatgttattagatacattgggagaactggtaaagcaactcaaaatgtgatggctgtagttgattttgacatgagatttacttatgcatctataggccaacctgggtctatgcacgacacaaatgtcctattccatgcattgaggaatgatacagaaaattttccacaccctcctgcaggtatgtattaatagtatactacttttcaacatttgtagtaagactctaatttttttatcatgttattcgttttaattgtagggaaatattattgtgtcgacgcaggatatccaaatcgacctgggtacttggcaccatataaaggtcaaaggtaccatgtacctgactggaggagaggaccggctccaaatggtgagcaagagcactttaaccatttgcattcaagtattcgtaatgttgtggagcgagcatttggagtctggaaaatgaagtggagagtgctactgaaaatgtcgtcttacaaaatggaagtttcaaaaaatgattgtggcagcgactatgtgtttgcataactacattcaagagaaccatgctttagatttggattttgtgaagtgtgatcggaatcctgattatgtgcccacaattccagaaaagtatgctagatttcagccatcgcaaaatgcatcgaatacatcgacaacataatcaaatgatcgaaccatggatagattccaggatgatattgctaggacagtctttatttctagatcagcgtgaattttgtatgcatacatatttgtatataatggatcatcgtcacttttatctgaatattttacaatttctagttcatatgtggatgacattaattaatcgttgttatatactattatgttaatttatttgatacttaaccgaaatcttcataatactattttgtttatatttgcgtacgatttccaaagttccttatgtatggcaacggcatccagatattttaaaaatataatgatgcagatcgtgtacgttatcaacttgtgtatctgcgtacgagcaaaccagcgaagcaacaatactacaatatattaaaaaactatcaaaggtttattttgcaaaacggtacagaagctgtgttaccaaacgatttttgaaaatggctttggctctcccaaaaaagctgctcgcatgaagaagctagagccaaatctatttttctaaaagctaaagccctgccaaagaggcccttagatgccccggtcctttgtttaatgaaaaataatattctctctattctatattataagatattttagttttttttctaaatatataaaagtaggttttgttatggacttagtcacttagatatagactacatctaaatgcacatatctagaaaaactaatacctccattctcgtaatatttgtcgtccgttagttcatttttgaactaaaccgcgataaataaaaaagaacggaacgagtaccttataatttatataattcataaaatagagggagtacttaaacggtgtttaatccaaaaatagtaacaaaatttctgatttgctacaccgtttctggacaagtaca

SEQ ID NO: 7133 - DNA, 1607 bp, Zea mays
gcacgagaccattacctagaacatcctaatcgaaaagtgtccacggcggccatccgtcattccacagctttgctctctcgctgtctctctctatccatggctgaatcggcacctcgactcctcgtcctcgtcctcctctccctcgtggcggcgctcgccatggccactgggccagcggcggcagcgcacgcagggggccgtagccgcctcatccacctgcacttgtacatgcacgacatcacgggcggcccggggcagacggcggtgcaggtcgtcaagggcccagggccggcgcacccggcgatgcccggctaccacttcggcgacaccacggtgatcgacgacgcgctgacggacgggcccagcgcgtcgtcgtcgcggctcgtcgggcgcgcccagggcacctacatgctggcgtcgctcacggagcccgtgctggcggtttccatgaccgtggcgctcacggccggggcctacaacggcagcgccgtcgtcgtcgtgggccgcgacgacgtctcggcgggcgtcagggagctcgcggtggtcggcggcaccggcgcgttccggagagctacgggccacgtgctgtggcggacggccaggatggagtcccgggaccacatggtgctggagctcgacgtctacgccaccgtgccggccgctagtccggctccgcctccgcgcgccggattggcgcgtcaggtggcctgagtgcctgacctcaaccgtacctcgacgtgatgtcaccggacttggttttgattttaccatgcacgctgctcgcctgctgtgtgtatggtcaatcgtataaaattgcttcagctccgcgcctccgcacatacgttggaaaattgaacaataaatgattactatactgctgctggtgctaccgctaccgtcagtcaaaaaaaaaaaaaaaaataataagtttgaattctttacgttcaaatcaacgaacctatgatggatgtgagtttgtcctagctcaattgatcttggtctgttggtaaaatatgattttgccctcatttttttaaaaactgttggagatccatgctctcgtaaaagcgcaccgatataacctcccgctgcgccaataggagtattttgtattctgcgcagcaggaatataccctgacaaggccaaaacaataatcactcatattataaggtgtgtttgattcaactacaagatatgaaaacgttgttgtgagttatctgctgtaaaaagattaaaaattatttaggatcaaactgatgtgaattgtctattataaacaaacttaattatatctcttaatcaatgtgcctaattttaaaaataattttatattcatgctcctgatattttttataaaaaatgactccacttgctatatagtttttatttaaaacatattttaattttttgtctattctgatacttaattattttaatcatattttatttttatttgtattttatttattataacacttatttaattttaattctgttttaatttctatctattataactctttattaatatatcaaacttagataagtagcaaaagccaaagactaagcttattaaaatttgtataaaaaatctggtttttaagta

SEQ ID NO: 7134 - DNA, 1698 bp, Zea mays
gcacgagaccattacctagaacatcctaatcgaaaaatgccaatgcgcctcgccgcgccgcgccgcaccgccctccccccacgtccggcattgcgtctcagcgatgcggccgccttcctcctcctcctcctcttcgtcgtctccagccgcggttccggagcccggcggccggatgtccgcgctcacgatgcgcgcggtggcgcggatgtcgagggcgcgttggttcgtcttcctgcgccgggtgtaccagtaccagaacggcccgaggtctgacctgggctccaacccgttcaactcgcccggctggctcgcgctcgagctcggcgtgatcgtcgcgcaggtggtcctgaccaccgccgtcgtcgcaacatccgccgcggagcgacccgcgtggccgctccggctgtgggtcgcggcctacaacgtcggcaacgtgctcagcctacccctcctatactggcggcaccgccattcctcctcctcctcctccgccggcggcggccggggcgacctcgagatgcacggcgccaatgacgctccggggaacaggtcgtatctgatgaacaaggcgcgggcgttcctggagctcttcttcgcgatgtggttcgtgatgggcaacgtgtgggtgttcgacgcgcggctggggtcgttccagcgcgcgccgaggctgtacgcgctctgcgtcagcctgctggcctggaacgccgtcgtctactcgctcccgttcctcctcttcctcctgctctgctgcttcgtgcccgcggtcggctacgcgctcggctacaacatgaactcggcctccgtcggccgcggcgcctccgacgagcagctcgccgcgctgccgcggtggcggttcaaggagcccgacgtggcaagggaccgggagcgcgatgaccaggatatactcagcagcaggggcggacccacaggggggtccgggtgggccctggcacaccctaagccaggcccatcggagaccccacccgttcatctgccgagcgctgaaggccgtttcaacttcccgatccttcagcttccagttcccagaatcacgagtgcggctgttcctggcgactggcgactggcgacctcaacctggctggcgagcgcgcgttgcgcggttggacggctgtctgcaggtggcctggctttctgttcctgacgagcacctggcttcctgttcctgacgagcgcgcggctgtagtgctgtggcgagcggccgagcgggtgcctgctctgctcttcgattgctgctgtgataaaatatgaagaagcaaggagatattgcctctctttttcgtaatcatgctgcaaaaaaacagaagtttattgcttcttcattatctccggatgttactcaagcgtcgacacctcaagaacaagagaaagaaagaataaatgaagaaattgtgaatccaatgccatctgcaccgccaccgccaacactttatgatgtcagtcgtcttccacatgatccaggtgaaagacaacctattgcaagttaccatgctaatgatcatgatgcaattcgaagagcatatattcttagaggtccatttcaaccatatgcacatgaattcccaaataggaaaattggagatagagatcgccattttaattttgtgtggtttcaaaattttccttggattgaatatagtgtcaagaaagatgctgcaaaaaataaaaaaaaaaaaaaaa

SEQ ID NO: 7135 - DNA, 1355 bp, Zea mays
gcacgagaccattacctagaacatcctaatcgaaaagacctgtgtacactcgtactcgtctcttcttcgccacacacacacacggctgctagtgtacacagaggcacagcagcaggaggatggccgtagtgccggcggcgccggtggttcttggagtggccatggtgctcgtcgtcctggccgccagcgccggcgcggccgggcagctcaggatggggttctacgccgagagctgcccgggcgtggagcgcgtggtgggcgacttcgtccggcagcacgtccgccgcgtgcccaccgtcgccgccgcgttgctccggctgcacttccacgactgcttcgtcaggggctgcgacgcctccgtcctgctcaactccaccgccggcagcgtggccgagaaggacgcgccgccgaacctgacgctgcgcggcttcgacctcgtcgaccgcgtcaaggcgctcgtcgaggatgcctgccccggcgtcgtctcctgcgccgacgtcctcgcgctcgccgcccgggacgcggtcgtcgccatcggcgggccgtcgtggcgcgtggcgacggggaggagggacggcacggtgtccgccatgcaggaggcgctcgacgacatccccaagcacaccatgaccttcccgcagctggccagcctgttcgccagcaaaggcctcggcgttcgtgacctcgtctggctctcaggcgcgcacacgatcggcatcgcgcactgctcctccttcgcggaccgcctgtacggctaccccggcggcggcgttggcgcggccggcaacgacacggccgacccggccctggacgcgacctacgcggccaacctgcggaggcgcaagtgccgggcggcgggcggcgggtacgcggaggacggcgtggtggagatggacccaggcagccacctgacgttcgacctgggctactaccgcgcgctgctcaagcgcaggggcctgctccgctccgacgccgcgctgctcaccgacgcggcggcgcgcgccgacgtcgagggcgtcgcggccgggcccgaggaggtcttcttccagctgttcgcgcggtccatggccaggctggcggcgctgcaggtcaagaccggcgccgagggggaggtcaggaggaactgcgctgtcgtcaacggcggctaatgcatgtagcttcttgcctttcttcttctttcccttcatggccattactgctagcgaatactgtgattttgctcttgcattttgggtgcttcacgctcgggtgcaattatcatgtcaaagaaattgttaccctcttgctccttttgttagagacttaatagaattgtttggactggcactagcactaaaaaaaaaaaaaaaaaaaaa

SEQ ID NO: 7136 - DNA, 1790 bp, Zea mays
tgtttcacagctctcccccacgcgtttgcttcttcaagcattgaccccttccgccccgtccgtcatcttccccacctctctccgcactgcaggagcttgcgggcgtggcggcggccgtgaccggcgctggagatcttggacgcgcgcgacatcctggtctccgctctgtgcctctggtctccgaaggcgccgccaccctatttttttttaaaaaaaatcctaagatagtttcttcagtccgacaccgcttctagcttcccctcggcgatctgtgaagctatgaagccacctctcgagaggaacccgactaagaagcgccactcgtggtggtgggacagtcacattagccctaagaactcgaaatggctcgccgaaaatctcgaagaaatggacaagcaagtgaaggaaatgctccagctgatcgaggaggacggcgactccttcgctaagaaagcgcaaatgtattaccagaggcgtccgatgctcgtcacccacgtcgagaacttctaccgtatgtatcgtgctctagccgagcgctatgacaatgtaaccggcgagctgcgcaagaacatccctacaaggctgcagacaaccggatttttaaccagttcagagtacggttctgagctgcagaggtcgccctcaccgtctcctgagccgttacagaggtcgtggacaagggagcagagccctagggccgctggcttcgacttcttcctgagcaataggagcaatgactcgccacctgtctacaggaaggaacccgaggacgcggcatcgcagtcggagtctgacgcgaagtctgcagacggtgaggatgatggcatcgcctacacgctgcaccagagagttcttgagctagaggacgagctcaatgcgacaaaccagaaactacaagatgcaaacgagaagcttgaggttctggaggagaagagcttgaggtgccattgtgattataaagagaatggaaacggtgctcagcgaactacagaagtttcaggcaaagagggggagctggaagccgaaatcgtcaatctccaggaggaagcggactcggcaagaaggcgattcgaagaggcattgtctgaacgagatggagaaatcagcaagctaaagcaagagcttgctggtgcttctgagaagctgcagcgagagaagtacgccaatggcgtgcaggtatctgagctgcagcgatcggttgaacacatcaggtccgaactagagagagtttctgaagagaaactactgtccgagaacaagatcaaggagctggaggcagcaaacgctgaagccggtaagtacggccacgagctcacgcgagctgccgagaagatttccgaggagaagttcgcgctcgaagctgagatcctcacgatgcggcagaacattgaagatctgaaatccaggatcgagagcctcgctcgagagaagtccctgctcaaatcatggtttgaggacttggagcaagttgtggggcgaggaaggggcatcttcgccgattaaccgagtttctatccagaacatcatcggtagctagaatttagcaagttagcaacattttgttttgttttctggtactggtacccataccatcttgcgaaattgagatacgtcagtgtacttcctttttgttggctgaatcttaaacttagacgtgatggatggtggtgatgtactggcaatatatgaaatattatactgaaccgcgctcgacgtcaataataagattcctatggtgcatccaaaaaaaaaaaaaaaaaaaaaagaaaaaaaaaaaaaaaaaagcggcc

SEQ ID NO: 7137 - DNA, 1219 bp, Zea mays
cgcagccggcggcggcgcccggcttcgactgcctcagcgaggtctacggcgccgccgcgttcggcgggcccacggccgcgggcgacggcggcgagatggggttccttgacgtcgtcgagcccaaggcggcgtcggcggcactggtggacggcgccgcgggcctcggggcctgcaaggtggagcccggcctggcggagagcggcggcgcgttcggcgctggcgctggcgctgcgccgccgccggccctggcgtccaagaagaagagggtcgaggggatgccgtccaagaacctgatggccgagcgccgccgccgcaagcgcctcaacgaccgcctctccatgctacgctccgtcgtgcccaagatcagcaagatggaccggacgtcgatcctgggcgacacgatcgactacatgaaggagctgctggagaggatcaagctgctgcaggaagagatcgggcagcagcaggaggaggcgccaggcatgctcagcgtcttccgggagctcaaccccaacgagatggtggccaggaacacccccaagttcgacgtggagcggaaggagggcggcgacacccgggtggagatctactgcgccgccaagccggggctgctgctgtccacggtgagcacgctggacacgctagggctcgacatccagcagtgcgtcgtcagctgcttcaacgacttcggcatgcacgcctcctgctccgagatgcagagggaaatgatcagcgccgacgcgataaagcaggagctgttcaagaacgctggctatggcggaggctgcttgtagaggggcatgtcatcatggcatgggaggaagaagaagaagaggcagcaataaattaatcttaagcagctgtgggagcagcagtagtagtatcagttcaggtccagtagcggaaaaggcaggcagggcaaagatttgggaggcctttttgcaatccatctcccccatcataacccacttcgatctatccatgttagcagtacgtgtccgtccgtcctatagcatcatgcaggatgcaaaggttgccctgtgctgctgaatctttctcctatatactattctatttaattaacaagagcaaagctcgctgcctttcttctgatgattgaattgatcaggggtgcatctggcgactacctctcttcttatatgtcattctaaagtttttagatcctaattttatcaaggagctaaattatcccaggttt

SEQ ID NO: 7138 - DNA, 1444 bp, Zea mays
  misc_feature (26)..(27): n is a, c, g, or t
gcacgagaccattacctagaacatcnnaatcgaaaaccaccacaggcacacacacctccctttttcattcgagttcgaggagaaggcggcggaggcggccatggagctcgacgagcaggccttcctggaggagatcctctccctgcgcagggacgcctgggactgcaatgtgtccatgggggacctcttcgccccggcggcggccgccgccattgactgctccttccacaaccagcaggcgcccaccgtcagcgtcctccccaccttcaccgcctcctgcgccgagccgccggccttcgactgcctcagcgaggtctacggcgccgccgccgcgttcggcgggcccaatgccggcgacgagatggcgttcctccacgtcgcggagcccaaggaggcgctgcagctggacgacaacgccggcctcggggtgtgcaaggtggagcccggcctggtggagagcgacggcggcggcgccgccgcgccgacgcccgcccctgcggcgtccaagaagaagaggaccgaggggatgccgtctaagaacctcatggccgagcgccgccgccgcaagcgcctcaacgaccgcctctccatgctgcgctccgtcgtgcccaagatcagcaagatggaccggacgtcgatcctgggcgacacgatcgactacatgaaggagctgctggagaggatcaagctgctgcaggaggagatcgagcagcagggggaggcgccggcgggcatgctcagcgtcttccgggagctcaaccccaacgagatggtggccaggaacacccccaagttggacgtggagcggaaggagggcggcgacacacgggtggagatctactgcggcgccaggccggggctgctgctgtccacggtgagcacgctggacgcgctagggctggacatccagcagtgcgtcgtcagctgcttcaacgacttcggcatgcacgcctcctgctccgagatgcagagggacatgatcagcgccgacgcgataaagcaggagctgttgaagaccgctggctatggcggaggctgcatgtagagggcatggcgcggctgtagcctggaggaaggagaagaagaggaggagcaggaggaggcggcaataaattcagctctattagacgacagcgctagtaacaaggagcagcagcagtatcggttcaggtccagtccagtagctgaaaaggcaggcagggcatgaggccagtgaagatatggcatgggggaactttttgcaatccaatctccccatcagaacccacttcgagttagcagtgtgtgtccgcctgaatctttctcctatatactgctgtatttaattagcaagagcaaagctctcactgcctttctaatgattgatcagaagtgcctttggcgaccccttgtctttctgggacatctatatataatgttcttcattctaaaaaaaaaaaaaaaa

SEQ ID NO: 7139 - DNA, 2085 bp, Zea mays
gaccaggccccgttctcgattaacccaagccaaaggtccgttttctctctgagaccgtttacatcagttttttttcttttcttcaaaatatatgtgtgaacgaacaatagtttgcagtacacgaccgaaacacaatatttcatcgattccttccttgtcttctcacctctgacgattctgtttctgaaatctgcttcctgcaaaatggttccatggtcacggaattcgccatggtcagagtcagagagagagagagagagagtcgtactggtcgtcacctgtcgaagattttcggtgtctcctgagccacagctgctgctgctgctggaaccatggagatggaggccgtggagtcgcacggaggcgccgggcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgtcaccaactggatgggcacgagcgccatcacgccgctcgtcgccgccttcctcgccgacgccttcctcggcagatactggaccatcgcgctcttcctggtcatctccgtcctggcctacgtggtgctcacggtgagcgcggcggcggcgctggagagcgcggccttctacgcggggctgtacctgctggcgctgggcggggcgctgcagccggtgctgtcgtcgttcggcgccgaccagttcgacgaggaggagcgcgggcgccagagctccttcttcaactggttctacctctccatcaacgtcggctcgctgctcggcggcaccgtgctggtgtgggtgcagtccagcgtcagctgggggctcgggtacggcatcccggcgctcttcagcgcgctggccgtcgcggcgttcctggccggcaccgccacgtaccgccgccaccagccgccggccggcagcccgctcaccagggtcgcgcaggtcgtcgtcgccgcgtgcaggaagtgcggcgtccccctcccggccgccgccgcctcgccgcacgcgtgcgtggacggcggcggcatgtccgcgatacaggggagccgccggctcgcgcacaccgatcagttcaggttcctggacaaggcagcgtcggtggagccatcggacgacaagtcgcgtccggcgagcgcgtggcgtctgtgcacggtgacgcaggtggaggagctcaagtgcgtgctccggctgctgccggtgtgggcgagcgggatcgtgttcgcggcggcgtacacgcagatgaccaccaccttcgtcctgcagggcgacacgctggacccgtacgtgggcggcttccgcgtgcccgccgccgtgctctccgtcttcgacacgctcagcgtcatgctgtgggtgccgctctacgaccgcctggtggtcccgctggcgcggcgcgccacgggccacgaccgcgggttcacgcagctggcgcgcatgggcgtgggcctcgtcgtgctcaccgccgccatgctcgccgcggggacgctggaggtggcgcggcgccgcgtcatcgcgcgccacggcatgtacgacaccaacacgggcgccggcggggacggcgagtacctgccgctgtccatcttctggcaggtgccgcagtacgtggtggtgggtgcgtcggaggtgttcacgttcataggccagatggagttcttctacgaccaggcgcccgacgcgatgcggagcctctgctcggggctctccatgacgtccttcgcgctcgggaactacgtcagctccgcgctcgtcaccgtggtggcgcgcgccaccgcgcggggcgggcgggacggctggatccccgacgacatcaaccgggcgcaccttgacaacttcttctggctgctggccatgctctgcgccggaaacttcggcgtctacctgctcatcgcgcggtggtacacatacaagaagactgtggactagtatagtgtatgtatctataaagaccatccctgaacgatctcgtgaaatgtactgccgatctcaatcaattcaaagacacttcacttggaagaag

SEQ ID NO: 7140 - DNA, 2929 bp, Zea mays
tgtagcacgatacacgcaacatagccggcaatttctagaaagattataagaaaacgcttgacgaggttcggtgcatctaacatgtacaatagtcaccttaggtgtagagtttggcagggcagttcagctatatctgccatctttctccatcagattcgtctgggcaaaccgatcagctactattatccaccattacgtataataataataataacataaacctccctgtttcttcctggtccttgctgtatgtaacacgcagccaccaattcatttccccttccaagtcattctaagccatcccagaagaagaatacatatggttccatgcatatatagccttttattggcacaacaaagtgcagttgcattgcatgactaccatcgtcggtgatggcaccgcagacggcaacgcgggtcgcctccggccggctcgtgttcggcgcgccaacaacaacagatggcaagctggtaaaaggtggaagcaggctgcgtgtgaggagccttgacaataatggcaggcgtgttgcggtggaagccgtcaacggcgctgccaggccgaacggcgcagcggcggtggccgacgtccggcaagtgcccgcgccgccgccaccggaaggcgacggcgacggcgtcgccttccggctgggtaagtttgcggaagggaggctcgtgtacaggcagcagtttgtggtcagatcctacggagatcgggcctgaccgaactgccaccatggagaccctcatgaacctcctgcaggtgcgtgcggaaacagtcttctgtgaatccatgcatgcatggtttacttatgccatgcatcgatctcactttctggcatggtcgtctctggtatcgatctgtgcaggagacggcactgaaccatgtgatgtgctctgggctcgccggagacggtttcggcgccacacggcagatgagtctcaggaagctcatttgggtcgtcacaagaatcaacatccaggtcgacgagtacagcagatggtacggtattggtatctgactgactacgtactgcatgcatgtgcatcatcagtcgtgtttcgttatattcactgtgtttcacaccatcacatgccgctcctccttgcttgaacaacgacgacaggggagatgtcgtggagatagacacctgggtcgcgtcgtcagggaagaacggcatgcgcagggactggatcatccgcgaccgcaacaccaagaacatgatcgcaagagccacaaggtaatacccaactctctatctctcccagtacatacgttgcagggctgcatgatcggggaagtaatgcaagtgatcgatgtgtttctgtgcagcaactgggtgatgatgaacagggagacccggaggctgtcgaaaatccccgacgaggtcaggcaggaggtgctccccttctacctggacaggagcatcatcgccgccgccactggcggcggccgcaagatcgagaagctcaccgactcgacggcggagcacatacgatcagggctagcagtaaggaggagcagaccagaacacctctcgtcccgtctggttggaccgctctcaactgaaaaacttgttccccccttcagcccaggtggagtgacatggacgtcaaccagcacgtgaacaacgtcaagtacatcggttggatcctcgagagcgtgccgctggacgtgctggaggattaccacctgacgagcatcacgctagactaccgccgggagtgccgtcagtcgcagctgctcgagtcgctcaccagcatgacgacctcgtcgtcggcgccggccgagccgccgctgacgtcgagcctgtgcggctctgacctgtacagcacacacctgatacggcagcaggatgacagggccgagattgtcagggcttgtgccgaatggcgtcgcaaggagcatccacggtcgattgaacagctctgacaagcggttgggtatatactctgttttgtatttgcttgtttttgttttaagatttgtgtgtcttcatttgtgctttatgctttacttgattggaaaacagtagacaaagaattggggaaaaaacacttggatattttgatgtatagaatggagcagtccattaccatctcattctttttttatatttttggaaaggaattaatgagttgctccatcgccaactcattacttgtaagctaataattagtattaacatgaaaaataaaatcattctactaaatttgagaaacaaactcatgatgcattactccatctataatagagggattctctaaaccaaacggtcctttagtaattggggaaaaacatttgtttgtggagcatattagtgttgtagttcagttttgttaaggttacctatatatttatgcttaagtcccgatagaagtcttaaagaaaatagaataccgaaggtctagattcttttggcaaattaaacaataaaaaaaaacgaatacatgctacttagccaccaaaagaaaaaacgggtctagagatacaaactataaatgtctcttcaacgaatggcttttttcaagttcataatgaactaaccaggggtttggcaagagctagcttttaagaatcaaatatatgttaaaagataaaactctttcacaagttcgtaagaaggcaggtgccgtgatactcacttttagatgagtgcgttaaaagtcttttaagtcgcatggatgcatttctcgtatattagcatagtgagttatattgactctagagacttctcctataagcatgaggcttgcggctataataaaacttccatgcatgctcagtgacaaaatctttttcttgagtcgatgcctcaaaaatgtccattgatcatacaccataactcattgtatatgacactctgtgtgcagtggatgtttgtctatcctcaaactcctgtgggtcgtggttctttgcttaggtaattga

SEQ ID NO: 7141 - DNA, 1393 bp, Zea mays
aagtcattctaagccatcccagaagaagaatacatatggttccatgcatatatagccttttattggcacaacaaagtgcagttgcattgcatgactaccatcgtcggtgatggcaccgcagacggcaacgcgggtcgcctccggccggctcgtgttcggcgcgccaacaacaacagatggcaagctgcaggtaaaaggtggaagcaggctgcgtgtgaggagccttgacaataatggcaggcgtgttgcggtggaagccgtcaacggcgctgccaggccgaacggcgcagcggcggtggccgacgtccgccggcaagtgcccgcgccgccgccaccggaaggcgacggcgacggcgtcgccttccggctgggtaagtttgcggaagggaggctcgtgtacaggcagcagtttgtggtcagatcctacgagatcgggcctgaccgaactgccaccatggagaccctcatgaacctcctgcaggagacggcactgaaccatgtgatgtgctctgggctcgccggagacggtttcggcgccacacggcagatgagtctcaggaagctcatttgggtcgtcacaagaatcaacatccaggtcgacgagtacagcagatggggagatgtcgtggagatagacacctgggtcgcgtcgtcagggaagaacggcatgcgcagggactggatcatccgcgaccgcaacaccaagaacatgatcgcaagagccacaagcaactgggtgatgatgaacagggagacccggaggctgtcgaaaatccccgacgaggtcaggcaggaggtgctccccttctacctggacaggagcatcatcgccgccgccactggcggcggccgcaagatcgagaagctcaccgactcgacggcggagcacatacgatcagggctagcacccaggtggagtgacatggacgtcaaccagcacgtgaacaacgtcaagtacatcggttggatcctcgagagcgtgccgctggacgtgctggaggattaccacctcacgagcatcacgctagactaccgccgggagtgccgtcagtcgcagctgctcgagtcgctcaccagcatgacgacctcgtcgtcggcgccggccgagccgtcgctgacgtcgagcctgtgcggctctgacctgcatagcacacacctgatacggcagcaggatgacagggccgagattgtcagggcgtgtgccgaatggcgtcgcaaggagcatccacggtcgattgaacagctctgacaagcggttgggtatatactctgttttgtatttgcttgtttttgttttaagatttgtgtgtcttcatttgtgctttatgctttacttgattggaaaacagtagacaaagaaatgaattgctccatcgcaaaaaaaaaaaaaaaa

SEQ ID NO: 7142 - DNA, 1942 bp, Zea mays
attgggacctcgaggcggcgggaccccgaggccggccgggaacggctggggcgtggcttcacttcacgttgagcatcctctctttccttttttcccccaaactccaaaatccaatccaagcaactcctccccatgctcctcccgctcctcctcctcgccgccttcctccatggcttggcggaggcgcagggcggcctcccgtcgctgccgatcggggtgaactacggcgcgaacgcagacaacctaccctcgcccgccgccgtggcggcgttcctggccaagagcacgaccatcgaccgcgtgaagctgttcgacgcgaacccggccttcctcgacgcgttcgccgccaacgcgccctccatcgccctcgccgtctccatccccaactccgccctcccgtccttcgccgacagatccacgggcctggacgcggcgcgcgggtgggtccgcgacaacctgtccccgcacgtgtccgcgggcgccaacatcaccctcctcatggcggggaacgaggtgctgggccccaccgtggtgcccgacctcgtcgtggcgctgctcccggccatgcgccgcctgtaccaggcgctgcagctggagggcctgcccaaggtccgcgtcaccacgccgcactacctcggcatcctggcgccctcggacgggatcccctccaacgcgagcttccgcccggggctggacgccaaggtgctggcgcccatgctcaggttccacaacgacaccggctcccccttcatggtgaacgcctacccctacttcagctacaacgccgccacgctggactacgcggtgttccgccccaacgccggcgtgtacgacccggcgacgcggctcaactacaccagcatgttcgacgcgcagatggacgccatccacacggcgatgaagaagctcgggtacggcggcgtgcagatcgcggtgggcgaggccgggtggcccaccaaggcggaggccgggcaggtcggcgtaggccccgaggaggccagggatttcaacgccggcatgatccgggtgtgcagcggcgggaagggcacgccgctgatgcctgggaggacgttcgagacgtacgtcttctcgctgttcgacgagaaccagaagcccgggccggtcgcggagcggaacttcggcatcttcaacacggatctcacacccaaatacgacctggggctgctccgccaaggaccgcagtctggatctccaaccccatctccggagccctcgccgtcggtcggcggaggcaagtggtgcgtggccaagtccggcgcgagcgcaaccgacctgcagaacaacattaactacgcctgtgcctacgtcgactgtaggccgatccagagcggcggcgcgtgcttggaccccaacaacatccactcacatgcctcgtacgtcatgaacgcgtactaccaggccaatggcatgcacgactatgactgcgacttcaagggcaccggcgtggtcacctccagtgaccccagttacgggagctgcaaatacaacgcctcctcctgacggcgcgcagcaagtccagctggcactactgcaccagcctccagtccacatcgtcctccagctccaggctccagccatggccacgctggggacgggaggaggtccgtactgccgccgggcttgcgccacatacttgtatactcatgtctcacacccatgcttcttgttgctctcaaccactactagcactactatttgtctagttccataattacaagtccctctcccctcatgttaacttgatcattgtccgtgtgtagtggactagtggtggtgaataaaatagcttccattccatgtagacaaacaaacaaattgtaacatctgttatccttgggttatttgatatatttatttttcatatagtaaaaaaaaaaaaaaaaaaactcgggccacaaaaaggttgacttttttttaaccc

SEQ ID NO: 7143 - DNA, 1268 bp, Zea mays
gggaccctcgaggccggccgggaaagattgctactgttggtttgtccaatttctattgggttggggcaaaggatcgcctttatgttggaggccgagtcagcttcacaaggaaaagttgtcagactgtgctcatggcacatctgctctaccttgttagggccatttccccgattatgcctcacctagctgaggatgtctggcagaacctaccctttcaatacaccttgcaggatggatcccttgcaaactttgtttttgatctgaaatggccagaaaagaatgaagaatggctctcggccccgaaggatgatgttgatttcctgggtgttatcctggagttgaggtcagaggtcaacaaaattttggagaatgctcgcactggaaagttgattggttctagcttagatgcaaaggtttatctccataccgaaagttcagatacggtattaaagctaaaggagctatcttctgcatccaatgatgcagacgctctgcatcgcctgtttatcacatctcaggtcgatattcttccaatcctaaatgaagagattacatcatctgtaccatacacaggaaagttcagtaacccacgcactggagtcatatggattggtgtgactcgtgcggatggtgcaaaatgtgagaggtgttggaattacacacaggacgttggatctttccatgaccatcctactctctgcgttcggtgctatggtgtcattgagttgcagacacaacctgcggccgcagctgtcagttgaaaggagtgatgttaacgtatcctatcgaaccatctaattttgaggatcattggtggaattcattcttttggagagctttcacgctaccatgtggcggtagcctgggactccagcttgaatcaagttttgcatgcagcaagctgtactttagattcttcatacataggtcacgagagttgtttggagcttgggtcatcgcttactttcccatactactggggggcttatttggaacagttttttacacaaaactcctgacctgtaaatcaattttggaaaaccgtatccggtggtcgatccatgtattaatagagtaataatgttactatgttcatccaaatctcaaagacgtgatggttgtgttgaaaaaacagcttgaatcacttgcttatgctcaactgttttttcttcatgtacatgtgacggaagtttactgctgattgtttattacatccagttatcataatcaaatgtccaacgaggtggccccacctgcaggcatgcaag

SEQ ID NO: 7144 - DNA, 3675 bp, Zea mays
tgccctgctcgaccgtcgtcccccggagattgttccatccctgagactgccccctgcgcgcctcgcaggtgggcgtgtccggcgcactcgactgtggcccatgtttcacttctacgccatctcaaacggctcacggacaccgtcctctatctcataatagtataacacacaattgtacataagttatcatggtattatatgttcccgttgtaaggcacgagcactcacctattaggttaaagaaaagtgtaagagcatcatgaaaagctaaaatgatagttaaaaataaccttgacaatgatacaaggtaggtatagatatacctatatatttcctcgcgcaccaaacttcagcggccgttttcatgtcgcggccaaatcgatttatatcataatcggtccataccgttgagttgtaagtcagattttagcagaaatcgacgtgagtccggatgtgtcaagatgagatgcagatgcccatgtagcagaaatcagaatttaccttaatgtctagtttaatcataaacaagaagggaatctagtcccatcgctttgctcccaaactagcagggccgtcctacgaaaattcgagaccctgtacgaaactaaaacatgaggcctgctaggctaaagaaaataaggttaaatgtgtaatataatgtagtatgtagtacattgcaataagatatatcaagaatggtacctatttgaatagcatcattctttcagtattttttgaaatgaagtcttcaatgatatgctcataatccattttctccaacattttgccttcaagtgctattataaccaaaatctttgtactactcaaatctcgttgtaagagaggctatagcttgatcaactagaggtacaaaatactctactcgaaacaagtcctctcgagacattgtggtaatatttgtgtcttctgggttttcatcgtaacgtctctttcttttaatttgtctttttttaggaaatgttgtaccaatatctatctcaagtgcaatttctttgactgactccaaagcttctaagaaaccagtttccctatagccctcaaagaaagaaataagcccttgcactttctcaatagcaacatcaataagcatatcctttgcttgcattcaaattaacagcatacaatacctcataccaaatgactatcgccactataaattcatactgtccaagttcattatttgctagacctttagcctcactgctttttgccggatcattatcagtatcagatacctaaaattaaaagaaggaaaacatttttaatatataagataaccaacaaaattatataattaattcaatactaatatgaaaatattgagtacctcaagtagagcctcacaaatgtctccacattgaaatctgatagctttaatactgtcaatacgactctctcatcgtgtagctctgagggttggtttttgtgacaattcgtccattgatcctctccaattaccttgtcaccaagccagccctaactcactagccaatgcgcgtagcaggatcacagggaacacacagggagcttctattccagaaattaaggcccggtcaagacttcaatgaatgtcagcaactcatcagctgttacctgtctaccagctccattgctagcagcaataacggccccatcagtcatgaagctgctcagttccacagtaccagctctgcaaaagatcgatagatgcggtagtagtaaaatcccaggatgcgaatgcagtgacacttgatgttcatgtgcccctcgtcagatcccatccccctcgttcgcgccaaattaacgtgtacaaacgcagaggcagcagcttaaatttccgctgtacgtgcgcagtaactgcactctcactctctctcgatctctccctgtaacgtactgcgcaaacctaccagcattgaagcatcaccagttagttgatcaccatcctggattcctggtggtggtaccaagcatgcatcgggccgacgacgaagctactaggaccgcttcacaccggcctgctctcctataagtagcagtgcctcaatgcgacgccttttggcaagttcgatccagattatagcagctagctcaccgtcaccgacatacagtacaatagcagcttattagcttgtgtcagtccatccatccatccatggagaaactcgtctacttcgcgaccattatatccttatccatggcggcgctgctagtgccactccgcgtacagtgcgaagaagcagctagagctgctgctgccagaagctgccatgccggcaccggagcttctgcttctgcaccagccgcagcagcagcgtggaaaaggagctgcggcggcggcaaggcggggaagcagcagccgcaggtggagggcatgttcgtgttcgggagctcgctggtggacaacggcaacaacaactttctcaacggctccggcgtgcgcgcagactacctcccctacggcgtggacttccccctcggcccctccggccgtttctccaacggccgcaacgtcatcgacgcgctcggcgagctcctcggcctccccgggctcgtcccacccttcgccgacccgcgcacccggcgggcccgcgccgcgctgcgcggcgtcaacttcgcctccggcggctccggcatcctggagcacaccgggcaggtcaccgtgagtcctcctctctagctatcctagcctagctcctccgtccttgagtccacgtagacgtagcattaatcaatgagaatcgctcttaggggctagcattgattaaacatgcgcgcgcttccatttatgttcgttcagggcaaggtggtgagcctgcggcagcagatcaccaactttgagtcggtgacccttcctgacctgcgggcccaactgcgtggaccagctgcggccgccaaccactggatcaagggtcaagattccttccacaagtgctacctctccaagtgcctcttcgtcatcggcacaggtggcaatgactacctgctcgactacttcaaccccgggaacggcacccaagggggcccgcccttgtcagagttcactgcgtctctcatcaccaagctctccggacatcttcaggtacaccaactcttgccacttgtaactgcacaccgtgtcgtgctcgtgctaccttgttcctgttcttgctcaacctcacgttaatatggcttattttcaacgactgcattctaatgtgtgctgcatgcaccagtctttttgccccctgtttacttatgagctaatggattttttggctaaatcatcagttggttggctagccaaatatagctatttttaagtaactagcttagggcgtatttaggagggctctaaaatgcgcagccttcgactcttccaactgcactagctctggcaacggagctattttcttgcggctcttgggagggggtcattccctgtgagagcgcatttcacagaattaacgaagccagagccgctgcagcgtttctcgcctgcgcacatggactgccggacgttggtcggccaggagccggagctccccggagccatcccaaagaggcacttaatacatgtttatcaaataataggctcttaattaaagaagtgggtggtaatttagcaattactggtagctctgagtgtgtaaaaggaaggttaatttgttcctagttcaggggtgccgagctcga

SEQ ID NO: 7145 - DNA, 423 bp, Zea mays
aaaacacaagcatataccgaaagcaagcaaggcttcttctttttttctttctctcccaagaacatggaggctccctccaccttgctccagctctccctctcctcctcctcgtctccgggtcttcttctgctgctgctgctgcttgtgcagttgccgtccatggccagctgccacgaggagatgaagtccatctacgtgggccagagggttctccccgtgcgcctcggccggccggcgttcgggcccgagagcctcgccttcgaccaccgcggcgacgggcccttcaccggcgtctccaacggccgcatcctccggtggcgcggcgcccagcgcgggtggaccgagttcgcccacaaccacaagcacgagacggtggccatgtgcgcggcgaagaagaggctggtggtgccggagagcgcgtgc

SEQ ID NO: 7146 - DNA, 644 bp, Zea mays
ttttgacgataacaaacacacgtcttgctgcaaagagtacaaggaaatactcgctaattcagtcatggtttgctgtttcctatacacgatgtgccgccgtcaacattgaactccctcagtattgctcttgcacaatgagcaaaaagaatagcaccaaagatcttatactaaaaatgaacagcaaggaactgcacttttgcaatgccaagctgaatatagggaaaaaaactcatcaaaccataatgaacagtgtgaaatattctacgttatatcttggtactctgcaacataactcaggtttcgtgctagtgatccttcagacatcgtggatgctgttatggcaacgttccgcagaaagcatttcatcttattctcctcttggaatttgactgagcactccctcgtcacgtcaggggtgaatttgtgtcatcatggatgttgcaggtcaggcgtgattctgtttattttcatgatgaacaaagcccatgaagtctgttgtccaaatgccccaaaaaatgagtgtttggtgcatttcatgccctgttaattagtgaatgttgcattccgtcatgaacttctctccactggtcatgtacttcctccagtagttcttgtaatcaagtatcccccaagttcaaggccaa

SEQ ID NO: 7147 - DNA, 2374 bp, Zea mays
gcacgagaccattacctagaacatcctaatcgaaaacagctcgtgcgctctcgtcttcgcgatcgcgaacagtcgcggcggcctcgtcattgccgcagaaaccctaaccctagatccgccgtcatggatctcctccagtcctcttacgcgccggacgacgcgtcgtctccggaggcttcggcggccgcgtcctcgccggactcctcgccgctccgccttccgtccaagtccgccgcccccgccgtcgatgacaccgcgctcgcactctcctccgcggcgtccgccgcccgcccactcgactcttcgctccacctcgtcgccttcaacccaactgctgaccagctctgggctcccatcctcgggccccagcacccccacgccccgatctcgtccgcctccggcaaccgcaaccacaagctcggccacgttgaggacgccgctgtcctgccattcctattcgacgagcagtacaacaccttccatcggtttggctacgccgccgacccgtctggcctccacatcgtcggcgacgcccagccccaggcgcctgagcccgacactgtctacaacctcgccccttccgagcacaagcgccgtcgcctcctggccaaggcggacaacgaggcggagctagcccccccggaggcaaagaaccccgcctccgaggaatggatcctccacaacaagcagagtccctgggctgggaagaaggaagcgcctcccgcggagctcactgacgagcagaagcagtatgcggaggcgcacgctgccaagaaggccgagaaggaggcccgcctcgaagggaagagcgagaggacagaggttgtggtcaagaccaccttccacggcaaggaggagaaggactaccaaggacgctcctggatcacgccgcccaaggatgccaaggccacaaacgaccactgctacatccccaagaggtgtgtgcacgagtgggtcggtcacaccaagggggtctcagctatcaggtttttcccgaagtatggacatttgctgctctctgcgagtatggattgcaagattaagatctgggatgttcttgggtcacggacatgtatgcgtacctatatggggcactcaaaggcggtaagggatatatcattctccaatgacgggactaagttcttgagcgctgggtatgacaggaatatacagtactgggatactgagacagggcaggtgatctcgaccttttcaactgggaaggtcccatatgttgtgaagctcaatcctgatgaggataagcagcatattctccttgccggaatgagcgataagaagattgtgcaatgggatatgaagtcagggcagattacacaagagtatgatcagcatttaggggctgtgaacaccataacttttgtggataacaacaggagatttgtgacctcaagtgatgacaagtctcttcgtgtgtgggagtttggcatccctgtggtgattaagtacatcagtgagccgcacatgcattcaatgccatcgatgtcactgcatcccaactccaattggctggcagcacagagtttggacaatcagatactgatatacagcaccaaggagaggtttcagcttaataagaagaagagatttgctggccacattgtggcaggttatgcttgtcaggtgaacttctcacctgatgggaggtttgtgatgtctggtgatggcgagggtagctgctggttctgggactggaaaagctgcaggagattcaagactttgaagtgtcacaacggggtttgcattggatgtgagtggcatccgttggaaactagcaaggttgcaacctgtggatgggatggtgtaattaaatactgggactgaactttggcagagatattggttgagctcctgggaaaggttttgtaacaatccgattcacgccgaatgtcatggcatactgtaagtcacatgctcgacaagagaatcccggaggaaaaaacatgtgttttttgaggttacatatatgggagaaaaaggtggggttttgctgctacctttgtgttggttctgccctgttagatgtccaaatgtacaatattcgcaccatattcaaatttttagttgtatctctgccactagcaacttgtttgcggtttctggtaatcctgttccttcgaacgtttgtaccatctgaggaagtgtctgttgtgtagtatccaaaaaaaaaaaaaaaccctccggtctgttttataacttaggggttgtttgtttgggattgtaatctgtccagatcaaaataagttaagattatataatttgggcagattataatcacaaacaaacaggcccttagatagttccctattttaatagctggggccaagtgaacaggaaataaatagagattgagctg

SEQ ID NO: 7148 - DNA, 3921 bp, Zea mays
agagcattcaataaattaaagtgaccaatcagctagcctcctatctcgaacatagagctaagacactgtgtcttcgtcaagatacatgtcttgagtttttttacattcacccccctagacacactctaaaacacaacttaagacactcgtgcttcctgcccttagcagacacgagagggaagccagcaaccggtccggcccatatcatggacctcaaggaaggcccaagtacttcaaaggccgagcccacatcctcaacgaaatatcgccaatcgccacccagaactgaacccaccaaaaaaaaaaacaaaaatatccaaacccatcaagcggagcagcagaggtttatccctaccagcctaccactcccccccaacgcggcgacggcggaaatggacgccaagctgctgctccccttccccttcgcgccggccgcggccaccaggtcccccaagtcgctcttccttggcgccccgctcccgccgccgccgcggccgccgccgttcccgctgcgcctccgcccgcggcccgcggcggtggtggcgcaggccgccgtgaagcgccgcaaggaggcccccttcgacaccgtgatccagcgggacaagaagctcaagctggtgctcaagctgcgcaacatcctggtggcgcagcccgaccgcgtgatgagcctccgcgagctcggccgcttccgccgcgacctcggcctcacccgcaagcgccgcctcatcgcgctcctcaggcgcttcccgggcgtcttcgacgtcgtcgaggagggcgtctactccctccgcttccgcctcacgccggccgccgagcgcctctacctcgacgagctccgcctcaggaacgagtccgagggcctcgccgtcgccaagctccgcaagctgctcatgatgtcgcaggagaagcgcatcctcatcgagaaggtcgcgcacctcaagcacgacctcggcctcccgcccgagttccgcgacaccgtctgcctcaggtacccgcagtacttccgcgtcgtccggatggaccggggcccggcgctggagctcacgcactgggaccccgagctcgccgtctccgcggcggagctcgccgaggaggagagccgggcgagggaagctgaggagaggaacctcatcatcgaccgcccactcaagttcaaccgtgtcaggctccccaagggcctcaaattgacgcggggggaggccaggaggattgcgcggttcaaggagatgccctacatttccccatatgccgacttctcgcacctgcgctccggatcagacgagaaggaaaagcacgcttgtggagtggttcatgaaattcttagcttaacggtggagaagcgcacgttggtggaccacctcacgcacttcagggaggagttcaggttctcgcagtccctgcgcggcatgatcattcgtcacccggacatgttttacgtatcgttcaaaggggatagggactcggtcttcctccgtgaggcgtacaaggactcgcagctggtcgagaagaaccagctggtgctacttaaggagaaaatgagggctcttgtggccgtaccacgcttccccagaagggccgcagttgggactggcgaggaggctgagggaatgaatggatcattgcagtcgcgggaccaagtgagtgacgaggaatacgacgatgaagatgaggggctctctgatatggaagatctgattagtgagctttctggtggcaaatcggatgctgactacgagtggggtgatggctggtttggtgagaacgatgactcaccgccagactttggagacgacgaagtcaaggtcgccatgaaaattgctgatggttctgccaacggcagcgcacctgttcctgtatttcctgatggcagaccaagggaacggtggtaaattgaggtgtttttgaacttctgattgatagaatcgttaatctataatcttagttcttttatcatagtatctagttgcaaagccctttgtcttttgagtcgccctgctgattcctgtcaccaagcacatcacccttcgaggaacccacatggcaatgctaaaaagtcactatacaagcacaatcctctagtgaatgttaaaggcatacagagtcgtaagcctatatttcatataaatgtgcataatcaacgcggtcggtgtttcttagttttggattgtagtaacagttatctagtgtagttctcatatttggcaatttatagactaaaatggaataaaatagagggactaaaaattagtccctagaaaccaaacaaccccccaagtatgcactgaactatatgtcaggatagtgtatcagtaggctatgcatgaatatctagcatctttgttggactatctttgacccgttttttcatgaaaaaaaaattccagttgctattaaagtcatgttcttttaggggaaaaaaaggaatagttctgacctctacagccagccagttcttacaaagttttcagctcagttgctattgctggtgatcatcaaaaacgaggaaaagaccccagaaccagaatattgtcttctatccattcttgggaaagatgtccagaacgcagccctccaattctttattccgccaagcgtagtaatttgatttatttcccccagtggactggatggcaaataactttggaacagcacaaccatgcctatactttatttttgtttctgagacatacatttttcttagtaagtagcagccactggaaccaagagcattgacattttttttctttcgatttcaccccttgatctaatgatctgccggttgtttgagttgagtgcacaacaagaaggtggaggcaggaaactgggatatccaaaatgaactcatagggatttaagtgacactgctgacactcaggggagcattagtcctccaggttactcttgtcgtgcaatatctatgccattttttttttgccaaagctgatttctggcctttatcattcatataagttgagacatatcttccacttccatcacctggctgtctgtctggacaggcaggcagaggcagccagaacattaggggcctacagtataccattgccacacagattcgtttaagctgcagtgatggtctgaaatctgccatttttttcagagatctgtgagaggtatgattggtccttactcctgatgtgaactgtgtgttctgacttgaagtatatactaaggagtaagtataaatttgtgttttaactcaccgtcttgcttggaaaattgggtctctgctgttttactctgtggaagttgagttgcattgcctggtaattgatatagcttttgttttagctcccccccccggcagtcaaggaagagcggcaattgcttaccaggcaaggcatacaattcggggtcggagtcggtatcagtgcagcctccaaacacagtacagagcatacgcaaattgtcggcgatcgttttggaaattggaactcctcctgtgctgtgcagatgtgggctcctgctgcttggacaccatgccgcttggagctttccaagagcgatcgctcctctgcgatgcgaccgcctctcgctctcgtcgtcggcgacttctccgcacgcgtctcgtatctaccgtaggtaataaggcccacctgtcctggatgacgcaacgcgtgctcacgctcatgacgccaccgcgcacgtagtggaaaagtggactaatgctgctggcagggttagggtcagggtcagcccccttcagtagttcagtcatcggcagatgccctcccttttcgcaccggaagcaaacaaaagctcggtccggcacatccatcggcggcgtggtgggcgctcgaagacgacgacccgtcagctgcgactccagcggcggcgaggccgaggccagggccgggggtttcgaactggaacgccctgtactcgttcatcttccacttggtc

SEQ ID NO: 7149 - DNA, 1077 bp, Zea mays
gcacagcttgttggaggcgtagaggaccgtccctcacatttagcggacaggagagtttagcggctcttgttggaggcagccttaaaccgtccgcacgccgtcttccccatctcgcgcagcgctactgccggctgtccggagtcccgaccaccgtcctcggctccccgccgtgaatccatcatcccgtaatggagacctgcccgtcggtgaagaacatcctcttgctggactcggagggaaagcgcgtcgccgtaaagtactacagcgatgactggcctactctatccgcgaagctggccttcgagaagtcggtatttaccaaaacccagaaagcgaatgctggaacggaagttgagattgtaatgtttgacggtcaaattgtggtatacaagttcatccaagacctgcacttttttgttactggaggagaagaagagaacgagcttattttagcatcagttcttcagggattctctgatgctgtcgaacgacttctcaaaaacatggttgacaaaaggacagcactcgagaatttggatatgatcctattgtgccttgatgaaattgttgatggagggattgtacttgaaacagaaggaagagagatagctgaaaaggtgtctggtcatggattggagggtgcttcatcagctgagcagactttagtcaacgccctaacgcaagcaagagagcatttggcgaagtctcttctcatgtgatgctatgctttatatattagggtgacgatggagtatctataactgtgtctggatgacacagttttttttggttagcagtggacccaaaaaaaatgtctgaaatctttgaatgtgtagaatggcatgttgtgtccaaaattttcatttgtaagccttcaaagttgtgtagcatgttttttcttctaattttgactggtttagttatcggtcgttttgtttaatctcttcctgttggaaacggtaaaatagcatgcttgatggcatgttgtaacttaacaaattagggctacactttgtttaagatggtaatatgtctccctgaaaccaaaacattattggaaaaaaaaaaaaaaaaaaa

SEQ ID NO: 7150 - DNA, 1945 bp, Zea mays
ctgcaggctgcatctattccaattttgaactgaagaaactggtttcttttaacttggactggagcgtgtcgttcatctgctgagcagactttagtcaacgccctaacgcaagcaagagagcattttgcgaagtctcttctcatgtgatgctatgctttatatattagggcgacgatggagtatctattactgtgtctggataacacagtttttttttttttggttagcagtggaccaaaaaaaaaaaggtctgaaatctttgaatgtgtagaatggcatgttgtgtccaaaattttcatttgtaagccttcaaagttgtgtagcatgtttttttcttctaattttgactggtttcgttatcggtcgttttgtttaatctcttcctgttgtaaacggtaaaatagcatgcttgatggcatgttgtaacttaacaaattagggctacactttgtttaagatggtaatgtctccctgaaaccaaaacattattggaatctgctaaaaattcaccttacaattttgtatccctgttttttatattaatgggtgcaaaaagcaaagggtgacggtgagtgtttactcgccggcggtgacatggtgagacagatcgtctctccgcttgattgcattgtcgacatgtcgagacaggtcgtctctctgcttgattgcattgtcatctgcggcgtcactgaactgctgcttgtagccaaggtcatggttgcctgaaaccagttcgtctctgcttggagtcccttccatgtcgatgatgatgttggttatcaagcagcagacaaagatgatccgtggcagccggtgtttgtcaggcctccacagctctccctgaatgacacgccacctccctttgagcgtcgccaatgcggtctgcaccaccgccgccgcggccgtgtgccgcttgttgaattccaccttggccgcctggaggccatgttcccggtacggggtcatgagccagggaagtagcgggtagcttgcatctccgactaggtactccctaaccgcggaacctccgggaagctccatctgccccccaagcctgaggcccttctcacacaacctgtacaggcctgaagtgcgaaggatgcacgtgtcgtccatgctcccaggccagccactgacgacgtctctgaaccgcaagtctgcatccacaacggcctgcagcaccatgctgtttttgttctcattgtccagccagaccttgctgttgggctgagccgaggaacacatgaggatgtgtgtggtgtcaatggcgccgcagcagttagggagcccgtaaaccttgtcaaaccttgtcttgatggtcgccatctcctcagggctcggccatttcaggtggcagatggcacgctcctccacggactcgatgaaccgccatgtgatgttcgagatggcagagtggttcatgccaaaccacattcctatgttctgcagcgactcaccagtagtcagcctcatcagagccaccgccacctgatcctccaccccaaggactttcttgtcaccaaacctgaagtttctgaaaccgtatgtctttgttgtcaggtccttcttaacaagtgagcagatgtagtcgaaggttcttcttgacatcttcaggacagactccatgttctggtgttctcttggaaaaggggaatgtcctgcaacccttcggtagaagacgccccaccaatcgctaccgtccggcagcggcggcagcggcaaccctggagtaggcgccggggcgggcttctccggccgcttcctcttcttggcacctcgcacaggagccatggacgcgaggagatcaagagaggcacaacgaggactcgaagactggaggtctgagatgttgtgccccctcctcgcaaaataaagtgttttccttttccacgcaaggcccgggggtggccgtgctgtgcagctacgaaagtgctgcgcagagcat

SEQ ID NO: 7151 - DNA, 3327 bp, Zea mays
  misc_feature (2408)..(2408): n is a, c, g, or t
cctcgaggccggccggggcgcacttaagccgtccgcacgccgtcttccccatctcgcgcagcgctactgccggctgtccggagtcccgaccaccgtcctcggctccccgccgtgaatccatcatcccgtaatggagacctgcccctcggtgaagaacatcctcttgctggactcggagggaaagcgcgtcgccgtaaagtactacagcgatgactggcctactctatccgcgaagctggccttcgagaagtcggtatttaccaaaacccagaaagcgaatgctggaacggaagttgagattgtaatgtttgacggtcaaattgtggtatacaagttcatccaagacctgcacttttttgttactggaggagaagaagagaatgagcttattttagcatcagttcttcagggattctctgatgctgtcgaacgacttctcaaaaacatggttgacaaaaggacagcactcgagaatttggatatgatcctattgtgccttgatgaaattgttgatggagggattgtacttgaaacagaaggaagagagatagctgaaaaggtgtctggacatggattggagggtgcttcatcagctgagcagactttagtcaacgccctaacgcaagcaagagagcattttgcgaagtctcttctcatgtgatgctatgctttatatattagggcgacgatggagtatctattactgtgtctggataacacagtttttttttttggttagcagtggaccaaaaaaaaaaaaaaggtctgaaatctttgaatgtgtagaatggcatgttgtgtccaaaattttcatttgtaagccttcaaagttgtgtagcatgtttttttcttctaattttgactggtttcgttatcggtcgttttgtttaatctcttcctgttgtaaacggtaaaatagcatgcttgatggcatgttgtaacttaacaaattagggctacactttgtttaagatggtaatgtctccctgaaaccaaaacattattggaatctgccaaaaattcaccttacaattttgtatccatgttttttatattaatgggtgcaaaaagcaaagggtgacggtgagtgtttactcgccggcggtgacatggtgagacagatcgtctctccgcttgattgcattgtcgacatgtcgagacaggtcgtctctctgcttgattgcattgtcatctgcggcgtcactgaactgctgcttgtagccaaggtcatggttgcctgaaaccagttcgtctctgcttggagtcccttccatgtcgatgatgatgttggttatcaagcagcagacaaagatgatccgtggcagccggtgtttgtcaggcctccacagctctccctgaatgacacgccacctccctttgagcgtcgccaatgcggtctgcaccaccgccgccgcggccgtgtgccgcttgttgaattccaccttggccgcctggaggccatgttcccggtacggggtcatgagccagggaagtagcgggtagcttgcatctccgactaggtactccctaaccgcggaacctccgggaagctccatctgccccccaagcctgaggcccttctcacacaacctgtacaggcctgaagtgcgaaggatgcacgtgtcgtccatgctcccaggccagccactgacgacgtctctgaaccgcaagtctgcatccacaacggcctgcagcaccatgctgtttttgttctcattgtccagccagaccttgctgttgggctgagccgaggaacacatgaggatgtgtgtggtgtcaatggcgccgcagcagttagggagcccgtaaaccttgtcaaaccttgtcttgatggtcgccatctcctcagggctcggccatttcaggtggcagatggcacgctcctccacggactcgatgaaccgccatgtgatgttcgagatggcagagtggttcatgccaaaccacattcctatgttctgcagcgactcaccagtagtcagcctcatcagagccaccgccacctgatcctccaccccaaggactttcttgtcaccaaacctgaagtttctgaaaccgtatgtctttgttgtcaggtccttcttaacaagtgagcagatgtagtcgaaggttcttcttgacatcttcaggacagactccatgttctggtgttctcttggaaaaggggaatgtcctgtgaaaagagaaatgttgcagtattgttactggtgaaatattacatctctcacacatcaggaatatgaggcctgcaaataatttaaattttgagaaacatgcttatttaacaggaaacgcaaggcccaacacgttttacaacaacagcgaaatactaatgatactgactgttaagcattcttaaaatataaccatttaagaacagtattataatagatatgtatgcagcattntcctacagacacaagtttgattccagcaatcaaagatttggttttgaacaggagtgcatagaaaacaactattaatgtgcttgacccttgatttgtggcttctgtaggatttcaactctagcctacccaccctaacttccttgaggctaaaagactttgtttgttgcagcattctcctgtaaaatcgacatttaaggcagataaattgctcaattataacacgcatatcaattttgaagatacaatatcatttctacagtattccccatgaacgtgcaaaagatatgcacctattggaatacaaagttggatatagtttcacttgtaacccttaacatattcatttgaaacaagtgaacttatagtttcaggctcatatttctagaagttggtgagtccatttgatttaaaatctgaatgacttctgattctaacgtttggcatatctttaaaataagaatggtgcagtatgtaccaggcactctcagctcttactggttaatatcagtttagcagtcaggatacctgacatgtatagaactatggcatccaaaaaaaactatggaaatgaaggacatttttacagaaagatttcctgtggttgccacaattggcctctgaacttgactaatcatactaaacactatgagtagagtctgcaatgaatagctcaaaaggatcatgtaaactatcaaactgcattgccattcttcctttgagctcaatctgtcaaacataaacacatacaattcaccaagctctgaagtttcaatatatgatgtcagcttgcttatcaagcatcagcgagttccacaagtacacttcgagctcttttgtgcttgtatgaagcacactaatcgaccctaatataagcttccaaaaaagcatacccaaggtttagcgacaatttaataaatac

SEQ ID NO: 7152 - DNA, 1339 bp, Zea mays
ccggccgggaacgtagaatgggcttccagttgccaccgtggcaccgcaggcttcccttccgtttcgtcatcctccgcccccccgcccgcccccaaaacgtccgcacgccgttttccccatctcgcgcagcgctactgccggctgtcccgagtcccgaccaccgtcctccgcggctccgctccccgccgtgaatccttcctcctcccgcgatggagaccttcccgttggtgaagaacatcctcctactggactccgaggggaagcgcgtcgccgtgaagtactacagcgatggctggcctactctctccgcgaagctggccttcgagaagtcggtcttcgccaaaacccagaaagcgaatgctggaacggatgcagagattgtaatgtttgatggtcaaattgtggtatacaagttcatccaagacctgcacttttttgttactggaggagaagaggagaatgagcttattttagcatcagttcttcagggattctctgatgctgtcgaacgacttctcaagaacatggttgacaaaaggacagcactcgagaatttggacctgatcctattgtgtcttgatgaaattgttgatggagggattgtacttgaaacagaaggaagagagatagctgaaaaggtgtctggtcacggatcggagggtgcttcatcggctgagcagactttagtcaatgccctaacgcaagcaagagagcatctggcgaagtctcttctcatgtgatgttgtgctttacattttgggggtgacgacggagtatctattattgtgtctggatgacacaattctttttgttagcaacggagaaagaaaaatgtctgaagcatttgaatgtgtagagtggcacattaattccaaaattctcatggtcatctgtaagccttcaaagttatgcagcatgattgttcttatattgactggttcagttatttgtcgttaaaaaaaaaaaaaccccaaaaaaaaaaaaaaaaaagggcggccaaaaactagtgagctcaaaaaaaaaaaaaaaaaaaaaaaaaaaaaaaaaaaaaaaaaaaaaaaaaaaaaaaaaaaaaagggggggccccttaaaaaaatcaaattttaaaaaccggggtttggaaagtaaaattttttttataggggccccaaaattaaattcccgggccccctttttaaaaccccggaatgggaaaaacccggggtttacccaatttaatccctttgaaaaaattccccctttccccagttggggaaaaaaaaaaaaggccccccccaatcccccttcccaaaatttgccccccctaaagggaaaagggaacccccccttaaacggcctt

SEQ ID NO: 7153 - DNA, 973 bp, Zea mays
  misc_feature (8)..(8): n is a, c, g, or t
gtaccctncgaggtcgcggcccccgggccggcccgggaaaacgtccgcacgccgttttccccatctcgcgcagcgctactgccggctgtcccgagtaccgaccaccgtcctccgctccccgccgtgaatccttcctcctcccgcgatggagaccttcccgtcggtgaagaacatcctcctactggactccgaggggaagcgcgtcgccgtgaagtactacagcgatggctggcctactctctccgcgaagctggccttcgagaagtcggtcttcgccaaaacccagaaagcgaatgctggaacggatgcagagattgtaatgtttgatggtcaaattgtggtatacaagttcatccaagacctgcacttttttgttactggaggagaagaggagaatgagcttattttagcatcagttcttcagggattctctgatgctgtcgaacgacttctcaagaacatggttgacaaaaggacagcactcgagaatttggacctgatcctattgtgtcttgatgaaattgttgatggagggattgtacttgaaacagaaggaagagagatagctgaaaaggtgtctggtcacggatcggagggtgcttcatcggctgagcagactttagtcaatgccctaacgcaagcaagagagcatctggcgaagtctcttctcatgtgatgttgtgctttatattttgggggtgacgacggagtatctattattgtgtctggatgacacaattctttttgttagcaacggagaaagaaaaatgtctgaagcatttgaatgtgtagagtggcacattgcttccaaaattctcatggtcatctgtaagccttcaaagttatgtagcatgattgttcttatattgactggttcagttatttgtcgttacttgttttgtttaaccttttccctttggaaacgttaaaatagcaagcttatggagataatttagcaaaaaaaaaaaaaaaa

SEQ ID NO: 7154 - DNA, 1698 bp, Zea mays
tcgaggccggccgggtctccggcagacgacgtcttctccaacgatgtcgcagatgacgacgctcctaccccaactctcgacgctgctcaacctccatgctcaagctgttgttgtgcccatcatccgagctcttgtatcgctcttcctcgacgtcaactccaccttctacgctcgatgttttattttagttaaggggtaaagggtcgtattcgctagcgtttgagaaggagcatcatccccagccgaacgcacagcaatctggtccaacatccctgcctattcctcaaaggtaggccctgattaaataatccttaactgtctgatcatccatgttgcaacgattctcctgtactgtgatatggtataacaagtagtactgtacgattctcccggggagctcgacgatctagatggagatgacggggtctctccctgtgcccagcgtgcaggccatggtggccgctggtcgtcatgcaccagtgccaccaaggtatctccgtccagatctggccgcggatgtcgtcgttgccgacgacgcgacgaccatccccatcatcgacttccagcgactgctgctggtcgacccagaggaatctgcgcgcctccatgcggcctgccaggactggggcttcttccagctgataaaccacggtgttccggacgatgtgatggaggcgatgaaggccagcacccagtcattcttcgcgcttcctgcggaggccaagcagcagtaccgtcagcaggcaggacagctggaggggtacggccagctgttcgtcgtctccgaggaccagaagctggactgggccgacgtcctctacctcaacacgcagccgcccgagcaccggaacctcagcttctggcctgctggtgagagcttcaggcagacgctggacacctactccgccgccgtcaagcacgtcgccgaccgcctgctgggagccatgtacatgaacctgggcctccagctgagcatcatggacatggacccggagcggggtgccgggatacagtcggtgaggatgaactactaccctccctgcgctgaagcggcggacaaggtcctgggcttctctccgcactccgactcggaccttctcaccctcgtcctccaggtcaaccagctccagggcctgcagatcaagaggccgcccgacggcggcggtgcctgggcctggcttcccgtcacgccgctgcagggcgccttcgtcgtcaacgtcggggacgtcctcgagatcttcaccaacgggaggtacaggagcgtcgagcaccgggctctagtcaacgcccacacggagcgcttgtccatcgcggcgttccactctcccagcatccatgccaccatagggccgctgccggagctcctcggggaccaggaggtgcccaagtataagacgctggaccaccaaagcttcattacgctcttcttctccgccaagctccagggcaagagcttcttggaacggatgaagaagctttcgtagagccaatcggacggaccggaaagttaagcaggccgacgtaaagtcggattacatgttatcggttcggccatagcaatatagcacgcatgtatgtccggattaatttggtgaccgacgagactagttttgtctaccaattcacttttacatcgatttttaaatataaaaaacttactaaaaaaaaaaaaaaaaggcggccgcagggaaggagctc

SEQ ID NO: 7155 - DNA, 1146 bp, Zea mays
cacgcgctctgtctccgtgcggaggagggacagcagcgtcaatccggtggtgttatcgccatcggcggtgtctccaagtgccaacgatggacctaaggatgcgtctgccgttttcggtgagatctcctacgagcagctggtccttgccaccggcggttttggcgacgaccagctcatcaaacacgggcattcgggggacatgtaccatggtgtgttggagaatggctcccatgtcattgttaagaaggttggtgcaaagggcgccaacagacatgcgagtgaattggatttctacgtgaggtactcgcacgaaaggatcgttccgctgctcgcgcatttgagcaatgacgatgacgaactcatggcttacaagtatatgccgaagggggacttaacccatgcgttgcacaagaaacctgtagacaccgcagatggcttgccctccctggattggataactagactgaagattgcaactggcgtggctgaggctatgtgcttccttcacgaggaatgtagcccgccattagttcacagagatatccaatcaagcagtgtccttctcgatgataaatacgaagtgcgacttgggagtatgagtgacatatgcatccagcaaagtgggggaagccagaatgtcttcactcggatattgagatcatcaaagtctctcgacaagcacacatcaggtccaccggccacttgttcctacgacgtgctctgcttcggcaaggtgctgctcgagctggtgaccggcaacttgggcatcagcggaccaaacgacgcggcgtcggaagaatggctgtcgaacacgctgaaccacatcaacggcggcgacagggcgagcatcgccggcatcatggacccgctgctcctggtggacgaggaccacctggaggaggtgtgggcggtggccgtcatcgccaagacgtgcctaagcgccaagccgtcccgccggccctcggcgcgctacgtgctgcgcgccctggagaacccgctgcgcgtggtgcgccagggctcctcccggtccaactcggcgcggcagcagctgcggagctcgtcgtcccggagctcgtggcagtccgtgttccaggggaaccaccgggtgcagagcctggacgcctcagcgacggcggcgttggcgct

SEQ ID NO: 7156 - DNA, 1532 bp, Zea mays
aactaatcgaaaaaaagttggctcacagaacacagcgcccgcccggacgcaaggggcacgagggagaagcgaggaacggcggcggcggcatcatggcggcgcggaacatccttcgcggtgcggcatgcggccaccgcttcctcgtgcccgtcccctcaggcgctcttgctggttctggaagccggagcatcggcgccgtcgctcagggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctcaaacagaatcatgccaatatcatgcaagttccagggttgtttgaggtcaaattagcaccaaaagccggctctgatctcaagatcccaattgggaaaatggccatggaggttttgagtggtcagagattcaaagaggcaaaaattgaccctttcgccaaagcaagaaagtcttctcgaaccaatccatttattggggccgacaaggacggtagcactgtcttcgcgcaaccaaccgttcttcgagggcatgcaatgtacaactttttggtgaggatgctgacagtgatgtccatgttaaattctcgggccgacattcgggagaacactgtgaagttcttcatggaaacggagttctgtgagttctctccagaattggaagaccatttcgagatatttgagcacatccgaggtttcaatgtgactatcgttacttcagccaatacaaaagatgagacctcactactgtggagtggcttcatgcttaatgacgagggagagaccaagtaaggtagaactgttgatctttgtttctgcttaatctccctgatattgtagttgctgcccaactggaccttcagttggctgttgatgtcaaaaatgattttggaaatttggtgcttcgtgctctaggagtgcgcaatgtcgcagccttctgttttgtagactgaatgagatgacgtgattgtttttcatcttgacgcgtggagctcatgtttgataactacgtctagtaccatgtatgaacataataatcttggtctaataagcattgttttgcttattcctgtggttcctgctatagtaacatggaatgctcgtttctgtttgacaaaaaaaaaaaaaaaaagggcaacgaaatggagttcctcccatttttagtcctatttttcagtcctgtgagcatgatatatatatgtccaggacccaaatcattctgctcttacttgatgccacatcaaacctctctttgtatttataaaaaagtgaaaataattcaatacctcttcgcatttgcggtttcctatttttctaaagcgatcaacaatagcaacatttgtaacttccaatgttttttgtttttccacataacaaatatgactattactcatgtactcatccctatgggtagtaatgtgctctaaagtctatactataaaattaaggatc

SEQ ID NO: 7157 - DNA, 3045 bp, Zea mays
  misc_feature (109)..(109): n is a, c, g, or t
  misc_feature (1653)..(1653): n is a, c, g, or t
gaagttggtgactgacgttgtatctgacgcttctgtggcaggtctctcgacaagcacacatcaggtgcgtaaatcttccacatatgctgctcatgttcatttctcgtgnaagaaaaaagaatccatgtttatccgaatcaccctttctttattatgaaccttgcgcgatgacaggtccaccggccacttgttcctacgacgtgctctgcttcgccaaggtgctgctagagctggtgaccggcaacttgggcatcagcggaccaaacgacgcggcgtcgggaagaatggctgtcgaacacgctgaaccacatcaacggcggcgacagggcgagcatcgccggcatcatggacccgctgctcctggtggacgaggaccacctggaggaggtgtgggcggtggccgtcatcgccaagacgtgcctaagcgccaagccgtcccgccgtccctcggcgcgctacgtgctgcgcgccctggagaacccgctgcgcgtggtgcgccagggctcctcccggtccaactcggcgcggcagcagctgcggagctcgtcgtcccggagctcgtggcagtccgtgttccaggggaaccaccgggtgcagagcctggacgccgcagcgacggcggcgttggcgctggaccggcggcactcgctgaggtcgcacggtagcggaggcgaggcgtcgttctcgttcaagagagccttgcccgtgcccacggacaccgcgccggagccggctgcggcgctcgacgaggacgccgttattgtctagtgtaggaggcggacattccccggttcttagcttctttacagggcggtgttcttgattcttttcccctgcgtgatatcacgtcgtcgcatgtgtgtgtataatttgttcctgtctgatgcgttcatccgtgttccaacatgaccaaaaaaaactgtgcataaagagtacgttttcaatactttcaaggaaaatttgaactttatcttcagcatgtcttccttgattttcaaagctgagaaacaattaaacaaagacagttgggccgctttcaggagaaaaaaaaaaacaactgggcagcagaacgtccacagatggcaccccccaccccctccccagcccccaaaaaaactcagcgggcccgtcgtagcacaggtgacggcctggtatagcccaaagttggctcacagaacacagcccgcccggacgcaaggggcacgagggagaagcgaggaacggcggcggcggcaacatggcggcgcggaacatccttcgcggtgcggcatgcggccaccgcttcctcgtgcccgtcccctcaggcgctcttgctggttctggaagccggagcatcggcgctgtcgctcaggtctgtccattcccctccaaagccctaaagctaggcttcctgtgctaacccgaatcaagcaagccccgtcaacctcccccgccgtcgtcttcttctctgttgctctcctctccaccgggtccccatctcctcccttcaccgccccagaactcctcactcgggcgctgccgctgcgaggtctccgtggcatcggtactcccgacccgccccactccgttcgatcgatccacttttccttttcgcgaaactttctgccctttttcttcgttgattgatcctggaatcggtgttttcctttgttnactcggattctcggacccgaagcctaccaaattttggagtaatttggtttgtactctgtagtgatgcaatggaacgacttaaaagtaattttgtttgtagcgctgcagcggaatggtttagttccgagaatctgcggttaagtttgttttgttcatgggatgtatgcaccaaggctaggctgatgcaacaaagggaattcgttgttttttcttttttcaacaaatcagaagctcaaatgatgaaatgaacattcttaacaactggacatgaacaggttgcccacttaccaaataactactagtaccgttttgttagattccacatttgtttgtcggcttgtcgccatgattttacattttagtatattatgctaattgaatgtgtttgaagcggaaattaaatttggttgtcgtgttctgagtgatttgatcatatctggatccgagcttgaacaccagtctgcattgcattgcatcctcgttgttgcaactagcagagaggcatgtgtcatcatctgctcttacttgagcacttcctgaaggttgaagggtgaagttaggaatttaaagttagggttgaaaaattaagcacacggttttatttgtctgtttttgtctaccataacatttgttttgtgtgtatacttaccgcatcgatgcattcttgtttatggaaaatgcagtattaccatatgtataggtcaaacatagggcagggtgcttgagaatcaatgcttgatcctttcttgcatctctttattacaagtttaccgtacacatgattactgattcctcaaagcctcagatgaatcgaatcagacagcctatatatctcagttagcccaaacttggtttgtgtcattggttgaatgaggaacaccaaatgatctcacaaatgcaccaatctagaatacagccttcttgcattgcaaatagcactaattgaacaatggtaaaacaacgtctttcactgcacgctgttattaaccgtacgaaccccctgagtaggagcgcccaatgatctagctgaccttttccaatcatatcagattggaaaaacacattatgattgagatacatcttttctccaaacgactcagattggacaaatctgcattttcctattttattttagttctatcaccctagtaccctacataaaattcaatttcccccctgcatatataaggtggaaatgttttctttgaactaattacagtgtttacatgcagggccttcgtcattacgcagcagacgaagcagtgggaaacttggaactgcatgcacccaaggcaaaacgtcggtcatatatcccaacgaaaaatggaacagccatgatgcttccgctccatattcattacgaagatgtactacgtcaggatctgttgctca

SEQ ID NO: 7158 - DNA, 1410 bp, Zea mays
  misc_feature (34)..(34): n is a, c, g, or t
gcacgagaccattacctagaaacatcctaatcgnaaaaatttttcgacatgccgcgcgagctggaggtccggtacggtggctggctggacgctgggatccgggaggagtacgagcactacgcggacgtctgcttcggggcgttcggcgaccgggtgcggctctggacgaccttcaacgagcccaacctgctggtcaagttccagtacatgctgggcgcgtacccgcccagccgctgctccccgccgttcggcagctgcgggagcggcgactcgcgccgggagccgtacgccgcggcgcacaacatcatcatgtcccccgccgccgtccgcgcctacagggacaagtaccaggcgacgcagggcggctccgtcgggatcgtggccgccatgaaatggtacgagccgctgacgaactccacggacgacatcctggccgcgcggcgcgcgcaggctttcgagacggactggtttctggagccgatattcttgggcgattaccccggagcgatgcgggagatcctgggatcggacctgccgaccttcaccgcggaggagaaggcgctgctgctgcggtacaaggcggacttcatcgggctgaaccactacacggcgatctacgccagggactgcctgcgctccccgtgcaacctcgggtcgtacgaagggaacgccttcgtctcggcgactggggaaagggacgacggggtcaagatcgggggagatactgcgctggcaggtttcttcgacgtcccagaggccatagagctggctatccagtacgtgaacgggaggtacaagggcacgcctgtgtatattactgagaacggttactcgcagtggagtgatgccagcagggaggagctgatcaacgatgtgaggagaaagaactacctgcagggctacatcacgtatctatccaaagcagtcaggaacggagcaaacgtgcggggctacttcgtgtggacgctgctggacaacttcgagtgggcgttcggttacaggttgaagtacgggctgtaccacgtcgacttcgacacacaggagaggacgccccggatgtctgcgaggtggtaccagggcttcctcacggcccgcaccagccagcgcgacgaagcagcgcaggcacggagagcagactcgtgatgaaccattcccacttccaccgatatatatcatcgaacgccttgctagacagccgagggtctcatgactcgtgctcatttccgtcctcgcggtatattggaataactgtggctgtggtgtcctaatgtctgtatatgcatatatcatatattttgacctcaaaagaggtttagatcaaaaaaaaaaaaaaaaactacccctggagcgcgcgccggtacccccaaaaaaaaaaaaaaaaaaaaaaaaaaaaaaaacaaaaaaacacac

SEQ ID NO: 7159 - DNA, 430 bp, Zea mays
gcaccgcagccgtcttctccttcccttccctcctcgctaaaaagccaacgcaaccgcttctcctcctcctcctccgcctcctccctcctcaactcaccccagcacgcctcagcccgcattccgccacccacgcgactgatcgaccgacgacttccccattcccgccccgcaacccgcagggctctgggttcggggcgggaatgggggaggcggcacggcacggcacgtctggcagcggcgaggtcgatcccctaccggcgggacggagcggggcagggcgtggcgtggggtttaagggtggcaggcggcaaggcaatggtcgctatgcagtttggtatgtatgtatggatggatccaagtatgtatgtttctacctaccagtacgaatgtattaaagcatccgatttgggaacgaaaaaaaaaaaaaaaa

SEQ ID NO: 7160 - DNA, 1216 bp, Zea mays
acgacccaacctgggctggggcggctgggcggcacgccgctgaaacggtctccaaccccactgggcaactgcaactgcctgcgccagcgcccccctcgattgaaatctcgccgccagttcggtcgcactcgcaccgcagtcgtcttctccttcccttcccttcccttccctcctcgctaaaaagccaacgcaaccgctcctcctccttctccgcctcctccggtccctcccctacttccccccagcacgcctcagcctgcattccgccacccacgcgactgatcgaccgacgacttccccattcccgccccgcaacccgcagggctctgggctcggaggaaccgagggcgagggacctccgaccgggaccgggccgggcgacatgttgggcgacctcctctccaggatcctcctgctcctgttcggctacgccatgccggcgttcgagtgcttcaagacggtcgaggcgcgccccaacgacgcccgcatgctgcgcttctggtgccagtactggattatcgtggccatggtgatagctgttgagagcgtgatctcttggatgccaatgtattcagaaatgaagctagctttctttgtgtacctgtggtaccccaaaactaagggaagtgacgttgtatatgacacctttcttcgccccatagttatgcaatatgaaccgaacatcgagcagagattgctccatctaagggcaaaatctgggcagttaatttccttctacatgaagaattttgcggataaaggaacagccttcttcatggatgtcctccgttatgtcgtatctgagaaacctgaaggatccaatgcagagcaaaggagcaagaagtccggctggagccccttcgcgaccaagcgccgaccaccatctccgccgccggagcccctcttcgacagcaacccggacgccgccgtgctggccgaggccctgcgtggcgccatcggtgcaaagccccggcgtgcgcccaacgacaagcattactagagggaattattaagagcgattttagggatgattgtttgtacatagaatgaacgaacgaatcaatcaaaggcacgaggggggaaaagagttagtacatagcaaaatccagcaatacattcaccattgtgaagaacggatggatggatttgtacctagtacggttcaagtaaatctgatatgatggaaatggttagtttttattgcgaaaaaaaaaaa

SEQ ID NO: 7161 - DNA, 1146 bp, Zea mays
gcacgagccaacccctcggggcctcggcaactgcctgcgccagcgcccccctcgattgaaatctcgccgccagttcggtcgcagtcgcaccgcagccgtcttctccttcccttccctcctcgctaaaaagccaacgcaaccgcttctcctcctcggccgccgcctcccccctccctccccaactcaccccagcacgcctcagcccgcattccgccacccacgcgactgatcgaccgacgacttccccattcccgccccgcaacccgcagggctctgggttcggaggaaccgagggcgggggacctccgaccgggccgggcgacatgttgggcgacctcctctccaggatcctcctgctcctgttcggctacgccatgccggcgttcgagtgcttcaagacggtcgaggcgcgccccaacgacgcccgcatgctgcgcttctggtgccagtactggattatcgtggccatggtgatagctgttgagagcgtgatctcttggatgccaatgtattcagaaatgaagctagctttctttgtgtacctgtggtaccccaaaactaagggaagtgacgttgtatatgacacctttcttcgccccatagttatgcaatatgaaccgaacatcgagcagagattgctccatctaagggcaaaatctgggcagttaatttccttctacatgaagaattttgcggataaaggaacagccttcttcatggatgtcctccgttatgtcgtatctgagaaacctgaaggatccaatgcagagcaaaggagcaagaagtccggctggagccccttcgcgaccaagcgccgaccaccatctccgccgccggagcccctcttcgacagcaacccggacgccgccgtgctagccgaggccctgcgtggcgccatcggtgcaaagccccggcgttcgcccaacgacagcattactagagggaattattaagagcgattttagggatgattgtttgtacatagaatgaatgaacgaatcaatcaaaggcagaggggggaaaagagttagtacatagcaaaatccagcaatacattcaccattgtgaagaacggatggatggatttgtacctagtacggttcaagtaaatctgatatgatggaaatggttagtttttattgcgtc

SEQ ID NO: 7162 - DNA, 860 bp, Zea mays
  misc_feature (857)..(857): n is a, c, g, or t
acacacaacagaaacaccacctccaggcttcccaaatcccaacaagggctaccgcccaccggccaccaccccacgcgcgtctcacgccatgggcagcgcgtcgtccccgccatctcacaggcggtggagctggggctcggcgctggcgggcgcggcgacgacggccgccgccacggccctagtgctgtgccggccgcgggacccgcggttcgagctcatctccatcagcctgtccgccttccacttccgcccgccggcggcgctggacatcgggctcaccctcaccgtgcacgccaccaaccccaacgtcgtgcccgtgcgctacgggccctccaccgtctccatcctctacggcggcgcgcacctcggcaccgcccgcctcgacgccggcgagcagcccgccacctcctgccgcctgctccacctcccggcgcgcctcgacggtgtcgagctcgcgcaccgcgcccgcgccctcctctccgacgtcgcgcgccgccacatggagctggatgcggccgtcgagatcgccggcgaggccgcggtgctgctctggtcccgccccttctccgtccgcatcgacagccacatcaccgtcgaccccgtcttcctagaggtcgtcgagcaggagaaccgctcggagatgcagctctacctcgcttgaattttttttaccaactagactagagtagatgcgatgcccaaatatcatatcaagtctagtcaaaaaccctatcgcttatcttgtgcagtgctcaaaatgcaaaaccttatcatttgttcgcacaatgcaatgcagcattcagactccagtgcaattcttgggcaaatttctgatgctctacataaaaaaaaaaaanaaa

SEQ ID NO: 7163 - DNA, 1845 bp, Zea mays
ggggaaaggcacagtgatttttatggtgacatgaagacattccttttcaaatgctatcctcaagcatccattttccgccctactggagcaaacaagaatttgcaatgggtatgttgtgctgtctatgtcatatcttcttgttttaattttcttcactgtttgtgactttgtgttactactaatcatctccagaatataaagggtagttcacatcattaacttattttggcagtgtgctgtaaacttcagctctgagaacataccaaatggtattggatttggagggcagccacatcatttcggactctttttatcagcaaattttgaccaagggcactcatttacgtgtagcacatttaccagccctcccctttccaagacaaataggttcaggccagaagttattgaatgttggggtatacaaatgagaggagcacaagatgaaaaactggagttagtcaaggggacagtcctcgagagattcaaggaggaccggaacatgctgaagatggttggtttggcaaatgcaagtgattaagtgatagaggatcacaatgatgtacatgatggagagtctgtacatcacatgttcataaaaataatcaaatctgagaccatgtttctatattctactgttcatattttgtcactcaaaatattcatctggtccacactttgtaacaattgaccagtcgtgaaggacagccgagccaatgttgcgtttgatctcaagaatgacgtcatccaagataagatggtctcatatgagttcatcccattaactttaatgggatgactttatcctttctgttgtactaatgtgcttgtaagatgagaaagtatctagatctttagtggttttggtgattaatgccaacacaagattattgtaactaacatgtgtgtttacaaagataaattaatgttaggtcacaatgatgaaaatgatttgggcagtcttttgtcttgatgcctctgattatgatttcctaaaattttcaaatgatgaaagataaagttaaagatggactaattctaagtatcgtttagagttgagaaacacttagaataatttagaactttgtttttatttaaccgcactataaatgaggtatgaattaacagtctgatctagataagtcaaataagtttagtatgatacacactaattatctttagctttaagtggcttaggagaggcccaaagaatgaaaaaattgaaaaaatgtgaacaagtattggcttgctaagtatgggaaatccaaaaagtatagtcatgagttaaaagatggaaacaaagctatgccatccaatgtccaagagctaaaatcttccttaatagacataaaagaaaagtatgataaacttgatgaaataacatgtagctcaattttagacttagctctttaaaaacaagactatactcatcaaaattaatcatgacaatcttgctatgacttataagcttttatgtactggaacacatgaggctactaactaaattgttaagtttgatgtagtgacttgattgagagaattgagcaagaaattaaaagaaagtgcaagcaggtggaagataataagcttattgaagataatgagaatacaaacaagtggaagataataaacttattgaagagattgagaatataaagaaagaaaaaataacaagattagaaaagcaatggaagtgtgtcaataatatgtagcatggaacccaaatcgatcttcatgaagaagagcctgggcaaaaggacccttggcctcgatcgcgagcctaagtactcagtaaaaaggtacgaagtgagtccaaagatctcatcagaataagcgatatggcaaaga

SEQ ID NO: 7164 - DNA, 2199 bp, Zea mays
ggggttctcatgaaacgttaccggatatctcgatgtctggcccgacaatgtgctcacagtcctcgcacccctaatttttgcagcaacgcacgggtgtcatataggatttgcaaattctgtaccaaaaatatatatctccaagacacaaataaaaaaaactaaaatatcggccgtcgtaactattttggactgggctgccagcacatgggcctccacgttttaaatgtgaaaagcgagaaagcgaaaagcccatcaaacgaaggcgtcaggcgtccccttggtggcgcgaggggccgcccagtgacggctgacgacaatcgacaaaagggaaaagaataactgaaaaagtaaatcgctcaaaaaaaaaggaaaataaaaaaaaaatcgtagagagttcgattggcagttgctgagcccgagcgcgccctccggcgccgacaagccgggaccccacctccgccggcggcgatgggcaactcgcaggcttcgccggcgtccgcctccagctcccgcttcgtcatggcctcgagggccttcccgaagcaggagctggacggcctccgcgagctattcgcctccctcgcagcgcagtcgcggaccggcggccgcgccatctcacgccccgtcttcctcgaatactatcaggtccgggggcgattaggagacaggctgttccagcttgtggcgaaggagagtggcgggagcgatggggtcacgttcgaggatttgatcatctccaaagcaacatatggaaggggaactcgtgatgaggtcgatgaattcatttatcaactatgtgatgtcacaggagatggcgccttaacaaggtctgatttggaatcagtcttggcgtctgttcatgaaactgtatttgcaataaagaaggaagttgtcgaagtttccaacaatagaccattcgaagaattcctcaactctgcagtgttttcaaaggatgttgaaggggtctcagggaagtctatgtcattgtcagactttaggaactggtgcactctcttgccatcattgaggaaattccttggaaatttgttgatgccccctgattcaggtagaccaggatttgaagtaccactgcttcatcatcctgaaaacatctgcactgatacgctgcttctaaacaaagagtatgcctggcatattggaggaggtttctcccaacatgaggtgcaagagtggaagcttttatatcatagttctcttcatggacaaagcttcaacactttcttgggcaaagtaacgaatggggatgctcagactgttctgattgttaaagatacagaaggatcaatttatggtggatatgcttcacagccttgggaaaggcacagtgatttttatggtgacatgaagacattcctcttcaaatgctatcctcaagcatccattttccgccctactggagcaaacaagaatttgcaatggtgtgctgtaaacttcagctctgagaacataccaaatggtattggatttggagggcagccacatcatttcggactctttttatcagcaaattttgaccaagggcactcatttacgtgtagcacatttaccagccctcccctttccaagacaaataggttcaggccagaagttattgaatgttggggtatacaaatgagaggagcacaagatgaaaaactggagttagtcaaggggacagtcctcgagagattcaaggaggaccggaacatgctgaagatggttggtttggcaaatgcaagtgattaagtgatagaggatcacaatgatgtacatgatggagagtctgtacagcacatgttcataaaaataatcaaatctgagaccatgtttctatattctactgttcatattttgtcactcaaaatattcatctggtccacactttgtaacaattgaccagtcgtgaaggacagccgagccaatgttgcgtttgatctcaagaatgacgtcatccaagataagatggtctcatatgagttcatcccattaactttaatgggatgactttatcctttctgttgtactaatgtgcttgtaagatgagaaagtatctagatctttagtggttttggtgattaatgccaacacaagattattgtaactaacatgtgtgtttacaaagataaattaatgttaggtcacaatgatgaaaatgatttgggcaaataaaaataaaattaaaaataataaacataaaaa

SEQ ID NO: 7165 - DNA, 848 bp, Zea mays
aacctgtgttgcgtggcatgatccgtgtgaaacaccttcgagtcttcgatcttcttgtgcgtcgccaacgcgccggcgccctcctcccctgcgcctcagcctggtaccgtgcctgcgccgccctgtgctccggtcctccgccctccgcatctgcctggtaccgtgctagtgccgccttcgcatccgtcctccgcctgggtctccgccctccgcggctccgccttgcgactttaccctgcacggcccgccgccggccggtcgcccgtccggagccactgacccgagtttccgtccagcactccagggaccagcgcctgttcgtccagagtaccaacagatctcgtcaagaggtctgaaggatgaggaagggactgcatcctcagatgcaatggatttcatatgtgacgcagagtggtaggctgatcaatatcatgatgaccaaggtgaaccatactggcaaagtgtaccacatgagggccaagcggcaaatggctcaaagcctcggccagattgcgaagttcaaacgtcgatatgagcaggaagcagaggaaagcaaagacaagtaggatggtgttgggaaggaggtgtagcctctgtggtcatagtcagttgtgttgactgcgaagttttcagctaaggaatttcgattgaatgattttattttagatcacatcatcttttgctccacttcacaattgggttgtaccccatcttgagagaacactttggcacttgttgcatcttaaagccccaagaaaatagtctatggatcgcctttgctctgaaccgcgagttttatgggccccttgggccataaaaaaaaaaaaggccgccgttttgagatcaag

SEQ ID NO: 7166 - DNA, 836 bp, Zea mays
tctcgccgggcgcggtgccccccccaccagtgaagtctgcactgcataccctccacccccgcgtccgagcgcgaccctggccccggcccgtctcgcctgaccgccgccacgccgacggctgaccagcacgcgggcccagcacccccgacctcgtcctcaccggctcaccctgaccgccgccgcccaccactcacctcgcctccccaacttctgccagctcgcatcccgccgcaagaaacgcccgtgccgccgctgccctagcccctaggccagcgcccaggtcccctcttcttctcgcccttcgccagcgacgagcccccaataggtctgaaggatgagaaaggggctgcatcctcagatgcaatggatctcatatgtgacgcagagtggtaggctgatcaatatcatgatgaccaaggtgaaccataccggcaaagtgtaccacatgagggccaagcgacaaatggctcaaagcctcggccagatcgcaaagttcaaacgtcgatacgagcaggaagcagtggaaagcaaggacaagtagttgggacggagctatggcctctgtaacctaagtcggttctgttgactgcacagttttcagctaaggacatgattttattttagatcacatcatcttttgttccacttcagaattgggtttgtaccccgtcgttagcaaactatggcacttgttccatcgtaaagccccaagaaaatagtctattgattgcttttttttctcaaaaaaaaaagaaaatcaagctccatttttcttttgttattgctatgtttgatgatcttgtcttttatggtctctaacaacagtaattctagtg

SEQ ID NO: 7167 - DNA, 3730 bp, Zea mays
tgcaggaactacatctgcctgcctgtccagtccattccaggaagcatagggacatgaaaagtcgtgtagttctcgtaatcataatctctactgggagccttttttgtgtgatgctggtgcttctctccttctattggagaaggaaaaagggacctcgtgctacagcaatggcaggggcagccgtctctttgttggatgataaatatcctaaagtttcttatgccgagctgttccgaggaactaatggcttttctgatggcaatttgattgggagaggaagatacgggtccgtatataagggcacactgtcgctgacaaacgtagaaactcaagtagctgttaaggtttttgatctgcagcagtcaggttcctccaaaagctttgtggtcgagtgtgaagctcttaggaagatccgccaccgcaacttgatcagcgtcataacctgctgctctagcactgactcggagcagaataatttcaaagccatcgtgttcgagttcatgccgaaccagagccttgacaagtggctacatgaccttgatcctgattcagatgcgtccggacctgtaccaggcctgacgctactgcagagattgaacattgctgtcaatgtcgccgacgctatggactatttgcataacaactgcgagcccccaatagtccactgcgacctgaagccgggcaacgttcttcttaacgcggactttgttgcctgtgttggagacttcggcattgcaaagattctttcagattcagatggtgatcctgtgaccaattcgagtaccttcaccggaataagaggaacagttggatatgtgcctccaggtaactgaaaatatgtagctgtatccttctcttactggttgagcatattgacattttttcttcttcttgttcttgcacttcagaatacggggagtgccgccaggtctcctcgtgcggagatgtcttcagctttggagtcacgctccttgagatgcgcacgcgcggggcccccaccgacgccatgtttgaggacggattgaccttacagggcttcgtggagatagcgtttccagagaagctgatggacatcgttgatccagtactgctgtccactgatgagaggttcgcaagaaagccgcgacacagaagcgttggaggggaagagattgagaacgccatagcttctgtcactaagctcgcgctgtcctgcaccaagctaacaccatcagagagaaagcccatgggtgatgccgcagccgagatgcgcaagataagggactgctatctcgcagacctaacaagggcaaacaattaagtgatcatatatgtaactgataggggacaagttttgcactctatttatgtattttagacatacagtatgctgctgaactggcttggtgccctgcccccagcacattgccgagactatatttgttttcattagaactttgggttcattgcagctatgtatttgtgtctttattgaaatgaagaaaatgcatggaactgcggtctggaggcgtatacttcccgtttcctgtctttttgtgtcctccaacaggcaatgagtggtggacaacatccagctgaaatgactggttccgaccacgctgagtgtcaccgtcgcagtgatttcatttgcatgtcctccaacactcgccgtacgttacgcttacacatttatcatccttgattcatgtccacgtcatacatggctcactagaatataccaacgcctgtgcggcccgcgccgccggcccgctgtagtatagaactgtgagaaagccacgtcagttctagtgccatggctgcagcagcgccgcacttcgtgctcgtgccgatgctggcgcagggccacttgctccccatgctggacctggcgcgcctcatcgccagccacggcgctcgtgccacggtggtgctgacgcccatcaacgccgcgcgcaacagggccttcctggagcaggccgcgcgggcggggctcaccatcaacttcgccgagctcgcgttcccggggccagcgctcggcctcgccgcgggctgcgagagggtcgacatgctggacgacatctccctcatcatcccgttctacgatgccgtgtggctgctcgccgagccgctcgaggcgtacctccgctcgctgccccggctgccggactgcctcgtctccgactcgtgcatgccgtggactgccagcgtcacgcggcggcacggcatccttcggttcgtggtccatttcccgtccgcgttctacatcctcgccgcgcacatcctcgaaaagcgcggcctctacgaccgcgccgacgacgacgacgacttcgaaccgttcgaggtgccggagttccccgtacgcgccgtggtgagcagggcgacggcgcaagggctcttccagtggcctgcaggcatggagaggttccggcgtgacacgctcgatgccgaggccaccgccgacgggatactgttcaacacgtgcgccgccctggagggcgcgttcgtggagcgcctcgcttcggagctcggcaagaagatttgggtggtcgggccgctgtgcctcctcagttccgactccgacgccggcgcgatggccgggagaggcaaccgcgcggcggtggacgccgaccgaatcgtgtcctggcttgacgcgcggccggcggcgtccgtgctctacatcagcttcggtagcatcgcccgtctgttcccggctcaggtcgccgagctcgccgccggactggaggcgtcgcgccggccgttcatctggtcggccaaggagacggcgcccgccctcgacgcggagttcgaggagcgcgtggaggaccggggcctcgtcgtccgtgggtgggcgccgcagatgaccatcctgtcgcaccctgccgcgggcggcttcctgacgcactgcggctggaactccatcctggagagcctctgctacggcgtgccgctcatgacctggccgcagttcgtcgaccagttcctgaacgaggcgttgatcgtggacgtgctcggcaccggcgtccgctccggcgccaaggtgccggcgacgcacgtgacggtcgttaagccaggggaggtgctggaggtgcaggtctggagggacggcgtcgacagggcggtcaccgacctcatggacgagggccccgcgggcgcggcgaggcgggcgagggccaaggagctcgggcaacagatgagggccgcaatggcgaagggtgggtcgtcggacaccgatgtgagggacttggttcgccacgtcgttgaggtcgcgcggaaaaagggggagcacgaggacacagctcttgcagtcttgctggagtcgagcacgtgagcaagagcaaggaaaagacaatgaaaggcactggtggcaaacactactgttgaaattcgtgtggtactatcgttctcgccagcttcaaagagaatctctcgagtgttagctggtagccacgcgaaaaaaattctctggggaagtacaaccaccccacacatctgcaggctaacacgaagtcacgaaccgaagaaaaaaattaccaaaaaatcaagtggtaggcttcgtcttctattcatgtaggcttgaagtctgagcggctataaaaaagtggttttgcattttatatgcagaactctattcttaaatactttgacgtcggctagttcatttttaaactaaaaagcaacaaataaaaaacagagtgagtaacaccttagttttctcagtaccaaaatttctttaaagtctttacctggagca

SEQ ID NO: 7168 - DNA, 3068 bp, Zea mays
  misc_feature (1878)..(1878): n is a, c, g, or t
  misc_feature (2019)..(2019): n is a, c, g, or t
  misc_feature (2226)..(2226): n is a, c, g, or t
  misc_feature (2312)..(2312): n is a, c, g, or t
ccggccggatggctcattagaatgtaccagtatctgcttctgctctgcacgagtgcgttcctcggggccggccgggagttgtagtgccatggctgaagcagcgccccacttcgtgctcgtgccgatgctggcgcagggccacttgctccccatgctggacctggcgcgcgtcctcgccagccacggcgcccgtgccacggtggtgctgacgcccgtcaacgccgcgcgcaacagggccttcctggagcaggccgcgggggcggggctcaccatcaacttcgccgagctcgcgttcccggggccagcgctcggcctcgccgcgggctgcgagagggtcgacatgctgcacgacctctccctcatcgtcccgttctacgatgccgtgtggctgctcgccgagccgctcgaggcgtacctcctctcgctgccccggatgccggactgcctcgtctccgactcgttcatggcgtggactgccagcgtcgcgcggcggcacggcatccttcggttcgtggtccacttctcgcccgcgtcctacgtcctcgccgcgcacatcctcgaaacgcgcggcgtctacgaccgcgccgccgacgacttcgaaccgttcgaggtgccggagttccccgtacgcgccgtggtgagcagggctacggcgcaaggggtcttccagtggcctgcaggcatggagaggttccggcgcgacacgctcgatgccgaggccaccgccgacgggatactgttcaacacgtgtgctgccctggagggcgcgttcgtggagcgcttcgcttcggaggtcggcaagaagatttgggcggtcgggccgctgttcctcctcggttccggttccgacgccggcgggatggccgggagaggcaaccgcgcggcggtggacgccgaccaaatcgtgtcctggcttgacgcgcgtccggcggcgtccgtgctctacatcagcttcggcagcatcggccgtctgttcccggctcaggccgccgagctcgccgccggactggaggcgtcgcgcctgccgttcatctggtcggccaaggagacggcgcccggcctcgacgcgggaattcgaggagcgcgtgaaggaccggggcctcgtcgtccacgggtgggcgccccagatgaccatcctgtcgcaccctgccgtgggcggcttcctgacgcactgcggctggaactccatcctggagagcctctgctacggcgtgccgctcatgacctggccgctgttcgtcgaccagttcctgaacgaggcgttggtcgtggacgtgctcggcgccggcgtccgctccggcgccaaggtgccggtgacgcacgtgacggtcgtgaagccaggggaggtgctggaagtgcaggtctggagggacggcgtcgagagggcggtcaccgacctcatggacgagggccccgcgggcgcggcgaggcgggcgagggccaaggagctcgggcaacagatgagggccgcaatggcgaagggtgggtcgtcggacaccgatgtgaggaacttggttcgccacgtcgttgaggtcgcgcggaaaaaggaggagcacgaggacacggctcttgctggaggtgaccaagtgatcacgagcaaggaaaagacgatgaacggcgccggtggaaaacactactgatgaaattcgtgtggtacggtcgtttttggctgaaagaatctctcgagttaagctagctactagccacgcaacccaacttgcatgtaccagcagcaatgacatattatgttatcgtgctttttgtgcgacaaaaaaaaaaaaaaattcaacaataccgaacttgtaattaacctaagttaattacagcagctgatggctgatataagtcgtatcagaaccacacctgaaaccaagaacntgatcgctagcccgctacggatgggatttcggtttgtaataataataacaataacatttttggtcctagaaaaccgaataaattccgaggacgaatgttgacaaattatggcaaaattttcaaataaacagttgtcttttngtccaaaattaaatcactggatgacacaaataagagatatcacaaaattggacaaaatattaaaacttctataatagcataacaaaaaatggaaaattttcatgggtaaaaatattgttatggatttttagtttagtccataaatttagacaaattcgattgatcatggaacaaccatcaagaaaatttagattgttttcatctatngttgcgagacagtcgatgaaaattagtttacactagtctattatatctatattttgccactctgacctttcactctcacctcttanaccatctcagcccacgcctacctcgcccctaggtagcgccatggcgcccgatcgcgccacatcgtcaccggacgatctttgtatttaccggtaacatattaattttcgagtgacaaattttcttttaaccaagatgcccttgttacaatttgtggagcatgaactaattatttctagatcaaaactaaataaacggtaaacaaatttagtcttagaaacctatatgatgtattcatgtcactgcatattttttgtttgaatgtattcaaatttgattttgatttgaattcaaattctcttttcaaataccatgcacaataactcgcagcctagaagtcggcccatctccctactctctctttgcatggggcaatgactagccaacttaccacaacagtctgcatcgcctccctctctccgtctctcttataggtggagccacctgtcatcctacccctctgtccccgccatgtcacgttggcgcgtgtgttcggccaagatatcaccggagtccaccatcgtttggcttccccattgcctccaaaaaacctcgaaggtccagacccatgacatctaggtcacattcctgttgcaaagcccattagtgtgatatcctggcccctgggatgggatatcctggcccaaggcttaattgaattaatagtgtactcataccaacaaggtgcatcttctttttcggaagcctatctagaaagaacctccaagttaagcgtgcttggcttggagcaatttggg

SEQ ID NO: 7169 - DNA, 962 bp, Zea mays
acttcctcccttagtccctctcgttcctggcggctggctctctcttccctgcggcggcgcatctgggcacggagccgttcctgtacgactatacgtgcatgcaggagccatgccggggaagcgctggggagtcgttcgacccgttcctgtacgtgcatgcgggagccatgctgggaaagcgctggggagccgttcggcccgttcctgtacgtgtatgcggcggcgcgtctactagcttcagggagcagctgcgcaaggagatcacggcggctcctgtccaaccgccttatcgggccagcggaaggacctgggagtagctacgcaaggagaccacgacgactcctgtccaactgcctcgtcgggccaggggaaggacctcctgtcgctactgctggccgggacggaggaggccaccgaccggcggctcaccacgagggagctggtggacggggcaagaccttcttcttcggcgggcacgagaccacgacgttggcgctgtcgtggatgctgctcatgctcgtcgcgcacccggactgacaggacgcgtttgcgggctcgggcgggcacgagccactaaatgggccgtgctattcgggccgggccggcacgatcgggcctacaccgtgtcgtgctcgggaagagatttgagtccatcgggcgtcacgacacagttaagtggacgggcctaaccgtgccgggctcaaacgggtcgggccgagtcgggcttggactgggccgggccgggccgcccgtttggacatctatatgtactcccaaaagtagattatgtatgtatacaattaatataaccgtggggtgtggggaccagctgctgagtggcttatgtatgtaaagcttttaatttcaaaaaaaaaaaaaaaacgagctaaaacgctttaatcaacttttagtccattttgtttagaactttagtcagtttgcttttgccccaaaggcgattc

SEQ ID NO: 7170 - DNA, 887 bp, Zea mays
tcccgcgccccccgcgcgtcccggaacctaagacaagtccgtttgtgttgcgtggcgtgattcgtgtgaaacaccttcgagtcttcgatcttcttgggcgccgccaacgcgccggcgccctccgcccctgcgcctcagcctggtaccgtgcctgtgccgttctggtcctccgccctccgcatctgcctggtaccgtgctagtgccgccttcgcatccgtcctccgcctgggtctccgccctccgcggctccgccttgcgactttaccctgcacggcccgccgccggccggtcgcccgtccggagccactgacccgagtttccgtccagcactccagcgaccagcgcctgttcgtccagagtaccaacagatctcgtcaagaggtctgaaggatgaggaaaggactgcatcctcagatgcaatggatttcatatgtgacgcagagtggtaggctgatcaatatcatgatgaccaaggtgaatcatactggcaaagtgtaccacatgagggccaagcggcaaatggctcaaagcctcggccagattgcgaagttcaaacgtcgatatgagcaggaagcagagaaaagcaaagacaagtaggatggtgttgggaaggaggtgtagcctctgtggtcttagtcagttctgttgactgcgaagttttcagctaaggatcttcgattgaatgattttattttagatcacatcatcttttgctccacttcataattgtgttgtaccccatcttgagcaaacactttggcacttgttgcaccttaaagccccaagaagatagtctatggatcgcctttgctctgacgttcgagttttatggtttatatttctcccaaaaaaaaaaaaaaaaaaaaaaagaaaaaaaaaaaaaaaa

SEQ ID NO: 7171 - DNA, 2438 bp, Zea mays
ctgtggcgtagacccgtagtgcatcatccatgacataagctgactgtgagactcagagtctgtgaccgattgtttggttctccttttctacgcccactgcttatttgaacagcaatatactggcgaagcggcaaaattgccaatggctagaggacgtactcaaactgaacttttcatatctgatgaacatgcaactgttggactgtactgtacatacggtacactccacgcctattataagaacagagagccgcgtgccccgccgggatcttccccaatctcataaaaataacctctgattgcgtagaaaaagcctcgcgaatggacgccagaagcagcagcagtatgcacgttgtgatgctgccatggctggctttcggccacatcctcccgttcaccgagctcgccaagcgcatagctcggcagggccaccgagtcaccctcttctccacgccaagaaacacgcggcggttaatccgcatccctccagaactcgcggggaatatccgagtcgtggacatcaccctgccgcgcgtggagcgcctgccggaggacagcgaggcgagcatagacctcccgtccgacgacctccgcccgtacctccgcgtagcctacgacgccgccttcgccgacaaactctcggccatcctgcaggagccggggccggagaggccggactgggtggtcatcgactatgccgcgtactgggcgcccgcggccgcggcgaggcacggcgtgccatgcgcgttcctgagcctgttcggcgccgcggcgctcagtttctatggccccccggaggggctcatgggacgcggcaagtacgccaggacgaagccggaggacctcaccgttgtacccgactacgtgccgttcccgaccaccgtcgcgtaccgcggcttggaggcgcgcgagtttttcacgccggtgttggccccggacgaatctggcgtatcggaaggctaccggtttggcaagtgcatcgaacagagccagctcgtgggcatcaggagcagcgcggagttcgaaccggagtggcttcaggtggtcagtgggctataccagaagccggtcatcccggtcggtctattccctccaccaccacccacacaagacatcggcagccacaaggcagcgctgcaatggctggacgggcaggcgcctcgctccgttgtgtacgcggccttcggcagcgaggcgaagctgactagcgcacagctgcaggcaattgcgctcggtctcgaggcttccggcctgccgttcctgtgggcattcaggcaaccaaccgatgccaacgaaggcaaaagcggattgccggaaggtttcgaggagcgcatcaacggccgcggactcgtctgccgcggctgggtgcctcaggccaggtttttggcccacgaatctgtcggagggttcttgacccacgccggttggaactccatcatcgaaggcctcgcccgcggcgtcaggctggtgctgctaccgctgatgttcgatcagggcctcaacgcgaggcatctgactgagaagaagataagcgtcgaggtgccgcgggacgaggaagatggctcgttcgcgcccaaagacattgcagctgctttgaggagggtcctagtggatgaagaatgcgaggtgttcggggataaggccaaagagctcgccaagttgtttggaaatgacgagatgaatgatcagtgcgtgcgagattttctcaagtgcatgtcggaatacagcaggcagcgacaggttgcattatagggctggtaacgtcaaattttagatagggccataggggcctttttcaaaggtttactacgacagacaacatcaccgagataataaaaaatatataaaaaatactcgtgtgttgcaactaggggtggtaatggatcgcgatccaaatggttcttcacaatttggtaaggccctaatatatttatagttcaaaaatgaatagaaacaaagcccgatcctaatccgattcgatccttaagttttatagtgtaaaatttgaggcccattgtcagccctagttgcaacagaaacatataaataatataaataatattatgatagtttatatgtgaatgtgttatattgttatgagaacaaatttgtaatccatttgttattctaagatatacataaattttattattttaatatagctataagtatatgcttatgtgttactatagtttctatatataacatttttaggaatttataactacttacataatcttaacctacaacatataacgataaatcataactgtcttgctccaaaatgtagagcataactaaacccaacatatcttaaaaagaatagagttacttatacagattttttagtgttttgtttgcattcaacaataattgtcctgaatcttcttagatattgcctgtcttcaggagatgaggtgaacataagagaccaaaac

SEQ ID NO: 7172 - DNA, 1661 bp, Zea mays
  misc_feature (16)..(16): n is a, c, g, or t
  misc_feature (26)..(26): n is a, c, g, or t
gcacgagaccattacntagaacatcntaatcgaaaaaacaaaactgcaattatctcagtctccttcaaacaactgttttttccattgttagactcaaagcctatccccttcacggagctcgccaagcgctatgggggacgccaacggcggcagtatgcacgttgtgatgctgccatggctggcgttcggccacatcctccccttcacggagctcgccaagcgcatagctaggcagggccaccgggtcaccctcttctccacgccaagaaacacccggcggttaatccgcatccctccagaactcgcggggcatatccgcgtcgtggacatcgcgctgccgcgcgtggagcgcctgccggaggactgcgaggcgagcatagacctgccatccgacgacctccgcccgtacctccgcgtagcctacgacgccgccttcgccgacaaactctcggccatcctgcaggagccgcggccggagaggccggactgggttctcatcgactacgccgcgtactgggcgcccgcggccgcggcgaggcacggcgtgccgtgcgccttcctgagcctgttcggcgccgcgaccctcagtttctatgggcccccggaggggctcatgggacgcggcaagtacgccaggacgaagccggaggacctcaccgtagtacccgactacgtgccgttcccaacaaccgtcgcgcaccgcggcttcgaggcgcgcgagctattcaagccaggccttgtcccggacgactccggcgtgtcggagggccacaggttcggcgtgtccatcggagagagccagatcgtaggcatcaggagcagaacagagctcgagtcggagtggctgcaggtgcttggcaagctctacaagaagccggtgatcccgatcggcctgttccctccgccgcccacgcaagacatcgccggccacgaggcgactttgcggtggctggacagacaggctcagggctccgtcgtgtacgcggccttcggcagcgaggcgaagctgacgagcgcgcagctccaaacaattgcgctaggtttggaggcttccggcctgccgttcctctgggcattcaggccgccagccgacgccgcacccggacaaggcacgggcgggttgcccgaaggcttcgaggagcgtgtcaatggccggggattggtctgccgcggctgggtgcctcaacccaggctgttggctcatgaatcggttggtgggtttctgacccacgccggctggaactccatcgccgaaggcctctcgcggggcgtcacgatggtgctgttgccgctgatgttcgatcagggcctcaacgccaggcttcttgtggataagaagatcgggattgaggtggagagggacgaagacgacggcacgttcgcgcccaaagacatcgcggatgctctgaggacggccatggcggagaaccaagacgggactagggtcaaggaactggccgaggtgtttggaaatgacgaggccaatgatcagtgcctgcgagatttcctccggtatctgttagaatacatcaggcagcatcaaggttagttccagtccatttcgaggctaatgttaatgcagaaaagggcaaagaaatggtagtgagtcacgtcacgctatcaaaaaaaaaaaatccttccaggtaaaaaaaaaaaaaaaa

SEQ ID NO: 7173 - DNA, 876 bp, Zea mays
gccggcccgttgtgccacgcgtccgcccacgcgtccggggggaaaaaaaaggaggctcactgtacaccgagctcacgcagggcgtagcaaatcaggtaggcgaaatcggagcagaggccagggacgcgccagcgcgagcgataaggcacactgacatggccgccacggcgtactccaccgcgctccccggcggggcgcgcctccccgctgccggagccgccgcaccgccctctgccctcctcctcccgcggcgtaataaactgtctccgctccctctccggctccaagatgcgccgaggctgtcgttgctccgggtgaaggcctcctccgacgactcctcggccgcgagcggggacgagctcatcgccgacttgaaagccaagtgggacgccgtcgagaacaagagcactgtcctcacctacgccggcggcgctgtcgtcgctctctggctgacgtccgtcatcgtcggcgccatcaactccgtgcctctgctccccaagatcatggagcttgtcggcctcggctacaccggatggttcgtctaccgctaccttctcttcaaggaaagcaggaaagagctcgccgacgacatcgagtcgctcaagaaaaaaattgctgggacagagtaaaacatgttgttctcgtgaaactttttttggacgattctttcgggaacacgttgcctcttgtctagactccagatcagtgctacatgtctttgcacttttttttttgttgcataccttatgtcctcgtctctctggagagctttgtacgacgatggagaacaacagtgtacgatcgaactggacgccatcctcggggattgttttcttaaaatgaaatagggtatgtatccgggttttcttttccctc

SEQ ID NO: 7174 - DNA, 891 bp, Zea mays
cattgggtacctcgaggccggccgggagggacgcgcctgcgcgagcgctcaggcggcggttcgccggaaggacactgacatggccgccacggcgtactccaccgcgctccccggcggggcgcgcctccccgctgccggagccgccgcaccgccctctgccctcctcctcccgcggcgtaataaactgtctccgctccctctccggctccaagatgcgccgaggctgtcgttgctccgggtgaaggcctcctccgacgactcctcggccgcgagcggggacgagctcatcgccgacttgaaagccaagtgggacgccgtcgagaacaagagcactgtcctcacctacgccggcggcgctgtcgtcgctctctggctgacgtccgtcatcgtcggcgccatcaactccgtgcctctgctccccaagatcatggagcttgtcggcctcggctacaccggatggttcgtctaccgctaccttctcttcaaggaaagcaggaaagagctcgccgacgacatcgagtcgctcaagaaaaaaattgctgggacagagtaaaacatgttgttctcgtgaaactttttttggacgattctttcgggaacacgttgcctcttgtctagactccagatcagtgctacatgtctttgcactttttttttttgttgcataccttatgtcctcgtctctctggagagctttgtacgacgatggagaacaacagtgtacgatcgaactggacgccatcctcggggattgttttcttaaaatgaaatagggtatgtatccgggttttcttttcaaaaaaaaaaaaaaaaatccgtatgtctgtcaggacctggcacccagttcgtaatccttgacttgccaaaaaaaatcgcggccgtgatttgtct

SEQ ID NO: 7175 - DNA, 933 bp, Zea mays
  misc_feature (895)..(896): n is a, c, g, or t
  misc_feature (905)..(905): n is a, c, g, or t
  misc_feature (923)..(923): n is a, c, g, or t
acctcgagcccggccggagaaaggaggtgcctcgtacacggccggcacgcagggcgtagcaaatcaggtaggcgaaatcggagcagaggccagggacgcgccagcgcgagcgataaggcacactgacatggccgccacggcgtactccaccgcgctccccggcggggcgcgcctccccgctgccggagccgccgcaccgccctctgccctcctcctcccgcggcgtaataaactgtctccgctccctctccggctccaagatgcgccgaggctgtcgttgctccgggtgaaggcctcctccgacgactcctcggccgcgagcggggacgagctcatcgccgacttgaaagccaagtgggacgccgtcgagaacaagagcactgtcctcacctacgccggcggcgctgtcgtcgctctctggctgacgtccgtcatcgtcggcgccatcaactccgtgcctctgctccccaagatcatggagcttgtcggcctcggctacaccggatggttcgtctaccgctaccttctcttcaaggaaagcaggaaagagctcgccgacgacatcgagtcgctcaagaaaaagattgctgggacagagtaaaacatgttgttctcgtgaaactttttttggacgattctttcgggaacacgttgtctctggagagctttgtacgacgatggagaacaacagtgtacgatcgaactggacgccatcctcggggattgttttcttaaaatgaaatagggtatgtatccgggttttcttttcatcacttcattttgcaatccgtatgtctgtcaggacctggcacccagttcgtaatccttgacttgccatcgcgactgtgatttgtttaagatcaatagcgatttgctcttaagtttcgatggtatnnaaaaaaaanaaaaaaaaaaaaaaaaanaggggccggc

SEQ ID NO: 7176 - DNA, 3662 bp, Zea mays
gtaccctccggcccggcggccggccggggtgcctgcccgggcggtagataggagaggtcaagaactacggcacgaccgccgacgtagcagagggatctgttcgcctcccgtaccgagacccccctaccctttcgtcgacgactaggcttgcggcgaccgcccttggcttcgccgtcggcgagcatcaccagggactgacgattggcgggggagcgaatgcggagatgggctgatcagaactgcgacaaggtccggttttctctctaaaccgcggtctctggaggtgggtttgctttttccgtagtcacagatggacgacgacgacggcagcctgggcattcggaactggggcttctatgacaccgtgaaaggcagcctcggcctgcagctcatgtcgcccatgccacctgatcgggacacgaagccactgctcccgagagctggtttcttgcagcagcatgggcatcacaatgccccacaccagctccacgcacagcagccgcagcattaccgtgactccgctggtggcggagtctctggtggcacacctgccgagcagcaccctatccacatggacttctcgcgcaatgaagcttggctgcacccatcacaccaccagcatccccatgaacagaaggtccttcattctcgccctatcggaccagctgggcatgttgggcatccaggccatgttgcccatcctgtgcatgccgtgcatgttgtgcatcaccatcctactggctatgggatgatatcagatgcacaacatactcttcagatgatgcaaccacagcttgagtcacagcttcaggagcctcctccttgcaaggaagacgaagcaccacctccactggttgaggatcactccgtggttagtaccgggccacccgtgaagaagaggcagcggggccagaagcagagctgtcagcctaagtcaccaaagcctaagaagcctaagaagtctgctgtcccaccggagggtgggacaattaatgggcacgcgacccggaggaggggacctaagaagaatgtggggatgatgattaacggtattgagttggaccttgccaacataccaacaccagtgtgctcgtgcaccggagctccccagcagtgctaccggtggggtgcaggtgggtggcagtctgcatgctgcacgacttctatttcaacgtatccactgccaatgaacacaaagcgccggggcgcacgtattgctggaaggaagatgagccaaggtgcattcaaaaaggtgcttgagaagcttgctggtgaagggtacaatcttgttaatccaattgacttgaagacgttttgggctaagcatggtacaaataagtttgtaacgatcagataaagaagccgtgctatgtttgtcgctttgtaggttgtagagctgcagttaggcctgatttattgtttgtatgcctatgtgccagtctgcagacatttgtagtagtagtttttagccatgtttagtttcgttgtcttaattgtcatgtctatctcgagctttggatatcgaccaactgaagtccttgtatcctcactttgcaaattgtactgtacccataatagtctctaatttagggcatcaagatcaatgctttagttaattgtgtgtggaagtaagcattatgtggaggttttctctggtggagggcattaaccagcacattttggataatgagataactgtgaattttctgtatggcatctattctaagtcaacttttatggagtactcatattacgtatccaaagtcttacaatttacaatcaagaacagattcaaggaactaaattctttagtgtatcttcattactctctacctccagtggtctgcgccaaagcaaattttattgtttgtggccttcttgctcaccatgaatgtttactgaactttgcttttagttcatgttgtattttcttgtcaagtgctagcttgcatgtagtatttcttcagaaagagtggtgtgcaggctggttgtgcttaactttctctatggcatttggttgcacttaactttctttatggtatttggttgcttttgttccgtgtgctagaataaagaagctatcctagagctaggaccatttcttggtgatgtggttgtgtcagaaatggttgagaagggttctgttattgctaatggcattgacagatacgtaccaaaaccattttacaagtgttcaggtgttgaaatctggttacgaagcgaagcagatttctatatgacaaatggatccatgatgcaaggttcgaaaccttaaaattaattgggtcctgagatgatttctatatgcttagtgaagaggctacgttttagttgaaatgctactgatttgtttcctgttttaaatagataccgagtcgtaataaactaagtaatcatcaaattgtttggcttttctcattgttattcccttgaaggcaatgcaacaagaattaggtcatttgtcgaatctggtagtggtagtatcgtagtcctagtttttattggtaggtaagctggtatagtcgctactattttaaagcactggttttatcggtcgtcccacgtcaatatttttcaaaaaaaccctacatttatttagaatcaaaccgcactcatataatctcttctctactactataatatgagagtttatgtaaaaaataaggtgaaactatgtataagttagtgtttgaagcttggtttttagctctatattcatacacacctaatcaatagaaaacatatattttatgttttattaaaaaaatttatcatatgtcatatatatatatataaatcgtagcaatgaacgggcgactagtatatctttaagcttctattatgtattagatcgtttctcttacatttgtgtgattatgttactagctaggataaaccttaatagctaatgcagatgtagtggttgtatcatgttctttttcaacaaatggtttttgtttttaaaagtttgcagacttttttttgtttttgttgctaagcatggcacaaacaaaactttaatgatcaggtcaccttaggttccatggttgtaccttgccctgagttattctgtacgtatctgcagaactttttacagcttgtagccatttttaggtttgtgaagattgatctacatgccagtatcagagcttagatacggagacctgtctcgttagatggcaagaaatttaacgtgtccaatgtctggtgtttctgaatttttaatttgctacatattacacctttcactgttgttttatgaaatactcatttttgtgctagtagtgttttttccccctgaattattgttaacctgatgccgtcgtctttattatttttatcatggaagtaaaattgttgagatgtaaatagaacttagaaggaagttgtaatgtttgtacaacctcatgataatgttgcagaacttctgtgttaacacatgttactaataagttggctcgataggatggattaacctatcttccctgccgaaagagtgcatgggatgatgtaatatttagtgagcttcattagtttgcttggttatcctggttatatgggagatgctattcttgaacatgtgacttttttgggggtggggtggggatcgtggattttaagattttacacttagtgctggtttggtgataagagatttttga

SEQ ID NO: 7177 - DNA, 2840 bp, Zea mays
agtgctgcgcgtgagcagcttgctataggaatctgagggaggaggcgctgggcggtgcccgggcgttggataggagaggtcaagattcaagaacgacgacacgccgaagtagcagagggatccgttggcctcccgtacccagcccccttctaccccttcgtcgacggctgggattgcggcggcgcccttgtcttcgccggcgacgagcatcgccagggacttccgattggggggggcgattgcggagatgggctgatcagaactgcgacaaggtccggttttctcctccaaattgtggtctctggaggtggatttgctttttccgtagccgcagatggacgacgacgatggcagcctgggcattcggaattggggcttctacgacaccatgaagggcaacctaggcctgcagctcatgtcgtccatgccacctgaccgggacacgaagccactgctcccgagagctggtttcttgcagcagcatgggcatcacaatgcatcgcaccagctccatgcacagcagtcgcaacattatcgtgattccacttgcggtggaggagcctctggtggcatgcccaccgagcagcactctatccacatggacttctcacgcaatgaagcttggctgcacccatcgcaccaccaccaacatccccatgaccagaaggtccttcattctcgccctaccgtaccagctgggcatgttgggcatccaggccatggtagccatcctgtgcatggtgggcatatcgtgcatcaccatcctactggctatgggtcaatatcagatgcacaacatactctccagatgatgcaaccacagcttgagtcacagcttcaggagcctcctccatgcaagggagacgaagcgccacctccgccaattgaggatcactctgtggttagtaccgggccacctgtgaaaaagaggcagcgaggccagcagcagagtcggcagcctaagtcaccaaagcctaagaagcctaagaaggttgctgttctgccagagggtggggcacttaatgggcatgcaccccgtaggaggggccctaagaaggctgtggggatggtgattaacggtattgagttggaccttgccaacttaccaacaccagtgtgctcatgcactggaactccccagcaatgctatcggtggggtgcaggtggctggcagtctgcatgctgcacgactgctatttcaacgtatccactgccaatgagcacaaagcgccgtggcgcacgtattgctggaaggaagatgagccaaggcgcattcaaaaaggtgcttgagaagcttgctggtgaagggtacaaccttgttaatccaattgacttgaagacattttgggctaagcatggcacaaataagtttgtaacgatcaggtaatgagaaaggcttgctatgtttgccactttgtaggttgtagtgctgcagttaggcctgatttattgcttgtatgtctatgtgccaatctgcagacatttgtaggagtagtttgtagccatgtttagtttcatccacttaattgtcatgcctatctcgactctcgagcttcagatattgacccgactgaagtctttgtatccttcactttgcaaattgtactgtatccataacagtctctaatttaggacgtgaggttcgatgtgttagttaaatatgcgtggaactaagcattatgtggaggttttctctggtggaggacatttgccagcacctttttgacaaggcgataactgtgaattttgtgtatggcttatattccaagtcatttttgtatgaagtactcatattacatatccaaggtcttacaaatcacacttaagaacagattcaagcaactaaatccttgagtgtatcttcattactctccagtctctacctccactagtcagcggcaaagaaaatattattgtttgtggccttcttgcttaccatgaaatgtttactgagctttgcttttaggtcatgttgtattttcttgtcaagtgctagttgccatgtagcatttcttcagaaagagtgtgtgcaggttggttgtgcttaactttgtggcatttggttgcgcttaaccttttttatggtatttggttgctttggttctgtgtgttagaataaagaagttatcctggagctaggactatttcttagtgatgtggttgtgtcaagaatggttgaaaggtattctattattgctactggcatggctagatgtgcaggtgtcttttccaaaaacattttacaacatgtgttcaggtgttgaaatctggttatgacttacgaagcgaagcagatttccagcagtgtgacaaatggatccatgatgcagtgtttgagaacttaaaattaattcggttctaagatggttattaattttatatgcttaatgaagaggctctgttttagctgaaatgttaatgatttggttccttcctgattttaaataaacatcgtgttgtgacaaaactaagcaatcatcagattgtttggctttcccattgttattcactggagggaaatgcaacaggaattaggttatttgtttaaactggttgagtacttgagtactatagttcaagttttcgttggtaggtaagttggtatagtatatctttaagcttctcttctgcattgggtagttctcttacatttctgtgattatattacttgctaggatctttagtggtcggatcgtgttcttttttggacatacggttttttatttttgaaatttgccgagcttttgggctaaagcatggccaaacaaaattttaatgatcaggtcaccttaggttccatggctatagcttggcctgagttattctgtatctatctgcag

SEQ ID NO: 7178 - DNA, 1576 bp, Zea mays
aaacagggacaggtccgcttcctcgccgtctcgtctgaccgtacgtctttggtgatgaagcatcgatccgggagaaggttcagcattagctctagctagagctagatagccggaggaggagctagtaggaagaggcatggataatcatcaacttgtcgccatggcagcggtggctcagccggcgagcccgacctcgccgcacgtcgcgcacaagatcccgcccggcgacgggccttacgcgagggccaagcacttccagctggtggagaaggacctggacgcgtcgatcgcgtggttctggaaggcgatcagcgcgggcgacaagttggacagcgcgctcaaggacatggcggtggtgatgaagcagcgcgggtacctggcggaggccatcgacgccatcaggtcgctgcggcacctgtgcccgaagcagtcccaggagccgctggacaacatcctcctggacctctacaaggccagcgggcggaccaaggaggagatcgagctgctcaagcagaagctccgcaagatctacctcggcgaggcgttccatggcaggaccaccaagcgcgcccgctcgcacggccgcaagatccacgtctccgtcaagcaagagacatcgcgcgtcctgggcaacctcgcgtgggcgtacatgcagcagcgcaacttcatggcggcggaggtggtgtaccggaaggcgcagatgatcgacccggacgccaacaaggcgtgcaacctcgccctctgcctcatcgagcaggcccggctcgccgacgccgagctcgtcctcgccgacgtgctcgccgggaggtacctgcaggcccgcgaccagcaggacggcaagatcgtccggaaagtggaggagctgctggcccggatcatggcgcatacgacgtggccgggcggtggcggcggtgacggacgacgacgcccggcggataagagcgggagcgggagcgagagcgacgacgatgactgggtcgagaaccagatgctggctttgctcgacgtggcggtgccgtaccggaagaagagcaggaggctgccggtctttgaggagatctcgcgagcagaatagcagatggctgatatagattagcagcagcatcatcatctttcgatcgagctccatgcatatatcgtttgagcgagcgcggatcctctggacctaactgcagtctgcagataggtaggtaggtaggtctgagctgatccagacccacatgtcagtgaccggacgcagaggatctgcttccattattatttgatcgactcctgtccagctcaaccttttggaccaactccgtggcgatagcagtagcagcagcagaaaggtaaagcgcgcgtgtgtgtgtgtgcccctgtgaatctgtggatcggagacagtgtgcagtagcatagcatcagcagcaaggtatttaaagcgtgcaagtgtgtgtataactgtatatacgcttcttatatgcatctgtggatattttgcgtggatcggacgcatgtcgcagtcgtgtagtacgtgcgtttgtaaagctattttcaccagtatactcatctctatgctcatattcaaattttcact

SEQ ID NO: 7179 - DNA, 1988 bp, Zea mays
agcattggagaaaaataaggtacaaatacgcaaaaaggtcaatacctccttttgttcctttaccatgttatggtgtactttccatctaagtaggcggagttccttttgtcatcaattcaagatttccatcttgaaagttttatctctagggagctcctttacacttatgtctgatcctttatcctgaccttttcttgttgctaagatacaaaacttagaacaagttatagtattgtggcacaagatgaagcttctattctagtgattaccaaaagataccaattgaagcacactaccaaggctaccaattgaaaaatcgtcactgtcatagctccatgatttatgccctgtttggttagctggactaatctttagtctctggtttttagtctcgtttattccctattttaccacacggaagaactaaagtagggactaattggttttagtctctagtccttcacatgggtgataaaagtgactaaaggacaatatttgctctaattaactttgtctagagaactgacgtgaaacaagaaaataggtatttcggtttttatgtgttgtatttaatgtatttagaatgtttagttcaagagtagggactgaagtttaatccatatactaaactttagtcatgtaactaaataaactaaacgttgcgtaaatacgatactttagtcctaaacagcccaacatgcccttgaaatggagacgccgacagcccgacacagcacatcgcagaggtgtctcctttctcccctgttgttgttgatccaaaaagccacctccccccaacccaatcccgtcgtcactctctcactccactgcctccggaacaccctagcaatggagcccaactccagcatccctcccccggtgatgggcgcggcggtggcgtaccctccggcggccggcgccgcgtactccgccgggccgtacgcgcacgcgcacgcggcgttgggcgcgctgtacccgcctcccccggcgccgggtcccccctcctcgcaccagggcggcgcggcggcggcgcagctgcagctgttctgggcggagcagtaccgcgagatcgaggcgacgacggacttcaagaaccacaacctgccgctggcccgcatcaagaagatcatgaaggcggacgaggacgtgcgcatgatcgccgccgaggcgccggtggtgttcgcccgcgcctgcgagatgttcatcctggagctgacccaccgcggctgggcgcacgcggaggagaacaagcggcgcacgctgcagaagtcggacatcgcggccgccgtggcgcgcaccgaggtcttcgacttcctcgtggacatcgtgccgcgggacgagcccagggacgccgaccccgccgccgccgccatgggggcagcagcgcccgggatcccgcagcaccccgccgccgccgaccccaccaccatgggctactactacgtccagccgcagtaaccgatctgccctgttggtattggtacccacgttcttgttgttgttgcccttgccaaccaataactcttaagatggcgttccatcgccgcatctcgtttctggtttcgtaatcaagagggaggcttgtgtgatggtcatggctcatgccatgcttaacagagtgtaagggggtttgcctgtggactgtcgtaactggagtattaatcagtgtattactacttaccctgtccatgcaactcccaactgcctgtcttgttactttgtcatgaacctatctgtataatgtcatgctgttctttagatctctggtaggatagagaagcagtgatctcaggcttgttggtgtcgcgcgcaaatttgatccattttctatgtgtgtgtgtgtgtgtgtttttttccccactggtgtgtaatcatgctcctccttggaatagtttcagggacctaattatgtctgctaaatttccagaacatgaatgcgtttctcgccaaaattccagattatggctgtatatcctgttttctcgtta

SEQ ID NO: 7180 - DNA, 2205 bp, Zea mays
ctcaaatatggtataaatacgggttaaataaaaaaacgatcctgtaaaaacggacgggatagaccctttcccgttttcgttccatttctggatttttacgtatattctgtgaaaaacgatatgggtccagacgtgattttatctgtccgtttttatccctgccatatcctaacaggtcgcacgtgcaaaaaaacaatatagagtacgctaaaatccttttaaggatttggtccaatgtgattttttcaaatggggctggcaatatcggcaaaaccaagtcaaccaagcaatttaatgttcatatcattaactccaatccacattgaatgtctgcctacaattctgttacagacttacagtgagctacaggcacctaggcgactggcctgtgccgtggaggaggaagcctgcagagctgtgcagacaagagttgacagttccacgggttgcctctgaagctctcctctctctccgtccgctgaccgagaccacctgacatccgaggcttccatcccagcagtagtgacgcgtgacgagcagtgaacccgcaccaacatcacgtcacgttgaaagcagcagtcagtttgggggactagtcggacgccagtgcagcaagcaaaccacagggaagtgttcctacttccaacgtctatatgctgctgctcgcttcatcagacctgcgaactggttggcagttggcacaacagccgtcggattacggatttgcgcgtgtcccatggccatggccatgccaaatgctgcgtcgcttcccctggccctgtccatgccactcgtcgtactcgtagtcgtagccctcgcagcggcaaaaggaccacacggtttccgcagctctctcagcctcccaacgaagggaactcccaggaactttcgccaacccgtgcggcggcaaaatcagctgccagcctgccacctctacgcgcgggcgcggcgcccgctcccgctcccgctgggacgccacgccaaggcacaccaccaccaccctacaaatacgccctgggccccacgcggccgggaccacatagaccaccacgacacccttccccacaccagcagtcgagctgagcacgacacaaagccggctggggccgcctcgccatggcgatccggatgagcaacaacgtgatcggcgcgctgaacctggtgacactcctgctctcggtccccatcctcgtctcgggaatctggctgcggtcgcgcgccgacggcaccgagtgcgaccacctcctgtccaccccggccatcgcgctgggcgcggtgctcatggccgtcgctgtcgcgggcctcgccggcgcctgcttccgcgccacctggctgctatggctctacctcctcgccatgctcgtgttcatcgtcgcgctgctctgcttcaccgtcttcgccttcgccgtcaccaacaggggcgccggggaggccgtgtcgggggtaggctacagggagtaccgcctcggggactactccacctggctgcggcgccacgtcgaaagccgcaaggactgggcccggatccggagctgcctcgccgacgcgcacgtctgcaggcgcctggaggagagggagagggagagcaaggacgcggcgggtctggttcggctcggcctgtccccggtcgagtccgggtgctgcaagccgcccacgagctgcaacttcacgtacaccggcggcacggagtggaccaggacagcggcgggctccgcgcccgccggccgggactgcagcgcgtggggcaacgacgaggacgacctctgctacgggtgccagtcgtgcaaggccggcgtggtggacgcgctcaagcgggactggaagcgggccgccatcgtcaacgtcgtcatcctctccttcatcgtcgtcgtttactccgtcggctgctgcgccttcaagaacagccgccgggacaactacgcctaccacagcggccgcggatggaaacgaggcggtgacgcttaaatgcttaatcaaacttttccttatcatctgcgttagtgcaatttaccattatcttgtatattagcctgagttcgtgatctgctttagttcagtttaccattagcttgtatattattagcctcagtttgtatcacttagttgtttggcagcatattagcagaatttcgggcagtatatgagcagaatttcgctgcccggtccaatttcccatagacaagtctgcaggcaaaattcattgtc

SEQ ID NO: 7181 - DNA, 1760 bp, Zea mays
  misc_feature (891)..(891): n is a, c, g, or t
aattaatccataaaatatgctagtgtcaactaaaaaatgtaaataagttaacaagattaataaacattgtataagaagataacatcccacatgaaaataataaagcgaagtattgattatattgaaacttgaatacttaaagtgatttcacatataactcacataaaaattggaagtaaaaaaattgaagaaatgatggcatattatgatttttatgattcaatcattttttattattatatatggatatatgtcacgtcttcgtaaaaatttatgattttctgagattatttatatattattaattttttctttagaaaatcattaaatgcacacgactatccgggtagatatccgggtattcgaaatctggatatccggtaagatattcgaatattcaaaatccgacggatatcagtcatctcatattgtatctaatatccgaactatattattcagatccagatccgaagtctgaatatgttgcggataattaaaaaaaactatcgaattggataattaggctcgtcggacgaacaaatgttcagataatattcatacgtttacctcgttagtgattgtatatgcacctttaacttttatggcaaatgacgtgacgaggtgcgccttttttttaccgaggtaagcgtctttggacttgttttttctgtggtggattcagcgtcattagactttactcccgctttgcaaagaaagtgaagttaagtgtcggacgcattcggcgagccaccactaccgccctaccggtccactgccgtttctccaggcggcctcccgggccacacgcgatccagcagcacgcgtgaccccgggtcggtggcgtcaggccaacaacgaccgcagcgcgttgcagcagggtccagcgatatnctgaaacggcttggcgtgcgttccgccgttcccacgccgtgcgcttttagccgggtcaacaaacgcgtctttgtcgtgctgtataccgtgccgccgacgcaacgcaagccggcggacgcggggcgaaaccgagagaaacccacgtccgcgaccgccgaacccaccttcacggctgactgaccgctgacgacggaaatggggtgggcctacctccaatcctccattttgccgcgtgcgacggcctataaagcccttgggtcccgccggcccggccgggatccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgcaaaaaaaaaaaaaaaaaaaggaccaccgaaggcccctaccctccggggatttttactctcctccccttcaacagccaccacaaagttaaccacaacatatggccacgtttgtttaactaatttcaccttctgtccatgccgactttcacttttcagtcagtttttttataaaataactgag

SEQ ID NO: 7182 - DNA, 1917 bp, Zea mays
  misc_feature (1328)..(1328): n is a, c, g, or t
  misc_feature (1448)..(1448): n is a, c, g, or t
  misc_feature (1890)..(1890): n is a, c, g, or t
gggtacctcgaagccggccgggattcgatgctcggaagaaaggcttcctcgcacactggcagttgacttgtctccgctcgtcccacctcatcctcctccctgatttttgccacgagctcgtcctagctagatatgtatttcctctgaggataatctcccccccgcatcgtatgtctaggatatctcacttggttattgtcccgcctccaaatcaaacgcatcctaagtgacacaggcatagagaagctttgctagcgaagtccagtgcaactccaccctctccacctagctaccactcccttagagcgccactgccgccaagcgcatggcgggaggaggggcggcctaccagagctcgtcggcgtcgccggactggctgaacaagggagacaatgcgtggcagatgacgtccgcgacgctggtgggcctgcagagcatgcccgggctggtgatcctgtacggcagcatcgtgaagaagaagtgggccatcaactcggcgttcatggcgctgtacgccttcgccgccgtctggctctgctgggtggtgtgggcctacaacatgtcgttcggcgaccggctgctgcccttctggggcaaggcgaggccggcgctcgggcagcgcttcctggtggcgcagtcccagctcacggccaccgccgtgcggtaccgcgacgggtcgctcgaggcggagatgctccaccccttctacccggccgccaccatggtgtacttccagtgcgtgttcgccagcatcaccgtcatcatcctcgccggctcgctgctgggccgcatggacatcaaggcctggatggccttcgtcccgctctggatcaccttctcctacaccgtctccgccttctcgctctggggcggcggcttcctcttccagtggggcgtcatcgactactccggcggctacgtcatccacctctcctcgggaatcgccggcctcaccgccgcttactgggtagggccaaggtcggcgtcggacagggagcggttccctcccaacaacatactgctggtgctggcgggggcaggcctgctgtggctcggatggactggcttcaacggcggcgacccgtactcggccaacatcgactcgtccatggcggtgctcaacacgcacatctgcgcctccaccagcctcctcatgtggaccctccttgacgtcttcttcttcgggaagccgtcggtgatcggtgctgtgcagggcatgatcaccggccttgtgtgcatcacgcctggcgcaggcctggtgcaagggtgggcagccattgtcatgggaattctctcaggtagcatcccctggtacactatgatggtantgcacaagaaatggtccttcatgcagaggatcgacgacaccctcggcgtattccacacccatgcggtcgctgggctcctcgggcggcgccattactggactctttgctgagcctgtcctntgcaacctcttcctcgccatcccggactccagaggtgcattttatggtggtgatggtggatcacagtttgggaagcagatcgctggcgcactcttcgtcattggctggaacattgttatcacttccataatctgtgttcttattggcctagtcctgcccctccgaattcctgatgcacagctgcttatcggggatgatgctgtacatggtgaggaggcgtatgctatatgggcagaaggcgagctcaacgatgtaacccgccaagatgaaagcaggcatggcagcgtcgctgtaggagtcacacagaatgtttgagcatagttcttgtaaggttgaaagaaagaaaaatacaagtgcatttgtttgctaattgctattaactgatggcacaattgtatgcaacaaaacacctgttcatggaggaatgtagagtgtcaggatntgatttattttaaaaaaaaaaaaaaaa

SEQ ID NO: 7183 - DNA, 3916 bp, Zea mays
  misc_feature (2628)..(2628): n is a, c, g, or t
catcactgcaaatgcaggggcactgggctcttatgtgcccccaggtgtggtaccacaacatccatctggaccagataaaatgcttcctcagcatattatgaatcctggtcataagcatggttcctctgaaaatatccgtcctccgttgcaacaaccatatggtttgtttcattctggaaagatatcaaggccatttggagagaaccagattcagatgcctatgtcacagcctgggggtatcagacctggtgatggtatgatccgacctcctgtggttggcccattacctggacatcatggtgcagtgttgtctccttttgatcttgaacatttgggccagccacattctctcggtaatactgtggattgtaggcaaattcttcctgtttttttgttgtttcaagtatgctgacctaactttcattccatttatttaggaatgttgaacagcaatgactttggtggtgaggggttcaatacttcaaggggtgctgcatatcccggaagacatgataatatcgaagacgatcggaaacattttccagcaccagcccttctggatggtcaaggcttgcaaagggaccctagacattttgagagagctttagttagacctgatggtttccttgattcagtacctggaaggcctccttttccaaaccatagaagtgtaggtttgcatgagggttttccaagaaaacaaaacacaactgccagtcaccctgacgtcctgtcacatggagcagaatttgatcatcacagggctattggaatgcctaatttcagaaatccaggtacagattttgaagcaatatgcataaattaataactgaaattattacaatacttcaatgggagcaggtcttttggttatatgaatgaaagcttatgactcttgaaccttgagtttgccaatgatgttcctccattggatttgaatgttttcaggcccatttgctcaagggacaagtggtggtcctggtgcgccccctaaaaaccagcttggctctggtaaccttcctggaaacatacaacatgcttttgcaggcccagacatccctccagctccttttaaccttggtgattcttttccttccactagcctacatgctgggtgtggagaacctcatggtaatgactattgcatttaactgaaccttctaccctactttgcaggtgacatgcatccaggtgaccctcatcttggtgctgactattctcagcatggatttcctaaaactgcagctcgccttggttgggtgccccggcagtgcctttgtacatgatttttttgttacaatgcactatcacttcctatattttctatcattgttgcattatgtactgtttaactactaaactgttgagtgttcttccatctagggtggattctcgagaaatgggaattctggttggtgccgaatatgcatgtttaactgtgggaccgcagagaatctggatctgcatgtacaaacaagggaacatcagcaatgtgcaatggacattatcctgaaaatgaagcaagatgttgcaaagaggaaaaaactgtaagatatgaactaatttaattttgaatttccaaaatgaagcatctccttgtttataaactcatatactctgtactcaggaattatggaggccccaagtcggtcaacaacaaaaaggtttctgggaagggccattttcgtgggaataggcgctagtgttacctgattcagcttgatgtgaatttgaaggtgagttgtggctgtttgattgtcattcacaagacattttgcccctatatggttcaattggtcacttcctaatatttttccaggttgctactggtgcttttggacgtttcataggcaattgagagttgagatctcttcagacatcatgttcacgcggttcagagtatttgaagtggaacttgtaatgttcccaaacttttgttgccatgttgatctgcagagttcacatggctatgtttactttacgtatttttgctgaagttctgggattgcttaacatgctagtacccttcttctgtatgcgatgatttatgactactgtttgtttcaactaggctcatgctttgtctaatgcgacctaataatagaccacactgaaacttttacaaagagacatgtaattgtgtcatcagacatccagaacatggtaattttttgttggaatcttttggtaaggggctgatgggaacatgtaaaaggtactttcagtgcctgaaaattatgctagtttttcatagtttaattcaaaaaaaaaaatctaagggtgtggtgtctaaatagagttcctttacaccactaagcccaatttgcttaatgatatattttaaaattattgaatgctgattccatgatatgttcccattcaaaacaagggaggacaaaagtgctgcattctggaataaacacatgggctagagttgttgacatatcattgcatgacaacaacaaagccatccaaatcaacaaaaataatctcattaaagtggtgcctattttgtgcctgagggatccattagtgttaaagggaggtttggaagcctggaaggaaacacaaaagtatgaagaggtttgaattgggacatgtactttgaatgttagcatgagatggganggaattgatggtaaaccttgtttggaaccaaagtatgtaggttgtgctcaaatatagaagaaaaagaaagatatcttgattttcatatgaatactagtacgtgcatcatgtatgcagagctttttgatactgatactggagttttattattcacttctagttagttagttagttattcgaggtagtgatggttttattatcatgggtttgatgttcagaataggacatcattgaaccctacaagcactaaatgttgtgggtaaaatacctaagtttctaattcactgctgctgggcagatggcttgttcagttatgtttgatatgatttttcgcatgtgatatattttgctgatggtggtgtttctctagatgtctgttttaaatcatctgtatttgctgtttgtttgctaagcagaaactggaaagtgtaggataatttccagcagagggctcctgtcatacttgcttgtttccctaacgatggtaaggatgacatgctttgatatgctggtaaggaaagatatgtattgagcttttactacaatacacttcaaacttttggactgaagtttttcatatatggattattgctaaagtgctgaaggccgaagccaatctgtgacctgtcaattacttggacactaatgacctgtttggttcgttgcctaacttaccacagtttgccgcacataaggttaggcaagtttgatcaacttaggcgcgtgtttggtttgtagtcacagttgtggcaagatttgtctcttgctgcgttggtcccactcatcaatgacttataaaagtgtagcatgattctcttaggcattgccaaaatgcggcaaagaatttgagcgcctaacctttggcatgtgtggcagaaaatatatggcaatttatgacaccttagccgtacaaccaaacagacgctaaaggtcccagtttgtataattgtgaggccatcatgaactgctatgcttttgttcgtaggaaacaacataagatatatttatgtgtaaattaatagattgttcatatctatgttcattcggggtaaggagtgacattacaatgtcttggttgaactcaatttatgtgatcgccaagtggttcaagtgtgccccaatgttatgtttgttcactttccagtgcttagtttgccggatgctgttgcccacagaagatgcccctccccccccccccccccccccaaacaaacaaaattggttgggcatcacttgtaaatttctcccaaatgcaggttgtttggggttagacttgttacatacattc

SEQ ID NO: 7184 - DNA, 2444 bp, Zea mays
ctgcagcctccacatgcccagcagcaagcttacccacaaccacaggcctatcctcaacaaacacatcatatgcacccccagaatgcttcatatacacagcagcaaacacaaggtgctcttttgcaacctgtacctgtgtcccatcaacaagcacatgtttctcatcatcctgcaccaatgcgtcctccgttgccaagtcaacagccagctttgcagccttttcagggaattcaacgtacaacacaacatggaaaacatattggatttcatgctcagtggccaccaatgggttccaacatttcttcccaggcaccaccacagggattccctgcaaactcatctgtttcttcacaatcagttcaaccataccagcaaggaatgtcttcatcacaacaggtgcattcccaacctggtcagccttatacacagcatcatgttactggcaatactggacatgttcaaacttcagctggcagatctatgactcatcttgcaccaacacagcagtttcagcaccaacaatcagcagtgcttagaactgagtcacctgctgctgcgcaccctattgggcagggttctttagatcttgaaaaacatacttcaaaatcagggaagtcagaaaatgcaattaatgctgctgtcagtgaaaataaaattagcggtgctgactcagctgccattgagacctacaaagcctcaatcaggtgaggaaaacatgaacagtgaacaaaatggttttgttggtgttagaaaagatgcagtgcaaactggcattgtatcacacggtttagatggttcaattaggagggatgggaatactgaccaggcaggtaattcacatggtctagttgtgcagggaggcaaagaccataaggcttcagatgttactaatcgtgagaaagaacaatcatttcagcaggcatcactgcaaaatgcaggggcactgggctcttatgtgcccccaggtgtggtaccacaacatccatctggaccagataaaatgcttcctcagcatattatgaatcctggtcataagcatggttcctctgaaaatatccgtcctccgttgcaacaaccatatggtttgtttcattctggaaagatatcaaggccatttggagagaaccagattcagatgcctatgtcacagcctgggggtatcagacctggtgatggtatgatccgacctcctgtggttggcccattacctggacatcatggtgcagtgttgtctccttttgatcttgaacatttgggccagccacattctctcggaatgctgaacagcaatgactttggtggtgaggggttcaatacttcaaggggtgctgcatatcccggaagacatgataatatcgaagacgatcggaaacattttccagcaccagcccttctggatggtcaaggcttgcaaagggaccctagacattttgagagagctttaggtagacctgatggtttccttgattcagtacctggaaggcctccttttccaaaccatagaagtgtaggtttgcatgagggttttccaagaaaacaaaacacaactgccagtcaccctgacgtcctgtcacatggagcagaatttgatcatcacagggctattggaatgcctaatttcagaaatccaggcccatttgctcaagggacaagtggtggtcctgctgcgccccctaaaaaccagcttggctctggtaaccttcctggaaacatacaacatgcttttgcaggcccagacatccctccagctccttttaaccttggtgacatgcatccaggtgaccctcatcttgttgctgactattctcagcatggatttcctaaaactgcagcacactttggtttgggtggattctcgagaaatgggaattctggttggtgccgaatatgcatgtttaactgtgggaccgcagagaatctggatctgcatgtacaaacaagggaacatcagcaatgtgcaatggacattatcctgaaaatgaagcaagatgttgcaaagaggaaaaaactgaattatggaggccccaagtcggtcaacaacaaaaaggtttctgggaagggccattttcgtgggaataggcgctagtgttacctgattcagcttgatgtgaatttgaaggttgctactggtgcttttggacgtttcataggcaattgagagttgagatctcttcagacatcatgttcacgcggttcagagtatttgaagtggaacttgtaatgttcccaaacttttgttgccatgttgatctgcagagttcacatggctatgtttactttacgtatttttgctgaagttctgggattgcttaacatgctagtacccttcttctgtatgcgacgatttgtgactactgttcgtttcaactaggctcatgctttctctgatgcggccgccgaatagaccacactgatgcttttagaaagagacatgtaattgtgtc

SEQ ID NO: 7185 - DNA, 2869 bp, Zea mays
  misc_feature (1950)..(1950): n is a, c, g, or t
  misc_feature (1998)..(1998): n is a, c, g, or t
gtgtggaattatgatatgtcctagtaacattaacattattatgcttgcattcagcgtgcttatgccttttcatttcctggtgattttggctacagttatgaacgttgggataacaaagtgtggtgaggagaaattctggcattctacaagctcgtctgtatatacatcggttggaattgttttgtagaatacaccaagcttcataggttacacaaaaaaaattacctatactttggttgtatcatttaaccctggcagatcagacatgggaatgttgttgttctgggtcatatttacgcttcctagtccagcgtcagaaaaattatgtttgcagtccttcatttgaaggttttttttttttttttgttgaaatggccagcataataaaattatttgtataataaataaagttacatgctgactttgatttgattcgttccttgaacaacataaatctcagatatctcatggaaagacacttatatttggttgagtttaaaagctcatatttcgtttgcgaaaaaacagaccgttgggtgcgttgtgcaaaacaattccaaccgatgtcaatgtgtcgcacaaaccccctcttgcaaacaaataacaaggcagctttatccggtgatcatggtgccggtgccctcgtccgtgaggatctcgagcagcagcgagtgcgggacgcggccgtcgatgatgctggcggtgcgcaccccctgggcgatggcacggatgcagcactccaccttgggaatcatcccgccgccgaccttctcctcggccaccatccgtctcaccccggcgacgtccacctccctcaccaggctccctggatcatcgcggtccgccagtatgccggacacgtccgtgaggagcagaagcttctcggctcccaccgctgccgcgatctccccggcggcggtgtcggcgttgatgttgtaagcctgcccggcctcgtcggccgctacggtggcgatgaccgggatgtgcccggacgcgatgatggggtggagtacggcggggtccacgcgcgtcacttcgccgacgaagccgagggaggcggcgtcaggggagggccgcgcggtgaggaggcgcgcgtccttgccgcacagcccgacggcggtggcacccgcgaggctgatgagggacacgagctgcttgttgaccttgcccacaagcaccatctccacgacctccatggtgaccgcgtcggtgacgcggagcccgttgcggaactgaggctccacgccgacgcgcgccagccaggagttgatctcgggcccgccgccgtggacgagaatggggcggaggccgacgcaggacagcaggaccaggtcgcggatcaccgacgcctgcagctccggcgacttcatcgccgcgccaccgtacttgaccaccaccgtcttgcccttgaacctctggatgaacgggagcgcctccgacagcacgtccacgcggctcagtgccgccgcagcgcccgctgcaggtgacgccggtgtgggctgcgccgccgccaccgaggcggcggagacccggagaccgccgctgcggtgggacgccgacggggtcagggccacaacgcggtttgcgttcaggctatgcttcggggtcagcgtggaggcggcggcgagggaggggtggagcttcgtgagcggcatggtttggaacggggggtcgttatgttcgatgaaatgcctcgccttgggcgtatgcggaaacgagcttgttgctcggcactggaagtgtgccgctgcggcacaacggaagtgtgtaattgtagatagggatgcctgcggagtaggtggcgactggcgagtgtgacaccggagctggtcaggtggagcagccggcgggcacgtgttttcgtttggggatcgacttgcttgcaaatttatgtatgttgtttaagggttgtttagtttgctgtacaagacatcacaatctgtctaactntcacatccgattttagaagtcaaaatgaatacaaatatacgtgtcagnatcataattcacgtacacagcgattacctaaataaatatcattgcacatcactggacgactatccacaaacttcttatgtccttgttgtggagaagcatactatgtctggaacagatgaactttcacaacagacataattgcattatcatgaccggatcgggtatgcctggactctcaaccaaacatttcttgaagcttcttaagaccattaccaaactcctggtatatggattcttgacccgaatccatcaggtgtagagatccttgctgtttatgcacggggctcgatggaatccgcttatgttatgataatatcaatcttgttgtacccactctccgctgggttggtgttttcacaagtgacatcgaacatcttgagttcaagtcaaaggtgagctaccaagactttaaggaggaagataatgtcaaattcaacggtctgttgaatcttgagactatgaagctgtcagagggctggttgaaagaaatacgtcacatgcaagcgtacgacaagaagttgtccttcgaagagttaaagcaaccgggttgttcttattttgctgatgagatgcttcccaagctgatcaagcgtgccagttcttgaactcctggagttcagaaacaatggatttttttgtgatttatgtgatacaaatattatttattggcagttacaggttgtaagcatgtttgtctactttgtttcatatatatgcttagagcaactccaaaaacctagctaaattgattagtatatgcaaaaatagaaaaaataggattaaaatccgatctaacgggctctctttcttgctcgctactgtatcctgctcgccatcctatcgagatcgttaggtatttttgccgagtctg

SEQ ID NO: 7186 - DNA, 1546 bp, Zea mays
aactagaattgggtgttatggtgtatccggtatcggtgacccctagcaataccaatactcaacccttccgaatatttcgtcgcaagatttttcgctagtgctcaaagctccaaaggccccaagactccttcctgctcaaacctttttttatccatccttttgcgcggaggctgttggagcgttggatagtgcgcggtgcgggcgaggacacctcgcactcgctcgcagtccaagaacgaaggcagcctctgtttccttccgaccggcgatgaggaacccgccgggcaggcacctcctctgtctcagcagccgcgccgtgcgctcttcctcctcctcatcggcgctcggccccggacccggcgctgctacctccgccgcgtccccacgcccgcgcgccatcgcgcccgggcggcccctgcgcgccagttccccacccccgccttacgcagtcgccgccgccgcgtacgtggaggacggggactgggaggaggtcgtcgctggggggcctggtactggggagatggaggaagaacaggactacagggtggtgttctggtccccgccgaccatagacgaggttaccggcgcagtcaccagcatccagcaagtatttgagaatcctcttggactggattcagatacaactgacagacagacaacactactgtctgcatcaggacattcatctggaaattcatcaggatcagatgactggattgaacctgctgcctatgttcttaactcaactgctcttctgtcaagggaacataggaatgttgtggatgctttccgtctgttgcaaaaggatcccaccgttcagaaaatggttatgtctttgtcatgcgataaggctgtttggaatgctgtcatgaataatgaggcagttcaagatttcaggagatctttacacgatggaaaagaaaatgatagaaacgaaaacactggtggtcctgctgaagtgcttaagtggatcctggaaagcgcccaggcaaaaatagttgaattcctagagaatgttcagaagataatcaacatgctgatccacactccagaggatgatgataatccagatggatacagcgatgcagttaaggtgtcgttcatgctcacggtattcgtcttcatcgtggtggccattgctcgtatcaattatgaacattgggattacaaagtgtgttgaggcgagattctggcatcctacaagcccgtctatatatgttttgtagaacacaccaaagttcgataacttatcctacacacagttttactcaatgctttggctgtatcatttcatcccggcagatcatgcaagggaatgttgttctgggtcatatttgtgttgttcgactttggagccggatggacctctgtagctacacttccttactccagcagtccagcgccagcaaatttcatgtttgcagtccattttaagcatacagcattaactgttggaatagcctgtataaatgttacttgaggaaattattttccattcatttcgagggaattaaaattatttaataaagtaaaaaaaaaaaaaaaa

SEQ ID NO: 7187 - DNA, 2954 bp, Zea mays
gtagactttcactttcaacgacgaggagggaccaggcaacgcaatttcggtccgagtttactgaaatctggtattttttttcgttctcggtgattaccgaaacacagatttcggtccgggaagttatgtttttcgttttaaaatctaaaagtcaaattttggtcaaataaacgaaatccagaacggtgaaaacgaaattgtaatccctgggaggaactcgtgtccctatgaactattttgtttacacaaattacaccatacaaatatactagagcattaaggttgtgcatgcatgtatgtggagtgaaaataattaatggatctaagctcctttagaacatagaattttcaggtttattttcaccagaaaagaaagaaaaaaaacaaatctcacattccaaagggaaccctaactgtccttagtaaaacgatacacagttcaatcaagttcataacaaacagtgatattcaagacaccaaacagatctagtataatataaaaatatattccacaaaaaaactaacatatctgttctcgaatatttagacacccgttaattttattttgaattaaaacgcgacaaataaaaaaagatcagagtgagtataatatttaattgtatataacataggtcaaattcaagatatttttattctttaatttcgctaagtagagtaattttttatgtcaggttcttgatcatggacatgaagttgattagcctcacaagcttgcgagaacaaaaaactaaatcaaccaataaacatgacacccacaactagaattgggtgttatggtgtatcggtgacccctagcaataccaatactcaacccttccgaatatttcgtcgcaagatttttcgctagtgctcaaagctccaaaggccccaagactccttcctgctcaaacctttttttatccatccttttgcgcggaggctgttggagcgttggatagtgcgcggtgccggcgcactcgctcgcagtccaagaacgaaggcagcctctgtttccttccgaccggcgatgaggaacccgccgggcaggcacctcctctgtctcagcagccgcgccgtgcgctcttcctcctcctcatcggcgctcggccccggacccggcgctgttacctccgccgcgtccccacgcccgcgcgccatcgcgcccgggcggcccctgcgcgccagttccccatccccgccttacgcagtcgccgccgccgcgtacgtggaggacggggactgggaggaggtcgtcgctggggggcctggtactggggagatggaggaagaacaggactacagggtggtgttctggtccccgccgaccatagacgaggttaccggcgcagtcaccagcatccagcagtaagatttgcctgctcacctcgttatagcattttttttctttgcgtactgttagatttgatataacttcttctcttgacatttcttgtgttggtgacccgcttgattgtcacgacctagtttatgctttgtttacctggattatattagagctgtttttgtctttattttgatgtgacatggatagcttctcatggggacatgggagccttgcatgcttcagttcattgagcaatatcgtgtaggtggttaccactcgttgtcgttatcatagttgtatgcctgccatctttggatggtgtcttcttggtggggcagggggtgggggcgagggatacatgtatagacatccgcatggacttgcagaattgcagctagtcccatcggaacaatcctgcctgcgcttcctgtaccttgtaatagacatagcagcccttgcagctgctgaaaagcacatccgagaattagatcctactgatgttgtgtccttgaatcataggattgttctggctaccttatggtagcccgtattgtagggactgttgtagaaacattaaactcacgtcattatatccactttcaattagtagcagctatacgaataattaccccctcccgccccgcacactcacacaaaatacatctatgtcctcatttgttgcgtgaaaacaaaccttttttgccctttaagatgaatatatagtagacctttgctgattaaatcatgagggagttacttatgcattgatgttctgtgctccatctaatctagttgccgtttcattcagagtatttgagaatcctcttggactggattcagatacaactgacagacagacaacactactgtctgcatcaggacattcatctggcaattcatcaggatcagatgactggattgaacctgctgcctatgttcttaactcaactgctcttctgtcaagggaacataggaatgttgtggatgctttccgtctgttgcaaaaggatcccaccgttcagaaaatggttatgtctttgtcatgcgataaggctgtttggaatgctgtcatgaataacgaggcagttcaagatttcaggagatctttacacgatggaaaagaaaatgatagaaacgaaaacactggtggtcctgctgaagtgttcaagtggatcctggaaagcgcccaggcaaaaatatttgaattcctagagaatgttcagaagataatcaacatgctgatccacactccagaggatgatgataatccagatggatacagcgatgcagttaaggtgtcgttcatgctcacggtattcgtcttcatcgtggtggccattgctcgtatcaagtgagcacaacaatccgccgactttacatatttctaggttccattgtcccttgattatacacagggcaactctagttagttagtcagattgaggtcatggaaaggttgactggccaataaatttaaattgatattgtgccgtcgtgtggaattatgatatgtcctagggatattaccattattatccttgcattcagcgtgcttatgctttttcaaaaaaaaaaaaaaaaaggcggcccgccttttttttttttttta

SEQ ID NO: 7188 - DNA, 1423 bp, Zea mays
acgccgacctcgccgcccgcctccgcgagatggcgctcgccgccaacgcgtcggcgtcctcgcccgaggagacgatcgaggcggcgagggcggccgcgcaggccgccgcggacgccgccgttgctgcgcgcgccgtggccgccgagaaggccgccgtcgccgcgaaggctagggcggccgcgcgcgccgccatggagttcatcgactccttctctaccagggccggcgcgtccaggaacgggagcggcctcccggtcttcggctcgtctaggaagaagcatgtccaggtcaagatgctgtacaggcccaatggaaccctagggccagcggaggctcccaagcctaggagacgcaagcagtcggatgaagaggtcccgcacaatttgcaccgcctcatgaatagctcgccgaggatctctcacgctggactgcccaagaggcctcgcacgaccgctgctggggatgccaaaaatggagctgtagcacccggtggaggtaacggcgctggtgtttgtaacggttcttcagttcaggtgccgacggaggctggcggttggttgggtaatggatgctctgaggcgaaatctcatgagagaaccgttccattgctcaaccacgaggtctctggtgaagactcatccaggcacgccgcgaagagtagcggcggcattgctgacaacggagtcggggttgggaactcgagtgctggtcagaaagtgaaggtcaagaggaaggagctgctcctgaatcaaaataccggtaaagaaagagaagaaccagaagaggccacacaaacagagccctttgtacgttctatcacgctcgatgaatcgaaaccaaactcaaaaggaaaaggaaggtcaaacccaaatgggaatggaacagaaaggcttgcaggccctgcagatacgaagggccgtggcgaaggcgtgacgccaccgaagataacttccgtatggaagatcaagaagctgaagacatctcactgctcttccgacagcaaggtgctgcacaaggtctgcgtgccgcctcctacggcggctgagacctctgcttcggtgaaagctgattagcgaggcaccatagcgtatagttcggcggatgcatgtcttagctacgcttgttgtgaggtttttgtatgttcaagttgctactcggacgaggagggaaagcggaggtaaatctctcttggtagatctcacgtttgctttgatttttcatacgaatgtgcttgttttatggtatatagattattgggtatttctactgtactgtttctgcccctgcttccatttgatgtcactagtggtagggagtgtggcataatcatgtagatgtacctgctatgcatacatcgttttaataaatggcaccattgctctcaaaaaaaaaaaaaaaaagcggccgcggccgccgactagtg

SEQ ID NO: 7189 - DNA, 1176 bp, Zea mays
gcttgcatgcctgcagagtcatgatcatttccgtccgtcgtgctcccgtccgacgacatagcaaccacgaaagcgaggacctgaaactgaaacgctagcagatgttcggtgcaccgtcgccgtgaccgagacagcaatggaagtcctccatttgggcgcgccaaggaaaattcattgcccccccttttttttctctctctctcaatcgtatcgttgaagcgtatgtctgcctggataaacctgaccaaaccaaaccaaaccaaactcgatctttggtggcatctagctgcgcagggtgctttcggcgacgacgccttgctttgctctctttatttttaaaacaaaattaaatttcgccatgacaaattccgtcgtcccgccatcatcactgagtttgctgtattggtcagaggtgcaaactaactccatcgatgccgcggattaatgaaccggccgtctttctgcaggttacctgaacgaccccgagtcgacgaagaacaccatcgacaaggacggctggctgcacaccggcgacatcggctacgtggacgacgacgacgagatcttcatcgtcgacaggctcaaggagatcatcaagtacaagggcttccaggtgccgccggcggagctggaggcgctcctcatcacgcacccggagatcaaggacgccgccgtcgtctcaatgaacgatgaccttgctggtgaaatcccggtcgccttcatcgtgcgggccgaaggttctcaagtccccgaggatgagatcaagcaattcgtcgccaaggaggtggttttctccaaaaagatccccaaggtttttttccccgaatccatccccaagaacccgtcgggcaagatcctgaggaaggcctttagagccaggctcccccccggtgttccctgagggcccgtatgcagcttcttttcgggcggcccccccgttgttgcgaaaaaaaaggcgatgtaatggcggtaaccctcctattcatgaactggcaccagaagggacccgtattcctgtggaacccatgttgccagaaaaaggttttagtttgtctgtttgttggccctgtgtgtaatgttcataaacgatatagacgtcgtctctatgttgtttttgacccaaagaacaagcctgatttcggcaatacagctatcggagtcccgtgtttcatatgc

SEQ ID NO: 7190 - DNA, 5645 bp, Zea mays
tgactaaaagaggaattatctttattttagttcacgtgtttaacaatttcaggataaaaaggatggactaaaagttagtccctagaaaccaaacatcatttgcatatgttacattaggctctagaaatgcagaatgctaaggtggcatttgattcgttgaaatggaacacaaaccgtttacatgaggtaatggatatcaatattttgtttggttgagctctttataatagtattaggtactactatctaatccaattataattagtaactactattgccgttaagagctttcattaccatttccttagcaacatatgaactaaacaacacctaatagtctccagttccacaaccgttgtcctggacacattcagacactcactgtcaccaaccgcagccacggaaacgcaggcagcgggatggcaggctggcagctctgatcagtgctcagctcagctcgatggggaggaggaatggaagacgtgccaccacacagccgctgatattggggttggtaaacgacgttgacgtggcgcccccgtcccagtcaacgaacaacagccccagcccagcctctctctccctccctctctcacaaccccgtaccatagctctcctaccccacctccccctcttggccacttccagccgggccccatcagtcatcacctcgaggccccactcaccaactccccaactccctgtcctcccctgctcgtatataactcggcaccagccggtcctctgccctccaggagatcagagccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcggtggtgttccggtccaagctccccgacatcgagatcgacagcagcatggcgctgcacacctactgcttcgggaagatgggtgaggtggcggagcgggcgtgcctggtcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttcctgggcgccgcccgcctgggcgccgccaccaccacggccaacccgttctacaccccgcacgaggtgcaccgccaggcggaggcggccggcgcccggctcatcgtgaccgaggcctgcgccgtggagaaggtgcgggagttcgcggcggagcggggcatccccgtggtcaccgtcgacgggcgcttcgacggctgcgtggagttcgccgagctgatcgcggccgaggagctggaggccgacgccgacatccaccccgacgacgtcgtcgcgctgccctactcctccggcaccaccgggctgcccaagggcgtcatgctcacccaccgcagcctcatcaccagcgtcgcgcagcaggtacgtaccgtggccggtgctactccttcctctcgctatcgctgccgccttggtcgccgtcgccgtcgccgccgccgtggccacggtgacatcacatccccatccccgatccctctccatgtggggacaagctggttggccccacctttgccgaggaacattcgttccagcgttgcgggctcataaataatggcgtgcactgcattcacccggcgctgggtgcgctgaggccgcagcttcctcgatttgttcggatgcggctggtccacctcacccactgtctccaccgaacaagtagtagtagtcaaccggacagccgcttcgagattcgtgccgagacgatgcctgtccttcgcattcgaactgtgtgttgatacatgctgaaactgtgggagtgtctggcccagcgtcgcgcagcaggttgatggcgagaacccgaacctgtacttccgcaaggacgacgtggtgctgtgcctgctgccgctgttccacatctactcgctgaactcggtgctgctggccggcctgcgcgcgggctccaccatcgtgatcatgcgcaagttcgacctgggcgcgctggtggacctggtgcgcaggtacgtgatcaccatcgcgcccttcgtgccgcccatcgtggtggagatcgccaagagcccccgcgtgaccgccggcgacctcgcgtccatccgcatggtcatgtccggcgccgcgcccatgggcaaggagctccaggacgccttcatggccaagattcccaatgccgtgctcgggcaggggtacgggatgacggaggcaggccccgtgctggcgatgtgcctggccttcgccaaggagccgtacccggtcaagtccgggtcgtgcggcaccgtggtgcggggcgcggcgctggcgggccccgtccccgccacctgcctggccttcgccaaggagccgtacccggtcaagtccgggtcgtgcggcaccgtggtgcggaacgcggagctgaagatcgtcgaccccgacaccggcgccgccctcggccggaaccagcccggcgagatctgcatccgcggggagcagatcatgaaaggtgcgccgcacaccgccccagccgttgacttgtcatctcatttctttgcagttgcagctgtaggctgtatagcgctcgtgttcgcaaaatatggccatctatccttcgaattcgaagcatcactttcacatgccattagcgccaccagccaaccaagctgcgggcacgccacgcctctgacgccgtcctggcgcttgaggcgacctcggcgcactgccacgtgggccaatgtggtgctcgtgcgcgcgtgcaccgccacgcggggccccgcgtggcttgggtacaggttggtgacatggacaaaatttcctgttggtccgagtactttggctgcaaagaatccgtttggtccctgcggttagggccacgcagcgacacacagtcgcctgatcgaacgcctttttccaaaccgacagacagtgaaatggtgatttgtcgttttcgccatcgtcaatacgagggaccatcggcatcgtctgcaaaatcaagaacggcgagctagaaaactcgtggcgtgctcggtcgtgttagcgccagtttattcgtagctggagactttgcaggagggatctgttagtggcggcctggcctggtccaagttccaccatggttagctggacagaggaatccattccccgcacgccacacgtttcgcgttctctgctccgcagccgccagccgcgcgtggtagttggccattcgggcgaccatggcactccctctttttttattggcaaaaacaaaaaagagtcatgtggccaccacgccgcatgattgagtggtactgctagctagcagggaagtcaaaagttttggtgaagaaagatggacgctcgtggccatggcggcgggttatgaacgttcacgtccatcgcctcgcctgtgccaggaccagccagagagcttgcttccccggtagacttccaacggcagttggttaggtttttaggtccacctaacacgagtagagtagctggcactacctggcgtgggagcgcgagggcagagtcggtgtcgctgcagagtcatgatcatttccgtccgtcgtgctcccgtccgacgacatagcaaccacgaaagcgaggacctgaaactgaaacgctagcagatgttcggtgcaccgtcgccgtgaccgagacagcaatggaagtcctccatttgggcgagccaaggaaaattcattgcccccctttttttttctctctctctcaatcgtatcgttgaagcgtatgtctgcctggataaacctgaccaaaccaaaccaaaccaaactcgatctttggtggcatctagctgcgcagggtgctttcggcgacgcctccttgctttgctctctttatttttaaaacaaaattaaatttcgccatgacaaattccgtcgtcccgccatcatcactgagtttgctgtattggtcagaggtgcaaactaactccatcgatgccgcggattaatgaaccggccgtctttctgcaggttacctgaacgaccccgagtcgacgaagaacaccatcgacaaggacggctggctgcacaccggagacatcggctacgtggacgacgacgacgagatcttcatcgtcgacaggctcaaggagatcatcaagtacaagggcttccaggtgccgccggcggagctggaggcgctcctcatcacgcacccggagatcaaggacgccgccgtcgtatcgtaagctgctcaccgataatacctttcagatggtttaagttccaaaaaaaaaaaataacttcagaattcagatggagccacaacgcaacctgctgcgctgccagcttcttttaagtaaactctgaactaatctcgttcgtctctctctcccccacggagcgggcggcggccctgctggtgaaatcccggtcgccttcatcgtgcggaccgaaggttctcaagtcaccgaggatgagatcaagcaattcgtcgccaaggaggtaaaagcaatccccgcgttgcttatgtttccacaaaaacaagtgttatttcttagattcgaaggcctccgtccacagggctgcaacacaaaaggaaccacaaactaagaactttttatgcactaattaagaagaagtttgtgcaaattaagagctgcgcgcatgcatgggtctcgagactgaaatcacatatataatgctgcaggtggttttctacaagaagatccacaaggtcttcttcaccgaatccatccccaagaacccgtcgggcaagatcctgaggaaggacttgagagccaggctcgccgccggtgttcactgaggcccgtatgcagcttcttctcggacggccaccacgctgctgcgaaaaaaaaggcgatgtaatggcggtaacactactattcatgaactggcaacagaagggacacgtattcctgtggaacacatgttgccagaaagaggttttagtttgtctgtttgttggccctgtgtgtaatgttcataaacgatatagacgtcgtctctatgttgtttttgacccaaagaacaagcctgattacggcaatacagctacggagtaccgtgtttcatatgcctagatgtttgtcataagttattatagccggagatggcgatgggcctcgatctctccttcactaggactagtttggcaacgaggagagaaaaatcccttgaaaattaatctaggaggggattttagatgccaccttatttcccccctcttcggtgtacttctctgacattgtttgagaagcaatgggctaaatacctctgttgagcaaaaatacataaaaaaatcaggaaaaataaaaaatatataagaaatatttagaaaactcacaaacaataaaacatcactaaagatccaaaaatatgaagcacctatgattcacgcaaagtttagggttttgaataccatctaatatcaaacgaagctaatccatcatcacatcacatagtatcatcatctccattcacacgtacaggtagacaatataatataaaaatggagtattaggaagtt

SEQ ID NO: 7191 - DNA, 2138 bp, Zea mays
cgtcccgccacgcgtccggccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcggtggtgttccggtccaagctccccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttcctgggcgccgcccgcctgggcgccgccaccaccacggccaacccgttctacaccccgcacgaggtgcaccgccaggcggaggcggccggcgcccggctcatcgtgaccgaggcctgcgccgtggagaaggtgcgggagttcgcggcggagcggggcatccccgtggtcaccgtcgacgggcgcttcgacggctgcgtggagttcgccgagctgatcgcggccgaggagctggaggccgacgccgacatccaccccgacgacgtcgtcgcgctgccctactcctccggcaccaccgggctgcccaagggcgtcatgctcacccaccgcagcctcatcaccagcgtcgcgcagcaggttgatggcgagaacccgaacctgtacttccgcaaggacgacgtggtgctgtgcctgctgccgctgttccacatctactcgctgaactcggtgctgctggccggcctgcgcgcgggctccaccatcgtgatcatgcgcaagttcgacctgggcgcgctggtggacctggtgcgcaggtacgtgatcaccatcgcgcccttcgtgccgcccatcgtggtggagatcgccaagagcccccgcgtgaccgccggcgacctcgcgtccatccgcatggtcatgtccggcgccgcgcccatgggcaaggagctccaggacgccttcatggccaagattcccaatgccgtgctcgggcaggggtacgggatgacggaggcaggccccgtgctggcgatgtgcctggccttcgccaaggagccgtacccggtcaagtccgggtcgtgcggcaccgtggtgcggaacgcggagctgaagatcgtcgaccccgacaccggcgccgccctcggccggaaccagcccggcgagatctgcatccgcggggagcagatcatgaaaggttacctgaacgaccccgagtcgacgaagaacaccatcgacaaggacggctggctgcacaccggagacatcggctacgtggacgacgacgacgagatcttcatcgtcgacaggctcaaggagatcatcaagtacaagggcttccaggtgccgccggcggagctggaggcgctcctcatcacgcacccggagatcaaggacgccgccgtcgtatcaatgaacgatgaccttgctggtgaaatcccggtcgccttcatcgtgcggaccgaaggttctcaagtcaccgaggatgagatcaagcaattcgtcgccaaggaggtggttttctacaagaagatccacaaggtcttcttcaccgaatccatccccaagaacccgtcgggcaagatcctgaggaaggacttgagagccaggctcgccgccggtgttcactgaggcccgtatgcagcttcttctcggacggccaccacgctgctgcgaaaaaaaaggcgatgtaatggcggtaacactactattcatgaactggcaacagaagggacacgtattcctgtggaacacatgttgccagaaagaggttttagtttgtctgtttgttggccctgtgtgtaatgttcataaacgatatagacgtcgtctctatgttgtttttgacccaaagaacaagcctgattacggcaatacagctacggagtaccgtgtttcatataaaaaaaaaaatatcataaaaaaaaagccgtagaaaagcggcc

SEQ ID NO: 7192 - DNA, 1588 bp, Zea mays
ggcgggggccagggtggtcgtcaccgaggcctgcgccgtcgacaaggtgcgcgggttcgccgccgagcgcggcgtgccggtggtcgccgtcgacggcgccttcgacgggtgcctggagctgcgggccctggtggacgccgccgagccgctcgccgccgacgaggaggtcggccccgacgacgtcgtcgcgctgccctactcctccggcaccaccgggatgcccaagggcgtcatgctcacgcatcgcagcctcgtcaccagcgtcgcgcagcaggtggacggcgagaacccgaacctgtacttcagcaaggatgacgtggtgctgtgcgtgctgccgctgttccacatctactcgctgaactcggtgctcctggcggggctgcgcgccggctgcgccatcgtgatcatgcgcaagttcgagatcggcgcgctggtggagctggtgcgcgcgcacggcgtgaccgtggcgcccttcgtgccgcccatcgtggtggagatcgccaagagcccccgcgtgggcgccgccgacctcgcctccatccgcatggtcatgtccggcgccgcgcccatggggaaggacctccaggacgcgttcatggccaagatccccaacgccgtgctcggccaggggtacgggatgaccgaggcggggcccgtgctggccatgtgcctggccttcgccaaggagccgttcgaggtcaagtccggctcctgtggcaccgtcgtcaggaacgcggagctgaagatcgtcgacccagacaccagcgcgtcgctgggacggaaccagccaggcgagatatgcatccgcggcgaacaaatcatgaaaggttatctgaatgatccagaggcgacaaagaacaccattgataaggacggatggctgcacaccggggacattggttatgtggacgatgacgacgagatcttcatcgttgacaggctgaaggagataatcaaatacaagggcttccaagtacctcctgcggagcttgaagcccttctcatcacacatcctgaaatcaaggatgccgctgttgtctcgatgaaagatgaagtcgccggcgaagtcccggtggcattcattatacgcagtgaaggctctgagatcagtgagaacgagatcaagcagtttgttgcaaaggaggtcgtgttctacaagaggatcaacagagttttcttcacggattctatcccgaagaatccctccggcaagattcttaggaaggacctgagagcgcggcttgccgcgggcatcccaagcagtgacaacacacagtccaaaagttgatacgtactttcgtactattcttttctagctgtgccaaaaatcatgctgtgctctattcatgagatggcaatggtatacacaaaacgccaagcggtcgttatcgattcttctagatgggcaagggtaaggtatacttcgtttgtgtccgacatattatgtatttgtatcatgtatagatacgttttgttgacaacaagtgctaattataatgtataccatgtttgggaaaaaaaaaaaaagttacaaagagtcgacccctgtcctgaaaaaaaaaaaaaaaaaaaactcgagacctcgtgc

SEQ ID NO: 7193 - DNA, 1043 bp, Zea mays
cctcgaggccggccgggccggctgttgaaacgggaatgtgatgtttacgaataacctctgttcgtttccaccaggggtacgggatgaccgaggcggggcccgtgctggccatgtgcctggccttcgccaaggagccgttcgaggtcaagtccggctcctgtggcaccgtcgtcaggaacgcggagctgaagatcgtcgacccagacaccagcgcgtcgctgggacggaaccagccaggcgagatatgcatccgcggcgaacaaatcatgaaaggttatctgaatgatccagaggcgacaaagaacaccattgataaggacggatggctgcacaccggggacattggttatgtggacgatgacgacgagatcttcatcgttgacaggctgaaggagataatcaaatacaagggcttccaagtacctcctgcggagcttgaagcccttctcatcacacatcctgaaatcaaggatgccgctgttgtctcgatgaaagatgaagtcgccggcgaagtcccggtggcattcattatacgcagtgaaggctctgagatcagtgagaacgagatcaagcagtttgttgcaaaggaggtcgtgttctacaagaggatcaacagagttttcttcacggattctatcccgaagaatccctccggcaagattcttaggaaggacctgagagcgcggcttgccgcgggcatcccaagcagtgacaacacacagtccaaaagttgatacgtactttcgtactattcttttctagctgtgccaaaaatcatgctgtgctctattcatgagatggcaatggtatacacaaaacgccaagcggtcgttatcgattcttctagatgggcaagggtaaggtatacttcgtttgtgtccgacatattatgtatttgtatcatgtatagatacgttttgttgacaacaagtgctaattataatgtataccatgtttgggaacctattgttcttgttaataaagagtcgacccctgtcctgaaaaaaaaaaaaaaaaaaaaaaaaaaaaaaaaacccaaaccc

SEQ ID NO: 7194 - DNA, 1687 bp, Zea mays
cattgggccccgccagggctctcggccggcaggagtaacaaaaatatccctccattaactctccaactcctcttcctcttcctcttcttctgcctcttcatttccaattccggcttcttcctcgcatcacaaaattccgattgcggcgcaatttcagattgcttgctccagggcgcaaatggtcatcatcagcggcagcaacttcccagcggattcgtgatccttccgcgatgggtcccgtcgccaacgatgcgtggcagaagcggttcttcagcgtcgcgccgccggccacgctggtcttcttcttcgtgctgatattcgtcgccggtgcaattgttacgcttgatcataaggagagcctggccatactgcagctgcagccaagaggagtgatcgcagcagagcagatgaggcctccagcgacgagcgagctgcgcgctgagccagcagcagaggaacccgacatctgtgagaataaatgtaggcctgcaggcagcgaggcgttgccgaggggcatcgtgcaggacaagtccaacttcgagatggagtcgctgggtggcaaccctgaacggaaggagaagaagggcaacggcaggcactcgaaaagcctcctcgccatccccgtcggcatcaagcagaaggcgatcgtcgacaagctcgtatccaagttcccggacaccaatttcatcgtgatgctgttccactacgacggcgaggtggacgggtggcgagacctggagtggtcgggccgcgcgatccacgtcggcgtacgcgaccagaccaagtggtggttcgccaagaggttcctgcacccggacctggtggcggagtacgactacgtcttcctctgggacgaggacatcgaggtggacagcttcgacccgctccggtacctgcgggtcgtgagggaggagcggctggagatctcgcagccggcgctcgaccggcggtcgcagatccaccaccggctcacggcgcgcgccgcgcggagcgggggcgtccaccggcggtactacaagacgagcgggcacggccggtgctacggcaacagcacgggaccgccgtgcgcggggtgggtggagatgatggtgcccgtgttctcgcgcgcggcgtggcggtgcgcgtggcacatgatccagaacgacctcatctacgcctggggcatggactacaagctcggctactgcgcgcagggcgaccggagccgcaacgtcggggtcgtcgacagccagtacgtgctccaccggggcatccctacgctcggcgacggcggcaaggcgacggcgacggctgccgcgtcggcattggggacggcagaccggttagcggtcaggcagcggtcctacaccgagctgcagctgttcaacaggaggtggaagaaggccgtggcggaggacgggtgctggaccgacccttacccgaacccggcgacgaccaccggctgaccgttggacggagcgaggcagcgcagggaagtacagtagttggtagctgtcagattgaccttgcctagaagatggtagtagatcatacactcgcattaatttacaggttcacagagagctatacatataatgtacagaactacagattgttttttttcctgtctcttgcctgtgatccatacaagggaataagcgtgcatgaataaaagaacctctggaaatcataaaaaaagagaagggag

SEQ ID NO: 7195 - DNA, 1464 bp, Zea mays
  misc_feature (1050)..(1050): n is a, c, g, or t
  misc_feature (1123)..(1123): n is a, c, g, or t
ggtactagtaaaaccattttacacactccgctctactcccggaagagacgatggcggaggcgacgccgacgatggtgttcgtctacggcaccctaaagcgcgggttccctaaccactcgctcctcgtggcctccgccacccccttcgtgggagccgcatccacggccgagccagcctccctcatcatcggcccctactcggtacccttcctcctccccactcccgcctccgcctcctccggtcgcgtcgtctcgggcgagctctacgccccatcccccgccgcgctcgccgagctcgacgccctcgaggcaagcgcctcgcctcctcatcaaactcgttgttccctgtccaccggtttggttttcccccatctcatgccttcaatttgtcgcagggcacccacatcggcgtctacgagcggcgcccgatcaccgtcgtggtcgacgggtcgggcgaggtggtgcaggcggaggcgtacttcgcgcacccgagctacgcggaggcgctctggcggcgctgcggcggtgaggaggccgagattggagagtacaccgtggaccatgccggcgagtacgtcccgaagagtgagcgccttgccgacgctgctgggcttattgacgccatccataggttcgtcgccactgccacggacaaccgacgtcgtgctcacggattactaccatagttcagtgaatatgtcacgtgtttcctcttttcctgggctagtgcttcggttgcagctgagtctgtcacgaactgtaattcatcctgcaaatttgcagacactgcttttaggctatgcaggtcgtcgtattatgtattcagcatgattgaatccgagttttacgaatgagaaatgttataccacactttgtttggacacatgattcttctcttttcttttctttttctctccggtgagtttagacgaatgttttgggaagcaggcagaccaggagacggtggcaaggcgaaagagacagggaaatatgagatggccgcagagctcgagcgaaatcctatcatgggtgcggccactgcggtctgcgncggggcggtggacggcagacggtaacagcacgttgggacttgggacgagaaagaaatagggcgtccggagganaaagaaatacgaaaatggaaatcggatgttggaagagacgtgtgtttgatacgaatggaagctccatttttatttttattttcgaagttaagttactgtagaaaggacctacagtattttattatttcttagccaaatatgaacagtttacagaaaagtaaacgaagattactgtatagaacactgaatccagttgctaattttatcccctatctctggcttaactcggtgatacactaaactcatttctcttttaaacgtttctcgacactcattcactgtgggtggagtctcgttgaaaatccaattattcctgtttttccaaatacaccaaatcaaaa

SEQ ID NO: 7196 - DNA, 862 bp, Zea mays
attattggagatgctctaactagatttaagttggattgcagttattggatatggatatccatccattgtcaggtctagttaaaccattttacacactccgctctactcccggaagagacgatggcggaggcgacgccgacgatggtgttcgtctacggcaccctaaagcgcgggttccctaaccactcgctcctcgtggcctccgccacccccttcgtgggagccgcatccacggccgagccagcctccctcatcatcggcccctactcggtacccttcctcctccccactcccgcctccgcctcctccggtcgcgtcgtctcgggcgagctctacgccccatcccccgccgcgctcgccgagctcgacgccctcgagggcacccacatcggcgtctacgagcggcgcccgatcaccgtcgtggtcgacgggtcgggcgaggtggtgcaggcggaggcgtacttcgcgcacccgagctacgcggaggcgctctggcggcgctgcggcggtgaggaggccgagattggagagtacaccgtggaccatgccggcgagtacgtcccgaagagtgagcgccttgccgacgctgctgggcttattgacgccatccataagttcgtcgccactgccacggacaactgacgtcgtgctcacggattactaccatagttcagtgaatgtcacatgtttcctcttttcctgggctagtgcttcggttgcagcttttgttttctggagtctgtcacgaactgtaattcatcctgcaaatttgcagacactgcttataggctatgcaggtcgtcgtattctgtattcagcatgactgaatccgagttttacgaatgagaaatgttatacaaaa

SEQ ID NO: 7197 - DNA, 2947 bp, Zea mays
attcgagagagacccggccaaaaatcaaacaggcctccaaaaagaagggagaggaagagggagggattgaaaagctagggttttcgccatggccattgcccacctcgagctcccctctctcgaatccacccttcccaagctctcctagctcccgcatctcgtatcttcacaaaaagcagacgcctttgattccccttcccgctgcgtcgcccccattcgagggttttccctccttccccaaatcgaatcgcagcattaccgaccgagcaagcaacccaccaacccacccgctttaagggtccgagccgagcgacggcgctggcgatccagctgggcgtgagggcggcggaggcggccggataatcaatgtgtacgctgtgcgccgtgcagcggtggtcgcggcgcgtcgccaccatgctcccgtggctcgtcgtcccgctcatcgtcatctgggccgccactcagctgctcctcccggccgcctaccgcttcgaggtcacctccccacgcctcgcctgcgtctccgtcctcctcctcaccctcttctggtacgagatcctcctcccgcgcctctccctctggcgctcccgccgctccgcgcgcctccgcgaggagcgccgggcccacgctctcgagctccataagctccgcaagactgcaacacggcgctgccgcaactgcagcaacccgtacagggaccagaaccctggcggtggtaagttcatgtgctcttactgcggtcatgtctccaagcgccccgtgctcgacctcaattcagccgggaaggcccctaccggatggccttgtgctcaggattgtggatattggctggacctgcactgctcctccagcaataacagctccttcttgggattctcgtggcgcttactttcatccttttgctcgacagcaatgaggtggttattaaggaatatattcagatttacattgtcaggggatggtgagggcttgaacatagatggtaaaaggttggcaaagagtggggagaatggaggaaaaaccgaggagagcaggaccaacaaggcaagaaggaaggcagaggagaagagactggcaaggctggagcgagaaatgctggaggaggaggaaaggaagcagcgagaggagatggctaagctagtagaggaacggaggaagctgagggatgaaaaggcagaggctgaagagcgatcaaaaagcgctacccctgttggggagaaggatgctaggagggaggtagagaagcggtgtcaggagaggaagaagaaagaggacaagggatcaagtaaaagcaattcagattgtgaggacattgatagaagattgaaccaagaaggcgatagaaagcgagactttgacagaaagagcgacttggacaggcgtgagagttacaagcctcgttacttcgatgctaacagtcacagtaataaaacaggggagagcagatcaagatactttggccgtgtgacaggtggcttcttatcttcttcaagagggtttggtggcggttccttctttggcagaagtgctcaggcccctgctcctcaagttagcaaggttagtagatctgtagttcctgcaactgaccagggtaatgcaatcaaaagagatgtccagcatgcagccacgcaagctacagacaaatctgctacagctggagaaactagaaatgcatggactaattttaatcgacctgttagtccaaatgtgcagccacaccctactggccttaaaaagtcatggcatcagctttttatacgctcagcatcagtggccccttatcctgacgttacaacttcaactcatgatatgattcggaagccagaaccaaatggagcacaaataaacaatgctcatacatttctctctcagtatcctcctctggactgcaagccaagttcaagccagtccatgcaatatcctggttttccaccacttaatggagcacctcccagtaacccactatttcatttttctgctggacatatgcccttctatgatgatgcagaatcaacactactcgaagaatcagagcaatttgaggacccatgctatgatccagatgcaattgcattacttgggccccggccgggggctttagataacttccctccggacttagattgtggattcttctcgagtgatgttgctaatgaacccacctgggtggccttcaccaattgagtctcctctctcaagatcccacacggttgaagaaaagcttaccaagccctcgcactcatcagttgcaagaggttctggtggtcccattctgcctgtgactagcagtgaacaaggcacatggcaaatgtggagcacgccattggttcaggaaagtttaggtttgcaaggtcctcagagtcagtggtttcaacaaaacacaaatcaatttaaccatagtgctaaccttttcagtagtggaggcagggcaagaagtcccctgggtactggtttgaatgacagtgatccatggcttcagaaagcacctttccaacaattgccacctgatacatcaagcctgttcctttcacatgaaatgccaggaaaattgcacaatgacttggctttcgggtctccaaacaaatcagcccgcgaacacccctttgggccacctggttatttgttgcctaaggaggaactggtgctggatggagctcaggaaggcggcggcgggcatgttctgtcgccgtccggtgcacatgttggcttgttttctccaacaagtcctgatgtgcagccactgtggccattcagtgaaaaaagagagcatagaacgaacagacttttgtaatagaaggaagggaaaatgtggagccaaggcttccttgcctcctctcatgtagggtttacggtcggatataagctggactgtgttcctcttttttgcactgcattgggccttgtttcacctgatgatgttttatgcccgttggttccctcgcgttac

SEQ ID NO: 7198 - DNA, 3598 bp, Zea mays
  misc_feature (2168)..(2168): n is a, c, g, or t
ttatctctttaaatcaaagaaaaaaactaaaaaattgatatccaaatagttattcgtttgaatgcactagaattaataaacactagttgctaaaattactcggagactccagacggtccccttgttgtagccagagacatccgatcatctttaactaagatccactcattagtttattagttagtttattagttggttcaatacaactaaaatcagatgatagccattgcaatttttcaccaacagttttttagtaactctggcgcattcaagtatacccttactggtgaagcgcattattttttaaaaaaatctgaaaggttttccgtttagacacaaacggaagccaaaaagcggatgaagcgttatctggtttctcaccgactcaccctgcagattttgttcgtctccctctcctttgccttgcccaccgagaaagaagagagagagagagaaaattcaagcaggcaacccaaaaagaagaggaaaggattggaaaagctagggttttcgccatggccgtcgcccacctcgaactcccctccctcgaatccacccatcccacgctctcctagctcccgcatctcgcatctccacaaaaagccgccgccttcgattcccctccccgctgcctcgcccccattcgagggtttcccctccccccccccctaaatcgaaacgcagcattaccgaccgagcaagcaacccccgccacccgtcttcaagggtccgagccgagcgacggcgctggcgatccagcagggcgtgagggcggcggagggcggataatcaatgtgtacgctgtgcgccgtgcagcgctggtcgcggcgcgtcgccaccatgctcccgtggctcgtcgtcccgctcatcgtcatctgggccgccacccagctgctcctcccggccgcctaccgcttcgaggtcacctccccgcgcctcgcctgcgtctccgtcctcctcctcaccctcttctggtacgagatcctcctcccgcgcctctccctctggcgcgcccgccgctctgcgcgcctccgcgaggagcgccgcgcccacgccctcgagctgcacaagctccgcaagaccgcaacgcggcgctgccgcaactgcagcaacccgtacagggaccagaaccctggcggtggtaagttcatgtgctcttactgcggtcatgtctccaagcgccccgtgcttgacctcaattcagccgggaaggcccccaccggatggccttgtgctcaggattgtggatattggctcgacttgcgctgctcctccggcaataacagctccttcttgggattctcctggcgcttgctttcgtccttttgctcgacagcaatgaggtggttattgaggaatatattcagacttacgtcctcaggagatggtgagggcttgagcatagatggtaaaaggttggcaaagagaggggagaatggaggaaaaaccgaggagagcaagaccgagaaggcgagaaggaaggcggaggagaagagactggcaaggctggagagagaaatgctggaggaagaggaaaggaagcagcgagaggagatggctaagctagtggaggaacgcaggaagctgagggatgaaaaagcagaggccgaggagcggtcaaaaagtgctacacctgtcggggagaaggatgctaagagggaggcagagaagcggcgccaggagaggaagaagaaagaggacaaggggtcaagcaagagcaattcagattgtgaggacattgataggagattggtccgagaaggcgataggaagagagactttgacagaaagagtgacttggataggcgtgagggttacaagcctcattactttgattctaacaatcacagtaataaaacaggtgagagcagatcgaaatactttggccgtatgacaggtggttttttatcttcttcaagagggtttggcagcagttcattctttggcagaagtgctcaggcccctgcccctcaagttagcaaggttagtagacctgtagttcctgcaactgaccagggtaatacagtcaaaagagatgtccctcatgcagccacacaagctacaggcaaatctgctacagctggagaaactagaaatgcatggactaattttaatcgacctgcgggtcgcccggttagctccaaatgggtgcatccataccctactgngccttaaaaagtcatggcatcagttatttagtcgttcagcatcagtgtctccttgtcctgacgttacaacttcagctcatgatatggttcggaaggcagaaccaaatggagctcaaatatacaatgctcatacatttctctctcagtatccgcctctggactacaagccaagttcaagccagtctatgcaatttccaggttttccaccgcttaatggagcacctcccagtaacccactacctcattttcctgctggacatatgcctttctatgatgatgcagaatcaacactacttgaagaaccagagcaatttgaggacccatgctatgatccagatgcaattgcattacttgggccagtttcagaatctctagataacttcccgttggacttagattgtgggtttttctcgagtgatgttgctaaagagtcacatgggaggccttcaccaattgagtctcctctctcaagatctcgtacggttgaagaaaagcctatcgagcccccacactcctcagttgcaagaggccctggtggttccattctacccgagtctagcagtgaacaaggcacatggcaaatgtggagcacaccattggttcaggaaagtttaggtctgcaaggtcctcagagccagtggcttcgacaaaacacaaatcaattcaaccatagtgccaaccttttcagcagcggaggcggagcaataagtccccttggtactgggttgaatggctgggatccctggctgccatggctgcagaaagcacctttccagcaattgccacctgatacaccaagcctgttcctttcacatgaaatgccaggaaaattacacaatgacttggtttttgggtctccaaacaaatcagcccgtgagcacccctttggaccgcctggttatttgtggcccaaggaggaactggcgctgaatggagctcaggacggtggcggcgggcatatcctgtcgccgtctggtggcgcacgagttggcggcggcgttggcttattttcttcagcaagtcctgatgtacagtcactgtggtcattccatgaaacattcaatgaaaaagagagcatagaatgaacaaacttttataatagaaggaagggaaaaagtgtggagccaaggcttccttgcctcctctctcttgtagggttttaccgtctttaccgaggtgataagctggactgtgttccttaatgatgcaaaaaaaagaagaagatatggggtcattttgtttcctagcactcaccctcacctgttaacatgcgtcgatgcactgcattaggccttgtttcacctgcggtcattttttaccccggttccgcattgtttttgtcgcgcacaggtgatccatccgtccacggctgtagttatcaactgtgtttctggcacgattttggttttatacatcacccgctaacgttc

SEQ ID NO: 7199 - DNA, 1670 bp, Zea mays
aaaacaggtgagagcagatcgaatactttggccgtatgacaggtggttttttatcttcttcaagagggtttggcagcagttcattctttggcagaagtgctcaggcccctgcccctcaagttagcaaggttagtagacctgtagttcctgcaactgaccagggtaatgcagtcaaaagagatgtccctcatgcagccacacaagctacaggcaaatctgctacagctggagaaactagaaatgcatggactaattttaatcgacctgttagtccaaatgtgcatccataccctactggccttaaaaagtcatggcatcagttatttagtcgttcagcatcagtgtctccttgtcctgacgttacaacttcagctcatgatatgattcggaaggcagaaccaaatggagctcaaatatacaatgctcatacatttctctctcagtatccgcctctggactacaagccaagttcaagccagtctatgcaatttccaggttttccaccgcttaatggagcacctcccagtaacccactacctcattttcctgctggacatatgcctttctatgatgatgcagaatcaacactacttgaagaaccagagcaatttgaggacccatgctatgatccagatgcaattgcattacttgggccagtttcagaatctctagataacttcccgtcggacttagattgtggatttttctcgagtgatgttgctaaagagtcacatgggaggccttcaccaattgagtctcctctctcaagatctcgtacggttgaagaaaagcctatcgagcccccacactcctcagttgcaagaggccctggtggttccattctacccgagtctagcagtgaacaaggcacatggcaaatgtggagcacaccattggttcaggaaagtttaggtctgcaaggtcctcagagccagtggcttcgacaaaacacaaatcaattcaaccatagtgccaaccttttcagcagcggaggcggagcaataagtccccttggtactggtttgaatgacagtgatccatggctgcagaaagcacctttccagcaattgccacctgatacaccaagcctgttcctttcacatgaaatgccaggaaaattacacaatgacttggtttttgggtctccaaacaaatcagcccgtgagcacccctttggaccgcctggttatttgtggcccaaggaggaactggcgctgaatggagctcaggacggtggaggcgggcatatcctgtcgccgtctggtggcgcacgagttggcggcggcgttggcttattttcttcagcaagtcctgatgtacagtcactgtggtcattccatgaaacattcaatgaaaaagagagcatagaatgaacaaacttttataatagaaggaagggaaaaagtgtggagccaaggcttccttgcctcctctcttgtagggttttaccgtctttaccgaggtgataagctggactgtgttccttaatgatgcaaaaaaaagaagatatggggtcattttgtttcctagcactcaccctcacctgttaacatgcgtcgatgcattgcattaggccttgtttcgcctgatgtcttttttttaccaccgttccgcattgtttttgtcgcgcacaggcgatccatccgtccacggctgtagcctgtagctat

SEQ ID NO: 7200 - DNA, 1951 bp, Zea mays
  misc_feature (1920)..(1925): n is a, c, g, or t
  misc_feature (1927)..(1929): n is a, c, g, or t
aatcaaatttggaaccacaaccagtactgggtctttacaaaaaaacggccgataccgtctccgccttttcttccttttgcgctagcttccacagcatcaccaccgccgccccagctcgcttccctccccgctacacggccgctcaccacccaccaccgcttccatactcctcgcctcgtctcccgctcgcgagacgtagctccagatcctctcccccacccacggcaccaccgcattaccctcagatccacccccgcgagcctcatttcagatccacccatgcgcttcccggtccttttcgccctgcagctggtcgccttggcggcggcagcttcggcggccgaggccgcggcgacgttctcctcgaggatggtgcaccgtctgtccgacgaggcccggcgggaagcgggcccgcgcatggggttgtggccgcagcgcggaagcgggggctactaccgcgcgctggtgaggagcgatctccagcggcagaagcggcggctcgcgggcaagtaccaggtcctctcgctctcaaagggcggcagcaccttctcccccggcaacgacttaggctggttatactacgcttgggtggatgttgggacgcctactacctcctttttggttgcattggatactggaagtgacctgttctgggtaccctgtgactgtattcagtgtgcccctttgtctagctaccgtggaaatctggatagagatcttggaatatacaagcctgccgaatcaacaacaagtcggcatcttccttgcagccacgagctatgccaaccgggttccggctgcacaaacccaaagcaaccttgcacatacaatattgactacttttcagaaaatactaccagctctggtttgctaattgaggataccctacacttgaactccagggagggccatgcaccagtgaatgcttcagttattattggctgtggtcgaaagcaaagtggtgactatctggatggcattgcaccggatggactccttggccttggaatggcagacatttcagttcctagtttccttgcaagagctggactagttcggaattccttctcgatgtgcttcaaggaagatagttctgggagaattttctttggagatcaaggagtgtcctctcaacaatccacaccgtttgttcctctgtatggcaaacttcaaacttatgctgttaatgtcgacaaatcttgtattggacataaatgtcttgagggttctagcttccaggctttagtcgatagtggaacatcatttacttctcttcctcctgatgtttacaaggctttcacaacggagtttgacaaacaaattaatgcttcaagggtgccttacgaagacagtacctggaaatattgttacagtgctagtcctcttgagatgcctgatgtgccaaccataatcctggcattcgctgcaaacaagagcttccaggctgttaatcctatcttgccatttaatgacgaacagggagcgcttgccaggttctgcttagctgtactgccatcaacggaacctattggaattattggccagaatttcctggttggataccacgttgtcttcgacagagagagcatgaagttgggctggtaccgctctgaatgccgcgacgttgacaacagcacgaccgtgccgctgggcccatcgcagcacggcagtccagaggacccgttgccgtcgaacgagcagcagacttccccgcccgtgacgcctgcaacgacaggcacggctccgccctccagtgcaacgacgaaccgacagatgctctttgctagctcttacccgttgctgtttctgacaatgtccactgtgttcttcatctcatgagcaactgataatctgatatgctggtaatcgatagccctctggaaaaaaaaaaaaaaaagccccccggtgccttttgctcannnnnntnnnaaaaaaaaaaaaaaggccccta

SEQ ID NO: 7201 - DNA, 1980 bp, Zea mays
gataccgtctccgacctcctcccttttgcgctagcttccagagcatcatcaccacctccacaccaccgccccagctcgcttccctccccgctacacggtcgctcaccagtcaccacccaccactgcttccatgctcctcgcctcgtttccagctcgcgaaacttagctccagatcctctcccccccatccaccgcgccgcattaacctcagatccacccggcgagctcatttcagatccatccatgcgcttcccgttccttttcgccctccagctggtcgccttggcggcggcagcgtcggcggccgaggtcgcggtgacgcgctcttcgaggatggtgcaccgtctgtcagacgaggcccggctggaggtaggcccgcgtgtggggtggtggccgcagcgaggaagcggggagtactaccgcgcgctagtgaggagcgatatccagcggcagaagcggcggctcgcggtcctctcgctctcaaagggcggcagcaccttctccccgggcaacgacttaggctggctatattacgcttgggtggatgttgggacgcctgctacctcctttttggttgcattggatactggtagtgaccttttctgggttccctgtgactgtatccagtgtgctcccttgtctggctaccgtggaaatctggatagagatcttagaatatacaggcctgctgaatcgacaacaagtcggcatcttccttgcagccatgagctatgccaatcggttccaggctgcacaaacccaaagcagccttgcccatacaacattgactacttttcagaaaatactaccagctctggtttgctaattgaggatacactacacttgaactacagggaggaccatgtacccgtgaatgcttcagttattattggctgtggtcaaaagcaaagtggtgattatctggatggtattgcaccggatggactccttggccttggaatggcagatatttcagttcctagtttccttgcgagagctggactagttcagaattccttctcgatgtgctttaaggaagatagttctgggagaattttctttggagaccaaggagtgccctctcaacagtctacaccgtttgttcctctgtatggcaaacttcaaacttatgctgttaatgtcgacaaatcttgtattggacataaatgtcttgagggtactagcttcaaggctttagtcgatagtggaacatcatttacttctcttcctctcgacgtttacaaggctttcacaatggagtttgacaaacaaatgaatgctacaagggtgccttatgaagacactacctggaaatattgctacagtgctagtcctcttgagatgcctgatgtgccaaccataaccctgacatttgctgcggacaagagcttgcaagctgttaatcctatcttgccatttaatgacaaacagggggcacttgccgggttctgcttagctgtgctgccatcaacagaacccattggaattattgcccagaatttcctggttggataccatgttgttttcgacagagaaagcatgaagctgggctggtaccgctccgaatgccacgacgttgaggacagcacgacggtgccgttgggcccatctcagcgcgacagtccagaggacccgttgccgtcgaacgagcagcagacttccccggccgtgacgcctgcgacggcaggcacggctccgctctcctgtgcgacgacgaatctgcagatgctccttgctagctcttacccattgctgttgctgacgatgtcgagtgtgttcttcgtctcgtgaacaaccgatatactactaatcgatagccttgtatattgtatgtgctttatttatggtgtttttttttgcaaaaaaaaaaaaaaaaaggtttatagatcagctgtattttgcctccgttgttggtccctgggatagcctagcaatagcaatcccccgactcgaaatgcagaagtttcagaaatggtgcgg

SEQ ID NO: 7202 - DNA, 1802 bp, Zea mays
  misc_feature (318)..(318): n is a, c, g, or t
  misc_feature (1082)..(1082): n is a, c, g, or t
cggcggatatcttacttaacatgctttacccaagtcctctgaactggttatggtatgacagacagaccagaaggaaccagagtttggctatccaatgtgcctagtgataaatcaagaggatgctgttctatggctctaaaggttgttggtatcatggtatgccatgtttatgatggtagaaatgcaaaatgttggtaacagagcaagacaccaagagatatatcatggtactggaaatgtgaatgaaataaatacctggcaaagtattgaaaatacaaaatagtgtcgtgttattaagttttattaatttcagagtancagaccacctcaagtggcctcctgaagaacagtatttgccaaataatatattggtagagaacagtacaagtggccaactaaagcttgtagccttgtaccactcaaatctggaaaataaaaaaggaacaaatacttttttagcatgcttattaaggcatgatagaattgtggaagacaacttaaccatatgaagccaacctcatgaccagatttgtgaaaacctgctaccattaatgaaagagtggcacggtacagagaaaaggctggaatttggtagttggatggccttggccaacagggatcaataaaaatcaacttgagaaattacatttgatggattggttagagaaagaaaaatatgtaattaagcaagaagggaaaggacggctttcaatagagcttgtttatgtaggttgcatctatggaaggaaagaaatacaggcaatttttcaataacaccagcttgacaatttgcgtgttatgcaccaaacagagggaggatatcacacacaagaactgcttggagtggtagacaaatagacatgcaacgccctctgcctctctttgtttatcagctagccttgcacagtcaggtggcctttttgcactttttactaattcatattatcttgcttcctttttcagtttttcctgttaatgaaagcacagctcctgctaattttaaccttttttttggtaatgaaaaataaaagaatcaggagatacctttaaggcgatctcgagatgtcatgtacggtaaaacnttcactaggcgcaggcgcgcgcgtgatgtccggcgagcagtcgagcgcgcggccacagagcgggcagcagcgcatgctgcaaatcagccacagatagcaagtggctaagattagggaagatggctaagattaggaaagaagcagtctatcaggctagagagaatcaaggagacttgctccatttgtaattggccaccccccgcgtccgcccacgcgtccggttacagcaataaggaatttgtctcttcttccacctccagcctcataagcctgcggttaggggggcataaccccaaccggagaggacggccgacggctacgagctacgtagccgtggtccggcgagtcggggattccaggtccttgacaatgacccactggaaaaggcaaatgcatccattaggagcagaactctcatgaacaagcttgttctgcctttacttttggttgaacttgtgataaccaacccaaactgccaaaaaatctggtgttgctacatttgtatcaatctttacctgagcttgtgtttttgtaagcttatgcatgtacctccacatgtatagatatgctacctacattttctttctgtggtcatatgatatgttgacaaggtcacagatatactctcagtatatgatgacgcttctatgaatctatatgcttcaaaatcatcaaaaaggaaaagctgcagggggatgccaactccacagtacacatact

SEQ ID NO: 7203 - DNA, 2256 bp, Zea mays
  misc_feature (2253)..(2253): n is a, c, g, or t
gtgatggcatatcatatcgtatctatcattaacctagctaagtagcatattacattacattacgttatgcgagttgttttctttcattagcccagcccagtagcatgtaaagctgactcttattctccgcgcaccgcgctttatcaactatggttcaaagattttcccttgagatcaaaccaaacccagcatgcatcagcctgcgatcaaatcaccgcccgtcgtcgatgactccagtcatcgccggcgacggggtgagaggcgcagtcgtctccctctgcacgctgaactccccggtcgtgtcgccagagtagccgctggtaacatagctgctgttcccacccctgcgctgccactcagtgatgtagcttggcttggtcaccacctcaggcacctcgatgtctccggtgagcatcttcactacacgcgacatcggtggccgctggtgaggcgaaccctgcgtgcagaggagcgcaacattgatgactctgatgactgcgtcttcaccgtcggattcttcgatccttgcgtccaggatgccaagtgcttggtccctctcgtacagctcccaggcccactcaaagagatagatcctgtgttcctccaaggaattgtcagtgtttggtcgacctgcgacagtctccattgccaataccccgaaggcgaagacgtcggccttttcagtcagatggcctctcattgcatactcaggcgccaggtagccaaacgtgcctgcgattttagtgctgacatgagtcttcttctcatcaaagagcttggcaagcccgaaatcggaaatcttgggcgtgaggtcggtgtcaagtagaacattgctggccttgatgtccctatgcacgatgcgcacgctggactcctcatgaagataggttaggcctcttgcaatacctaaaatgatctcggggccgcgtggccagtcaaggatcgtaccactgtcaccaaagagtgctcgatcaaggcttccgttctcatggtactcgtagaccagcaggggggtgctactgtcaatgcagcaaccatatagcttcactagattgcggtgctgcacagcagaaattgtggccacttctgtcacaaactggcttttcccctgatgtgatgtttgggaaagttgcttcacagctattaccctctcatcaggtagcttacccttataaactggtccatatccgccttctccaagaatattttgagaactgaaattatctgtagctaactttagttcagcattactgaagatgtttggccttcccaccatgttgtaaagctcttcttgctgctgtgctgctcttcttctcttctgtaccagcataaagattccagctaaggcggctagtcctaagacagaagcaccaattactattccaacaattgcccctgctttgcttttctttttgggaacgccatttcgcacaggtaggagtaaaattggtgtcacactcaatgctgagatcatgggtccataatacccttgagttggaatgcaacaagtgcccttgcctgcccagaagagatggatctcaaggaagtttttggacacagttgcattgtatttcttatatactgcaacatatgattttccaccagccgtcttccttatgtcgaaattcttttctttcagaccaccctggatgtatatgtcaaaaactctccttccagtgctttgccaggtgggtgattctggataagcaaactctgcaaactgaagctcaacagtataatttccattctcaagtccaatgccatagtaccgtagcgatgatggtgacatccttgctgtttggaacagttgtgaatccagtgcattctgaaactgctcggaactatctattgtataacttccatttggggcctcattaaattttccaacattgctaacaccccatcttgtttgaccagtaacacaatatgatgcagctccaatatttgtaggatccatttcataaaaagtattatctaagcccctaaatgatttgttacttccacagtctacggcaatggaggaatattccggagagccacggaaacaaggaatatcttgttggagacagtttaggcctgaaggcagaatgctgttgttgctgctaccaagaatgaagttgttggccaccaagttcaattgcaaattattctgggtagcccaagaaggaaagctaccagagagctggttgtaagaaaaatctaaattgtttagtgaagggcttttaatatcaggcaggcttccagaaaggctgnatt

SEQ ID NO: 7204 - DNA, 986 bp, Zea mays
  misc_feature (975)..(975): n is a, c, g, or t
  misc_feature (979)..(979): n is a, c, g, or t
gatatagagtggacaacacgcgcgcgaaaaaaaaaagccaccaacgcagctgcttctcggacacgcgcctcggagaggctcgcgtttgcgcaattgcgctgccagtgccaccggcccctgcccttccccagccgctggtcccacgcgcgtccagcccacgggcaccaccgccgcaccaggcttttagctctcgacgcgtcgccgccgaccacagcacggctagcgtgtcgattcctcccgctctcgtcgccggatccccccacccgacgcgcccacctctgagtccaatggtggcagagatccgttagggcgaggactggtcccagcttgggtcgggtctccttctccagcttgtgagatcgacactggttgacactgattgtagcacttcgtggcgccttattgggtcgcgggtgcggtttgcgctctacaaattttgggtttggtttcgctgaaccctcatgacccaagcgaagtccactccccggccgggggagatgggccgggcgcgatcgccggaaccgctcgatttcttcatatggactgtcgaggatgttggattatggctggaagaaataaatcttggtggctacaaacaagtatttcaagaaaatagtgtcaatggagaatatctagaaagcttgtccatgtttactactgagcagattctgcgctttattaggcggtgccatatgaaatggggagactttatcacactgtgcaaagagttgaggcgcattaaagtggcgtgccttaaaggggagcaagaagtccgcaggccatggtgggcgccggcatgcctctccgtagttttcgtgagggcagccaagcagaacaggaagtcccgtgttgtctcgttgaagctggaaccataatgcttgtcaagcacttcgaaccgtcgtgcgctagcctaaagtggagaagttttattcacttatctttgggttagttacttcatgtggaggacttgaagcntagnatgtttt

SEQ ID NO: 7205 - DNA, 1151 bp, Zea mays
actggagttgctctaaaaatcaattatctcacccacgagcgatcgctttctacctcgctatgcccacgagctcgctttctactagctctcgacgcgtcgccgccgaccacagcacggctggcgtgtggatccctcccgctctcctcgccggatctccacccgcctcgctctctctgagtccagtggggcagagatccgtgagcgcgaggactggtcccttcttgggttgggtctcttctccagctcgcgagttcgccactggttgacactgattgtagcacttcgtggtgcctgattggatcgcgggtgcggtttgccctccacaaatttgggtttggttccactgaacccccatgacccaagcgaagtccgctcctggaaggaaggagatgggccgtgggcggtcgccggaaccgctcgatttcttcatatggactgtcgaggatgttggattatggctggaagaaattaaccttggtggctacagacaagtatttgaagaaaatggtgtcaacggagaatatctagaaagcttgtccatgtttactactgagcagattctgcgttttattaggcggtgccatatgaaatggggagactttatcacactgtgcaaagagttgaggcgcattaaagtcgcctgcctcaaaggggagcaagaagtccgcaggccatggtgggcgccggcatgcctctccatagtgttcgtgagggcagccaagcagaacaggaagtcccgtgtcgtctccttgaagctggaaccataatgcttgtcaagcacttggaatcgtcgccgcctgtgctccaatcctccagctctataggaggcagcctgcgcacaccatcgtgcgctagtccagagtggcatggaagctgtctgttttcgctcttggtgcatcatgcacaactggtctctctctctctctctctctctctctctctctctctctctctctctctctcttatcccttgctacttgttcttcatatataggtttggaacagtagtatgttgtagacaaagaaagaaacatataatgtgcagatggtctctggtctgctcttttcttgcaaatcttcctgagtagttatggtggtgcatgcgatttgctaaaagaataaaagattgtctaccaaaaaaaaaaaaaaaa

SEQ ID NO: 7206 - DNA, 1180 bp, Zea mays
ccccagcgtccgcccagcgtccgcccacgcgtccgcggacgcgtggggcgcctcggagaggctcgcgtttgcgcaattgcgctgccagtgccaccggcccctgcccttccccagccgctggtcccacgcgcgtccagcccacgggcaccaccgccgcaccaggcttttagctctcgacgcgtcgccgccgaccacagcacggctagcgtgtcgattcctcccgctctcgtcgccggatccccccacccgacgcgcccacctctgagtccaatggtggcagagatccgttagggcgaggactggtcccagcttgggtcgggtctccttctccagcttgtgagatcgacactggttgacactgattgtagcacttcgtggcgccttattgggtcgcgggtgcggtttgcgctctacaaattttgggtttggtttcgctgaaccctcatgacccaagcgaagtccactcctgggaggagggagatgggccgggcgcgatcgccggaaccgctcgatttcttcatatggactgtcgaggatgttggattatggctggaagaaataaatcttggtggctacaaacaagtatttcaagaaaatagtgtcaatggagaatatctagaaagcttgtccatgtttactactgagcagattctgcgctttattaggcggtgccatatgaaatggggagactttatcacactgtgcaaagagttgaggcgcattaaagtggcgtgccttaaaggggagcaagaagtccgcaggccatggtgggcgccggcatgcctctccgtagttttcgtgagggcagccaagcagaacaggaagtcccgtgttgtctcgttgaagctggaaccataatgcttgtcaagcacttcgaaccgtcgtgcgctagcctaaagtggtatggaagctgttttcgctctgggtgcatcatgctcaactagtctgtcttatcccttgttagttcttcatatataaggtttggaacagtaatctgttgtagacaaagaaagaaacatataggtgatttgacgactagggaattgtagggaatttgaaggggatctattgaggaaatcctcctgctattcaggggattttctatggaatctcttcaatttcctggtccccaaatcagcccctaaaatgcagaatgtttcctgggttccccaacaggcct

SEQ ID NO: 7207 - DNA, 863 bp, Zea mays
  misc_feature (482)..(482): n is a, c, g, or t
  misc_feature (764)..(766): n is a, c, g, or t
  misc_feature (799)..(800): n is a, c, g, or t
atcgctttctacctcgctatgcccacgagctcgctttctactagctctcgacgcgtcgccgccgaccacagcacggctggcgtgtggatccctcccgctctcctcgccggatctccacccgcctcgctctctctgagtccagtggggcagagatccgtgagcgcgaggactggtcccttcttgggttggatgttggattatggctggaagaaattaaccttggtggctacagacaagtatttgaagaaaatggtgtcaacggagaatatctagaaagcttgtccatgtttactactgagcagattctgcgttttattaggcggtgccatatgaaatggggagactttatcacactgtgcaaagagttgaggcgcattaaagtcgcctgcctcaaaggggagcaagaagtccgcaggccatggtgggcgccggcatgcctctccattgtgttcgtgagggcagccaagcagaacagggaagtncccgtgtcgtctccttgaagctggaaccataatgcttgtcaagcacttggaatcgtcgccgcctgtgctccaatcctccagctctataggaggcagcctgcgcacaccatcgtgcgctagtccagagtggcatggaagctgtctgttttcgctcttggtgcatcatgcacaactggtctctctctctccctctctctgggtgtctctctctctctcttatcccttgctacttgttcttcatatataggtttggaacagtagtatgttgtagacaaatattgnnncatataatgtgcagatggtctctggtctaaaannttggtgtgaatcatggaagagggaaaaaaaaaaaaaaataagaaaaaaattaaagggggtgcc

SEQ ID NO: 7208 - DNA, 635 bp, Zea mays
  misc_feature (7)..(7): n is a, c, g, or t
cctcacnatcatgaaacaagagagatcaaattttttattgcatgagaataaactggacaccaatcatcaccagagagagcgccatcccttagtgatctgagccatggagctggctttcctgctttcacaagagcagcacttgatgggcactgagatactgggattgtgtggatttcgagcctggactattgaaatgaacagaaaaccaaacagtcctaaccaaatccagcgtctatgtgacgaggactgattaaggcaccagtgcagggcttcagcgacaatgttcagccaagacattgcaaaccaatataaagatattttccttgatgcctcctatcccccaaaatgattgctcctccttcattgacattggagaaacacataactctgttttttcctgaacgggggatttagaagcatcatgaagggtgtatgtgtagtgagaagctatagatggtgaaggagatagatataggtaatagcagtatggtgtgacaatatgggcggaacaaatgtacaatgtagctatagatatatgtggaatgaacttccgatccttttttttcagttcagctactgttaacaagtactaccaataaattataccgcaatgcatatatatgtcagttcccaaa

SEQ ID NO: 7209 - DNA, 2658 bp, Zea mays
  misc_feature (2628)..(2628): n is a, c, g, or t
aattcggcacgaggctcccagaacctcctcctccgcttctctccactcttcacgccgccaccgagtttatacacgcttcgtcccgtcctgccgcgcccgtctgttccatagcataccattattgtgataaaccatccaatccagagttccattccattctgaattgctcctcccagcttcagataaaccatcgagattgtgccgccagcgccccaccatggccgccgcgccgccgctgtccgccgacgtactctccttcctaacctccgcccccgccgcgccgacgccggtcgtagccgcggcgtggggcgcggcgagggcgggtcctgtgaggggtaaggcggcactaaggacgacgagaggaggaaggggcggggtgctggctccgctggtcgggaggaggccccgccggacgccgctctcggtgcgctgcaacgccaccagccgggacggcaggattacacaacaagagttcactgagatggcgtggcaagcaattgtctcatcccccgaggtggcaaaggagagcaaacaccagattgtggagaccgaacatctgatgaaatccctgctggagcaacggaatggccttgcccgccgtatcttttctaaggcaggagttgacaatacaaggcttctcgatgccacggagaagttcatccagagacagcctaaggtattaggtgaagaacctggatctatgttggggcgtgacttagaagctctgatacaaagagcccgggacttcaagaaagagtacggcgattcatatgtctcagttgagcatctagtccttggctttgctgaagataagcggtttgggaaacagctgttcaaggattttcagattactgtgaagacgttgaaatcagccattgaatcgattagagggaagcaaaatgtaatcgatcaagatcctgagggaaagtacgaagccttggagaaatatggaaaggatctgacagctgtggcacgccaagggaagcttgatccagttattggaagagatgatgagatttcgaagatgtatacagattttatcacgaagaacgaagaaccatccagttctgattggtgaacctggtgtagggaaaacagctatagctgaagggttagctcagaggatcgttcaaggagatgtcccacaagctctgacaaaccgtcgactaattgcacttgatatgggtgcattgattgctggtgcaaaatatcgtggagagttcgaggatagactcaaggctgttctcaaagaagttacagattctgatgggcagaccgttcttttcattgatgagattcacacagttgttggagcaggtgccacaaatggtgcaatggatgctggtaatcttctcaaaccaatgcttgggagaggagaactacggtgtattggtgcaacaacccttgatgaataccgcaaatatattgagaaagatccagcactggagcggcgcttccaacaagtttttgttgatcagccttcagttgaagatacaatttcaatactccgagggctaagagagagatatgagttgcaccatggtgtacgaatatctgacagtgcccttgtagctgcagctgttctttcagaccgctatatcagtggacgattcttgcctgacaaagcaattgatctggttgatgaatcagctgccaagttaaaaatggagataacatcaaaacctactgctctggatgagattgatcgtgctgtcttgaagcttgaaatggagcgtctctcacttacaaatgatacagacaaagcatcaagggacagactgtcccgtcttgaagcagaactatcactcttgaaggataaacaacgtcaattgactgagcagtgggagcatgagaaagcagtgatgactaaaattcaatctatcaaagaagagattgacagggtaaatgtggagatacagcaggcagaacgtgagtacgaccttaatcgtgctgctgaactgaaatatggcagtctgaacgccttgcagcgccagcttcaagcgacagagaaggagcttgatgaatatcagagttctgggaaatccatgctaagggaagaggtgacccaagatgatattgcagaaatagtgagcaggtggacaggaattccagtttctaaactaaagcaatctgatagggagaaattgttgtatctggaggatgagctgcacaagcgagttgtcggtcaggatcctgctgtaaaagcagttgcagaggccattcagagatccagggctggattatccgacccaaaccgtcccattgctagtttcatgttcatgggacctacaggagttggcaaaacagagttagcgaaagcccttgcagcttttatgttcaacactgaggaagctgttgtcaggattgacatgagcgagtacatggagaagcattcagtctcaagattgattggtgctccaccaggttatgttgggtatgaagagggtggtcaactaacagaagctgttcgtcgtaggccatattccgtcgtcttgtttgatgagatcgagaaagctcattcggatgtgttcaatgtcttccttcaaatactggacgacggtagggttaccgactctccaggacggaaagtgagcttcacaacaccataattatcatgacgtccaacgntggggtcgcagtatatactaaacatggacg

SEQ ID NO: 7210 - DNA, 1231 bp, Zea mays
acagacaaagcatcaaaggacagactatcccgtcttgaagcagaactatcactcttgaaggataaacaacgtcagttgactgagaagtgggagcacgagaaatcagtgatgactaaaattcaatctatcaaagaagaggtaaggtttgccttcccacaatgactgtgaatgcatttacagagttggttcaggcaatcgacttaaatctactacctgttgcaacagattgacagggtaaatgtggagatacagcaggcagaacgtgagtacgatcttaatcgagctgctgaactgaaatatggcagcctgaatgccttgcagcgccagcttcaaacgacagagaaggagcttgatgaatatcagagttctgggaaatccatgctaagggaagaggtgacccaagacgatattgcagaaatagtgagcaggtggacaggcattccagtttctaaactaaagcaatctgacagggagaaattgctgtatctggaggaagagctgcacaagcgagttgttggtcaggatcctgctgtaaaagcagttgcagaggccattcagagatccagagctggattatctgacccaaaccgtcctattgccagtttcatgttcatgggacctacaggagttggcaagacagagttagcgaaagcccttgcttcctttatgttcaacactgaggaagctgttgtcaggattgacatgagcgagtacatggagaagcattcagtctcgaggttgattggtgctccaccaggttatgttgggtatgaagagggtggtcaactgacagaggctgttcgccgtaggccatattcggttgtcttgtttgatgagattgagaaagctcatttggatgtcttcaatgtcttccttcaaatattggacgatggtagggttactgattctcaaggccggaaagtgagcttcaccaactccatcattatcatgacgtccaacgttgggtcacagtatatactaaacatggatgaagaagatggatcatctgattcagcctatgagaacataaagaggagggtgatggatgctgcaagatcggtgttccgtccagagttcatgaatcgtgtagatgagtacattgttttcaagcctctcgagagagaacagatcaacagcattgtcaaattacagctttgcagagtacagaagaggattgcagatcgcaaataaagctcgatgtctcgcctggagccattgaattcttgggaag

SEQ ID NO: 7211 - DNA, 2680 bp, Zea mays
ctctgactcgggcccgcccggccgggatcacgcatcaaactagtagcaaattaataatccagcgaacacactatactactgagcaaataaagccaccgatgtcatcactcctgttgcgagtgctgctcatccagcttgcagcagtggagtgcctctccgccgcgattccaggctgcctaacgcaatgtggaggcgtagagataccctatccattcggcgtcggcaccaactgctcccgcaaagggttccggatcaagtgcatcaacggcagcgcgggcgaggagattccagtgctgctacctactacgcgctaccagaacatccgggtgctgaacctgtccgtgtcgccgttgccggaggctcgagtgcttcttccggtggcatggcagtgcttcaacgccgccgggggcgtcactgggatctactcgggagatgtggacttcaacccagagggcgtataccgcatctccaacacacagaacgagctcttcgtcctcggctgcgacacctatgcgttcaccaaaggcgtgagggtgcacaacgttaacgcacgcttcccttacagatacttcacggggtgtatcaccgtcagtgtagacgagaaggacccgcgcgacggtgcctgcgcgggcctcggctgctgccgcgtcgacatcccgccaggcatcacggacaccagcatgaccttctcgtctacctggacgcgtgccaaccagaccttctgcccctgcgactacgccttcatcgtggagaagggcaactacaccttcaaggcatccgaccttgtgtcgcacacacccgacaaccgtctgcctttggactggtggaccatgccactgcgtctcgactgggccatccgcgacaacaacggcgactccatgacttccatctcctgcgcccaggcacccaacgaacctgagtatggctgccgcagcaagcatagcgagtgcactaattcaaccaatggccctggctacttctgcaagtgtgcccatggctacgacggaaacccctatgtccagagtgatggtgaatgcacgaatatcaacgagtgccaagatccaaagtcacataattgttcaagtggcagcaaatgcattgacacagacggaggctattattgtcaatgcaatttcttccgaagagggcagcaatgtgatcccttaattcctatggctgccgttgcactgttaactttcttgaattctgtctgcagcaacatttgctgccgtcgtccttggatgtgtcgcaattgttttgcttcagactctaaacaacaggaaaagattcaacagaaatggaggtaaactactgaatgcccagggcataaccacctacaccaaaagggagctgaagaagataactaatggctacagcaaacgccttggaggagggcactttggcaatgtttacgagggcaccatcgtcgacggcagaaaggtcgccgtcaaatgtcctttgcggacaagggtgtcgtcgcaccgctgccattggaagaatttgattcgacctcgccgtgtaccgctaccgcaacagagggtggaggaagatgggtcgttcatgaacgagatcaggttccagttcgaagtcagtcgtcacaagaacttggtccagctcctgggatgctgcctagagaccgacattccgatcctagtcttcgagtttgtcgccaatggaagcctggaggacatacttcatagtgccaagaaaccatgtaccctctcgctgccggagcggctggacatcgccattggctccgcggaagctatcgcctacatgcactcccttgacaatcaaaagcgtgtccatggagacatcaagccttccaacatcctccttgacgatgacctcaatccaaaagtctctgactttggttcctccaagctcctggcaatccatagctactacgttagggcagtggctgcagatataggctacatggacccattatatatgaagaccgagcacttcacattggagtgcgatgtctacagcttcggcgtggtgcttctggagctcatcacgaggagaagggccagctggtatgaacaagatcagcaagggaacaagatcctccccatcgagttcgtcaagtgcttcaaggaccacggtagcggatgtgcgatgtatgatagcagacttgatttctcaggcgaggatgctcaatctcgatgcaacaagcgttgcctcgacatgattggcatgttggccgtccgatgcctcaaggaagacaagagggagaggccaaccatggcagaggttgtcgaggagcttaagcgagtcaaggtactactgctgggtacacatatataaaataatggcctgcagctctcaagcgagttcgaagcacgcagatgaatggaagcgaagcaagcaacaagaatggtcggtcagcacatgtgaagcgctgaacatggcggcggtactgatacaagcaataataagggttcctcaactcaaataaatatacatgatttattcttccaataaaacagcaatgtctatctgtaaacatagtaattcgcatgaattgcttcgctttatacttcttaatttgatgtatgtccatacaaattaatagttgacactgttgagtaccaaaagtggcggacgctccgaccttagggcccggacggtccacggtcctacgatttaaaaaaaaaaaaaaaaaaggccccta

SEQ ID NO: 7212 - DNA, 5614 bp, Zea mays
  misc_feature (4290)..(4290): n is a, c, g, or t
  misc_feature (4366)..(4366): n is a, c, g, or t
  misc_feature (5006)..(5006): n is a, c, g, or t
tgtcttaatggtttatttgcacccagagattgagggtacgcagtttttgcaaaaaaatgagggtatgaagtttgttgtgtcaatttgtaatttcttttctttgtatagtgaaccatagctttgatgtactgtatgtctcctatatactgattactgaaggatttccaattcaagaacaaatatactgtgataaatctgctttacctgcctttaaacaggaaagttgttttgctataaattatctgaaatgtagcatccaatgtgccactttatgattggcctgatgtacaattgccccttccaaaaaaatgaactgaaaaggaaaaaatacttccattatttcatacttggatagttgtggtttctgcctttcttgtagatttttcatttttgcaatataccagcattacttgtatatttgctgtttcaggttattacttatgtacataattatggcagaaagaaaataatcattgcctgcctgcagaatatacatctcatgtgggctgtgtgttctggatttaccagctggacttgattattacagttaaattgcctgcatatgttatcctttcatataaacttttcattgtaagagattagtcttgagatcgtatctataccatacctttttaaatttttttgcgcgtttcattttcagctaagaagagatgttaacctaccaaagcatattggggtaaataaccttgggacttctttttcaagagaaagtgagttgtgccattctggttaataatctatatatttgtttggtttaagaattttatttgtttctttgcttgctttcagtaatacttataccaggaacaacttgtcttaccgagaagaatatttgaatatcttacctaacactaaatatttgatagatcagagttcttgatttcttgaatatgtttattatgatctagatgtccttgtaaactcttaaggaatttttcataacatggtaatacttttgtgataattgttttgtgggatgccctgatggattttgccactgccagatgacataattattaatcagttgttccttctttttttttgactgtttgtactgagattttcatgaaaagaagaagaaactatctgtatatgctctttttcatataatagtgttgtcatgaactgctacatctgcatgtatattttctttggtctaatgtgatattttactactttggtaggttctgctgctgctgactgggcgccggaaatttgaatccccactctggtccgatcagcatgtgctagttgctaaccaaggaccgaatggcaatggctggtggtctccacagcatcattcttctctccttgctgattccagattgcacagaacatcctcatcccctcagcaacaggaacaacacaatcatgatgcacctattcttggaccaaggccatctcctttgcaccggacatcttcatacccgcaaaaggagcctcagtacaacccagctgaagtcattccagatgcaccatacatgtcaaaccatctacctggtgggccacccaattcagtgcctcgacaaccacatcagatgaacatgccatctttcaatgaatttcagatgcatatgtctgcgcaaagtgagaccccattctcccagtttcctcgtggagggacacctccagagccattatttggtggaaaccggggtcatacgggttcaacaggcttctcaactaacagcagtggacaacgagaccatctgctgaataatgggcagtttcatggggaaactgccagcatcatgccaaatttgctgccaaaccatctacaacgtccgaatacattcatgccccctcaattgttgacagtacgccaacagcatggcatgctcccaattcagcaatcttcaaagcagtcatcaagaacacagacacacatgtttggcccccagcatccaccacaaatgatgaataggtttgataattttgggatgcctgagttcagtgatccaagagcaagatcatcaatgcaccatggcaggcaaggtcaacattttcctctccatggctctgagtttggtattatgaagatgggtaatgggaggtcaaggtttagatccaagtatatgtccactgaagaacttgaaaacattttaagaatacagcatgccgccactcatataaatgatccatacatcgatgattattaccatcaagcttgtctggccagcagatatgtggatgcaaggtcgaagcaccgcttctgcccaaccttgattcgtgatccatcatcctgtacacggagtaaggatgagccacatgcataccttaaggttgatgcccttgggagactgccattttcttctgtacggagaccgcgtccactccttgacgttgagccagcttctgcaactgatgatgacaccgttatttcaaagcctcttgatcaggaacctctgctagctgctaggatcacgattgaggatggactctccctattacttgacatagacgatattgaccgcttgcttcagtttagccagcagcaagatggtggttttgaacttaaaaatagaaggcaatctctacttggtcagctggcagaatcgctgcagttggttgatccactaggtgcaaataaaaacacacatctgtccgcaaatgatgatttggtatttcttcgcattgtttctctacccaagggccggaaactactttcacgctatatcaacctcatggtacctggtagcgatcttgcaaggatagtttgcatggcagtattcaggcacctgaggtttgtgtttggaaatctgccctccgatgacggcgcagctgagacagtaactaaactggctagcgctgtagcatcatgcattcgtgggatggacttaagtggcctcagtgcttgtctcgcagcaattgtatgctcgtctgagcacccaccccttcggccccttggccatgctgccggcgatggtgccactgtcgtcataaagtctgtcctggatagagcaacagagctcctcaccgagcagcctgccgcgccagactatggcgctccaaaccgagccttgtggcaagcgtcgttcaatgccttctttgggctgctcactaagtactgcatgagtaagtttgatagcatggttcacacgatgcacaagctcggtgctgctgctgcaacagcgatacgcaaggaacttccggttgagcttctgcgcgccagccttcctcacacggatgagcagcagcgcagactactgctcgagttcgcccagcggaccgtgcccgtctctggccatggctccgacgggtgacggacgggcgggtggcggctggtggaaccatggcatctgaaacaataccagcttaaggtggtcagcgaatattggtgcgctagatgcggtattttattctatcatacgcagacctgcccaatgaatcgagcgttccttgagctgcagttcagatgggcatgccggcgttaagtggatgtatgtcccaggtttggatccgtctgtttaggctaatagtattctctctgcacggttgcatcgcatcaccactggatagattagcatgattagcttccgtctgcagggctgtgtttcgttggctctgggtgggaacggaacccccctgcacgttccttgaaggcaattgcaagaaaatactgcgagctgttggtgtttcggtttgcagtgtttgtttgtagtggcgtcaaggcttccaaggttctcatctcatcactccggacgggtgccaggaagatgtggtttaacacatgtataaactagcaaatgcttggaaggttgatatttggttctgtagccagccattcgaagattgttgggtggggggttttgtttcctgttatattcgcaactgaatacattatcttgcgaagctgttcagtctgtaacgagttcattgggaattccactatatatccttgttatggatggtcaggagctttgtatttttgtgattctgggtattacccttgtgttccataaaggacgctttcttcctcgctcctgaatccattgcatcgtgtcccgtccgaatgggtgttcttcacttttagctttgcctttgccctctaaagataatagtcaaattaaaggactggattcaagaatcatcattttctaaaagtcgatttggaaaacaactctagacctgtttttagtggctttcgaatggaactgtaaaaacatatatcgaaaaacttttaacggtttttagttatttctatcaaacaattttttagctttttaatatcttataacccacaacagctttttccacagttcacaggcnacaacaactttttttatagcccaaccaaacaaactcttgggccctgtttatttgggatttttttcaacttatagcnaccaaaagctgctgcggattgccaaacgccacaacttttcagcttgtttccataagaatcgttttggtaaaaattccaaaatcaatataaacacaggattagtcgagtcgtcattatagcagaaatccgtcgttttttatatcttgaatcttttgagctacttcatgtttctacgcacgtaatcttcgctatactcagattatttctacagctagatttttttcatagccagattctctgatcagaaaaagctgagacactggcccagttcggatgtatgcatgcatggtgcggagtagtacgcacaagcaactggctgggccttggcgaagttgcagagcggcattgagcagaaaggaatacggcaaccaccatggccctgtgcccgcacgacggactgagcgttcgaccgacggcgaggcgctgtctggtccatgcagctgctccggggcggcaaatggcatgtgtttgttccttcctggaccagaacagaactgcatttgctcttgtcgtggaccatatatatatataataaagttgttttcaacaatgttctctaaatttcattctctaaaaaaaatattatttatcctttataatacactataaaagattctgtcatctatatcttctttatctncaacaacgttctctaaatttcgttctctatatcttatactccatttttcaacatttatattaataaaaaaatcaaacatactttgtaccgaactgtaccatgtcatgtcagaggcagcgcgttggccaatcaccgatggcacatcgtaatgcagcacactttagcagcgcgggaggcagggcatcaactaatcactgatggcctggtaccggatagcgcaaacgccatatttggcggacgagaagcatactctaaaatttagaggacgttgtaccggaccttgctggacgcataaaggagacaagtaatcgctatgtttagcggagaggaccatttaccggctcttgctagagacagtctaagctcccaatcaattctcccgccgcatgcgagttgggaccacggtttaccaaactgttccagggtaaaaaccgcccctaccgataacggtttaccggtggtaaaccgatagaaaccggtaaaaaccgaccggtttggccaaaccaaatcaatttgaattcaaaccggtttaccggcgaaaaaccgacgcaaaaccggtagaaaccgccggttaaccatgaaacaaactggtttttattgttttttgc

SEQ ID NO: 7213 - DNA, 6149 bp, Zea mays
  misc_feature (454)..(454): n is a, c, g, or t
  misc_feature (3170)..(3170): n is a, c, g, or t
  misc_feature (3377)..(3377): n is a, c, g, or t
  misc_feature (5291)..(5291): n is a, c, g, or t
  misc_feature (5677)..(5677): n is a, c, g, or t
cgtgcccgcggtctctaaaacctggggtgtgacatcttacacgaccacatatgaagtcgggacaatgctcacccaacccctctaagatttgaaggaacatgcggtaactttgatgaaagtagagcgacaggtaggcccacagatcgttgaagtggtcttgcattaaccagtcaggggcgaatatacggttgcgatcgatgtagctccgatgttgccttgttcgtttgttaatcgtgaaagacctagaggcaacctctaatgcctgctacattataatttgttacaacaactcgatcaccccatcttcgatcatgtcgatgtccgaactcgatgaagacatctcaacaatgctttactcaaatgaaatgattgtgatatgcgtatgaggcggcggtagagaaattcaaaatgtgacttgtgcgaatgagttcaaacactcctttatctgtagatnagattctaatatactttttaatttttttggatttttaatttttaaaattcaaaatgacgtgaaccaatcaagcaacaccacaagtcaccagacagtcattatgaaccgaatgctccgcagtgaggctgttaccaaccgggtataagtcgactgtcccggtgaccacaagctcgtgccgattgatgttgaaaccatgacagcaataccttgagccaacgtaccacgcaagctagcggtatagcttaggtctagaaccagccttaacctggctccaactgagccccttaaacggccccaactggacataggggcattatacctctccaggggcggatccacaatgtgggcaaggtgggccataaccccaccttaatttttgaaactctttatacctacctttcgtatatactataaataaaaaaggtataatgtatatgaggccaaaatagataaacatcaccacgacataccatcactaacccacacggtatagcccaccatcttagaccacaacccacatcgactgaaacataggcagacagaagaagacaccaaccacaggtctacaacgtccaacccctgctcaacgcttgccctatcattgttgtcgcccaatcatcgccaccagcccgtcacctagtcataagcccactgtcgctagcctgctgcctagtcgcccatgctgctgtcattattagcccatcgcatagtcaatagcctaccgtcaccagctcgtcgttcaccatggtcttccactagagtgcaagctgccacaacgtcgcaactcttatccccgattggttgactccgacgtgatttacattgacacgacaacaccactttctgttgtaatagtcatgatattacaacttaactttcatgatattactaaaaactacctttattttaacatttttagtgatttttccattgcagattggcctccacctgaactttcttcttgcgtccgccactgtgagtctaacggttcccatatgtaccagagatgaaatctccatgtatgtatataagagaaacaatgtgctcctcttattcttatcaaactgttttttatgatattattaatcctatctaagccttttaacgtgataataacgtgtataggatagtataactattgtaaagtttttaatattttttaaaaataataaatatatgttaattaattgagttaaagtgtatagggaagttgtttaagaagaatgacgcgagaaagacttatatgtaagagaagattattttaatagaagatagtaaaatatatttaaaatacatatgtggtcgtctctatcgtcgtcctctcccgtcattgataccaccactctgttctctggtgcgtgctctccgtgcctctcctgtctggctgtctcctctggaggttgagagagaaggcacacgcggcttccaagaatgcccgatgaggcgaggccaagcaagacctcttctcgctcagacacgggagatgtgcggaagcaagtcggagagggacagcggcccactactccccaatccacgcaccattaccaccggcctcctgtcgtccaccactgctgataggatgatgggtagagagagataaggggtgggggatacagtccagagtcgttgggggcggtggcttttcttgccgggcatgcgtgcttcctcaatctcgccccgtccgccccggactcctattgccaccaatcgttgggcctttttgggttttcgacctcacctcacccatgggtcagaggagctctccgcctctccccttcacacgccgcccacggcaggagagagaaagcggggacgagcaacagcaggccagggcaggcaggcgcaagaaacttcccccacctccaccacctcctcctcctcgccttccgcctttatttcttctcgtctccttcctcggtcctatctcctctcctgctccgccttttcctcatcggtccctcctcccctatcctctgctcctcatcccctgcgctccgtttcttcggggtttgaggcgagtgatctaggccatggcggccaccaagaaaaccaagatcgtcttggcccagccggcggttggggctccgacgtcgcggctgccgttcttttctcgcgcgcccggcccggtccgaggcgccggggacgaggcggcgcacagggcgagcctcaggtaccggtccctcctccaggactaccaggagctcatcaaggtgagccgagagattctcttcttgacccgtcaactcatgctggtgttgatctgatctgagctgatctcgggattgggggaggttttgcctcatctattcggtttgagagccacgtttattacttgtcgttttccccgggatttgttgttgtgatgtttgcggtgtttgttatgccctttctttttggggtttaggtttcattcgtcccttgtgttcttttgacgatttcttgtggatctcttgcctttagttaggttcaacctgtttgctacggcgttcttagacccatctgtgcattcgagtttcatggtgttagttttagttctagtttgttccactgcgatttgcaattcagcttttgttggagatttagcattcgaggcattataacttctataacattttgctgggtttatttatctccactttgatatgcatgatctgaataatatctgacaatggttaggtcttgttgacctgtacaggaaacccaagcaaagaagganaggctgtacatggagaggctcaggaagaagaggcttttggctgaagtcaagtaattctcagatcataccatttttgctcaagtgtgtacatgtgttatttgtctctctgtgtgtgcgtgtgttaactgttgtatgtatagatggccaaacgggtcctacggcacttacactataaagcacggcgctattagtcatgacactattagncattgttattaatcgtgctgggtcgtgctgtgccagaactagcgtctagccatcagcccaaccatggcactacaatgcctaatcctgccgtgccagcattgacattagcatctagtagtgcccgttctatctcaggtctcaaaaaatctagatctagaaaatctttaagattatatatataattttaaagcatctagatctagtagtgcccgttctagctcagctctcaaaaaatctagatctagaacaacttaagattatatatatagttttaaaacatgaacattcatactagtgtagagtggatttattatttttaaaaccataacaaatcatatttcacaatcacatgcacacattacaatcgcatctatagaccatcagttggtctaagccgtgtctagttgtgccgacctcttgatcgtgtcgtgctcgtgctagtgctagctcatcatgtcggggtggctgtggcggcctatggatcgtgtcgtgccgtgttaaagcactacgggtcatgtcgtgtctagtaccagtctatttagcacggcccacttgaccatctatagttgtatgatgcctgcgtcagtgtgtgttatcgttgtgttgtgtgatatctgtttatgtgggtggcatactggcatgtttgctaaacagttgtgtaaacccatggtgttgcagattcttgcgtaagagataccaatctatggctaagaacccctctcagacaattgcttgtagagtgaagaatccagcactgtcgtctgcatcctggagggctgcttcggtaagtgacgcccagcaccagttggttcgtgctgtcgggagctccagtagaaaccagctggtgcagccaaggcgcggtggttctccaagggtgtatccggcgattgacctcaatgaggcctgtgagccggtatgaaattgtgataaacctcattccacttgctgcaatagctcccaaacttgagttatctgaacaggtttatctcattgcagggttatgagatggaaatcgtcgaagagcgccatggcaacagggcccctcttggcatcaacaagtcaaagaggtatccaatggaaagtgatgctgatgccggcaacaactcaaagaggtatcctatggagatgggaagtgatgctgttgccggcccaacccaggggaggatgcctgtgttctgggatgtccagaacccagcagggcgatctgggaagaggaagatctcatgtcaggatcaacgttagtccttagagtataggtaaacgacaatgttagctctggtacagcagtagtgccctagtaggatcagtatgtgccgttgctagcctggtagatgtaaagggatgcctgggacaatcttgacggttatctgctcatgtttattgatgatgaaaacatatgctgttgcatgatgaagtaggtgggcatgtgtgtctgtcattgttttaaagactaccgacccaaaaaaatcctaggcgcggctaggcgtcgccttaccgctttaagaagcatggtgtctgtgatccatcaccaaaatcttgtggttagtactggtatggagggctattgattaatgagagatgtatacgctttcaagcaagtaatctcctgttcatgtagagttgaaaaaaaagtgtgcgcctgctctattgacgtagtaaatatggcaacgactaatatgcaatcagtcattaggcgaaagcgtgcaagtagttctcttggtccgtttgatctagatttaactgtatgtttgttaaaccttttttataaagctacacgaggtggtagtgagaggatttaaatgctaattatagcatatggttagatctagatctaacaaacaaaaaacctagcacgcttgcgcataacgactgcttgcatattagtcgttgccagtaaatataaagcttaagaanttatgttagagtacatttgatcgtttagatattgtgtttcgtatgtcatatgtatctgtgggttgtcttatatcctaagctatatactgtatataaaccgctaagtcaagtactctatatgaatcatatactctatataaatcgtttaaggactcaattgcaatacatccatctaattacataagttctattttccttcatggtatcacgagcttaggttatgacctagatttcctcttgcaaagccgccaatgtatgacttccgaggagatatctttgtcggggctgtgccttgtagttaggatgtgtggctggcccttctgatctgccgtgcctattgtcgtgtcgtcaagcttgaatagattaggaacattggtttctccacntgatctagtggttgcttgggatctcctatcggcgagatcatgccttgtcctttctgcatgccatcgtggtgacgacagtgggggcacaacatccatgcttcctctccatgtgtcgttgtagtgatgactgtggggaagccgcttgggccataagctctgtcacctcgtccctcagatccacacccaaatttgttgatgttgtgagtccttttattctttccgattggtgatcaggtttgtgcgccaccgcccgctgtcattcttgttgcttatcacacccggatttaaggacaatccagatgttgtaagtagtgggtctcttttactttcgtcgagaggatgacactaggagttgggacactttctgatttatttctcacacaacacacaatgtcatactcatctaagggttgggttacatatttataacctaaggggatgaagaacatatgctaagatgctcctagagatg

SEQ ID NO: 7214 - DNA, 1135 bp, Zea mays
gcacgagaccattacctagaacatcctaatcgaaaaatctcctctcctgctccgccttttcctcatcggtccctcctcccctatcctctgctcctcatcccctgcgctccgtttcttcggggtttgaggcgagtgatctaggccatggcggccaccaagaaaaccaagatcgtcttggcccagccggcggttggggctccgacgtcgcggctgccgttcttttctcgcgcgcccggcccggtccgaggcgccggggacgaggcggcgcacagggccagcctcaggtaccggtccctcctccaggactaccaggagcttatcaaggaaacccaagcaaagaaggagaggctgtacatggagaggctcgggaagaagaggcttttggctgaagtcaaattcttgcgtaagagataccaatctatggctgagaacccctctcagacaattgcttgtagagtgaagaatccagcactgtcgtctgcatcctggagggctgcttcggtaagtgacgcccagcaccagttggttcgtgctgtcgggagctccagtagaaaccagctggtgcagccaaggcgcggtggttctccaagggtgtatccggcgattgacctcaatgaggcctgtgagccgggttatgagatggaaatcgtcgaagagcgccatggcaacagggcccctcttggcatcaacaagtcaaagaggtatccaatggaaagtgatgctgctgccggcaacaactcaaagaggtatcctatggagatgggaagtgatgttgttgccggcccaacccaggggaggatgcctgtgttctgggatgtccagaacccagcagggcgatctgggaagaggaagatctcatgtcaggatcaacgttagtccttagagtataggtaaacgacaatgttagctctggtacagcagtagtgccctagtaggatcagtatgtgccgttgctagcctggtagatgtaaagggatggctgggacaatcttgacggttatctgctcatgtttattgatgatgaaaacatatgctgttgcatgatgacgtaggtgggcatgtgtgtctgtcattgttttaaagactaccgacccaaaaaaatcctaggcgcggctaggcgtcgccttaccgcttt

SEQ ID NO: 7215 - DNA, 1408 bp, Zea mays
cattgggaccctcgaggccggccggaaaaaaaatcactcctaagggcgattgggtacctcgaggccggccggggcacatgcactagctcctcctctcttgcccaccagcgactcccgtagctggaactcgctcgtcaaaaggaaaaggaaacacttcgcttcagctcgttgacagacgacgactcagagcaaaatgggtatactggtgattacggtggacctagactgctgtcgctgcagagccaagatcaccaaggtcctggactgtctcaaagaggagttctgcatcgagaaagtggagttcgatgacaagaaggagaagaaggtggtggtggtgcgtgggaagttcgacgccgagaagctctgcaagaaggtgtggtccaaggccgggaagatcgtgaaggggattgtcatcgctgaggtgtggccaataccagccccgcccaaggagtgcaagcctgaggcaccgaaatgttgcgactgtgagaagtgcaagcccaagcccaagcctgagccaccgaaatgttgcgactgtgagaagtgcaagcccaagcccaagcctgagccaccgaaatgttgccactgtgagaagtgcaagcccaagcctgagcctcccaaaccagagaaatgctgcagtgcctgttgtcactgcaagcctaagcctgatcccaaaccgctgatatgttgtgtctgttgccactgcaagccggagaagaaggaagagaagaaggaagaaaagaaggacgaaaagaagccggcgccggccaaaacggagtacaagtttgtgccctacccgtacccgctgccgaaccccgcgatgtgcccgagctggccgtggcagtgcccgcctcagcagcagtgccagtgctgccagaagcctccgcctccgccgcccaagtcgccgccgaagccgccgccgtgcacctgttcgagccacgccgcctgtgtctgcggcaagacaccgccggcggtctggccaccgatgccgccgccggtctggccgcccccgtggggcacctgcaacgtcgtcaccgaggagagcccgtgctccgtcatgtgacgctacgcgcttgctttgtcatgtactcgtcgctgttggcctgttgctgtgctgccatcggtactggacctcggtgctacttgggccggtgccattctgtgtagtgaaggtacagtgcatcgtctgcagatgtgcttgcctcctacagtctcttatacgaacgtgtcacgccttgttttattgcagtaattatgtagcttccagccataatttgctactctgtatatgtggtataagatgaattttcatagctcggctccatggaaattcaagaaatctgtcacatccgcatggaaatttaaggacaagttaaaacatggatattaaaaaaaaaaaaaaaaagcggcc

SEQ ID NO: 7216 - DNA, 2730 bp, Zea mays
ctagctacgccactgacgaacaacacgggtcacacgaggcttagctccgcttcgtttcctttcgtttcgttatataacctgcgcgcccaccctcccctttgctgcacatgcactcctcctctcttgcccaccagcgactcccgtaactggaactcgctcgtcaaaaggtgagcatagatcctttcagcttttcctttcactgcttctagctgctgcattcgacgcacatgttgaccaaaacatccagttctagtttctccactatagtttgatatatatacatatgtatagaaggtgtaataatctatcactcttgctcgttacccaggaaaagactctcgtcgctccccctggttgacagacgactcagagcaaagtaagggtgactgaataaaaaaacatagtctttccgttggaacgacggcggcagaagctctgctgatgctgctgtagtttctgttcgtcagtacacgcaacgcaagtagtacgtttttcacatgttcgttttgcagatgggtatactggtgattacgggggacctagactgctgtcgctgcagagccaagatcaccaaggtcctggactgtctcaaaggtacatatttatcagcatgtacataaagatgggaatacttccatgatgcgattgtacatataatccagcaattcattcgaaaaaaccaaaagcgtattttaccccccaccccaagcacgaacagtccatgttcgaagaaactgatattgtcgaagctgtagcgcaacgtgtcttcgcaaaaagggaaaaattaaagaaagacaaaacattcggggttcccattttttgcagaggaaagtatgaacaatactgaccaggtttgcaagattcttctgaaaccacgtcgacgagcttgtctggttcagcttatttttaatcacatgcggaagaagatgaatgcggcacgaaggagtcgtttagggtctagaaatgacaaattgctcctaccacaacgactcaacggactatgtgttcatattgattcggacgatttttaccaaaacgattctcatagagtttgggagtttagttgccagaagccgattccccgatggccagaatccaattttaagccgaaacaaacaccccgtcatcggcctgaatcggaaaacattttaaccaacatcatctaggcttcctgtgattaattaaataatcatagttagactatgttcagcagttcatagttagactggatgttttgtactgtagactactcgtaggagtttaaatatgggtattgggatgggtaagactgcaactgctagcttataagaggctgaattctaatatattcttgcaacagtaattatctttttctttttcaaaaattgatgcagaggagttctgcatcgagaaagtggagttcgatgacaagaaggagaagaaggtggtggtggtgcgtgggaagttcgacgccgagaagctctgcaagaaggtgtggtccaaggccgggaaaatcgtgaaggggattgtcatcgctgaggtgtggccaataccagccccgcccaaggagtgcaagcctgaggcaccgaaatgttgcgactgtgagaagtgcaagccgaagcctaagccggagccaccgaaatgttgcgactgtgagaagtgcaagcccaagcccaagcctgagccaccgaaatgttgccactgtgagaagtgcaagcccaagcctgagcctcccaaaccagagaaatgctgcagtgcctgttgtcactgcaagcctaagcctgatcccaaaccgctgatatgttgtgtctgttgccactgcaagccggagaagaaggaagagaagaaggaagaaaagaaggacgaaaagaagccggcgccggccaaaacggagtacaagtttgtgccctacccgtacccgctgccgaaccccgcgatgtgcccgagctggccgtggcagtgcccgcctcagcagcagtgccagtgctgccagaagcctccgcctccgccgcccaagtcgccgccgaagccgccgccgtgcacctgttcgagccacgccgcctgtgtctgcggcaagacaccgccggcggtctggccaccgatgccgccgccggtctggccgcccccgtggggcacctgcaacgtcgtcaccgaggagagcccgtgctccgtcatgtgacgctacgcgcttgctttgtcatgtactcgtcgctgttggcctgttgctgtgctgccatcggtactggacctcggtgctacttgggccggtgccattctgtgtagtgaaggtacagtgcatcgtctgcagatgtgcttgcctcctacagtctcttatacgaacgtgtcacgccttgttttattgcagtaattatgtagcttccagccataatttgctactctgtatatgtggtataagatgaattttcatagctcggctccatggaaattcaagaaatctgtcacatccgcatggaaatttaaggacaagttaaaacatggatataagctagttgttccgttggcagaccagacccaaaaatttagatggcccttcgcccctagctgttggtgtttcggacttgtgcctgtaagaatcttttactcttctccttcaccatccttgcattcaacctgtaaacagtgccgccatgaaagtcctggaccaacgaggagcaagtcaaacgaaggaagaaggccggatccaggctggccactacagcccgccgacgtggcaccggcgaccagggggat

SEQ ID NO: 7217 - DNA, 669 bp, Zea mays
caatcattagtcgattccacaacgtatatcttagatagtttaattttgataatggatccaagatatatcaccctatgcatcttcctagtacttgtcttacatggagatacaactttggcagaaacttgcaggcagtttgttaaatgggatccattctgctttagtgcaatgtgcaaggcaagttgttttatagagggaaaatcctccgatggttcctatgtaaaggggcacagatgtgaatcaaatggatatcacgctgtgtgtgtttgttttctgtgtaaaaattaggtatctaatgacatgcgaatctatcttcttttgttcctctctgtcatctaggagtgttgtctaaataattatatggtaaaatagttaactagtatgtttactattagagttatgtagcactagttaactagtcgttatttcttcaatttcttatatctagaaacatgtttttagttgtcaagcacttcaataatatatgtttgttttcctttattataaatttaaagagagtcgttgttagctttttgtctatagtcttgtttactcaagagttatatatatttgtaatgtgtcgataaatagtataattctacaggtacaatcacaagttcgttgctaaaaaaaaaaaaaaaaaaaataaaatgtaaattcaaaaaagta

SEQ ID NO: 7218 - DNA, 1615 bp, Zea mays
  misc_feature (792)..(792): n is a, c, g, or t
atgcccgcgccgcccgccgcgcccccatggctgcgcgcgtgggcctgctcccgcacgcgatcctcgtctcctcccgagctctacccacgccccgagctcgcgtcccttatcctcttccacccgtcccttcctacctccgccacgcctcccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgtcacagtggctgattatggatctcaaatattggtcggtttttccttaaagatggatgtatcatctggaccattttcattggtggctgaagaggactcagatgaattgagaaaagatggcgctgaagaaattttggaagatattactgaccttgtcaatgaaaccatctttgatgatggttcatataacatttcgtttacaaaggaaggtatactctctgcaattgatgatgggaagtctgagggaggtccatctggacgacattgggtgcttgatccgattgacggtactaaaggtttcttgaggggcgaccaatatgccattgcattggctctgcttgatgaaggtaaagttggttttgggtgtattggcttgtccaaatcttccattgtcatcaataaacaacatcaatggtaactcttcgggagataaagttggtgccctgttttcgctacaaattggttgngggggctgaaagaaaagtccttagatggctctccaccacaaaaagattagtgtttgctccatcgacaatcctgtcaatgcatcattttttgaatcctatgaaagtgcacactccatgcatgatttgactggctctattgcagagaaacttggtgtccaagctcctccagttagaatcgacagccaagcaaaatatggtgctctggcccgaggtgatggcgccatttacttgcgctttccacacaaaggttatagagagaaaatatgggaccatgcagcaggctcaattgtcgtgacagaagctggaggcatagtgacagatgctgcgggaaacgacttggatttctccaaagggagatttctcgatctcgacacaggcatcatcgcaaccaacaaggagttgatgccgtcgctcctgaaagctgtccaagaggctattaaagagacgaaccaggctgcctccctcttatagctgttgtagtggtcgacaaaaaagtagttgcaaaattttcgtactggcaaacaggcatcatcaagacaggcgagcgcttggtgccggtgctcttaaaggccatccaagaggttatcaaggagaaagttgagcagtcgtaatgatgaacagaaattttagttgcacgtgtgacttacatatttcagctgtaccacttttgatcagacacgttcccagtgggtgcttagcagataacagttcttttactgaatactgtaaaagcctttttttttcaaaaataaactaggtttcctccgttttctttctagtgtaaaatctgtttacagcctgcggatcgatgacccgtctgcga

SEQ ID NO: 7219 - DNA, 3773 bp, Zea mays
cttttgtgaattgatgcaagatttatggagtacttccaaatgcatatatactaaatgctaatgttaacttatatgtatctttttggtttctatacttaaatagttagattacaaaaggcttatacaattcagtgtttatccatgttccactgtgtacaagtcctgggaatgcctttcaaaagcattgcatttatggtgatggttcattgcaacctgataataatgaataactgtttggcttccttctattcaagattttaattaatagatagccgtacaccactgatttgccagccttgctaataattgtcataccttatctgaatttttattttatgacccgaatcagtttcttgaggggcgaccaatatgccattgcattggctctgcttgatgaaggtaaagttgttttgggtgtattggcttgtccaaatcttccattgtcatcaataaacaacatcaatggtaactcttcgggagataaagttggtgccctgttttctgctacaattggttgtggggctcaagtagagtccttagatggctctccaccacaaaaggttatagcttttattttgatcaataatcttaagttcttaacctaccttctctcgtactaaaacattttagtttctcttgctcattatttggttataatcttcaatttatgaattttttactgactcttggtgaactttaatttagattagtgtttgctccatcgacaatcctgtcaatgcatcattttttgaatcctatgaaagtgcacactccatgcatgatttgactggctctattgcagaggtagcttccaaactattctttgcttactcgatatccacaggagtacataagtaatctggttttttaatgctatcagaaacttggtgtccaagctcctccagttagaatcgacagccaagcaaaatatggtgctctggcccgaggtgatggcgccatttacttgcgctttccacacaaaggttatagagagaaaatatgggaccatgcagcaggatcaattgtcgtgacaggttaatttgatgttctttttctttttcccaaaataactgctgcaagatttgcatttttcattttatcgttgttgcccatggcagaagctggaggcatagtaacagatgctgcgggaaacgacttggatttctccaaagggagatttctggatctcgacacaggcatcatcgcaaccaacaaggagttgatgccgtcgctcctgaaagctgtccaagaggctattaaagagacgaaccaggctgcctccctcttatagctgttgtagtggtcgacaaaaaagtagttgcaaaattttcgtactggcaaacaggtgtgcatcatttctccgtggtattacagagtctagcaaatttatagcatcaacctgattggtgatcagacgtccattcgttttactgaatccccttcttggtgcagcattgctagaagtggacaacatgaataatttgagtgagtccatagttgcctgaactcagctttggcatttgaactggttatagaaattgtgaaataattaatggatatttggaagacaaacttgaacttcagttggaatccaaatgtagcatacaaagtctgtaaaaacaagaatcccgaaacatgaaatgcatcgtgtctgaaaatgacccaaatatatggcccctaattttcatgacctgtcctaggcatcatcaagacaggcgagcgcttggtgccggtgctcttaaaggccatccaagaggttatcaaggagaaagttgagcagtcgtaatgatgaacagaaattttagttgcacgtgtgacttacatatttcagctgtaccacttttgatcagacacgttcccagtgggtgcttagcagataacagttcttttactgaatactgtaaaagcctttttttttcaaaaataaactaggtttcctccgttttctttctagtgtaaaatctgtttacatcctgcggatcgatgacccgtctgcgaaagccactggaggcagcaacaacatcttcactaatgctcatgtcgctcaactcatttttttagtttttttttttttgcttcgaagcctttatatagcattatagcttgcttcaccgaacgatgttcagttttcaaatggaacatagtatacacttttacaagggaaaatggagttcctaaactagtccttgtataacggtctcacccggtggatgcatgtgtatagaaacatgtcgtgattgttccatcgagaaaccatttcgtaattttgcgaacacataacatatgtgcttactatgttcagttgtgatgggtgattatctaggagatggccagctttagtggagtttatggatcaactattatatgagtgcgtggtgcaacatgtttggacctcggtgcaacatgtttggacctcggagacgttgacgacaaaggtaaaggtcaactagggtccatatcgatggactaagagtggtaaaggacgggtgccaacacttgaattgatatactagataagccagagattgaccatggtgtcgaacatctggggacatatgtaggtgcaagagtatatgggagagtagactatgttgactaattcaagcgaaggcgttggaggagttgatgattgaacaatcgagggttggtggtgacacatgtcgaaattatggagaaagtgtatcagatactctactcacgagaggtttagtagtttgtgtctcaaaaccaccatgcaaatagtttctcgagtttggacctgaaaactcggttggagttttggcaggaataggaggaggcacgtggcatcatacctaaatttatgtcaagacaaagtaaagtcatgatgatcccgtggctattagatgcacatattttgagttggaccattttctccctaggttaaatggttgaaccaaaatatctaagggcatattaggaatatgtaatagttagaaataagatggggaccatcccgaccaaccatctctttattttttatgtttcaacacaacactctagttgtagaagcttaagcttttatctattttcgtttgtgagatcctcggtgtagagtaattactctatcatgtttaatttttttgtataagaatcaaatctggttgatcttagaataaaacaatcattcatgggagatctgagtgtatgttcttactttgagttggatttggttttctcctttcttttctctccccctttattgttttgctcaatcttaagttcatgaggttttgggatatttttgcttggttaaattattttgaggacctttgatgaatatgtctccctagtgaaatgggcagattcatcatgagcatagattttgacacttgggagaatttcttgagaacactccaactctattgatggatttttagatatgtgatgttgttagtagagaatgattctttcataatatcttctaatatatctaataatctgtcacacccggttcggaaggcaaaccgaatgtgaaccatgtacgtgccaggatcagaccccatgtacacaatgattacataaatgattcatcatcgcacaatgctcaaataacataataacataaagagtatttaaactcacagtcttagacttcacaatgatcaaagtgctaaatgggaatgtagttaagataaatgccttctacaggcaactggattgggggattacactaatctagctctagaactcatcgaagtcctgaaactcctagaatacgcctcgtttcctccttctagcaaagtttcatgtgg

SEQ ID NO: 7220 - DNA, 1632 bp, Zea mays
tggcttccgggaccccgcgcggctctttccataccttgccgggtcgttgccaaatgccaacgcaggcgccgggcagtgcacgcacatggctgcgcgcgtgggcctgctcccgcacgcgatcctcgtctcctcccgagctctacccacgccccgagctcgcgtcccttatcctcttccacccgtcccttcctacctccgccacgcctcctcctccgccttccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgttacagtggctgattatggatctcaaatattggtcggtttttccttaaagatggatgtatcatctggaccattttcattggtggctgaagaggactcagatgaattgagaaaagatggcgctgaagaaattttggaagatattactgaccttgtcaatgaaaccatctttgatgatggttcatataacatttcgtttacaaaggaaggtatactctctgcaattgatgatgggaagtctgagggaggtccatctggacgacattgggtgcttgatccgattgacggtactaaaggtttcttgaggggcgaccaatatgccattgcattggctctgcttgatgaaggtaaagttgttttgggtgtattggcttgtccaaatcttccattgtcatcaataaacaacatcaatggtaactcttcgggagataaagttggtgccctgttttctgctacaattggttgtggggctcaagtagagtccttagatggctctccaccacaaaagattagtgtttgctccatcgacaatcctgtcaatgcatcattttttgaatcctatgaaagtgcacactccatgcatgatttgactggctctattgcagagaaacttggtgtccaagctcctccagttagaatcgacagccaagcaaaatatggtgctctggcccgaggtgatggcgccatttacttgcgctttccacacaaaggttatagagagaaaatatgggaccatgcagcaggatcaattgtcgtgacagaagctggaggcatagtaacagatgctgcgggaaacgacttggatttctccaaagggagatttctggatctcgacacaggcatcatcgcaaccaacaaggagttgatgccgtcgctcctgaaagctgtccaagaggctattaaagagacgaaccaggctgcctccctcttatagctgttgtagtggtcgacaaaaaagtagttgcaaaattttcgtactggcaaacaggtgtgcatcatttctccgtggtattacagagtctagcaaatttatagcatcaacctgattggtgatcagacgtccattcgttttactgaatcaccttcttggtgcagcattgctagaagtggacaacatgaataatttgagtgagtccatagttgcctgaactcagctttggcatttgaactggttatagaaattgtgaaataattaatggatatttggaagaccaacatgaacttcagttggaatcc

SEQ ID NO: 7221 - DNA, 1720 bp, Zea mays
gcacgagaccattacctagaacatcctaatcgaaaaataccttgctgggtcgttgccaaatgccaacgcaggcgccgggcagtgcacgcacatggctgcgcgcgtgggcctgctcccgcacgcgatcctcgtctcctcccgagctctacccacgccccgagctcgcgtcccttatcctcttccacccgtcccttcctacctccgccacgcctcctcctccgcctcccgctcctgccgcgcgtcgccgcgttttgtcgcagtccgcgccatggcttcggggaacccctacgccgccgagctcgccgccgccaagaaggccgttaccctcgccgccaaactctgccagacagttcaacaggatattatgcattctggcgttcaggctaaggcagacaaaagtcctgtcacagttgctgattatggatctcaaatattggtcggtttttccttaaagatggatgtatcatctggaccattttcattggtggctgaagaggactcagatgaattgagaaaagatggcgctgaagaaattttggaagatattactgaccttgtcaatgaaaccatctttgatgatggttcatataacatttcgtttacaaaggaaggtatactctctgcaattgatgatgggaagtctgagggaggtccatctggacgacattgggtgcttgatccgattgacggtactaaaggtttcttgaggggcgaccaatatgccattgcattggctctgcttgatgaaggtaaagttgttttgggtgtattggcttgtccaaatcttccattgtcatcaataaacaacatcaatggtaactcttcgggagataaagttggtgccctgttttctgctacaattggttgtggggctgaagtagagtccttagatggctctccaccacaaaagattagtgtttgctccatcgacaatcctgtcaatgcatcattttttgaatcctatgaaagtgcacactccatgcatgatttgactggctctattgcagagaaacttggtgtccaagctcctccagttagaatcgacagccaagcaaaatatggtgctctggcccgaggtgatggcgccatttacttgcgctttccacacaaaggttatagagagaaaatatgggaccatgcagcaggctcaattgtcgtgacagaagctggaggcatagtgacagatgctgcgggaaacgacttggatttctccaaagggagatttctcgatctcgacacaggcatcatcgcaaccaacaaggagttgatgccgtcgctcctgaaagctgtccaagaggctattaaagagacgaaccaggctgcctccctcttatagctgttgtagtggtcgacaaaaaagtagttgcaaaattttcgtactggcaaacagcattgctagaagtggacaacatgaataatttgagcatcatcaagacaggcgagcgcttggtgccggtgctcctaaaggccatccaagaggttatcaaggagaaagttgagcagtcgtaatgatgaacagaaattttagttgcacgtgacttacatatttcagctgtaccacttttgatcagacacgttcccagtgggtgcttagcagataacagttcttttactgaatactgtaaaagccttttttttcaaaaataaactaggtttcctccgttttcaaaaaaaaaaaaaaaaaaaaaaaaaaaaaaaaaaaagaaaaaaaaaaaaaaaa

SEQ ID NO: 7222 - DNA, 4678 bp, Zea mays
  misc_feature (3463)..(3463): n is a, c, g, or t
  misc_feature (3611)..(3611): n is a, c, g, or t
ctgcagttgaacagctatgggcttgcggatttacggtgtggggaatttgaaattttgggattgaaggaaggattggttgactggattacctgtacgcggaacctctcaattagcgctccgctttggctataagtttcccggtttccccatttttttagtacatggatttggagagctgagataaggaatctcaagctaattctcaagctgtggtagtagtagtacttgcgaagtaggatgaggaggacgtggcctcatggctggagcctttttgtggttatgcttattcactgcaatagttgtctgacttggattatggtagttgacctcatggctcagtcagttttggagaattgtatcagatcaacggaacccttacttctatttgtttcaagcaatagtgggaaatgatcatatactgcaagcctctttgctattgtatgatttgtgctgatttaatgtcgtctaattcaagttttgttttattggcatgtcatttattggattaaataagcctatgcactgatgcttctacctcactatggctgtttacaatgactgtgttgcttcactagaagtagagttgtctttgtctaggattccgtacatagttaacatcttgcatcatctgttttggccaggtattcctgttctcagattctaatatgtcactgttttattattacagacgcactatgtattgctcctttgctcattcaaggaacaactccagcagcatgtacgtgttcatgcaatggaagcagtgatgggttgcttgggagctttgaacaatctttacaaagacctaacaggttgattgggtttctttttttaatcttgtgttaattcagaaacgtgcctgaagctttcagatatacatcacttgcttttatcatttcaataattgcagccttgctgtcagatgaaaaaaacaacaaagtgctttcagtatttattgcaactatgtagtattgaaagaaaggaaacaccagcattagctaaaaaggaaacagtgaaaagaaaaaaaatattttgcaaaagtatgagtatgtgaaagctctttaatcgcatgcattctaataaaaaaatgcatgtcttttcaatcatttcttagccaacactgaagagtatctgtttataatatgtgtggtaccttatatagtgaatactgaatacctgcctaagcttctagggccacactcagaatataaacgcgatacgagcttctagtgtcacatagaatataattcacataaagcattcagtatacattttattcggtttggggctctacatgcaagttgctatccaaatttcaagggcatgtgtgagtccttggcaagagcttagggcctgattgggaactctgcttctcaaaaccacagcttataaaaccatagtttattgtatgtcatgacataactatgatatattctatatcagtccaatctaacacctgtttggagacacaatattccagttatagtgtaggagaagaggagactgcgtgcaagcaaaaaactttggtccagactaaagtttttttatcccaaaaatatcgtggtattggtaaaaccatgacttaaaatacagagtttttagttatgctctcatacgtcttttggtctaaaatatcatggtatgctcaaatacacagtattgtcttgggactaaggaaatactgtgttcccaaataggccattagtctatcacagattcacagatggttgtccatggtagcatttagatgtgcaacttatagaagcaatgtgtgcaatgtcaactaaatttttgcaccatacacacctttctattgatctatttttgcaccatgtacacctgaactgaatttataagatcagctaatagaacagtactacagaaatcaccgtcgtcaggcaaaactgagtgaggctaggattggttctgcaggggcatctcctggtgaaggcactggcgcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcaggtctctctctttaaaatgcttcattcgtcactgcttatggtgcattgttgactaacagaatgtttcctacctctagggttacaaagaaaagcttgttgatatcagggaagagattatgcgcaagcgcagagctgggaaacttcctggagatactgcatctgtgctgaaagcttggtggcaagctcattccaagtggccatacccaactgtatgtgacactacggcgacatataattccctcgtcaacttttgctatcagcttgggttcattgctgatccactctttgcttattcatccaggaagacgacaaggcacgactggtgcaggaaacgggattgcagctaaagcagattaacaactggttcatcaaccaacgcaaacggaactggcacagcaacccaacatcctcgggtgaaaagactaagaagaaaaggtatcacaatgaaagctgctttgctgttgcctaaaccctgacaggcaggcttgtggcttgcccttttttttctgtacttgcactgttttaaacatgtaaaattggaaatgtcgcaggtgatattgatccagagcaatcttgacgatgctaaacgtccactgtgtactttatggcgaagtacattaccctccttccgtagccaggagcggagatgtgcatcttgggtggcccagtggtcacttaatgccccaagtttgaccacgttgtgggactggtgctagtagtgacctctgcagtatagtaatattcactaatgttgtgggaatcatgtggtgtataaccggcgaacgggagggagtaatttatgttttattgtaattgtgtatctttaccttgtaatgatattttagggagaatcccaagatctcagaatggccgttcactgtattgtcggtggtaaaagtggtgggcaatcatcgtgttcagattacctccagaagggtatgcaatggctcgaatgttccatgtcgtgtttagctggttgtcgtttgtcttacttcctgctgagttggatacttgattccttcgaagatgtaaagcacccatcgatgcagattttgtcgtcctgatgtgggagcatattttgttgctcagatatgctccgagcatctcgaggagcccctgttcttaaattagggcttctaatttttattttaaggatttttcctttatttttaaggtcttaattttttagttgttccaatataagtcctctaatagggaatgggcattagcccgggtggctagtcgtagccggcctgcgttcgagcgctgcccaaccggtatacacacacgagcgcgcattcagcggtattgtgtgtgtttccacgcacttaagctctaggnctctaaatttatttctgtgtgttatggacgcgcacgtctgtgtctagtagtgtgcgtttgtggcgtccttataccctaataaaaaaaagagaagtcttctaatcaaagccgtcaaatcattgtaaaggaacactgacacaagggtatntgacgaggagcttatcaaactgagcgagctcatgtcgtcgtggcgatgaagagtttgccacaccatgctcccccgaggcaatcgacctagatttgagcgctgttcaacctaggttttcttacctacctgagaattttctcaggttttagggtatacacacgcgtgcattcagcagtattgcgtgttaccacaaactagaggtctagatctcattctatttctgtgtgttatggacgcgcacacatgtgtgtgggtgtggtgtgtaatggtgtgcgttggtgacgtctttataccctaataaaaaatagaagtcctctaatcaaagccgccaaatcattgtaaaggaacaccgacacaagggtatgtgacgagaagcttgtcacactgagcgagctcacgtcctcatggcgatgaagagtttgccacaccatgctccaccgaggtcatgaggtccctcgcggtaaggacgaaaaatggttcgaaaatatcagtaattttctagtatagtttaccgcttttttggttatttctggatttaacgtgatatacgaaaacactaaaaacgggataacattcggaaatggtaagggaaaggttgggacgtctttatcgatttttttggaaatccggtgattttctgtatttcccatattcgggagaatccagtaattttccatatttctggaaactcatcttattgttcatagtaaataattaatattagtatgataatcttactcctcatcaatagtagtcatttcttaaaccaaacatctcataagatgttgcatttaaacatcatgtaatttatacaatttgcatttaaacaattttcatttacaaacatcgtgtaatttaaacagtttgcatttgtaaatagttttcatttgtaaaaataatgtaatttaacattgcttatttgtaactatagaagatcttttttactcacattgtcttgtgtccttgcatttcagcttccacgcatgtcccatcccttcctatggatttggagattttagatgcgatatttacttctttggatgtcatagaagtcatatcgagtgatc

SEQ ID NO: 7223 - DNA, 1435 bp, Zea mays
gataaaattacaaatttctcgacccgtggagccttgcaaccaaaaccaacctacgccatcatcatccatccatccgcttgtccctcgcaccaccaccaaccaaaaacccccaactgccgaggtcgccggcgactccgtccgctccgcgccacgggtatgtcgttccactaccccgaccatgggctatccatggacgccgcggcagcggcggccgccgccgccgccgcgtcgtcgccgaaccctagcggcttctcccccggcgtcggcggggagagggagaaggcggccattgcggcgcacccgctgtacgagcgccttttggaggcgcacgtcgcctgcctccgcgtcgccacccccgtcgaccagctccctcgcatcgacgcgcagatcgccgcgcgccccccgccactagccgccgccgccggggccgcggcagcgggagggccgtccggcggcgaggagctcgacctcttcatgacgcactatgtattgctcctttgctcattcaaggaacaactccagcagcatgtacgtgttcatgcaatggaagcagtgatgggttgctgggagcttgaacaatctttacaaagcctaacaggggcatctcctggtgaaggcactggcagcgaccatgtctgatgatgaagacaaccaggtggatagcgaagccaacatgtttgatggaaatgatggatcagatggtatgggctttggccccttaatgctgacagagggtgaacgatccttagttgagcgtgtacggcaggagctaaagaacgagcttaagcagggttacaaagaaaagcttgttgatatcagggaagagattatgcgcaagcgcagagctgggaaacttcctggagatactgcatctgtgctgaaagcttggtggcaagctcattccaagtggccatacccaactgaagacgacaaggcacgactggtgcaggaaacgggattgcagctaaagcagattaacaactggttcatcaaccaacgcaaacggaactggcacagcaacccaacatcctcgggtgaaaagactaagaagaaaaggtgatattgatccagagcaatcttgacgatgctaaacgtccactgtgtactttatggcgaagtacattaccctccctccgtagccaggagcggagatgtgcatcttgggtggcccagtggtcacttaatgccccaagtttgaccacgttgtgggactggtgctagtagtgacctctgcagtatagtaatattcactaatgttgtgggaatcatgtggtgtataaccggcgaacgggagggagtaatttatgttttattgtaattgtctatctttaccttgtaatgatattttagggagaatcccaagatctcagaatggccgttcactgtattgtcggtggtaaaagtggtgggcaatcatcgtgttcagattacctcc

SEQ ID NO: 7224 - DNA, 1374 bp, Zea mays
aaaccaacccacgccatcatcatccgtcaatccatccatccatccgcttgtccctaccacctccaccaaccaaaacccccaaccgccgaggtcaccggcgactccgtcctcgccgcgccgcgccgtgaggatgtcgttccactaccacgaccacgggctgtccatggacgccgcggcagcggcggccgccgccgcgtcgtcgccgaaccctagcggcttctcccccggcatcggcggggaaagggagaaggcggccatcgcggcgcacccgctgtacgagcgcctcctggaggcgcacgtcgcctgcctacgcgtcgccacccccgtcgaccagctcccccgcatcgacgcgcagatcgccgcgcgccccccgccgctcgccgcggccgccggggccgcggccgcgggaggcccgtccggcggggaggagctcgacctcttcatgacgcactatgtattgctcctttgctcattcaaggagcagttgcagcagcatgtacgtgttcatgcaatggaagcagtgatgggttgctgggagcttgaacaatctttacaaagcctaacaggggcatctccgggtgaaggcactggaggaaccatgtctgacgatgaagataaccaggtggatagcgaagccaacatgttcgatggaaatgatggatcagacggtatgggctttggccccctaatactgacagagggtgaacggtccttagttgagcgtgtacggaaggagctgaagaacgagcttaagcagggttacaaggaaaagcttgtcgatatcagggaagagatcatgcgcaaacgcagggctgggaaacttcctggagataccgcatctgtactgaaagcttggtggcaagctcattccaagtggccgtacccaactgaagacgacaaggccagactggtgcaggaaacggggttgcagctaaagcagatcaacaactggttcattaaccaacgcaaacggaactggcacagcaacccaacatcctcggctgaaaagaccaagaagaaaaggtgatgatggcccagagcaatcttggcaaaaagctagacatgtccactatactttattatggcgaagtacattctccctcacttcgtaggcaagagggaaaggtatcttgggtgacttgagtggccacctaatgcgcaagtttgaccacgtgtggggctggggttgggtagtgacctcagcagtatagcattcgctaacgtgatgtgggaatcacgtgttgcagtagaaccggcgagcgggaggggggtaatttatgttgtattgtaattactatatatgaaagacggacacaaacgtcgctcctcgtacgtccacgtcgtcacttttttcagcgaaaaaaaaaaaaaaaa

SEQ ID NO: 7225 - DNA, 1515 bp, Zea mays
ctctaaagcatccccctgcactgcatgagcgactgagcctgggcccgcctgtgctctgctgtgcggcgaaagaaaaccaacccaaagtcccaaacctgtgtagccttccaaccaaaccaacccacgccatcatcttccgtcaatccatccatccgcttgtccctaccacctccaccaaccaaaacccccaaccgccgaggtcaccggcgactccgtcctcgccgcgccgcgccgcgccgtgaggatgtcgttccactaccacgaccacgggctgtccatggacgccgcggcggcggcggccgccgccgccgcgtcgtcgccgaaccctagcggcttctcccccggcatcggcggggagagggagaaggcggccatcgcggcgcacccgctgtacgagcgcctcctggaggcgcacgtcgcctgcctacgcgtcgccacccccgtcgaccagctcccccgcatcgacgcgcagatcgccgcgcgccccccgccgctcgccgcggccgccggggccgcggccgccggggccgcggccgcgggaggcccgtccggcggggaggagctcgacctcttcatgacgcactatgtattgctcctttgctcattcaaggaacagctgcagcagcatgtacgtgttcatgcaatggaagcagtgatgggttgctgggagcttgaacaatccttacaaagcctaacaggggcatctccgggtgaaggcactggaggaaccatgtctgacgatgaagataaccaggtggatagtgaagccaacatgttcgatggaaatgatggatcagacggtatgggctttggccccctgatactaacagagggtgaacggtccttagttgagcgtgtacggaaggagctgaagaacgagcttaagcagggttacaaggaaaagcttgtcgatatcagggaagagatcatgcgcaaacgcagggctgggaagcttcctggagataccgcatctgtactgaaagcttggtggcaagctcattccaagtggccgtacccaactgaagacgacaaggccagactggtgcaggaaacggggttgcagctaaagcaaatcaacaactggttcattaaccaacgcaagcggaactggcacagcaacccaacatcctcggctgaaaagaccaagaagaaaaggtgatgatggcccagagcaatcttggcaaaaagctagagatgtccactatactttattatggcgaagtacattctccctcacttcgtaggcaagagggaaaggtatcttgggtgacttgagtggccacctaatgcgcaagtttgacgacgtggtggggctggagttggtagtgacctcagcagtatagcattcgctaacgtgatgtgggtgaatcacgtgttgcagtagaaccggcgagcgggaggggggtaatttatgttgtattgtaattgtgttttttattaccttgtaatgatattttagggagaatcccaagattcatattcgcatgttttgtcgtccgaaaaaaaaaaaaaaaa

SEQ ID NO: 7226 - DNA, 999 bp, Zea mays
gtcgccatctccccaccacctcgtcaccgcagaccatgcccccacggggcccccgcgcggccgtggcctaccggtgaacgccacccagacacacgggaccgcgcagccggcgagcacggcatcgcacatcacgggcgcggccaagaggcgggagccgtgccccgcgccccgcggccgcgccggttaattgctctccctccagtgccgcgcagtgcgcacagggttttaggaagggggcgacaccggtatcgccattcgccagccatggaatccgcaacggcggccgtccgcagcgcgtcgctagcccgggcccggcccgcgccgctcgtccacgggcgcgcgcgcggggcgggtcgcgtcgtgggcgctggcctcgccgcgcgcgcccggcggagggcgctcgtcgccgtagcctcccaccaggagcaccacgagccgctcccgccgcgcgcgcaggagggcggcgccgtggctgtggcgacgcaggctgacgaggcggaggtccatgcgaatgacgctccggcggctgctgctgaaacctcgtctccccaactggctgctggcaagacagtgcgtgttcgatttgtgctgaaaaggcagtgcacgttcgggcagagcgtctgccttgtcggcgacgaccctgcgctcggcctctgggatctgtcgaacgcgtttcctttgaagtgggcggaaagccacgactggaccttagagaaagatttgccggccaacaagctgattgagttcaagttcttgctccaagattccacaggaaagttgcattggcagggtgggccaaacagaagctttcagacaggtgaaaccgccgcaaacacattggttgtgtttgaagattgggatgatgtgaagaatcagaaaatagtagaagaggggggagtggcgtctgctgggatagaacaaactggtgtttcaaatgtcagtgaaagcaggaaggataatgttttagaagctgagctccatgtagatgataatctggtc

SEQ ID NO: 7227 - DNA, 1499 bp, Zea mays
aagatatttccggagactctgagagccccctcctggtcatgtcgctgctcgccgtcgcctcctccactcgcgccgcggcagtgcggccgctgtgcgcctcggcggcctcggacgaggcggtgccggcgcctgctgtggcggataccgcagggcggaggccggtgaaggtgatcctaccaaagaagaaaccgcagaagtggtcgacggggatggcaccgggtgagtacggcggcgggccggccaccatcaagccgcgcaagtactggtgggggaaggaggaccgcgaccccgtggggaacaccgacgacttcatctggaacaaggacttcctcccccacatggaacgcgtcatcgccaacggcggcgccgatgcagaacccaccatcacccgccttgcgccggtggatgaggagggggagtccgggtttctgagcatcaaccgcgcaatgagccttgacagcgtggaggttgatctgagccaggagcttcaggcgccgaccaggccaatcttgcaaacccaggttgaggctgcctggagaggacgggcaattggtgctgaggctgtgaatggagccagcgctcctagatggaggctagtccctactcgcagggagcaggcaaagtgggacagagcggccaaggcagccactggtggaagtgatgttatactaagggagtcaaagtcaagagtgcagcaaggagaccctaaggtattggcagctcggtccagagaagactacttacagctgaaacaaagattacagtggttcactttaggcattggtggcgttggtgtaatctctgcttatatttcatacactcctgaaattgctgtcagctttggtgcagggttgattggatcattggtgtatctccgcatgcttggaaccagtatagattccctagcaggtggaactggagaaactgtcaagagtgctgctgcacaaccaaggttgcttattccagtggtacttgtgatgatgtataacagatggaatcagatattagttccggattatggtttcatgcagcttgagttaataccaatgcttgttgggttttttacctataagattgctacattcgctcaagcaatccaggattctatacctccagtcggaaatcgtgaaggttgaaaagtgtcatgttgtatataaacgaaggtggtagccatggtccctggtcagtggtcacccagatagtaaggtctgtatagaagaatctggtctggtgtcatcgccaagtagatgagatgctcgttgaggacgccatttgaaaatctcgagtgcttaactatgttctgcacaaatattttgacgaaaggtgatgttaccacattcattccatattacacgcagatcatcagtgtataaatttacggctccgaacttttaccacaacgattaattgacaaaacaattgtatgattgaattcacatttaaaaatggatgcaaattatgcaaaaaaaaaaaaaaaaaaaaaaaaaaaaaaaaaaaaa

SEQ ID NO: 7228 - DNA, 819 bp, Zea mays
  misc_feature (41)..(41): n is a, c, g, or t
  misc_feature (818)..(818): n is a, c, g, or t
cattgggtacctcgaggccggccggggcctaagcaactttntgggcgacggcggcgccagcaggtcaccactagccaccgcgacgcggtttccagctcggcgccgtggctataaaagcgcgccgcccggccgccgaggccaccatccaccaccatcctctgccttgtcgatcatccatcgaccgcctcctgctcggcttcccaccccgcctgcctgcgttgcacaccagggaggagctcctccgaccgaccggccatgagctaccaggctcctcctccgggcacctcagcctacccgccgccgggcacggcctaccctccgccaggccagccgcaggcgtacccgccgccggcatacggcgcgccgccacccatggccgccggcgggtaccctcccccgccgcagcaggactctaagggcggcaacgacggcttcctgaaaggatgcttggccgctctctgctgctgctgcatgctcgacatgtgcttctgagttcgtcgtcaggggctcagggcacggggatggcgcgcctagagtccagaccgatctccatcatgcagtcaggcgaaaaacaatgcatggagctgttctttttttttccttcctttctgaatcatgacgatgatacatctttgtttccgtttccatcctgtatatgctttcccgtgctatgcatggaaacttcactagctaccccagcagggattatgttctctggcgttcatgcgcgtgtgttcttgagctctgaagtctgaaatgaaaacatctgcgatcggattcgtattaataaaaaaaaaaaaaaaaaagccccctagggnc

SEQ ID NO: 7229 - DNA, 810 bp, Zea mays
ttggggcccgcccggccccgcgccagcgaaggcatactgcagccgccgtttctgcatctcccatcttattcgcaacgccggcgctccatcttgcgctccctccctcactcgctctcggtacggcggcggcggcggctctcaggttcgggctctcagcgacggcgtcagcagcttccactcccgcctctcgccagttgcctcgcgccctcgcctccggtcctccgcacaccgccggttaccctgctaaacacctcatccccaaatgaagcacatattcaagattgctgcaatactggtagcaatctctgctatctggattgctctccttgaaacctccactgttcctcgaagttatacttggctgcttcccatctacttggtagtggctcttggatgctatggcctttttatggttggatttggacttatgttcttcccaacttgtcctcgagaagctgtactactgcaacaggatattgtggaggcaaaggaattcttaggaaagaggggtgttgatgtgggctctgagtgagatcaattttaagtggttgacatacatgtctgttttgaaggatcaccattctgttccttggaataggttgcttttttgggtactgtagataggaaacatataattccactatgtccagctattactaacacggtttttgtgagttggcatgttatagttctgcttttgtcaatgatggggctcacattgacttgccggtgtttttcaagttttaaagactgaactgttctaggaatatttgggttctatcttgatttcccgccaggggaccctttacc

SEQ ID NO: 7230 - DNA, 1172 bp, Zea mays
cactcctatgggcaacctagaacatcctaatcgaacaacactttccaaaccctaggcaccaccattatattgatcgatctatgctgctgctggtcgcaaacgcaccgcagattcacgggccgccctctcccaaaaatcgagcaccagagtgtttcaattccttctccatatattgttggtgttagtttcctgctttccctagtccctcgcaatcaacagatacctcatggacgatcaggagaacgagcacgagaagcatgctgatgctgggactgacatcgacgaagaagaggaggacgaagatggccacaagcgtgtcgtcgttcttggaccccaagtccccctcaaggaacagctcgagcttgacaaggatgatgagagcctgaggaggtggaaggagcaactcctcgggcaagtcgacaccgagcagctcggagagactgcggagccggaggtgaaggtgctcaacctgaccatcctgtcaccggggcggccagatctagtgctaccgatcccgttcgaggccgacgacaagggctatgcgtttacgctcaaggatggcagcctctatagcttccgtttctccttcaccgtctccaacaacatcgtttcaggcctcaagtacaccaacacggtctggaagactggagtcaaagtggagaaccagaaaatgatgctagggacattcagtccccagcaagagccgtacgtttacgagggtgaagaagagaccacacctgctggcatcttcgcaagaggttcctattctgctaagctaaagttttttgatgatgatggcaagtgttatttggagacgagttactactttgagattagaaaagagtggccagggccagcaacctaatgatatggagcggcggtgttgcattggattcgttaaatgcatacatgttagaactcttagttaagacaagcagaagatctattatattctactgcttctagctagaggatgattgcttcacatgcatatcgtgcatgtttaaccaccgtacgtacgtataatttgtttcgagtccattattctacgctatcgatctgttgcgtattattattgttaattcacattatagaatcagtcgtgtatgaagattcaaagatatatttatatacttatgacctttttattgaacgaaaaaaaaaaaaaaaaa

SEQ ID NO: 7231 - DNA, 1118 bp, Zea mays
ccggccgggacactttccaaaccctacgcaccaccattatattgatcgatctatgctgccgctggtcgcaaacgcaccgcagcttcacgggccgccctctcccgaaaatcgagcaccagagtgtttcaattccttctccatatattattggtgttagtttcctgctttccctagtccctcgcgatcaacagatacctcatggacgatcaggagaatgagaatgagcacgagaagcatgctgatgctgggactgacatcgaggaagaagaggaggacgaagatggccacaagcgtgtcgtcgttcttgggccccaagtccccctcaaggaacagctcgagcttgacaaggatgatgagagcctgaggaggtggaaggagcaactcctcgggcaagtcgacaccgagcagctcggagagactgcggagccggaggtgaaggtgctcaacctgaccatcctgtcaccggggcggccagatctagtgctaccgatcccgttcgaggccgacgacaagggctatgcatttacgctcaaggatggcagcccctatagcttccgtttctccttcactgtctccaacaacatcgtttcaggcctcaagtacaccaacacggtctggaagactggagtcaaagtggagaaccagaaaatgatgctagggacattcagtccccagcaagagccgtacgtttacgagggtgaagaagagaccacacctgctggcatcttcgcaagaggttcctattctgctaagctaaagttttttgatgatgatggcaagtgttatttggagacgagttactactttgagattagaaaagagtggccagggccagcaacctaatgatatatggagcggcggtgtgtggattcgttaaacacatacatgttagaactcttagttaagacaagcagaagatctattatattctactgcttctagctagaggatgattgcttcacatgcatatcgtcatgtttaaccaccgtacgtataatttgtttggagtccattattctacgctatttgggtattattattgttaattcacattatagaatcagtcgtgtatggagattcaaagatatatttatatacttatgaccttcttactgaac

SEQ ID NO: 7232 - DNA, 1820 bp, Zea mays
cttgagcgaagccaacgtcgcatgggagagaggatattataaaaaacttttaaggatataaaggatcgcatctatgagcttagaaggaatacaatatcacgtgaatgccaaatcatatatgttagagcaccaaatcatatgttccacacattttttgagtcttgctatgtgtgttgataggagcacaaaatcatatgttagaatatcaaattgcagcacaagtttctacacacgaaatataagggacaacctatgtaatcaagcatcctaattatagttttaactacatgcttaatatccaggaattatatgtttgtccatcttaaaaacttaaataatttattggtgtctgcgtgttagataactagatttttgtgacaacttgggggttcagcacttctcctctcattcaatctgggttttccaactcaaatacttactggggaagcggacgacaactgacaacagcgtctgattatatatttattcccccaaacagtggcttatctaagggattaatattttttactctaaatattttattggtaaggaagttgtttgtatttttttgtaggatttggtttcttttaggctgtttctggacaaactgccacgtccgacgagacagaagcgaagcgaagcaaagccgaaagtgacgatcccagtccagttcatcgggctggcggcctagcccattcagcatgcacggcccaacattcccttccttccccgggcggcggggtaggattccttgccgtctcccgctcttcaccgcgcgcttcccgcgaaacgccaaccaattcctccgtcgatcaaaaaccgcccctctcacaaggagaaatctttcccgcgggcggcggaggaattcgcggattaggttggtgggttcgaccgatccgcgtccccgggttcccaagttcccaggtaagccgagcccggagcatggcgccgctgtcgtggcggcaccacacgctgctgcaggcgctgctccaccgcggtcccctctccgaacgcgacttccacgccatcttcgctggcgtctccggcaagaaccccggtacgccgtacgctttgctcccatcccgtcgtctctctcggtctattctctctacgcgccacggcccaacaagcgctcgacgaaatgcgtctctgcagctgccgtgccgtgcctatctctatagtctatactctcatgccggcgggggtgcgtacaagcacaagcagcttcaggctgccgccgcgtagggtcgaacccaccccacaactcctgctcttcatccgcgttctcgaccgtaggggtgctggagcgcatcctcgttatcggggccgtagggttgtggaggatatggacggacggcaactctggacgcctttattggtcggctctgtctgtccagagctacagactggatcttacactgcaagccacccccatccctgcccacctccttccagcgtaagccaaagctccactagtacatataacgtatcttcttcaggccgagaacccgtgcatctgctacgctatactcgtcaacttcagcagcaatggcgcctccctcgtggcggcaacggcaccacactctgctgcaggctctgctctcccgcggcccccttgccgagcctgacttccgcgcgctgttcactgctgtctccgacagggaccctggtacctacctatgccgcgatgcttgcaactctctcccctcttagctctagtctttctccatcttctcttcgcatctgttccatggaaagccgagagattctgatatttgccatcagcaacaaacaggttttaaaattgccattagacccac

SEQ ID NO: 7233 - DNA, 1424 bp, Zea mays
gcggaggaattcgcgtattaggttggtgggttcgaccgatccgcgtccccgggttcccaagttcccaggtaagccgagcccggagcatggcgccgctgtcgtggcggcaccacacgctgctgcaggcgctgctccaccgcggtcccctctccgaacgcgacttccacgccgtcttcgctggcgtctccggcaagaaccccgccactcaccaacaactgttcaatgatacacttctcaagatcaacaaggaccttgcctacttgcagttcgagttgcgggcatgcatgaaccaatatgatggaatggtttactacggggtggttaataacattgctgacgaagaatctaagcttggaacaaagtactctgtgccccagatcgcattctacaagggactgctagaagcaatagttcaggaagctggaaatgatgggagcataaccagtatcgacgccctcaatgtccggcttgataaccaggtcgcagtattagacggttcacaggacagccagtctcgccttcctagctccataaagaacttctcaatgagccagaaggagaaaactctcgatgagctgatacgggaccgctggttgtcgtacaccgccacaggcaagatcggtctgggcaccaggtcatttcttgacctccggagctggttccgtggcaacgatatcccgtcttgtgttgtctgcaacgaagcttgtataaaggcatcgagttgtccgaacgagggatgcgatgttaccgttcgcgggttgcgatgttagaattcacgagtactgcttgaagaagcgattctcacagagaaaggcctcgagagcgtgtcctagttgcggtactggatggccgtgtcaagatggcgaggccgacgacgtgaacgaacctggggaggaggagctagcctcgccagctaaccatccctcggggaagaagcgcaggagagtcaaagctgagctggtggaggaaaacgacatcgcaggcccgtcgacggaggtgcctaggactaggaggaccctgagaagcgctaaagccgaagcagtcgaggccgatcaagaggcgtcgtccaccgcagcttcgcagccaggcaggggttctaaaacaaggaagaagtgagtgatgactgatgatgcatgcttataaaggagggagattgcaaatgctcctcctttgccatgtgtagatactaccgtagacgtgctggtatggtatccggtgggtagtttttcaagtgccagagcaaaagagccttctagttctgctctttgctacagtagggactcgtagactggtggagctctctcatgacgtctaagttatttatcttgtgaagccattcccatattattacttgtttgttatggtagttgagaacatcttggagcactgaaaaacttgagggcatgggatggggtgctgtcgct

SEQ ID NO: 7234 - DNA, 934 bp, Zea mays
cctcgaggccggccggaaccaaacgctaatttattaggtcctccaggggagcccgccgccgtttttcccgtccacagccctcagcccaccacaaacgcgcctccgtaccatccgtcgccgccggcgcaccgcgatggctgcctccgccacggccgcgaggcctctcgccgggaccgccgtcccgctcccgctctcgacgcggacgcggcctgccagggtcgccttgctctccctgattcctcctgctccggcccagcgccttgctctcaggcgtggcgcgtggctctcacccccggagcgcagccggtcggtgcggtgcctggcggctatgagcccggagatgcgggcaacgctggacaaggtcgtaggatccagcaaggtggtgctgttcatgaagggcaccaaggacttcccgcagtgcggcttctcccacaccgtcgtgcagatcctgcgctcgctcgacgtgcccttcgagacgctcgacgtgctcgccaacgaggcgctccggcaggggctcaaggagtactccagctggcccaccttcccgcagctctacatcgacggcgagttcttcggtggatgtgacatcaccgttgaggcatacaagagtggagaactgcaggaaactctagagaaagcaatgtgctcatagagaaaagaaattagaaccaggagtgcacgacatacagttaatcaaaatgttatagtatttgctgtacaattcaggcaatgttaagctggagataccaaagttgtaggcaatccatgtccaaatgctcagtgcacttggtttggaacacatttgttttctgcaatttgtgattaatcatccagctttaacccagatggtatgctaccagattgcagcagatgcagcaaacagcctagcaccctgctactgctttaataagcctgcctggagtcattaaatcag

SEQ ID NO: 7235 - DNA, 823 bp, Zea mays
ttccgctccccttgcgacccccaactggttagttattacgtgccgtcccaactcacccgcggctccgtaccatccgtcgccgccggcgcaccgcgatggccgcctccgccccggccgtgaggcctctcgcccgggccgcaatccctatcccgctctctgcgcgtccgcggaccgccagggtctcctcgctccccctggcttctcctgctccggcccaacgcctcgctctcgggcggaccgggcaagcgcggctgccagcgcgcagccggtcggtgcggtgcctggcggcgctgagcccggagatgcgggagacactggacaaggtcgtggggtccagcaaggtgttgctattcatgaagggcaccaaggactttccgcagtgcggcttctcccacaccgtcgtgcagatcctgcgctcgctcgacgtgcccttcgagacgctcgacgtgctcgctaacgaggcgctccggcaggggctcaaggagtactccagctggcccaccttcccgcagctctacatcgacggcgagttcttcggcggatgtgacatcaccgtcgaggcatacaagagtggagaactgcaggaaactctagagaaagcaatgtgttcgtagaaaaaaatgaacaataagcagatggcatacaattaatcaaaatgttatagtatttgctgtacaattcaggcttgtcatcaactggagatgcaagttgtggataattcatgtccaaatgttcagtgcactttcgactggaaatacatctttctgcagtttgtgactagtcatccagtttgaaccccgaaaaaaaaacaaaagccgtcacg

SEQ ID NO: 7236 - DNA, 7760 bp, Zea mays
  misc_feature (1691)..(1691): n is a, c, g, or t
  misc_feature (4140)..(4140): n is a, c, g, or t
  misc_feature (5682)..(5682): n is a, c, g, or t
aaaaaaggtgagaactagaaggaaccgctgtgtcacacacgcacacaccacacggcggccggagcggcggagccaccatagattggtgctctctccgtccgaagtgctctctgaaattccccccaaatatcccagccactgccgtcgtgcagtcaaagtgtcaaaccatgccggcagtagcgttcgcgtcggctcctgccatattcgcctccgcctccgcgcgtccctgccgcagcgcggctccgggcatcctttcctccgactccgggcggccccgccgcggcgcgcgtggcgccgtccagtgtgaggtcgcctcctcctcggcaccgtcggcggctggaccccaggccgcccggtgggcccagaggaccgtggtcatcccgccacagcgccgcgggtgccacctcatcaccaacaagatcgtaaatgagatagggaatgggtccatctgctccatggaggcacaccatagaaggacctgatgacatgccagcacatatcaaatcatcaatgtttggttgttccctgatgattcctatcaccaatggacgtctcaacatgggaacttggcaggcacgaaaatatctaacttggcttgtaccatattgtagtacacttaatcacctcccatgccagcgtttaaggttctgtttttgaggtgacaattgagaataaatgaggattttggataaagaaatgagtaaaaattatataagcacaaattcattcattgtattaagtctctgcagcaagttgctttgggattatttcccgcaacatcatttcaatattcgaagcagctaaaaactcattgttgcttatccccaaggttcctacctgtaccaatttggtacacaccagtgtggcgttatgtcagactgttcactgttggcctagggttgctagcatatgtgtgtatcagggtccatacatatatggtgaggttgagtgtggtttgtgtgagctatgtgcatctgccttatatctccaaaaaacgcaccaaaaaatcatcattgatcaacctagctatagctgggagactgggacctaatgttaagcatgctaattttgcagggtatttggctctgtgaacatcgagattatgctactcctcgacagattgtgatcacgctcaatgggatctagcctaaggtgatctatgttaagagctggaaatgcaatgcagcgacttcgacatgtttaaatcagatgcactgaaacagaaactgtctttggcccagttgtgataggcgttccagtggagaatgttatttgtaatatgatgctagcatgaggggaacaaaatctcttaacgagcttcttctcatgttgagcttgtttagttatctttggtggtttaaagaaatggtttataagttgttagtgtcgtttggttcacgaaatgtaacgtaaatggtaatgataatgattcacactctgattcccacggtaacaagtttgaataagttgatatctatttctagtgtggtatcaattacagttagacttaaataaacgtgatttaacgttatcgataacctattatgttactaatattatgctactaatatgtgaatcaaacgacaccttagtttggaggaaaaactccattgcctttactcctctcctgttaacagtttttcactcatgggcccgtaggaagtgtcaattctctatttggcttgtagtcnaatggctgttggacagcgggtcgcttggctcaagggatggttgttaagccatagctgaccaatagacagaaaatcaactcccaacctcctaccaaataactcagaaatgtttgagcaatgctgtttatctactacacactcaaagagtaaatgatgaaccgattaatcttctgaaaaaaaaaacaaacaaagacttatattccccgtctgcaccgacgttgatgcacagtgccgttctgcttggactcccaagattttacaaaaggcacgacggcagcaacagtgttcatgacaaaagctggcacggtgaatgaaatacagagtgggtctggcatcttctcattagatcttctacggaacgagacccaaactctgaagcgtaagtgtgtcattactcattagtttggcacaagttcttgcttcttggttcaaacagttagcatgcatgttccacgctaacgccttcatttgggccgttcaatcaagaaggactgaaaagaaatccggcagcacagaacagtggtaaactgacgacttcagctgatttcctggccttatcgaagagcagcaatatcttctccggcatactagtcgacgttcgtgtaaattcattctcactgctgccattctagtttgcagattagacttgcgcacagaagacgctgaagacttgcatggcgctaggaaggcccagagaccatggaaggagcgccaacttgttgggcccgtttccagatagaagatatttaaaaaaaacgataatgaaatttaaaaagttatcctcgtattcgtcagaataccattctcgttttctcatccttgggccaaacaacgcttccgaagcaagacgatttactttatttatctctcccatgcatagcttctttttaacaatgattcttcagtttagttatcgatgcattttgttttcaaactccagcagtcttttgctgccttctgtagcttctgatttcctttttttgttgtcgttgtgcttgactctgtagttctgttggcaggatcagaaaaccctcaaatggacaggccaccatcaatagtgagcacctgcagagatgaatgaacaggatgaaaacgagaagaaacaacaccatcacgtacgtcgtcgcgttcggggaaacccggccgcttcgttctactcgcctgtccggtgacgtagctagcagcaggatgaacagccaggaaccccaccaggccggcgacctcttctggtctcccaaaccgtcctacataacatacatatatatggttatgattcgtatcacgatcccgacacagatctatcgacgctgagaggagacgaagatctgcagtccagctctcctacccaatggtatggtctccagcgccttccgttccacgccgtcccctagtccggcggtcatgtcggacgccacccagcccggcgccacggcgttcacctgcaaagccacgtacgccaacaggcgtgattaattagctagggcacgtacggtacacggtgtgttgtgctgcagaaaagcacggagattatgcacgctactatgattactaagcgctagctactcgcattgatgtttctgccgccgtactccctggccatggccttggtgaggccgatgaccccagccttggcggcgcagtagttggcctgcccgacgttgccgatgatcccggagacggatgcgatgttgatgatccttccctgagtagtgagattattggctagtatcaggtactacgtcgtagtataagcaacgaacgtccggccggctctctgggcgggtagtttgctacgtgtaccttcttcctcttcatcatcagcgtcgctgcagcctggaggaggaggaagaccaatcacatgcatgcgcgcatgccagttgacaggaagattgcgggtggtggacgtacctgcgagcagaggtaaacgccggtgaggttgacatccaccacctcttgccactgggtcctcttcatccgcatcagcagcgcgtcacgtgtaatccctgtccggtcgttacgactcagtcagtcatgtatagcgtgtgtgtgtgtgtgcttgtcaaattgcagcgtgaggtgtagtttcttagattaaaaaacaaagacaaggaaagataaacaatacagtactatccggacctgcattgttcaccagcacatccagagttccccaggcatcaatggcctgcagtagtaacacacaactgtacgtcacgggtaaatgaacaaactcatgcaacagcaccggatggatgaatcttgtactctactctactcacggccctcatcatggactcgacgtcggcttcgcaggagacgtcggcagcgaagctcaccgccgttccaccggacgcctcgatctgcacggatccagtcaaactcaaatctaatagcgagtgaggaagcaggttataatcagctagctcacctctctgcacacctcttcggnctccacgcctgacttggcatagttcacaaccaccttgaattgaatcgacaaacaattaatgtaaacgagtgttcttgcttatcgtaatcaatacagtatatatggcagctagcgcagcaataacaaaaagataccttgcaccctgctccgccaagtgctacagctatggctctgccaatccctctagacgctccagtgacgacggctaccggcggcggggcttcaagccgtgctgcccagccgcccgcgtccatgatggtcgcagcatcatctgaagccctgattcgctcgcctcttccagccctactcttactcctacctacagatcaatggcgtgagttgttccgctcgttacgttcatcggaaaatatatgtcatgacaatgcaaggcacgcacgcatgcatgcacgtacagcagtagtctaacgataggttcggctggtcgccgcctgacgcgggcagggtcgccgtcgccgccgccgccggccgtccagagcgctgcggcttgacgaagctgctgccatggcgcggagacacacagcaggcggcgcttagaccggcagagtatgacgacgacgctgtggaggcagccataattgcagagagccacggcggactgtgtagcgataggtctgttctttgtttgttggcagaggcatcagcatatatcactcatagcggcgtctttaaagtcagtagttcaaaggactgttagagcagtcgtcgaaaccggattagatggaggcatgctttgcatgacggattagaattggatgttggaggcttgctttgcatgacaaccaaaaaaaaacacacacgccgttagtctgtggctctctgtgcgcgctggacttggtagctaggctgctgtcgtagcctgtagatgacagaccaggtttctaaggaattgcattttccattccaattaacaaacggtgaaaacacccgccttttcctctcattccgatcggtaccactctaaacacaacatcaagtgcattcagatccgagcaacaagattccatagcaagacgaggagattactaagtacgtatatataatcatgtgatcagggtagcttggcatagcaatatagtactaagaaatcacctgcaattgctggtccagacgatgcatctccagcagcattttcgcctgccacacgcatatatggctgcaggaatcatgtggtcaagtactaactccaagatcaccccaggatgattccaacagaagctcctgatcaactgacagaggcaacgtcatgtttgaccacccggtagcgcagacagaagatgcctgaacagctaggttttaacatggagcactggatctagtaacgccagacagcctgccgcctgctgagttttggcgaatgtctgcatcaaaactaatatatttagttgttgaggctgaacctgaggtctgcgctctctagatttttttttacgcacgcattctccgttttctttattctgctttctctaggttaatctgctcacccctgagtgccaagcttacgtacacacgctgctagatctnctttaagctttaatcacgcgtcatgctgtactggttcttttgtaaactaaggcaagataatgctgatatgatagtgtagatctgcaggctggatttgatctggcagaggctatatgctaatctattatcttattatcttgtaatttacccctatctccagctccagctgttttacttgtgttctcatatactaccgttgtggtgtgttggatctcgttgcgcacaagtgtacaagcggagtttatttgtttgttgtaccacgaaactgggtagattgtttgtctaaggctgttgttccattagtgtactatagggggtgtttggaatgactccagtttccagcttcagtatggaactgtaatttataatattaatttaaatagttttaaaaatatttttaatctaaataataaatgaaatggcttatctaaatgtattctaaagacttacaattctagctccacgattttatagagtacctaatgacctgctccactaacttcactaaattttctagagctggaactagatctattccaaacagggcctaaatgcatcattgttgttcttaagttgatcttgagggtctattctatcgtctatatttcaaactctactatgtctattgttaaaacaaccttctgcacactcatgcatttagacctattgacgaggacaatcttgcgctcttttctttattctcttcgactcttgggcattaattagcacatgtttgtcggattgatctcatctgaactcggtgagggaccatgcggaacctcactcgcaccttgatagaggctatcataaccttcttggttgcagtcccttcataccatgtaaataaatacacagttggtcgacacgtgataccaatattcaccatgcctccttgctcatacacagactaacgagatacaatttatctctatactgagctggatggtaggtcactgcctctactgtcccagaggcgtcgtcaccaataatgacactcaaacctggactccaacctcgcatgaccactctccctaatcccgaaggtatacttcttggttcttcattttgtagtagctagggtaacaacctaaggttctatacacctaacagtggtaccggagcttggaccgtaactctagaagttcatacccttcgattttggaccgaatccgagcaaatctcatcaaaagacgtagattatctcaaccctcgggcatttgagatctcctatcatgaagtaaatggtatatactaaactatgtgtatataatggccctcggtactccccacgactgggccccggccatgggtctgcttgcagtatcacattaaatgttggcattgtcgaggttaattatcctttggtaagataaccgctatatcggctacctatgtaggcattataacctatgacatcagccttcacgacatggtcttgttgttcacatgtgactggctaccgacactggcccttgtgttttattatatttccaggtatagtatgcacttgtttctatggttacatgacattacacatgcactgcttagcgacctcaagtgctctagagcctatattgcatgtctgcacatcatgttagccatgtaatgttgcccatcgtacatttaatatcttgtacatgagacttattcattaatatatagtattgtgacaatctttaaagcatctagacgtggtgtgtcttgatgtcttgatgtcgtattcagtggacccttcacacctttcagctacgaaatagaccgaggttgtcactaagtcatcgtctccttttaggaggaattttagctcgtgagagtatactatataattaaaatagaccgaggttgtcactaagtcctcttcaccttctaagaggaattttagcttctaagagtatactatataattaggtgccccgggggcacgaggagccatggacttatgacgtcaagtgtcgcgaggcatgaaccatgaagagccatgggatcttataccactagatgccaaggggcaaaaggaggtccagggctctatcagagatgtcgtcaccatgaacaccgaatccgactccaaccaaagg

SEQ ID NO: 7237 - DNA, 1127 bp, Zea mays
cctcgaggccggccggaggggggcactagaaggaaccgctgtgtcacacacacacacaccacacggcggccggagcggcggagccaccataaattggtgctctctccgtccgaagtgctctctgaaattccccccaaatatcccagccactgccgtcgtgcagtcaaagtgtcaaaccatgccggcagtagcgttcgcgtcggctcctgccatattcgcctccgcctccgcgcgtccctgccgcagcgcggctccgggcatcctttcctccgactccgggcggccccgccgcggcgcgcgtggcgccgtccagtgtgaggtcgcctcctcctcggcaccgtcggcggctggaccccaggccgcccggtgggcccagaggaccgtggtcatcccgccacagcgccgcgggtgccacctcatcaccaacaagatcgtaaatgagatagggaatgacctggccgacttcaagtgtggcatggcgcatctgttcttgcagcacacaagtgcgtcgttgactattaatgagaactacgactctgatgtccaggttgacactgaaacatttcttagtcgcattgttccagagggtccatctgctccatggaggcacaccatagaaggacctgatgacatgccagcacatatcaaatcatcaatgtttggttgttccctgatgattcctatcaccaatggacgtctcaacatgggaacttggcagggtatttggctctgtgaacatcgagattatgctactcctcgacagattgtgatcacgctgaatgggatctagcctaaggtgatctatgttaagagctggaaatgcaatgcagcgacttcgacatgtttaaatcagatgcactgaaactgaaactgtctttggcccagttgtgataggcgttccagtggagaatgttatttgtaatatgatgctagcatgaggggaacaaaatctcttaacgagcttcttctcatgttgagcttgtttagttatctttggtggtttaaagaaatggtttataagttgttagtgtcgtttggttcacgaaatgtaacgtaaatggtaatgataatgattcacactcaaataccgacggtaacaagtttgaattaaaaaaaaaaaaaaaaac

SEQ ID NO: 7238 - DNA, 1053 bp, Zea mays
aggatacctagctacccacaccctatataaacatatacaaccacattgaaccagaccagcaatcaacattcaagccatggcactgttcaagtgcatgtgcatcttcttagtctcgcttctactcgccctcaccttcaccaatgcccaggaagaatcttcacatcggactctcccaccgttcccctgcatcccaggccagccacggcccccgcggttgccaccttgcccgccggcaccaaccgagtgctacacgtcgctgtcgggaatgatgccgtgcgcggacttcctcacccacaacgaggtgccaccgatgccacccacggtcgcctgttgtgatggtctcaggtcactcgtcaccaacgcgtccatctgtctatgccatatcgtcaacggtaacatcaacaagctcctaccggcgcccatgatacccgtgcgcatggtggcgctcccccgcttttgtgttgtccgcttcccacgagccatacttcgccggtgtatcagagggcatttgccaccgatgaaccctccgcctccaccagaggcatcaccgtcggaaccaccatctacatcgccagcagcatcaccatcggaatcaccaccagcagcatcgccaccagaatcgccgtcgacaccaccaccagagtccgtcgactacaccgccgacaccagcagcagcaccaccgaaatcaccgtctgatccaccaccagctacgccaccagaatcatcatctgatccaccgtcgacaccagcagctacaccaacggcgactccatccccatcatcttaatcacgaaagatatttcaaaagcagtagtagtttagtcaaattagatatgcgttttaggattctagttgatatgcgtccattattttgttcacatcgaatgcagtagtgtgttagctatgtagttgcatacctatcataactaagtctattagaagtatctctaataatatttaggatctgtcatcaataaaatgtatgcaacaatacgactattgtattattttgtctactcaacatgcatgttatttcacgtcgacgcggccgc

SEQ ID NO: 7239 - DNA, 1068 bp, Zea mays
agaaaaaaacaactcaagcctcgcccggtcgcccctccctccctccctctgccccgggtttccagggaaacccacccccagatccaaatccagcgaagcgacagagatcaaggatggagctggaggtgggtgcgccttcgccggcgaggtacctggtgggggcagcgatcatgatggccggcgtggtgctcccgctggcgtacatgatcttccgcagcaagcgttcgccgtcctccgcctccgccgcggggccctcctccttctccaagcagacgtaggaacaaagggctcatctgatctgagcgagtgggtgaatcgatcgtcttcccctgatgcttgtcattctgtctgttttggcaccgcgagatcctccaactgcttctcgagactgggcatcatcacgtcaaatactagctgattagtagtcagttccttttgtaccttagctgacacatacattgttgctaagtgcattagtttgttatctgataatccacacctccagtgggggccctgtatgtttgtgttcttataagttggctcctattgaattgtctgtgttcctgcacatgaaggtagtaaacaaatcagtgtgctgccccagaaaagtcagatggatcgattgtttttgtggctacatgaagggcttgcggcttgccttgtggcttgtgatcaagatggtaattctcatggaggctactgggtattcagggcctacccttcctcagtattgaatcaaaccccgatatttaagactgtcccttctgaagttgacgtgacatgctcgagcgctggagcgcgtcgacatcaccggtttctaccctgagtgtgtcctattaaagtgagaagtgcctgctggacctagcatgatgtatgtgtccttgagtcttgagaccgcaacatatcaacatcactcgaagaggctgggcacctactgatcagtgatcacataacacagatggagagaaatatatgtgttcctgttttttattttgtattctagtaaaaaaatactagcttctacagtttccatcatcaaacgcttatcccactgttctgcctcaaaaa

SEQ ID NO: 7240 - DNA, 833 bp, Zea mays
ggggtcttgagggaagagagactggatcatcctgcaggatggaagaggcaataaatgccggccccggccgggaagaacaaacgataccagcagaaaaaaacaactcaagcctcgcccggtcgcccctccctccctccctctgccccgggtttccagggaaacccacccccagatccaaatccagcgaagcgacagagatcaaggatggagctggaggtgggtgcgccttcgccggcgaggtacctggtgggggcagcgatcatgatggccggcgtggtgctcccgctggcgtacatgatcttccgcagcaagcgttcgccttcctccgcctccgccgcggggccctcctccttctccaagcagacgtaggaacaaagggctcatctgatctgagcgagtgggtgaatcgatcgccttcccctgatgcttgtcattctgtctgttttggcaccgcgagatcctccaactgcttctcgagactgggcatcatcacgtcaaatactagctgattagtagtcagttccttttgtaccttgtgtagatcagatcgattgcttatttggctgatttgatacaattataaacaatgggtttacttttgagtgcactacttacaagcatcattcatacggatttcagtttacctaaacaaaccacttgccctctaaaaaaaaaaaaaaaaaaaaaaaaaataactgtgcagaatttctctctatgctagttctccctcaattccaaaatgtaagttgttttagttttgtctgagttaagcttctctaagactaagtttatagaacatcaaattgggtttcgctgagaccaccaggaaatat

SEQ ID NO: 7241 - DNA, 2520 bp, Zea mays
tccactcgtccgcccacgcgtccgcccacgcgtccgcccacgcgtccgcccacgcgtccgattcaaggcactgggaagaacagtctgatgaaaggaacaacaattgcctcatcttatctttcagatctgacaactcttgctgttggatacatgttcatcttctgtcttgtgtttttgtacattggatcactggctttacttcgatatgccaggggagaacgttttaccattggaagactctacggtatagctactatattagaggccatcccttctctatgcagacagttctttgctggaatgaagcaccttatgactatggtcaaagttgcattccttctggtcatcgagcttggtgtatttcctctaatgtgtggttggtggcttgatgtttgcactctaaagatgctgggcacaacaattgcacagagggttgaattctttacagtgtcacccttagcgagctcatctatccattggctagttgggattgtgtatatgctccaaataagcatatttgtcagccttcttcgaggggttctgcgcaatggagttctttattttctgcgggaccctgctgatccaaattacaatccatttagggatttgattgacgatcctgtgcataagcatgcccgacgagttcttttgtcagttgcagtgtatggaagtttgattgtgatgttggtcttcttacctgtaaaactggccatgagagtagctccttcaatttttcctctggacatcaccatatttgacccatttactgagattccagttgatgtccttctgttccaaatatgcatcccatttgctattgagcatttcaagcctcgtgcaaccattaaatctcttctgcatcattggtttgctgtggttggttggggccttggcttaaccgatttcttgctgccaaaacctgaagaaaacggtgggcaggaaaactggaatggcagggcagaaagaagagacaggggacatggtgggcaggaaatggttgccccacaggttgaacaacttatgatacaacatgttgccgcagaacataatgacaggggaaatgcaaatgaagccaatgatgtcactgaagaatctgatgtagatgatcagggagactctgagtatggctttgtgcttcgcatcgtgctcctgcttgtactggcatggatgacactactaatattcaatgctggaatgatagttattcctatctcgcttggccgtcttgtttttgagggtgttccccgcctgccaatcacacatggcatcaagtgcaatgatctgttctcctttagcattgggtgctatattctctggagtgttgcagctgggaccagatatgccattgattacatcagatcacgacagctgggatttctggttcaacagatctgcaagtggtgctcaattgttttgaagagctctgttctcttgtcgatatggatctttgttattcctgtgctgattggacttctttttgagctgctggtcatcgtacccatgagggtgcctattgatgagagccctgtcttcttattgtaccaggattgggcactggggttaatattcttgaaaatatggactagactggttatgttggatcagatggcacctttggttgatgaaagctggaggtcaaagtttgagagagttagagacgatggcttctcccgtttaaagggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgcactcttcttttggggcaagagatttcatgtctggttcaccaacctccacaactccatcagggatgaccgctatctgattgggcggaggctgcacaactttggcgaggactcacactcacctgagcggagtgaatctggagcaactatagggtcagatgatcaggacagagatattgtactaagagatcaggaagaggaagtggggttgaggatgaggcgcaataatatgcatgcaaaccaacaacctaggcttgctttataagtaggaagtagttttggacaaagagctcataaccctataagcttcggtctgcaggttctgcttgtgctttgtaatgggcattgtagagtgagtttatgtgttagtgataggaaatagtctaaggactgttctacgataaagcctggagaaagctgaagtggctggtgattataagaactggtggcaactcccattcctgtggtagtcctggctgactgtaaatatcgtttgacagagcattaccatgccaactcaatctgttgtgatcctcttgtaatgactagtgagttaagttgaactgttgggtagatacgagatactaggttattatcgcgttcactcttaaaaaaaaaggtccaaaaaaaaaagtcctctgcgttgtgaccactgcttaagggcaagaaccag

SEQ ID NO: 7242 - DNA, 2394 bp, Zea mays
gggcatcagcttaaaaaaccctagattatatatcaacataactgagtaatgatccgtgtttgcaacaaatactcaagagtatgacattctgaacatatttcactgagtatatcaacataaactatggttagttatttatgctcttccatcttttaaggtatggctttgtgcttcggatcgtgctcttgcttgtactggcatggatgacattactaatattcaatgctggaatgatagtttttcctatctcacttggccgtctggtttttgaggctgttccccgcctgccaatcacacatggcatcaagtgcaatggtaatttgcatgtgattctacctgaattggtgttatataaatttaacttgctatgtttatgaatgacaagatcagtcatataacacatttgctgacaccttttggaactatcagatctgttctcctttagcattgggtgctatattctctggagtgtggcagctgggaccagatatgcgattgattacatcacatcacgacagctggggtttttggtacaacagatctgcaagtggtgctcaattgttttgaagagctctgttctcttgtcgatatgggtaattcttttacgctgcatttctactgtttgaactgtcccctttttgaacccggggggggggggggggatctggtagtactacgctttctgagtgcctcttttatggacctaaccaagtaaccagtagtgttaatcttttctttcagatctttgttattcctgtgctgattggactcctttttgagctgctggtcatcgtacccatgagggtgcctattgatgagagccctgtcttcctattgtatcaggattgggctctggggttaatattcttgaaaatatggactagactggtaagtttatagatatctgattcttgtgtcctcactattcatttcccagctacttatcaatcttattctataggttagttacctatttggatatttgcattaaaataggattgagtagattgaccaacctactatgagactttccaggttatgttggatcagatggcacctttggttgatgaaagctggaggtcaaagtttgagagagttagagacgatggcttctcccgtttaaagggtctgtgggtcctccatgaaattataatgccgatcgtgaccaagctccttactgctctctgtgtcccatacgtccttgcaaggggcatcttcccgttgctgggttacccactcatcgtgaactcagcggtgtaccggtttgcctggcttggaagcctgatcttcagcgccctcttcttttggggcaagagatttcatgtctggttcaccaacctccacaactctatcagggatgaccgctatctgattgggcggaggctgcacaactttggcgaggactcacactcacctgagcggagtgaatctggagcaagtatagggtcagatgatcaggacagagatattgtactgcgagatcaggaagaggaagtggggttgaggatgaggcgcaataatatgcatgcaaaccaacaacctaggtttgctttataagtaggaagtagttttggacaaagagctcataaccatggtataagcttcggtctgcaggttctgcttgtgctttgtaatgggcgttgtagagtgagtttatgtgttagtgataggaaatagtctaaggactgttctacgataaagcctggagaaagctgaagtggctggtgattacaaaactggtggcaactcccattcctgtggtagtcctggctaactgtaaatatcgtttgacagagcattaccatgccaactcaatctgttgtgatcctcttgtaatgactagtgagttaaggtgaactgttgggtagatacgagatactaggttattatcgcgttcactcttttttttttgggtcccatctttgtttttttagaaactgcaattgcattctgtttatatcatggagcatctagcggcttgaaatgaacaagaacaagatgcatgggcagtgggcagtattggttgtgggtaactgaaagcagggaaaagttcctgatgaataagggctattttggaaacttaatttttctaagggttttctattttatcaagagaaattagtttattttttcttgggaaaataaaaatcccttcaaaaaatgaagtttccaaacttgtccaaagctcaaaaataatttgtttgttttgtcagtggaagaagttttggtgagaagggaaacgttgactttagagctcaagtacctcctaccaaacacttttttacagaaatggttggtaattgagtgagaattgtattgagctgaaaatatgaatacttccttagtctcaaattaaaatctattttaactttttaccgaattcatacaattata

SEQ ID NO: 7243 - DNA, 1101 bp, Zea mays
gttctcctttagcattgggtgctatattctctggagtgttgcagctgggaccagatatgccattgattacatcagatcacgtctgctggggctgctggttcatcagatgctgccatgggggtgcctattgttgagagccctgtcttcttatagtaccaggattgggcactggggttaatattcttgaaaatatggactagactggttatgttggatcagatggcacctttggttgatgaaagctggaggtcaaagtttgagagagttagagacgatggcttctcccgtttaaggggtctgtgggtcttccatgaaattataatgccgattctcaccaaactccttaccgctctctgtgtcccatacgtccttgcaaggggcatcttcccggtgctgggttacccactcatcgtgaactcagcagtgtatcgctttgcctggcttggatgcctgatcttcagcgcactcttcttttgtggaaagaggttccatgtctggttcaccaacctccacaactccatcagggatgaccgctatctgattggccgaaggctgcacaactttggtgaggacacacccgagccgagtgaatctggagcaactatagggtcagatgaccaggaccaagctcttgtcctgcgagatcaggaagaggaagtggggttgaggatgaggcgcaataatatgcgtgcaaaccaacaacccaggctggctttttaaggaggagatagttttggatatagagctcataaccatggtataagctttggcctgcagcttctgcttgtgctttgtaatgggcgttgtagagggggtttatgtggttgcgataggaaagagtctaaggactgttctacgacaagcctgggagaaagctaaagtggttagtgattataagaactggtggcaactccctttcctgtggtagtcttggctgactgtaaatatcgtttgacagacactaccaggccaactcagtttgttgtttcttgtaatgactaatgaattaagttgaactgttgggtagatacaaagtaaaaaaaaaaatgacttccaccacttcctccaggggtttgtcatctttgtttcttggcaaccgca

SEQ ID NO: 7244 - DNA, 1342 bp, Zea mays
  misc_feature (1182)..(1182): n is a, c, g, or t
cccacgagtccggtcttctcgcgatggggagcaccggcgacacgacgatggccgaggcggaggcgccggcgccggtgggtgactacgagctgctggagcgcctgggggggcgtcccccgtacacgtccgtgtggcgagcggtctcccggtccaccggcacgcccgtggctgtgaagcaggtgcggctcaccggcctccccgcgcgcctccgcgacagcctcgactgcgaggtccgcttcctcgccgccgtcagccaccccaacatcatccgcctcatcgacgtcgtccagacccagagctgcctttacctcgtcctggagctctgcgagggcggggacctggcggccttcatccggcgcaatgggagcgtagacgagcgcgtggccagaaattttatgaaacagatcggagctggcttacaagtgctgcaccggcaccatgtcgtccaccgggacttgaaacctcagaatatcctgctctcttctccgagaagcagcgatgcgatcctcaagatatctgattttggtcttgcaaggtttcttggacccggggagtacgcagacacatcttgtggttcttgtttgtacatggccccagaagttgctgtttcaaaagtacaatgacaaggtagacatgtggagcatcggcgcgatcctatttgagctcttgaatggctacccgccattctatggcagaagcaacgtgcagctgcttcagtacatcaacagaagcacgtctctcccgttctcggaaccactggcgtctaccttaggccccgattgtgtcgatatatgcaccaggctactatgcactaatccagtgaagcgtctgtccttccaagagttcttggaccaccgcttcttcagagtatgagtgcccaagccatggggaccaccgggcagcgacatgatctgaagaacatcaagaagtttcttgtccttggagtgctgactgactctgttataaagcgttcagaaattgatgcccagtgctcgtcgtcttggttttctgttcgcgtccatttccttctccaaagagccatgtggccaacgtttcaatctgttgtgatctggtctgtactgtttcaatctgctaacagtaggagttttaaagatatttagtccaaaacagaactccatcttttattcaaagcggcataaactatcccattttattgagcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggacccaagttttcttccccgtgcttgcgacgtaatagcttttt

SEQ ID NO: 7245 - DNA, 1276 bp, Zea mays
ctcgaggccggccgggacgccagcacgcccgagccccgaatcgagtcccctaccccatcgatccccgccgcccgcccctaccccatcgatccccgccgcccgcctttccccgccattcttctagaacctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgctggagtggcggtttgcgcaggtcttcggcgagcgcgccgcgggagaagatgtgcaagatgtggacataatctctgcaattgagtttgacaaatctgggaatcatcttgctactggagatagaggtggacgtgtggttttgttcgaaagaacagacattgctgataatgcttgtcgaagagaacttgagaggcaagaatatcttgtttctaggcatcctgagttccgttacaagaccgaatttcagagtcatgaacctgagtttgactacctaaaaagtttggaaatagaagagaagattaacaagatcaagtggtgccaaacaaccaacaatgcactctttctcttgtctacaaatgacaaaacaatcaagtattggaaggttcaagagaaaaaggtgaaacgggtttcagtgatgaatttggacacctcccaaagttcagacaatggttcaacttcaagtccgggtaccagtagttgcagagctcttcttccaaatggtggatgcacaggaaaaatgtacagtccaaacaacaatatgtcatttcctccaggaggatgcacatcgctgcgtttgcctgtggtggttacaggccaagaatttactcatgttgcgagaagcagacgtgtatatgcccatgcccatgactaccatattaattccatttcaaataatagcgatggagaaacgttcatatcagcaggcatgatctgcgcatccagtggcgctggggtacgcctggatgctaggcaatatggcataacgaaaaccttgtggctcctatggcgcctggggtatgcctcaactccttggcgacggctcaaaaaccatggtagtgtgtaaaaccagtatggtggcaacattgttcttctgtagtaggaaatgtggtctatgacttatgtaacataaaagctttgaagtaggtaaaataaaagaagcttattctttcattataaagaagctactgctcttaaggctattag

SEQ ID NO: 7246 - DNA, 1019 bp, Zea mays
gcgattgggttcctcgaggccggccggggggtctatgccggtggctgtttggacatctgttgacacaccccaccccgttgccaagcggcgccaaaccaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttacgtgtggagtgatgcagaggatctcaatctttatggagaatgggactttgaggagtggaagaaactgcacatgaaggatttccttgcgatgacgaacggtttcatgcacgagctcgagcagcctgaatcgaagacccgggtggagacctaccaggaattcatgcaacaacaggaacagcctgcgccggggacccaggtggagggttgagagctgcaatccgctggctgctgatctacatctagtcaattcccatggaggaattgcattggcattggactgtaccgtatctaataggtcacctatatcatttgtgaagatcaggattatccggtctataataactaaacatacaaataaaatgtccaccgaggtttctgttgattctttatgtcattgttgaccccatggctgctgctcaactgctgatgcgcggtctctataatttgtgaaagaagatagtgattaacttacataatgcaatagttaagtacatgtatatgaaacagttttccttgaaaaaaaaaaaaaaaatttcggcc

SEQ ID NO: 7247 - DNA, 698 bp, Zea mays
tcgaggccggccaggggacattcgtttgccgcacctcgaggccggccgggaagcggcgccaaaccaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttacgtgtggagtgatgcagaggatctcaatctttatggagaatgggactttgaggtgatatgacttgtttcctgcagtcctggggtgttaatgctatgtgattatcatgctacgtggatcatatcaaaatgatgaactctatcagctactgccgtcctcgggatctaaaattctgttgcgaccacgcacaatgaatgtagtgattttctcgcatatataatactccctttgtcccaaaatataatccgtttta

SEQ ID NO: 7248 - DNA, 3606 bp, Zea mays
catgcctgtgtacgtagacatctaagcataaatgttcggtctaagcttagacactcgtattgaagaaataaacttaaatagaaaagtttggcaagttgtgatggtttagatggaaaccaaacaagccctaaacaaaaagggcaagggcatgctctaaatgggaaatagcagggtaacaaataacggatgcttgtgctgtaagcataggctgcaaaatagctaaattggaaggagtcccagtagggcaacaaccaacaaggagtgacatggtggctgaagttagtgaattttctagaaaatatacaccatccgtcccaaaatataatttgttttagattaaatatacactcattaattaacctataaatgtaatttatatgtatgtttacattcattatcattcatttgaatgtgaatggaaaaaataaggctagaaagaactatattttagaacggagggagtggagggagtactgaaaacagaggcctatttctggcgacaactctttatcaatacagtcgtccatgcccccatctatctgtttccattacacccatagcccagaatgtgcttatgtgcccaaaatgtggtaggagtatgtacaaatgtgaccctgtgctttctaactacaaagtttatctcctctccacaggagtggaagaaactgcacatgaaggatttccttgcgatgacgaacggtttcatgcacgagctcgagcagcctgaatcgaagacccgggtggagacctaccaggaattcatgcaacaacaggaacagcctgcgccggggacccaggtggagggttgagagctgcaatccgctggctgctgatctacatctagtcaattcccatgggaggaattgcattggcattggactgtaccgtatctaataggtcaccgtttccatttgggcacctcaggattatccggtctataataactaaacatacaaataaaatgtccaccgaggtttctgttgattctttatgtcattgttgaccccatggctgctgctcaactgctgatgcgcggtctctataatttgtgaaagaagatagtgattaacttacataatgcaatagttaagtacatgtatatgaaacagttttccttgagatttctgttgattattttgtcgttgttcatcccatggctgtttgtggaatatgattaggagtaacctgtgagatagaataattaagtacagcgatgaagttgtcactgagattgttgaacacatggctggtggttggtgactggtgctgaacagttgatgcacggtctttagcagtaacggactaaaaggaattcagacgccaccaaaatcttactacaagcttgcttctggaacgtcggattctttttaattcagctatattcgtcttaagttgtggctgcaaagactgacacactgtctctaacatcgtccttaccgtcttatctaaaagattctctatattttcttatcctccaacaatgacctctatatttcttcctctataaataaatatctatattaaaagttcataaggaacaaactacagccttctaattaccgcaccacttattgatttatgctatataaaaaatatatactataaatatatatagtaataattttaaaataaaaattgtgtcgaactggaccaacattgtaggcagagaagaccgtctaagcacggtacgggcctactataaatcacatcagatcgaattgtgacgctattaaataaatcataccttagattggctcgctagatatagctcatttagttatttatagttcagtaccaactccctcttcgtcccttcgtccctggtctcgcgagtgtgaaaaaaacgagaggaaaaattgtatcttatctaactccccaccacatatacctcgtcattcacactcaactaatctataagtttagatcgtgtttaaataactatctcattaaacaatgtctatatatatgatattaaaaactatagcgatgcacgtgcaactaactaggtgtattatatatattttagttttgctacatatgttgtttaaaatgctaaatagatagagaagaggagagaaactctatatagaggatccaatagtgtaccctaaatttagaagatatattcgatagagcttctatcctagtttcacaatgttgttttcagttttttgtaccaaacagaccttgatgagacatcatctcttcaaaaatcgttttagcatctcccgagagaagctgtcttaccgtttgtttatgaaaacagattcagctctactagtaaaaccttttttgaagctaaaaaagtaacaaaaactaatttaaacagcccctaatagtatgcccaacaactttattgatcaactctgacaaagatggctgaaattggagatgaaaaatagggagaaaatgttctcaattctctggaagatgctggatttgggtctgtttatacaagcacagatcacgaggaaagcaactatcataatcaattttttgaaacgataactatcataatttatatcgcttggtaattgatcaactttaaagcctaatagttttcacaagggatgtacgtactacgtattcgaattcacgtctaaaagggttgggatcttactaaattccaaatttgagtctgattattcaatatctcgtctgtattcgatctatatctatatccgtaatctcgaaattggatatttaaaacatcgatatctgtttagatcttctccaacacaagccgataatatccatattatctgattcacgagtgaaagtatgaaatcaaatatgggagagtaatattcgtgtagattcgatcgacaccctggttccctagttcttaccggtgctcgaggcctcgagcgcacaggccagccacatggcgtcatccagggtcgccggttgccgcagctccacgtcggtgagcagcggatcgcggagaccggcggtaaagaaggccacctgcagcggctccgtcacgccgtcgcatctgtccagcagcctcaggaactcgtcccggtactccgcgacggagccagtgtgccgcagccggaggagctcgcggagcgcgtacccgctcgtcggggcgccgaagcggcgacgcaccgactcggcgagctgcggccaggtagggacgccgcggttgtgcttgagcaaggagtaccagatctgcgccgcgccggtcatgtggaaggccgcgaggcacaccttgtcgtcgtcctcggtccgctgcaggctgaagaacagctcgaagcggtggagccatatggcggggtcgtccgtgccgtcgtactccggtaaacgcagctcgagtactccggggaacgcggcctgcttcccagcctcgacggcatcttggaggcgccgttgatcgagcttgacggtgcagagctcgcgctcgaccgtcgtcatcttggtctcgagcgatgtcagcttgtcgacgacgtcggtgagcagcttctggacgtcgatgaggccggagtccgccattgtcggtcgacgagcaggaatcacgagggttcgtgtcgtgtgcggccgcagagaacgaaaccactggatttggtagggttttggggtatggcacgagcggtctaggacttt

SEQ ID NO: 7249 - DNA, 940 bp, Zea mays
gaccaaccaccgtctccatccgacgcactgtcgcctcgccggccgcacctacgccgttgaagtcgctgtcgcagctgcagaacaacactctgtgttggtgtcaagatctatagagcaggcatttctagtatcccttggaaaaatggggttgccaaacttgcccttagaggaactaattcctggcatatggtgctcagtgggcagtgcatcaggactcgaaggaagcatagcatcatcggtttttgtgtttcattagttctcatttcaagatggcatctgctggcctaaaaccaggggtgcctgttattctacgggagctggagccatcctcagagatgttcaagcaaggagcgtcccttcgagtcacaggaagtctccagtcattcgatgtggagtccgcgactgccaccattcaagacggcagcgtaagtctgaaggttgacacccagcatctgagggatgtcagtttccgcacgaactcggtgtaccaattcattggtgaacttcagatccgtgaagttgatgatgcgattctactcgcgcgcatcggaaggaacgtcgatggcctcgacatgaacctttaccagcaggctctactcatccgacggcagcacgaagcaaagctgctgagctccaggagagcatgatctgcttgctatcttggagcaggaggcgcatggtggttgtagttattaggtttctttgtttctcaacagtgcaattgcatatgtaaacgtgaagagaactggaccaagaactggttaattgagagggtctgctgcatatgatttgcgatctctcttgccctccaaagggctgccatggcatgtgtagatgtgactgccaatttgtgatcatcttacttgcagcagaatgctggttttatttcattgacatgagaacagcctgtggatcatgtttaaaaaaaaaaaaaaaaaaa

SEQ ID NO: 7250 - DNA, 786 bp, Zea mays
ctctgtgttggtgtcaagatctatagagcaggcatttctatgggcagtgcatcaggactcgaaggaagcatagcatcatcggtttttgtgtttcattaattctcatttcaagatggcatctgctggcctaaagccaggggtgcctgttattctacgggagctggagccatcctcagagatgttcaagcaaggagcgtcccttcgagtcacaggaagtctccagtcattcgatgtggagtccgcgactgccaccattcaagacggcagcgtaagtctgaaggttgacacccagcatctgagggatgtcagtttccgcacgaactcggtgtaccaattcattggtgaacttcagatccgtgaagttgatgatgcgattctactcgcgcgcatcggaaggaacgtcgatggcctcgacatgaacctttaccagcaggctctactcatccgacggcagcacgaagcaaagctgctgagctccaggagagcatgatctgcttgctatcttggagcaggaggcgcatggtggttgtagttattaggtttctttgtttctcaacagtgcaattgcatatgtaaacgtgaagagaactggaccaagaactggttaattgagagggtctgctgcatatgatttgcgatctctcttgccctccaaagggctgccatggcatgtgtggatgtgactgccaatttgtgatcatcttacttgcagcagaatgctggttttatttcattgacatgagaacagccttgtggatcatgtttactgggatgctttgttgtgtt

SEQ ID NO: 7251 - DNA, 2981 bp, Zea mays
cacgccccaaagtctctccccgttgcttccctcccctagggttggcttcatccggcaaccaaccacgccccaaaagtctctccccgttgcttccctcccctagtaccagcaatgaacgacgtataaaccacaccaccgcccggccgggccgccctcttgtcatttcgccttcgccccacggtcccacccgcccctaccagatctgctccgccgccaccgacaccccctcctcgccttcctccggcgagctcctcgccggagcagggccggccgccgctaccgacccatcacccacaacaggccttactgccgcgtggcccagatccgcgcgctccccgccgatccagatccatggctcgccccggcgcgctcctcctcgccgtcgcggtggccgcgctgctcgcggccgcagtgccgggcgcccgcggattctacctcccggggagctacccgcacaagtacaacgtcggggacgacctcaacgtgaaggtgaactccctcacctccatcgacaccgagatgcccttcagctactacagcctccccttttgcgagccacaagacggtgtcaaggacagcgccgagaacctcggcgagctcctcatgggcgaccgcatcgagaactcgccctaccgcttccgcatgtacaccaacgagtcagacgtcttcctctgccgctccccaccgctgggcgccgacgccttctctctcctcaagaagcgcatcgacgagatgtaccaggtcaacctcatcctagacaacctccccgccatccgctacaccaggaaggacgactacatcatgcgctggacggggtaccccgtcgggatccgcgtcggcgtcgactactacgtcttcaaccacctccagttcaccgtcctcgtccacaagtacgaggatgccaatgtcgcgcgcgtcataggcgccgccgacgccaccgacgccatcccctccggggctaaggatgccgcctcctcctcccctggatggatggtggtcgggttcgaggttgtgccctgcagtatcaagcacaacccagaggacgtcaagtcgcgcaagatgtacgacagctaccccagcaagatcaagtgcgacccgaccaccgtgtccatgagcatcaaggagaacgagcctattgtctacacctatgaggtgaacttcgtggaaagcgacatcaagtggccctccaggtgggatgcctacctcaagatggagggggccaaggtgcactggttctccattctcaactccctcatggtgattgccttccttgctggtattgtctttgtcattttgctgaggaccgtgaggcgtgatctcaccaagtacgaggagcttgacagtgaagcgcaggcccagatgaatgaggagctgtccggatggaagcttgtggtcagtgatgtgttccgtgcgccaagcaacccgatgctgctttgtatcatggttggggacggtgttcagatccttgggatggcggttgtgaccattctctttgctgcgctcgggttcatgtccccagcctcccgtggtactctgatcacgggcatgctgttcttctatctggtccttggaatcctggctggatatgttggtgttcgcgtatggaagacgatcaagtgtggggatcactctgggtgggtcgctgtgtcgtggcgggtggcttgcttcttccccggcattgcattcctgatcctgaccacactcaacttcctattgtggggaagccacagcactggtgccatccctttctcattgttcgttgtgctgcttctgctctggttctgcatctccgtgccgctcacgcttgttggcgggttccttggtgccaaggctccacatattgagtaccctgtccgcacgaaccagatccctcgtgaaatccctcctcagaagtacccatcctggttgttggttcttggtgctggcacactgcccttcggcaccctattcatcgagctcttcttcatcatgtcaagcatatggatgggtcgtgtgtactatgtctttgggttcctcttcgtcgtcttgctgctcctggttattgtctgtgctgaagtttccctggttctaacttacatgcacctgtgtgttgaggattggaagtggtggtggaagtcattcttctcatctggatcggtggcaatctacattttcttgtactccatcaactatcttgtttttgacctcaaaagcctgagtgggccagtgtctgctaccctctacatcggttactcactcttcatggtgattgctatcatgctggcaactggcacagttgggtttatttcttcattctgcttcgtccactatcttttctcatcggtgaaagcagattaagtttcttcctgctgaggattcaagtcactcaattgagaggtgagcagaatggacagtgaaaagtttgtagtcacaaatcttagttcatgtcatcttttggtatacaaaagcctggacaactattgcaagggctactaggattcatcaatggatctgtggagaggtgtttgcagcttgcacgatgtaataggttgaattgctttattctcatgtggcgttgctatagttgtttttagattaccattactatatctcaatatgtatgctaagtaccatatctgcttgaatttatgtttattgacattttccccgaatgttagatctagttatctacttatctgctgcaatgtatgtctgttgacatttgccccaaatgttggatccagttatcgccacctactaatagatctttgtagttccacattaaaaaaaaaaaaaaaaaagcggcctcatgttggtattatttttgctcccacctatggtttattttgcccaagtctatttaatctgcttactgtcatcgcgaatatttatgtgctgagtctgtgtactggctttgagcatctggcaatatgcggtctctaggcaacttccatgtgactttacttgcctgtatttaggaggatcgcccaacaaggtcagag

SEQ ID NO: 7252 - DNA, 4320 bp, Zea mays
  misc_feature (3561)..(3561): n is a, c, g, or t
  misc_feature (3614)..(3614): n is a, c, g, or t
aggattcaggaatagaaaaagaaaaagaatggacagcttgttgctcaagttgttcacccacctccactccacctgtgtgtgtgtgtgtttcacgtcccggcgaaacttgccggcggacacgcgtcgtcacagccgaccaacggcgcttgcccgttcccccagtcccccttgattcctccgccagcccagcggcggccactctccacgcatctgcatccgcatggctctccacgccgcggcgccggcctgcgcggtgttctgccgcctcccgtcgccctccccatctcacgtcggtggcagacgctcccttcccgccgtcgcgagtccccgcggcgttgtctctgccgcgccgctacggacacgcgcagttccaacaaaggcgatcgtaaacagtgatggcatccctgaaacgagtgattctccacatgtggtttgctttggtgaattgctaattgacttcgtcccaactgtcaatggcgtgtcactggcagaagcacctgccttcaagaaggctcctgggggagcacctgccaatgttgcagttggaatagctcgccttggtggctcgtcagctttcattggaaaggttggtgatgatgaatttggctacatgctagctgacatattgaagcagaataatgtcaataatcaaggattgctgtttgatcctcatgctagaacagcttttggcgtttgtgtcactccgaagtgatggtgaacgcgaatttatgttctatcgtaatccaagtgctgatatgctacttgaagaaaaagaacttgatcttgatcttatacggaaggcaaagatattccaccatggctcaataagtcttataactgagccctgtaaaactgcacatattgcagctgccagagctgctaaagatgctggagtacttgtttcatatgatccaaatttgaggctttcattgtggtcatcacctgaggatgctagagatggtatcctgagcgtatggagaactgctgatattttcaaggttgctattctgtaaattatggttcagctgtagaggcaaatcttgtgttaatttgtgcattttgcttctcttttcaaaaaggtaagtgaagaggaggtttcctttctcacaaatggagaggatccttatgatgatgccgttgtaaagaaacttatgcactcaaacctgaagttgcttcttgtcactgaaggtccagacggctgtaggtattactctaaggtaatcctacagttatgatgtagagggtactatttttatttcttgcttggttacggaatttacttttttttctccatgaccataaacatgatttttgtccaataaaaatttacatggcgttggatattatattaatggaattaactatttatttctagtgaacaaacttttcttaaatcttaactacatttacttgctaacaatgccttatgcacataggtctgtaaaatgttgtttacagtacatttttgtggaataacaggattttagtggtagagttggtggacttaaggtaagtgctgttgacacaactggtgctggcgatgcctttgttgctggagtgctatctcaattagccacagacttttctctgctccaggtatgactataacctgaggaacatgaaactgcaggcgtgctgttactttctttcaggaagtagatgaaactatgtttgaggtgttcctgcagcctgctacagaaccctcctcgacgcttttactatagatgggtgcatgaaatgatttttttgaaggacctaaaacgaattatgtttaatacatttacttctccacatagattcaaagatatttagtttggatagttacagagaaagtcatactgatctgctggagctgtgcatctgaagagaattttagcaactgtataccagagtcaactttctcttatctaactactacaatctttcaattcctggatgctacaaacctgcaagctgtgaaaaattaaagattaaatattatttagttatacttatacctggatcttggactttgaattttaaaagtaggttcatgtaatgtgcattttttttaaaaaaaggaagacgcacaagttcttgtaatgtcgcatgtcacaagccttttccaataaacaattccaagaacgtataaagtttcagtacttctctatggatataggcaacatgctggtgcatgggtatatatgtttagttggcaacccacgcatacactcgcaaactgaactatgcagcggtgctttgaaaccactcatatttcccttgtggctgaaacaggatgaaggtcggttgagagaagccctgaagttcgcaaacgtctgtggagctctcaccgtgacacagagaggcgctattcctgcgctgcccacccgacaacaagtgcttgatgccctgaccaattttgttgcttgaaagtagccgtgcacacctacttgtgtattgtaatgctgaccgcctgagcgccatgtcgatagattacaggcgtgatttcgcttgcataccacttggcatttttgttggtgcgtaccaaagccccccagccaaaccaagtactcggtggaagaggttgtttcccgtcggattttgatgtgtgaagttgtgtgttggggacgttgggttaacactttgtggacgtgtgtgatgtgtgtgctgatgttgtaatgctgctggggagaacatgacacagcggagcagttttggtacctgaaaacatgagctatgaatgagtgattcagttattgggcccaatttgcgttgcttccctagcatcaggtctgccccctctttacgatagttggatcaacaataaccaggcaacagtccaatgttagccacatatgagtacatgagatagtatatccttttcttttttatttgcgtgtatatattttttatgtacatctgcgcatgactgaggactaggagaatgaaaacctgaaacagctcactctgcagagtggagacaccatgtggactaaattcccactgaagttgtggatgacattcccgatgaatgaaaaggcaccggaccttgagtgatctccaatccattccgaagaatgttgacgcgaatcatgggatcctgtccgcgtaggcgacgaccggtaactagagcaacacccctgtgggctgtggccatatgcgtagcgtagcgtagcgcctcgtaggttaaggctgtctttggatccaccccttaaaaactggtttctagatttagtttctagaatctggcttttttaaaaaaaactaggagaaaatgtttggatccatctagtttattagaaactggttttagctggagagtgtggcttcttggtttttaagaaactgagaaacccgattttaaaaaccgaataaaaaactggcatgtttggagatcttctagtttttaaaaaccaatttccacgaaactaggtggatccaaaacgagcctaaaccgtttagaccaattgttcatgttgccctcgacgccggccgctgaccatatttctgatcatattattaactgtcgtcggtccttatctgtttgtaggagtggaaacctgatgggcggttgtccaagcngcttgcacatgcagactcggtagacgtctctctagaacatgacttcgatcatntctaagtgctagaggcgatcaggtttcaggtgtgccacctagcttcgctatgtagatgtgcaacaataaataaaacattttagtttgattgtgtggatcgactcatgctggtcacacttatcagctctcttgactccattgtcctttttattaagtcagctaaaatgggtaaatgaatgtgcattggaagtggccgaaaagaaaataaacatgtctaaagcatggtttagacgaccattggtcctaaatcgatgcatggcacgcacggccaaagaggaataaacgagccagcagcccattaggattacccacaccatatgccaaaattagggccaaataaatggtgaacagtttatagaatatatcccagatttgatctatagaatctattacattgaaaacccttattccaagtcgggcgaccagctggtcgtcacagaggaccgaccaggcgcctaatcgcgattagggcgacgattaggacgcctaatcggtcctggtcgacctcaggtcgtctcctaatcgtcctatacaatttctggacatatatatgtatatagctatatataacaagcaatactgcaatagccaataggctaggcactatataagtctgaaactctgaactgagtctgaaattacaagcagtgaagcagcagaaatgaaagtctgaaattgtaactagagactgcagaatgcactggtg

SEQ ID NO: 7253 - DNA, 867 bp, Zea mays
tttccctcgcgtccgcccacgcgtccgcccacgcgtccggaaggtccagacggctgtaggtattactctaaggattttagtggtagagttggtggacttaaggtaagtgctgttgacacaactggtgctggcgatgcctttgttgctggagtgctatctcaattagccacagacttttctctgctccaggatgaaggtcggttgagagaagccctgaagttcgcaaacgtctgtggagctctcaccgtgacacagagaggcgctattcctgcgctgcccacccgacaacaagtgcttgatgccctgaccaattttgttgcttgaaagtagccgtgcacacctacttgtgtattgtaatgctgaccgcctgagcgccatgtcgatagattacaggcgtgatttcgcttgcataccacttggcatttttgttggtgcgtaccaaagccccccagccaaaccaagtactcggtggaagaggttgtttcccgtcggattttgatgtgtgaagttgtgtgttggggacgttgggttaacactttgtggacgtgtgtgatgtgtgtgctgatgttgtaatgctgctggggagaacatgacacagcggagcagttttggtacctgaaaacatgagctatgaatgagtgattcagttattgggcccaatttgcgttgcttccctagcatcaggtctgccccctctttacgatagttggatcatcaataaccaggcaacagtccaatgttagccacatatgagtacatgagatagtatatccttttcttttttatttgcgtgtatatattttttatgtacacctgcgcatgactgaggactaggagaattaaaacctgaaacagctcactctgcag

SEQ ID NO: 7254 - DNA, 914 bp, Zea mays
  misc_feature (892)..(892): n is a, c, g, or t
gtattaactggctagaggacgcctccgggggcgcccccgctgctcatactcttaagaccgatccgacccaaaccaaaacccgattgccctcgtagtcgtttgtcatcgcgcgaccgattaccccgccgccgccgcgtcggcagcggcgatggcgtcgtcgttgtcgcgggcgctgctccgccgcgtcgcagaactggctagaggacgcctccgcgccaaccaccgcatgctctcatccgcgtcgtccaccgccgccatcgagagggcttcgcagttgccggcggaggcccaggccgtgcgcatgacggagggttgcgtgcggagattaaaagaattacatgctaaaaaaccatctgctgaaggtaagatgctgcgcttaagcgttgaagctggtggatgttctgggttccaatattctttcgctcttgatgacaagaaaaatgcagatgacaggttttttgagactgatggtgttagattggtcgtggatgacatctcatataatttcgtaaaaggtgccactgtggattacgaggaggaacttatacgttcaacatttgtggtttcaacaaatcccagtgctgttggaggctgcagttgcaagagttctttcatggtgaaatagcttcaatgttaccttgaagagatcaataaccggagttctgtagcgaaacatacgctttagatctgagtgtacaattggtattttttggtagctcttgagatgtttctttttgagttttattaccttaaagagaacaataaccagaaatatcaatcacaaactgtctggttcaatttgtatctctctaacatgtgaaatgatgacaaatttatgtacatgtaatcttatggctattaacatttgactctatgtcgcttttcccccccnaaaaaaaaaaggccctagggcc

SEQ ID NO: 7255 - DNA, 1047 bp, Zea mays
agccatgcaaactagcaaatcaaggcaagtctggaacggccccaccgatccgaaccaaagcccaaatcggattcccctcgtttctcatcacgccaccgtttacccgccgccgcactggcagcggcgatggcgtcgtcgtcgtcgcggcccctgctctgccgcctcgcggaactggccagcggccgcgtccgagccaactaccgcatgctctcatccgccttttcatccactgcctccaccgagagggtttcgcagtcgccggcggagcccgaggccgtgctcatgacggaaggttgcgtccggagattaaaagaattacatgctaaagaaccatcctctgaaggtaagatgctgcgcttaagcgttgaagctggtggatgttctgggtttcaatattctttcgctcttgatgacaagaaaaactcagatgatagggtttttgagactgatggtgttaaattggtcgtggatgacatctcatatgactttgtaaaaggtgccactgtggattatgaggaggaacttatacgttcagcgttcgtggtttcaacaaatcctagtgctgttgggggctgcagctgcaagagttctttcatggtgaaatagcttcaattaccttgaagagatcaataattggaaatagcattctgtagcgaatcatacgctttggatctgagtgtacaattgttattttttggtagttctgaagacgtttctttttgagttttgttactgttggaaacatcatcacaaactgtctggttcaatctgtatccctctaacttgtgatagttgtgatatgatgacaagtttatgtacataatcttgtagctattaacagttgactttatggtgctccttataaaaatgcaaaataagatgaacaatatttttgtattgacaaaaaaaaaaaaaaaaaaaaaaaaaaaaaaacaaaaaaaaaaaaaaaaaaaaaaaaaaaaaaaatacaaatcagatagaatgctgactacccaacaaaaatatatgaactaaaaaccaactaaaaaaaatgggggcgcccgtttt

SEQ ID NO: 7256 - DNA, 1279 bp, Zea mays
ccccgatgctcttcgtcccgcgccaagtcgtactcgccgcctcatcacagccccgcgccgccgcctcttccgccatggccaaggaggaatccaagaaggagaagaagaaggccaaggccaaggtggccaatggagccgccgccgccgccgccgccccggtccctggcgcgagggccgcggtggtcgcctccgtcgccgccttcctcgagtccgctgggctctcgcgcacgctcgtcgccctccaatccgaggccggcctcgaggccggtgcgtgggggtcgtcacaggtgaacttggaggagctggttgccagattcttagagtcgagcaattcaactcgggcggctgccattctgggaagcgatgagcaagacaaggaaaatgatgatatagcaggagaagttggcaaggaaaaaaagaggagcggcacagaagccggtgagcctgagagcaaggcgatcgagcctttagctgaggaaaagccgactgaaaatatggacggtgaggctaaagagaagaaacaaaagaagaagaaagacaagggtgtcccttcagctgcgaatgctgctagcgagggaacaactgaaattgtgaagaacgccgaccagaaggacgatgaggccaaggagaagaaacagaagaagaaggacaagggtgacccctcagctgcgggcgctggcagcggcgaaacaactgaaacagtgaaggaggatgatcataagcttgatggcaagaagaagaagaaaaacaagaagcagggaaaggatgatgatgtcgaagctaggctggaaaaggcagaattagcaatacttaacaagtttgaggcagcagaaaagctcaatggaagagaggtagaaccaaaaagtcagaatgacagtgctgatgactgcagtggtgctgtggaaaggaaaaagaagaagaaagagaaatcatctgccgggacttcagagaagactgatgcaggaagtgcacctgctgaggctgatggtgccaagggaaagaatggtgctgtagaaacagtcaaggatgataatgagaaaaaggccaaaaaaaagcggaagaagtctaaccctgaagaaactgttcaggtggaaggtaaagaggctgcagggaaagattcagtcccaaaacaagatgatgcgaacaagagtgtaatggagattgaagaaggtaaccaagggaagtcgtcaaatgaaaatgcagttgctggcaaaaaacggaagctagaagaagttgagggaagcattccccctgtgactgggaaagaagattgcacagc

SEQ ID NO: 7257 - DNA, 1785 bp, Zea mays
tccatcttctctttctccgtcccctcccaaacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcgtcggccgccgctccgcccgcatcgcctactgcggcctcttcgcgctctccctcttcgcatcctgggcgctccgcgaggtcgccgcgcccctcctccagtcgatcccatgtgcgcggcgctgacccgaatcccccctactttccctcggttcgattcgtcggttcagttcatcgaaacattcatcgagacctctctctctgtttccgcagggattaaccacttccacaagacccccgaccgcgagtggttcgagaccgacgcggtgctcagggtcagcctcggcaacttcctcttcttcaccatcctcgccgtcatcatggccgggataaaggaccagaaggacccccgtgacaagatccaccacggcggatggatggccaagatcttctgctgggtcgtcatcgtcttcctcatgttcttcgtgcccaacggggtcgtcagcttctatgaatctatatccaagtttggctctgggctgttccttctcgttcaggttgttctgctgttggattttgtgcacggatggaatgagaactgggtcgccaaggatgagcagttctggtacatggctctgttggttgtctcggttgtctgttacattgccacgttctgtttctcgggtctcctatttcactggttcactccatctggacatgactgcggactcaacctgtttttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacattgggactccttaccacggtcctctctgtggtctattctgctgtccgcgctggctcctctgcaactgtgctctcgccaccagactcaccacgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggctggtcaacttcggttggtgagagcggaaagcttgtggatgttgggtggccatctgtctgggtcaggattgcaacccagtgggcgacggcaggtctgttcatatggtcgcttgttgcacccgtcctctttcccgacagggaattctaagttcaaccacggtaagcctggagcatcaaacgtgtctactgtggtagctaatatatcctatcaagtatgttgcctttaaaacatgctccgagtcggtgtttgcccactgttatcaagtttgtctacttaataacatgtgactttaggcattgtgccactatcttaacagtgaacgtgtgctgcttgtattgtgtatatactggagaattttaagaatgcatcatgcgagcgtgttgtgtatcaaaaaaaaaaaagagaaaaaaaaacgcgggggggggccgcctaccc

SEQ ID NO: 7258 - DNA, 1788 bp, Zea mays
gcacgaggcccctttccgtccgcccgtctcgtgcgtgcacccgcgacccattgcgtccctcgcggccggcccccatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccacttccacaagacccccgaccgcgagtggttcgagaccgacgcggtgctcagggtcagcctcggcaacttcctcttcttcaccatcctcgccgtcatcatggccgggataaaggaccagaaggacccccgtgacaagatccaccacggcggatggatggccaagatcttctgctgggtcatcatcgtcttcctcatgttcttcgtgcccaacggggtcgtcagcttctatgaatctatatccaagtttggctctgggctgttccttctcgttcaggttgttctgctgttggattttgtgcacggatggaatgagaactgggtcgccaaggatgagcagttctggtacatggctctgttggttgtctcggttgtctgttacattgccacgttctgtttctcgggtctcctatttcactggttcactccatctggacatgactgcggactcaacctgtttttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacattgggactccttaccacggtcctctctgtggtctattctgctgtccgcgctggctcctctgcaactgtgctctcgccaccagactcaccacgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggctggtcaacttcggttggtgagagcggaaagcttgtggatgttgggtggccatctgtctgggtcaggattgcaacccagtgggcgacggcaggtctgttcatatggtcgcttgttgcacccgtcctctttcccgacagggaattctaagttcaaccacggtaagcctggagcatcaaacgtgtctactgtggtagctaatatatcctatcaagtatgttgcctttaaaacatgctccgagtcggtgtttgcccactgttatcaagtttgtctacttaataacatgtgactttaggcattgtgccactatcttaacagtgaacgtgtgctgcttgtattgtgtatatactggagaattttaagaatgcttcgtgcgagcgtgttgtgtatcaaaataaaaaaaaattggtggctgtgtctgcggacttaatcttttgctaaaaaaaaaaaaaaaaaaaaaaaaaaaaaa

SEQ ID NO: 7259 - DNA, 1841 bp, Zea mays
actgcaagcggactcggtctccttatccggtccaacccatccggctccatcggcacgccgtccgcccctttccgtccgcccgtctcgtgcgtgcaaatccacctccaccccctccttccggctttccccatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccacttccacaagacccccgaccgcgagtggttcgagaccgacgcggtgctcagggtcagcctcggcaacttcctcttcttcaccatcctcgccgtcatcatggccgggataaaggaccagaaggacccccgtgacaagatccaccacggcggatggatggccaagatcttctgctgggtcatcatcgtcttcctcatgttcttcgtgcccaacggggtcgtcagcttctatgaatctatatccaagtttggctctgggctgttccttctcgttcaggttgttctgctgttggattttgtgcacggatggaatgagaactgggtcgccaaggatgagcagttctggtacatggctctgttggttgtctcggttgtctgttacattgccacgttctgtttctcgggtctcctatttcactggttcactccatctggacatgactgcggactcaacctgtttttcattgtcttcacgttgattcttgtttttgggtttgctattgttgctctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacattgggactccttaccacggtcctctctgtggtctattctgctgtccgcgctggctcctctgcaactgtgctctcgccaccagactcaccacgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggctggtcaacttcggttggtgagagcggaaagcttgtggatgttgggtggccatctgtctgggtcaggattgcaacccagtgggcgacggcaggtctgttcatatggtcgcttgttgcacccatcctctttcccgacagggaattctaagttcaaccacggtaagcctggagcatcaaacgtgtctactgtggtagctaatatatcctatcaagtatgttgcctttaaaacatgctccgagcgtggatggcaaaaagtcggtgtttgtccactgttatcaagtttgtctacttaataacgtgtgctgcttgtattgtgtatatactggagaattttaaggatgcatcatgcgagcgtgttgtgtatcgattgcttggtggctgtgtctgcggacttaaatcttttgctatgttgattatctcttctgattgtgagtttgtgttgcagtagcaaaaaaaaaaaaaaaa

SEQ ID NO: 7260 - DNA, 1122 bp, Zea mays
gactccatagggcgattgccctcgcccgacgccgttgccgagtttgtgcacggatggagtgagaactgggtcgccaaggatgagcagttctggtacatggctctgttggttgtctcggttgtctgttacattgccacgttctgtttctcgggtctcctatttcactggttcactccatctggacatgactgcggactcaacctgtttttcattgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacgttgggactccttaccacggttctctctgtggtctattctgctgtccgcgctggctcctctgcaactgtgctctcgccaccagactcaccacgtgggaccgacaagccattgcttcccttcagcaaggcagacgaacaagaagataagaaggatgtgccgaggccggtgacatactcctactctttctttcacctcatcttctccctggccagcatgtactcggcaatgctcttgactggttggtcaacttcggttggtgagagcggaaagcttgtggatgttgggtggccatctgtctgggtcaggattgcaacccagtgggcgacggcaggtctgttcatatggtcgcttgttgcacccgtcctctttcccgacagggaattctaagttcaaccacggtaagcctggagcaccaaacgtgtctactgtggcagctaatatatcctatcaagtatgttgcctttaaaacatgctccaagcgtggatggcaaaaagtcggtgtttgtccactgttatcaagtttgtctacttaataacatgtgactttaggcattgtgccactatcttaacagtgaacgtgtgtgctgcttgtattgtgtatatactggagaattttaagattgcatcatgcgagcgtgttgtgtatcgattgcttggtggctgtgtctgcggacttaaatcctttgctatgttgattatctcttctaattg

SEQ ID NO: 7261 - DNA, 1400 bp, Zea mays
cccggtcgcccacctccggctggcctgcttgcacctttgcactgcaattttgccaatctccctttaagaagaaaccaatggatttctcagcttaaggagccatatctggacagataccgataataaccgtgcagggatgctcccttttgtctttgacaactcatttgggtttgagcaatatgtggattatgcattagatgtccccatgtattttgtgtacccgaaataataagtatattgactgcaccggaatgtcatttcgggattttatgcaaggaaagctccgacaagctcctggggagttgcctactcttaatgattgggagaaccatctaacaacaatttttcctgaggttaggttaaagagataccttgagatgagaggtgctgatggtggcccatggaggagattgtgtgcgctgcctgcattttgggttgggctgctgtacgatgaggaatcattacaaagcattttagacatgacttttgactggacacaggaggaaagagagatgctaagacataaggtaccgttgactggtctgaagacaccatttcgcgatggatatgttagagatttagccgaggaagttctaaaactggccaagaatggattggaaagaagaggatacaaggaggtcggtttccttagagaggttgacgaagtggtgaggacaggagtgacacctgccgagagacttctgcatctgtacgagacgaagtggcaacgcaacgtcgaccatgttttcgagcacttgctatactgacgttgtagatgtaccctagtacaaaaatctcatctttgattcattcaacgccttgagtgggagggcacaggaacacatcttttggttaagttgctgaccgggggaacagctacccggtgctgcgtgcggtgcctacaaataacttcgctcgggacggatcactactctctagggagatggaacaaatcactgtttgtaccggccctttttgtttctgttttccttcagagatggagatgccgtatggaaaataagtccatcttctgtacgatgggaactgtttgttttcccgcctttcctttcagcattgttgggatgtttgtcccgtctcccgtgttaacatgcaaaatcaattacgtgtacgataaataagctgatggtttgatccggaattgtcacgaccctacacgcaatgcatagatgctgacaagacaacaagagggcaggaaggaggatagagggatacagctgtaagttgctggcatctagctgtaataactgattagatctgtcatctagctgtaatccagctgtaataactgattagcagttagagccactttggatgctataaatctgagcaattgtaatggagaaggcatgaatgaaataaaacagaaatccagcaccatc

SEQ ID NO: 7262 - DNA, 1752 bp, Zea mays
ggcgcaaatatacttgttgataacaaaggttgcattaagctagcagattttggggcatctaagcaagtagaaaagttggcaactgcaactgctgccaagacgatgaaaggtaccccatattggatggcaccagaagtcattgttggaagcggtcacaattgttctgctgatatctggagtgttggttgcacggtaattgaaatggcgataggcaaacccccatggagccatgaatatcaagaggtttctctactttattatgttgggacgacaaaatcacacccacctataccagaacatctctccacagaagccaaggattttctgttaaaatgcttacagaaggaaccagaaatgagatctgttgcatcagacttgttgcagcacccatttgttacacgagtattggaagatttttgtcagcttaatcatgctggacccaaggaaacctccaaaaatgagcttccttcctatgtagtgcctactgttgactcggacttgagtcgccctggcaagctacgcaatctgaattcttacaagttatcagacaccaggccattatgggatcagcgatgtaatgatgatgatatttgtgagtttgctgacgaagataatgtcccaatggttggatctagcttcaatcctatgtctgaaccatctgatgaatgggaaaacaaacttgacataagcccagaacaacaatttagtcagtcaagggagtttggtggactagccaaacttgcagaaagtcagatgtctgaaaacgattttactttcccttgtgagggaagctgtgaagaggatgatgaatttacagaatcaaaaataaaggaatttctggatgaaaaggccacagatctaaagaaactacaaacacctttatatgagttttacaacacagtgaatgctggagtttctcaaggagttagtgatgtttgccgagcaaacaatgtaactaatccccagttaccccctcgagcaactaagatggtgggaggtgcagctttagagcccatttgtgttaatctgaaaaatgtcaatcccaagagttgcacaaggcgcttctcaagaggcagcgtggagagcaatcatgtcttgagagaaatagcttcacctgaactcaacatactcgaggacaaggtccatgatgatagtgaagatagtccaagcttgagcttttcggaaatacagaggaagtggaaggaagagttggaccaggaacttaaaagagagcgagaaatgaggtcgggtggctatggtaaagcaccatcaccgtcctcaacgagccggagattgactggaaaacgagatcgcagtcctgtgtattgagtagagaatcagaatacaacacagcaggactcgtatatttgactaaccgcacagtgtcatcgattggtggccattgctagtacagtgcagtgccaaccttcgtatgacctgacagaacctacttgacgaccaaatccttttggtccttgtaaggtaaattaggttgagcgagccacttgtaagcgcactgtgcatcggaggctatcatgatctgcgatgcctgccttcgcagccctttattgccagcatgaaatcattggggtggcgatttttatgcaatgttcaagcttcatgcaattttggatgacaataggtgcatgttgtacaattgtcttctctttatttttcaaatgtttgtaagtttacctgatgaccgagaatccataattcgttgaaccaaaagtatggaagtgttcgtctcgt

SEQ ID NO: 7263 - DNA, 970 bp, Zea mays
  misc_feature (949)..(949): n is a, c, g, or t
cattgggtccctcgaggccggccgggccctttcgctcctctcgccgctttgggttggggtttaagcgcgtgtaagggaggccggaggcgacgacgacggcgccggcgtcggagaagaagaagcagacaactctcgtatatgtcttcttgccccttttccgatctggtggtcgtagcgctcatcatcgccgtcgtcgccgtcatcctccgcgccctcgcttgctctggccgatctatgcgcaaggggctcaacggctggaacaaatcctcgtcgatgctcagggacgggttcggggtgaagtattccggattcctccacataaggccgtgcggcttctgtagaggagattgacggattcggccgatttgcgctcgtctccgtcatttttttttgcacccagagtttcttgtttttctttagaagttttccccccatagttttggcaattttggcgacaagttttggagttctccccgtcggaagagatagaagagagatgtctccgttgaaccagcaacaggttctcctcaagaaggccctggcgaagaagcccaacgctaagaagatgtctgagtttggccttaaaccctctgctgccctcttgaagtcccggacgcagcagctgccggcgccggtccagccgaggcgccgcgtccgtgtcctatttgaggaccccgacgccacggactcggactccgactcggacgacgaggaggccggcggcaccccatcaaggaccaagcgcttctcttttgaggccttcatcggcaaggccccagccaagccggttctcccggccggccgctgtggccgcgtgcaccaacggcggggcgccggagcgctaccgcggagtgaggctccgcaagtggggcaagtgggcggcggagatccgcaacccgttcaccggcaagaggcagtggcttggcaccttcgacaccgctggtgcggnctccgcggcctacctgtccgc

SEQ ID NO: 7264 - DNA, 811 bp, Zea mays
tggggctcccctcgccggccgggcccttttgctcctgtcgccgctttgggtcggggtttaagcgagtgttcagggaggccgggacggaggcgacgacgacggacggtgccggcgtcggaggagaagaaagaagaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcagggacgggttcggggtcaagtattccggattcctccacatacggccgtgcggtttctgtagaggagactgacggattcgtcctcaaggccgtgccgtttctgtagaggagactgacggattcgaccgatttgcgctcgtctccgttatatttttgcgccagagttttttttgttttttttcttcagaagcttttccccgtagttttggctggagttctccccggcagaggagatacaagagacatggccccgttgaaccaccagcagcatgttctcctcaagaaggccctggcgaagaaacccaaagctaagaggatgtccaggtttggccttaaaccctccgctgcagccctcctgaagtcccggccgcagcagccggcgcctgccccggcccagccgaggcgccgcgtccgggttctcttcgaggatcctgacgccacggactcggactccgacgacgagggagggccggcgcctctacgtgcccgggcgaaggccaagcgct

SEQ ID NO: 7265 - DNA, 1288 bp, Zea mays
ctgcaggggccagcagcacccctgggtccacgagtcatcactgtgtgcgtaacaaacagccttggcagatccctagtacgtccagcgccagcgcatcgcggccgtcctctcctcccccctttccgttaggcagataatcttccaatgacgcgtgggtccggacaagcttcgggccgtttcggcagtgtgtggagctggatcgggacgcgtgacgcgaggtatcgcgttgtgcggcgggcggggcgggcggtacaggatggggaagaatgggggattaataaatatcggcggacgaggggcgtggcctgccccttttgctcctgtcgccgctttgggtcggggtttaagcgagtgttcagggaggccgggacggaggcgacgacgacggacggtgccggcgtcggaggagaagaaagaacaagtagccagctctcgtatatgccttcttgccccatctccgatctggtcgtcgtagcgctcatcgcccccgtcgtcgccggcctcctcctcctcctcctccgctccctcgcctgctccagccgatctatgcgcaaggggctcaacggatggaacaaatcctcgtcgatgctcaggtccgtgccccccgctctctttttcctccgtgttttcgccgatctgggaggtttttgaccgggttttgtggccctgttcgtccagatctggggagttcgtggctgctccttccatgggttttgacaaaaaaaaatctgctcttgtggtcgcagggacgggttcggggtcaagtattccggattcctccacatacggccgtgcggtttctgtagaggagactgacggattcgtcctcaaggccgtgccgtttctgtagaggaggctgacggattcgaccgatttgcgctcgtctccgttatatttttgcacccagagttttttttgttttttttcttcagaagcttttccccgtagttttggctggagttctccccggcagaggagatacaagagacatggccccgttgaaccaccaccagcatgtcctcctcaagaaggccctggcgaagaaacccaaagctaagcggatgtccaggtttggccttaaaccctccgctgaagccctcctgaagtcccgtccgcagcatccggcggcccagccgaggcgccgcgtccgggttctcttcgaggaccctgacgccacggactcggactccgacgacgaggaggccggcgcccctacgagcccggcggaggccaagcgcttctccttcgaggcgttcgtcggcaaggtcccagccaagccggtcctccc

SEQ ID NO: 7266 - DNA, 541 bp, Zea mays
cttttcgctcctctcgccgctttgggttggggtttaagcgcgtgtaagggaggccggaggcgacgacgacggcgccggcgtcggagaagaagaagcagacaactctcgtatatgtcttcttgccccttttccgatctggtggtcgtagcgctcatcatcgccgtcgtcgccgtcatcctccgcgccctcgcttgctctggccgatctatgcgcaaggggctcaacggctggaacaaatcctcgtcgatgctcaggtccgcgcctttttccttttcctttcaattttcagccgcaaaaggttcatgctttcatcgatctgggtggttttgaccgggttctatggccctgttcgtccagatctggtgatttcttggctgttctttccatggggttttgacaaaaaaaatcacttgtgatggcagggacgggttcggggtgaagtattccggattcctccacataaggccgtgcggcttctgtagaggagattgacggattcagccgatttgcgctcgtctccgtcattttttttgcacccaga

SEQ ID NO: 7267 - DNA, 3048 bp, Zea mays
tgcagagacactgacatgatggccccacaccgcagtcagggtcggaacggcgcactcgcgaacggaacggggaccctccctctccctctcgctccctcgggcccctcgccgccctcccttctttgccccggaggcgtcaccagagcattcgtccccttcgcctccgcctcgccgccaccacgcccccgccgccctatcccaccctcccccccactctctcctcgcatggcgacagccccttgccggtagccctagatccagacatccctcgcccacgcagcaacagccctcctccctcccacctccatccatgcccatggacgcggggaatggctgcagtgcccgggcgctggtggcgtgcgtcatcggcagcatcgtgctgggcgcctcggtgctcgcgctccacctcgcgggcgggcctgccgccatcccgcacctgcccctgcctccgcttttcggcacgctccgccgccgccgccgccgccccgtgcgggtctacatggacggctgcttcgacatgatgcactacggacactgcaacgcgctgcgccaggcgcgcgcgctcggggacgagctcgtcgtcggcgtcatcagcgacgacgagatcaaggccaacaaggggccccccgttacgccgctccacgagagaatgataatggtccgtgctgtgaaatgggtagatgacatcattccagatgcaccttatgccataactgaagaattcatgaacaagctgttcaatgagtataacatagattacatcatccatggagacgatccttgtttgctaccagacggtactgatgcatatgctcttgccaaaaaggctggtcgatacaagcagattaagagaaccgagggagtgtcaacaacagacattgttggacggatgcttctttgtgttagagagagatcatctgatgcacataatcattcttcactacaaaggcagttcagtagcggacatggtcagaaagtcgatgatactggatctggaactggtacaagagtatctcatttccttcccacatctaggcgaatagttcagttctcaaatagcaggggtccaggtccagattctcgaatagtttacatggatggtgcttttgatctgttccatgctggacacgtcgagatattacgacttgctcgagaacttggagattttttgcttgtggggattcacacagatcagaccataagtgcaacacgaggacgacatcgcccaatcatgaatctccatgagcgaagtttgagtgttttggcttgtcgttatgttgatgaggtgatcattggtgctccatgggatgtttcaaaagacatgattaccacattcaatatttcgttagttgttcatggaactattgctgaaaacatggactttacggaggatgatttacacccatatgctgttccaatggctatgggcatttaccgccgactggagagtcccttggatatcactacaagtacgatcatcaggaggattgttgctaaccacgaagcctaccagaagcggaacgagaagaaggaagcaagcgagaagaagtactacgagagtaaaagcttcgtcaacggggagtgaagttacgagtagcagaacttggatgaagattgctgcctagaccgtttagcaactgcaacagttgggcgatctacagactacagccgtaccttttcttcggtatctttgatgttccgctgacatagcttaggaagcatgagccaatgactaggcagaggagatggcgagtctaggagcatttccatcgtttccctagcgtcttcagccaattccctgcccccgctgtattgtatgtatatgcgccttccagctgagttgcatttgagatctataggcttttccacccattgaaactatgcgccacagtatgaaaaccctgaatgttagcgtggttgacaactattcgctgctggtgtttctttcccgtatgcgctggcaggccagtcattttcttgaaaatctggttgggttccgctgtgttgctgaacttgaatgaacacatggactgtccggtgttggcgatggcaacagcgactgatggtacacctggacggctgtccggccggctggctggctggatgaaacgaacgtgggttggtgacacgttgggatctgatgatacgatatggatctgtgaattaactgctgacagatggttgccgccgatctgctgcaccttgtcgcggatggaaagagatgtgctacctgtgatccgcgcgcacatctggtgctggggctgctcgtgcctgctctcttgtgagcagcatttactgtagtctgtccactggacgctgacgggtttgcttcgccaacagacatttgttttcgccttgtatcttggattaaaacgctcgcgtcctggttttcggagtgcttcttcatcgtctgactcacgcgtggccacggttgagtcgataggctccgcctccgtttgtttcttctgtttgggtaatcgtttgtcgtttcccttgggaaggtacagagtattgcaccctcgtcccgcaccttccctcctctttcccaacagcattcgtatagataaaccaaagataaggaatagcaatctgacgaaaaatgcacccgcacggccacacatatgtatcaattgttttcacttatatatatatatataggcgtatagtttttatggttattcattcgttcagtcaacgtcggtgcatgttgtcattttccaagtgatttatatttttttcaggagaaaataaactaatttttttgtggaaaatgaaattctcttaaaaaaagttccaagactagcatttaaaaaaatataaaccatgccagttgtcctgttaactgtaacagcagattgtttttgtgtgttcgttcgctgtttcgatgagcgactgaacgtgcagtcaatcaaaggctctccgcctgatccttgccatgtgctttcgcccgtcatgcgtgctaggtaaaggccttttttttcactttgatcagcaacagcacgcccctaaccaacttagctttgctccttgacactgctgctgctgcag

SEQ ID NO: 7268 - DNA, 4038 bp, Zea mays
cataaaaaatattagcattaaatttgatacatatctattttagaatattaaatttatcctggatactactctcgtccttaaagtaaggtctataatttaatactctctctatccatgattaagtcagtccctgtagttctcttatttaatttttaatgttgatttaaggcttgtttggatgccagaagttaaaggaaactaactaaattttaactcgtctttggagtaaaagtgactaaaataataacttttcaccattccagtcacttttagctctttctgtttggatctatagagtaactctagtattctctgaaagactctctaaattaataatttaggtagttaacctaaaaactcatctccaacaactctctaattgaactttctaaatttagttactttctatctaatatcattttctctctacattgggtaaccatttatcaacaccataaacaaaaaatggctgcattatgtagatgatgaaggtgattgttcatttgtgacatatttttgtcgtggatatattcaaaataaaactacaacctatatttagagacctattaaagaattcagaattttttacttccaaagttatttagtaactccttaaatctgtgaatttgagagctaaagtttacttaactgctgctcttagctcctaaagtggctaaatagatcctatgatcaaacaatatagttaacatttttttgtttcaaattctttttagtaataatacgtagtacatcgacctacactatacacctacgtggccggcggctcaacccaattatcacatgcgtgtgcggctgtgcgccgccgctacactcgccggcgacgagccttcgtgtcggctcagagaaacagacagacatgcagagtccagaaatccaacagagaaaacagggctccgacccactcgcgcgctggctcgctggcaccgcgcgtccctcgccacctccgcaccgccgccgcgctcgccgccgcggtgcagggcctcatcgacgcgtcccctgcgcggggcgagtcgcagaccatccacgcgcagctcctagcgtcgggactcgtcggcagtgccgacctctctgtcaagctcctcgttctgcacatacggtgcggctccctgcacaatgcccgcgccgtgttcgacggaatgccgagccggagccgcgccgcgcacaactacctcatcgcgggatacttccggcggggccgccccgcagaggcgctggggatcttgcggcggctcgcggcgtccacggggcggctggacgtcttcgcgctgtccatggcgctgaagctgtctgcggcgctggctctgcccggcgtcgtcgccagggaggcccacgcgcgcgcgctgaggtccgtcgaacagtccgacgatatcctgttcgcggccctggtggatgcctacgtgaagagcgggttgcttggctacgcgcggcgggtgcacggcgcaatgcccgtgcggagcgtcgtgtgctccacggcactgctcgtcgggtgcatgcaggaagggctgttcgaggacgctgaggcgatattcaacgagatggaggggaaggacgtcgtggcgtacaacgccatggtggaggggtacagcaagacggaagagacggcggagggctcgctcgaggtgttgaaggcgatgcagcgagcggggcttcgtcccacggtatcgacattcgtgagcgtgctcggggcctgctcactcttgtcgtcgccagagctcggcgagcaggtgcattgccaggggacgaaaagcggcctagtcttggacatcaaagttggaagcgctctggtcgacatgtatgccaagtgtggacgggtggaagacggccgtaggatcttcaaccagatggcagagagaaacgtgattacctggacttcgatgatcgacgggtatgggaagaacggcctctctgacgaggccctccagctgtttggcgaaatgcgggagcggcgagacgtgaggccgaaccacgccaccttcttgagcattctgtcggcgtgcgcacacgctgggctgctgtcccagggccaggaggctttccagagcatggagggtgagtacttgctgcagccacggatggaacactacgcatgcatggtggacttgctgggtagattcggaggcgtgcggcaggcctatgatttcgtccgaggtatgccggtgaggccaaactctgatgtgtgggctgcgctgctcggggcggctacactgcacggggatatggacatctgcaaagttgcatcgagggaggtcttcgagctgagccgcaaggggagaccgggcgcctacatggcattctccaacacacttgcggcagctggggagtgggacggcgtgcacgacgttagggagatgatgaaacagcgaggcgtgctgaaagacactgcttgcagttgggtcggttctgagaacccgccactcgtcgactgatgtacaggtagagtttttacctacccataccatgtaaagtttctcctgtaacagcttcatgctagaacatgtctctgaattaaccaatagagttagcttattacagcttcattcttcacaacgctaataatgtgttcaatgcaatacaaatatcgaggacatcagtaactcttgttgcttttgtactagaacacatgtctctgagttaatcaatagagttagcttaagcatggcttctgtaggttttattgcctgaaatactttagaggatcaaatttgcaagaaaccaggcccaaaatctccatgccacttatcagccatcatttgaattcctgaagtaatagtttttaggtgtaaaatcattgtgctgcagattatcagatctattgaatttgtgtagattaggaagaatgcgtgaaaaggatctttagctgagttggttatgtggtctgagtatcaattctcaggtcctgagttcgaatctcagtaagagtgaatttcagaccgatgttaaaaaatgacctatgaaggtggatccttgtgtaggggttaggagggttcaaagcacgagtaaagatctaacctttagagggtgaaccctcgtaagaaccaactttcatggcatttctcagtaggggtttcgattgagcttcttcgtaccgtgggggcggtcttttcctctactggccgagtttttttaattagaaattatgcagttagtaaaactatactaatttgttgtgctaattagattaaggaacccaaaaatccaacactgtactttcgttttttctaaattcatttcattattaaatatgtttgcttgtaccaattctaggaacgtttacggttgataagagtgaacgcagacacaaggcaccagagagaaccagaacagttatgaagcatggacaagttgtcttgttctaattattggaatatatgtagttttccatttatcaaacgcttcaatcgagtggcgcaccgacaatcaaggccagtgagatgtcttttctggattacaaaagtcgataagcaggtcagcatatgtactaggcaacaaagtacggcttctactctttgagaaaccccatgtgcttcacttctttctctctccacaagcttgcacctgtgtcctaatttcctattgcttccatctcctgcatttttatattgcatttatctgttttttattttctattgcttagattttatctgtttgtacatcttgtgatcatgtgtgggagagaaatttgacacatcctcttcacaacctttgtgacaggtgttatttagaatggtggacccatgctgtctaattgtttccttcctcgtagaggataatgcaaatatgctgatcgcaatggtgcccgcgcggccgaattttatcttctgctgaccgagaaacattccatgttttgcatttggaatgaacaaatgtggaggtttggaagtgcaaaatatctgaacactagaaagcaaactgaatgcagtgatatattttctttccgtggattattttaatcatgaataaacgacatttttgtctcttcaaaaaaaaaaaaaaagaaaaagaatatagagaagaaaa

SEQ ID NO: 7269 - DNA, 3487 bp, Zea mays
  misc_feature (2144)..(2144): n is a, c, g, or t
  misc_feature (2457)..(2457): n is a, c, g, or t
  misc_feature (2608)..(2608): n is a, c, g, or t
  misc_feature (2750)..(2750): n is a, c, g, or t
ggttttcagattgacatgttccagattgacgtgaatgtaatgttttcatctgtcataactcataaccactcagtttcgttgttaattttgtgccataactcaaacactcggtcccgtttttagttttgggtctgttaggttggcttttaatttttacgcgactataatcatgtcaaaccaaaatagaccgtggcttggtgtgcacgtgatgggctgatggcgttggcgtgccgggccgtgccgcgctccacccaacataatcacacgatccgcacccaagaccaaacacatcatcatgctagttcctcacctgcaactgcaagtctgtcaccccgctcacgggaccagatcgcagtgttgtatacgctatatatttcgcggcatagttgcgtagctacagtatttcatcaattatatttatagcgcgtgcaaatcgttatgatactagtattgaccatagcaagaaatcgtgtgttatataaaggaaaaaatataatagtggaattagaatgaataaaatatgtattaatagttgatatagaaggaatatatatatagcggtagtgtggaaaattataatataaagtaaggaatcttgacgactaaaggattatagatcaaagatatggcactgaggatagcctcacgggcggcggctcgcgtgtcccgccagctagccgcacactttcctctctttcagtttcgcttcgcagacttcgcttgcgcttcacccaaccttaaccgcaacggttcccgtgcggagtttttattatgaatgaatgaatacgaattcagagcacgagcgccgttgattggccgctactagtactaccagctaggccactgctcctctgctacccgctaacctcgcgccggagtcgtcgcccacgatggcctaccgatccgcagtgctcttgcccgccctcctactggccgtcgccgtcgtcgtggcctccgccgccgccggggacgggaggtggcgggaggagcaggcgcgggaccgggtgccgcgggtgccggggcaggccttcaacaccagcttcgcgcagtacgccgggtacgtgaccgtcagcgagcagcgcggcgctgcgctcttctactggttctttgaggccgagaaggacccggggtccaagcccctcgtgctctggctcaacggaggtgcgtgcgctacctacctacgtacccataccttatcacccgcccgcctgctgcgtgcttcgcttcgcgatccgtttcgtactgtgatgactgtttgggtctgatgggtacttgggggagatctgtggactaatcatctgattgaggttgcgggggatcgggcaaccaaggattttcggacttcggtgtaggtgacctgtggtctccagcttgttttttaacaggggagccgagagtgatgccttgcgtgcgctgtgtgtacatgcacagatgcttgtggtaccctcattcttgccaggactaggatttagcttgggggccgtaagtttagatcaagtattaaatatactctaattacaaaactaattacatcgatcaagattaaactttaatagaaaaagagagagacgaggattaaacgacaagacaaatctgttaaaactaattagtccatgattcactcatgtgatgctacaataaacatttacttatcatatgttcatttgtgtaattagactacatttaaacatcctatgtgatactaactaaactttagtaaaggggtatccattgtctggatagctcttttaattttcacccaactctctctctgaatgacgactgtgcaagcatgcaagcaagttggatctctagatcgtgatctaatttgtcgttttttaataaagctacatgagttggtggtcgtgagcattagatttaagctatatataagtagaactttttttttctcaaacacgcaggagacctgcttatcatttcataaatagaagaaaacagaaagaaaaaggacaggtccacagcccacacacccgaaagctaacaacatggaaaggcccttggccccagccatacaccacagagtgtggtcgtcgtcggccaaccctaacacactatacaaattaggagagatccccttgaagacgcaatcgttgcggtgttgccaaatatcccaagctccaagnatcaccagcgaattgaaaccaatcttgcgaggaccatcacctagatcgacagagctgctccaccatatataagtagaactagtaggcaacaggttaccattgggttattggtagacttatccggtccatgatatgtttctctttactgaagttcatctgttgtacggtagcacaatatatcagttaaattacttcatgtaaatctttcagggcctggatgctcgtccattgcttttggacttggagaagaagtaggacctttccatgttaacgcagatgggaagggggtccatgtcaatccttattcttggancaaaggtaccatccaattaaacaaatatgttcacaaacaatactactgttttccgtttttaatttctgcatgtgttgttatgtgttttttctttgcacttttgtttccgatctccacggattgttggattgttgatactgtcagtaaattntattttttttctattatacaactaacctcagttaggcagcagtttactacatttcgcagtagcttagcattcttagcctttgcttttttgtgaagcaaactggtaggcttgtatatacaatctgggaaggatcacaactgtnaaaagatgaacatgaaaaaaagaagaaagaacggtttttcgagtatgcctgccaactaattttttccctggattttaatctttccttaagctcaaccttattagcacaaattcttgcctttagtcgtggagttgatttcagttctgttagatgcaaagtgcaacttgaccattgattcatgaaccttttctaagttctgataaccatattggataaaactcttgttccattctttttagaactttcctttttagcaaaactgttaagatttttctatagctaagcttacatggtctttttttcttcttcttctatcgaacaagtcaggatagccgtgtgacatttgatacaagaaaaagagtagcgtatcagttcttatacactgtttaacccacctttatacttcattacttcaaggacagatctgttaataacgtctttcgttttgcagttgcaaatttactgttccttgattcacctgttggtgttggttactcatattcaaacacctctgatgatgctttaaaaaatggggatgcaagaactggtactgtagtccctgcactattgtattcctggccctgaaagaaattttattagaattttctcactggttctctcaatattttacagccacggattcattggcattcttactgaagtggcttgaacgctttcctcaatacaaggaacgcgaattttatttgacaggggagagttatgctggtgtgtacctt

SEQ ID NO: 7270 - DNA, 1107 bp, Zea mays
tgtattcggcacgaggtttcacccacgcgtcccgcttcgcagacttcgcttgcgcttcacccaaccttaaccgcaacggttcccgtgcggagtttttcattatgaatgaatgaatacgaattcagagcacgagcgccgttgattggccgctactagtactaccagctaggccactgctcctctgctacccgctaacctcgcgccggagtcgtcgcccacgatggcctaccgatccgcagtgctcttgcccgccctcctactggccgtcgccgtcgtcgtggcctccgccgccgccggggacgggaggtggcgggaggagcaggcgcgggaccgggtgccgcgggtgccggggcaggccttcaacaccagcttcgcgcagtacgccgggtacgtgaccgtcagcgagcagcgcggcgctgcgctcttctactggttctttgaggccgagaaggacccggggtccaagcccctcgtgctctggctcaacggagggcctggatgctcgtccattgcttttggacttggagaagaagtaggacctttccatgttaacgcagatgggaagggggtccatgtcaatccttattcttggaacaaagttgcaaatttactgttccttgattcacctgttggtgttggttactcatattcaaacacctctgatgatgctttaaaaaatggggatgcaagaactgccacggattcattggcattcttactgaagtggcttgaacgctttcctcaatacaaggaacgcgaattttatttgacaggggagagttatgctggtcactatgttcctcaactggctcaagccataaaaaggcaccatgaggctactggtgacaaatcaattaatctaaagggctatatggtaggaaatgctctcactgatgatttccatgaccactatggaatatttcaattcatgtggactactggcctgatctccgatcaaacatacaagctgctgaatgttatctgcaactaacaagtccttcgtgcattcgtctccacagtgtcataagatcatggatattgctagcactgaacctgaaaacattgcttcatataacatcttcacaccctacatgtcatgcatctttt

SEQ ID NO: 7271 - DNA, 2310 bp, Zea mays
  misc_feature (2246)..(2266): n is a, c, g, or t
  misc_feature (2270)..(2271): n is a, c, g, or t
  misc_feature (2279)..(2280): n is a, c, g, or t
cattgggtacctcgaggccggccgggattccttctctcaacactccactgctcccctcctttttccttcaaatcctcccaacaccacccaggccagggagacaaccaacaaccacccccgccgcaatggacaagattgagacgacgacgaggaggaggaggaaagggagaagcagcagcagccgccgccgccagggggcacggggaccggcgggcctcgtagccacggccttggccctcctctgcgcctgcgccttctccacgcctgccgccacggctctcaccccggacggcgaggcgttgctggagctcaagctggccttcaacgccaccgtgcatcatcggctcaccagctggcggcgcagcgaccccaacccctgtgtctgggagggcatctcctgctccgtccccgacctcagggtacaatccataaatctcccatacatgcagcttgggggcatcatttcgcccagcatcgggaggctggacaagctgcagagactagctctgcaccagaacagcttgcacggcccaatccccgcagagatcaagaactgcaccgagctcagggcaatttacctgagagccaactacctgcaaggaggtatcccttcggagattggcgagctcgtgcacctcaccatcttggacctgtcaagcaatctgttgaggggaacgataccggcctccatcggaagcctcactcaccttcgcttcctgaacctgtctactaatttcttctccggagagatcccaaatgtcggtgtcctcggagccttcaaaagcagctcgttcgttggaaatctggagctctgtggcctgtccatccagaaagcttgccgtggaaccctcggctttcctgccgtgctgccccactccgatccgctctcttcagctggcggtgtctctccaatcagtaacaacaagaagaagacatcgcgctttctgaatggcgtcgtgatcggctcgatgtcaaccttggctcttgccctgatcgctgtgctcggattcctgtggatctgcttgctgtccaggaagaagagcgtcggtggaaactacgtaaagatggacaagaaaactgttcctgacggcgcgaagcttgtgacgtaccagtggaaccttccgtactcgtcgagtgagatcattagaaggctggagctgcttgacgaagaggatgtggttggctgcgggggcttcggcacggtgtacagaatggtgatggacgatggcacgtcgttcgccgtcaagaggattgatctcagccgccaaagccgcgacaggaccatggagaaggagctcgagttcctgggcagcatcaggcacataaatcttgtcactttgcgaggctactgccggctgctccctgcagcaaagctactcgtatacgatttcgttgagctgggcagcttggactgctaccttcatggagatggacaagaggaccagccgttgaactggaacgcgcgtatgaagatcgcccttggctcggctcgaggcctggcatatctgcaccatgattgctcgcctgggatcgtgcacagggacatcaaggccagcaatatcctgctggacagaagcttggagcctcgtgtctctgattttggacttgcaaagctgcttgtagacaatgccgccgcccatgttaccactgttgtggcgggcacctttggatacctagcaccagagtacttgcaaaacgggcatgctactgagaaatcagacgtgtatagctttggagtgcttttgctggagctagtgacgggaaagaggccaaccgattcatgcttcatcaagaagggactgaacattgttggctggctgaacaccctgacgggggagcaccggctggaggatatcgttgacgagcgatgcggcgacgtcgaggtggaagccgtggaagccatcctggacatcgcagcgatgtgcaccgacgcagacccggcgcagcggccgtccatgagcgctgtcctcaagatgctggaggaagagatcctgtccccctgcatgagcgagctgtgctacgagcagcacctggagctctgagccgaggaagcctgacctgactacgatgcagtgcatgatggatgagactgtgtaggaaacaaaagttttgtagatatgacgatgatgaaccgcgtacgtagtgtaggtgtttgtgagcagctcaaaagtaggacaagtgcagaaccaacaacctgatcggcacgttacataaaaaaaaaaaaaaaatgtctgtcttctaaaaannnnnnnnnnnnnnnnnnnnngaannaaaaaaannaaaaaactcgaagggggggcccggtacccc

SEQ ID NO: 7272 - DNA, 2297 bp, Zea mays
  misc_feature (7)..(8): n is a, c, g, or t
gccggcnncgggccgggaaaaaaaaaacctcgagcccggtccttcttccttctctcacacactccactccacgtccccctccttcaaatcctttcaacacccaagcacaaggagagagaagccgccgccgccgccatggacaatattgaggtgaggaggaggaagaagaaagggagaagcagcggacgccgccaggggggacgggtacaggcggtcctgcgcgccggcctcgtcgccatggccttcgccctcctctgcctctgctcctccacgccctccgccattgccctcaccccagacggcgaggcgttgctggagctcaagctggccttcaacgccaccgtgcagcggctcaccagctggcgtcccagcgaccccaacccctgcggctgggagggcatctcctgctccgtccctgacctcagggtccaatccataaacctcccattcatgcagctcgggggcatcatttcgcccagcatcgggaggctcgacaagctgcagagactagctctgcaccagaacagcttgcacggcccaatccctgcagagatcaagaactgcaccgagctcagggcaatttacctgagagccaactacctgcaaggaggcatcccttcagagattggcgagctcgtgcacctcaccatcttggacctgtcaagcaatctgctgaggggcacaataccggcctcgatcggaagcctcactcacctgcgctttctgaacctgtctactaacttcttctccggagagatcccaaatgctggtgtcctcggaaccttcaaaagcagctcgttcgttggaaatctggagctctgtggcctgtccatccagaaagcttgccgtggaaccctcggctttcctgctgtgttgccacattccgatccgctctcttcggctggtgtttctccaatcaataacaacaagacgtcacactttctcaatggcgtcgtgatcggctcgatgtcaaccttggctcttgccttggtagccgtacttgggttcctatggatctgcttgctgtccaggaagaagagcattggtggaaactatgtaaagatggacaaacagactgttcctgatggtgcaaagcttgtgacataccagtggaaccttccatattcatcaagcgagattattagaaggttggagctgcttgatgaagaggacgtggtcggttgtgggggctttggcacggtgtacaggatggtgatggatgatggcacgtcgtttgccgtcaagaggattgacctcagccgcgaaagtcgcgacaggaccttcgagaaggagcttgagattctgggcagcatcaggcacataaaccttgtcaatctgcgaggctactgccggctccccacagcgaagctactcgtatatgatttcgttgagctgggcagcttggaatgctaccttcatggagatgaacaagaggagcagccattgaactggaacgcgcggatgaaaatcgcgcttggctcggctcgaggcctggcatatctgcaccacgattgctcgcccgggatcgtgcatagggacatcaaagccagtaacatcctgctggatagaagcttggagcctcgtgtctccgattttggcctcgcgaggctgcttgtagacagtgctgcccacgttaccaccgtcgtcgcgggcacctttggatacctagcaccagagtacttgcaaaacgggcatgctactgagaaatcagacgtgtatagctttggagtgcttatgctggagctagtgaccggaaagaggccgaccgattcttgcttcatcaagaagggactgaacattgttggctggctgaacaccctaactggggagcaccggctggaggatatcatcgatgagcgatgcggcgatgtggaggtggaagccgtggaagccatccttgacatcgcagccatgtgcaccgacgcagacccggggcagcggccatcgatgagcgctgtcctcaagatgctggaggaggagatcttgtccccctgcatgagcgagctgtgctacgagcagcacctggagctctgagctgaggaggaagatgttgctggctgcgtgcgtgaagcgtcatggatgagactgaagtttttgtactgtagatacaacgatgatggatgagtgtaggtgatgttttgtgtgctcttagggccaatgaagaacagtaagcagcagttcgtgagtgaagaaggatcgtccattgggcgtactgccctgatacgataccggttggctgcacatgagcggccggccttgtgcctcgcttgcgaattgcaaccaaaaggctgacgagt

SEQ ID NO: 7273 - DNA, 1237 bp, Zea mays
ccaagccagaccagagatgggcaatgtgagcggtcgagcggaagacctcgtggacgccgacattgatgacggcaacaacatgcgacgtgcctcttcctcctctgcgggctacgtccggggcggtgggtcatcatcatccccgccggcgagcccgccgaggccgcattcaccgcggatgttcgtgccccagagtcctgtaactccattgcaaagagctacagaagtgtctcctccggtgttcaaccagatattgatgaatcaacagcaggaggattctgatggcccgcctcaaaagaaaattcccacgttgctcacgtgcactcttggagggaggaatatctacgtagaaggatcatgggacaactggacatcaaagaaactcgttgagaaatccggaaaagatcacaccattcttttgatgctttcatctggagttcaccgttatagattcattgtagatggagaaagaagatttatacccgaccttccctgcgaaactgacaatatgggtcagattgtgaacctagtagatgtccatgacttcgttcctgacagcgtggaaagtgtatctgagctgatggcccctccctccccggactccagctacggtttccatgttcccggcgagaaggagttctccaaggagcctcctcagctgccgtcccagctctatctcggcgtgctgaattcccggagcaccgaagaaggctgcgcgaggccgaggcacgtcgtcctcgaccatctctacatcgagaagggctggggcgcacagccgctggtggccctcggctacacccacaggttccgctccaagttcgtcacctgcgtcctgtacaaggccatcgagcggtagcctagctaaccattgctgtgctgttgtgggccggcaactatagctagccgtggtggacttggcagttcattcaggtttagaagtctctcctgcataattcgttcatctgctaaactaaagaggtgggtgcaaatccatgtgaatcttgttttttttagctgccagagcttacatattcttattattcgattgttttgttgggggataatggtaaattcgacggcttagtgccggacagtaaggatgccagtctcaggcctgctttattgcccctctgcaaatggtggagattttacgctgctgttggtctgcttattattgactagagtgatttttactactcctagcggctagcgctcgagaaaattccggaaagcccaaggg

SEQ ID NO: 7274 - DNA, 1912 bp, Zea mays
  misc_feature (214)..(214): n is a, c, g, or t
cattgggtacctcgaggccggccgggacacacagttccctcagcccctggcggcagaggctgagccggggaggcgcctccctctcccctccctcgcctcctactctcctgtctttctccaatggcggcgattaccgcgccgccggcccctcatccggcctccacctcatgccgccgccgcgcgccactcatccgcttcgccgcctcctcgtccncggcgtcgcgggcatcgccgtcgagctctggtggggcgtcatcgagcgccaccgccccggggagtacgactgggccggctacctcgagctcgccgccatggcccgacgccacggcctccgcgtgcgcgccatcctcgccttccaccagtgcggcgccggaccacatgacccgccctggattcctttgccacaatgggttcttgaggagatggataaggttccggacctgtcatataccaatagataccagaagagaaacagagaatacatatcactgggatgtgatattcttcctgttctgaaaggaagatcacctatgcaagcttactccgacttcatgagaagcttccgcaatactttcgaagattacctctgaatttggctcgtggggccatagtaacagaagtacaagttggaatgggtccaggaggtgagcttaggtatccgtcatacccaactgagaagctaaatcagccaggcagttcatctgaacttggggaatttcaatgttatgataagtttatgcaagcttcgttgagtgctcgtgcacagatttttgggttacaacagtggggcaatggcggttcaactggcacagatggttcacagcagaaccttgaagaaacgagtttttttcgcaccgatggaggctattggaatacaccttatggtcacttttttcttaagtggtattcaggaatgcttctcctccatggagagaggttatgcatgatagctgatgcaatcttctctggtactggtgtgaccatctcagggaaggttgctggcatacattggcactactatacttgttcacatccatctgaactgacagctggctactacaatacactactaagagatggctatcttcctatagctcaaatgtttgccaaatacaaagctgcattgtgctgcagttgtttcgacctgagggacacagaaagaacagattctgagagcagcccagaaggtactctccggcagcttgcgggtgctgctaaaatgtgcggccttcctcttaatggtgagaattctatgacaaggctggatgatgcatcactgaatcaagtcataagaagctcaaggctatactcaggccgtacttcaggaacatccttttcctttaactatgttaggatgaacaaaagcttgtttgaatttcacaattggaatcgatttacaaagtttgttaggcagatgtcagatgctaggacctttctagcaagactgtatgtcaggagagggcagcaatgcttgtcttcaatgtcggttgtttgggtggttagtcgggcttgtgtatatacatgaaagttgtcgaaagctactggggaaatcatgtgcttgtaatctcagccatcaatggttccaccactgtggatggaaaaggtttgctcagtatatggctcatttttagttgccagaagggcaggcaggcttatatgctgaaggctgtactgatttcatgcatatgcatgtattagtttcatgcatatgtcattgctgaacaaaagtttatagttatttgttgtaaagtggcagactggcagtgttttgctgccaacaatattgaatcgcacgagggtcctgtttagccattttagaaataattagatggagcttcatgttttcccgttacaatatgaatgctttcaaactatatctgcctatgaaaatatgtatacttcctcttgtcac

SEQ ID NO: 7275 - DNA, 4714 bp, Zea mays
  misc_feature (2473)..(2473): n is a, c, g, or t
  misc_feature (2834)..(2834): n is a, c, g, or t
aagacacttaaatttaaatctctaaagaaatcccttaatctcaaaataggattttgatgctacacgaggcgacgtgacacatgttcttcgcagccgtacaacgcactctttccagggaggattccttctccctttaggactagtttgggaaccacaaaaccggaggggattgaaggttgaataagaagcggattctagcccttccaatccccttcggtttgtggctcacaaactagctcttgagacatatttgtatcgcaggtttattataaagaaatataaggattgtttgtttttcgaaaatgtcgacgcacgacaacagtaaaaagtggttctttctagtagtactagagaaggacaatgttttaagcccgaaaaacatcaaatatatggtaatacatatctttattttgtagagagaatatgtattatcatcttgtaaaggtagatgctagtaaaccagatgtagttactagatttttatatttaatttgttgatgtgaggcctgacttgtagttgcttagttgggtgtaagtgtatggaaagatgacatgtatctgttcgacaggtgtgaaaaggtggatggtgttgacatatgtgagattctcgtagtgccataggccaccatcaaggtagttatttttgttctaataaataaaatacatcagcaacgaacacgtatgatttatatatgtatggatggatatagatggagctttgtgtataatttccgttggacccggtcctcttttggcttggctttcggcgttggttgcgaggtctccttcgtcagctggactgctgcggttgttgaattgagaattgagaattgagaattgagatttgagatttattcaaattcgttggctcgctttaaatataaagatcttgtgcgcacgcatgcggactttggaccgtataatcctgcgtatactgtatatatatatatttaccctacgacgtgcatagcctcatatatactccatatcaatcatccagaaggtcaaactctcccctgtttcgacttggttccctgctcctgccctgaaaggagttgtcttggttccctgcccctgccctgaaagcagcagttggagagtcgaatcgtccttcttctctccggcgggaggaggcgggcggtgggcggtgggcggcggcaggaccgtgatgacgagcagcagcaacaacggcggccggcccgacgacggcggcgaggtggtcctggaccacgagtaccaagaggtacgcacgtaggttatcgatggaatcggtaacacgatcgagaccccgtcgtccatccatccatggttcacggatctatcattccgctagtcgtaactaatctggtatgcatggtaggagtacgtgaggaactcgcgggggatgagcctcttcgcatgcagatggctgccggcagttgcaggcaagagggggagggctccagctccaaaggcgctcgtcttcctctgccacggctacgccgtggagtgcagcgtgacgatgcgcggcaccggcgagcgcctggcgcgtgccggctacgccgtctacggcctggactacgagggccacggccgctccgacgggctgcagggctacgtgccggatttcgacgcgctggtgctggactgcgacgagtacttcacctcggtggtggcggcggcggcgcagtcgcagtccaaggacgcccaccaacttccccggttcctgctcggggagtccatgggcggcgccgtggctctcctcctccaccgccggcgccccgagtactggagcggcgccgtgctggtggcgcccatgtgcaagatcgccgacgacatgcggcctcacccgctggtggtcaacatcctcagggccatgaccaccatcatcccgacgtggaagatcgtgcccagcaacgacgtcatcgacgcggcgtacaggagccaggagaagagggacgagatccgcagcaacccttactgctacaaggacaagccgcgactcaagaccgcctacgagctgctcaaagtcagctgggacctcgagcacaacctcctccaccaggtcaggataatccgttctagatcgatcatcttcttcctgcttatataatatattttattgcctttaatttctttttcttcatcattagtattattaattatctgtttattctcccaatacaaaatcacatgcgtatgatatgctgtggcccttcggccgttgtcatcttctcacagtattattattaatataataataacaataataataataataataataataataataataataataataataataactataacgatgtgattcacgagatatatagatgtggatggagatctaccaacctattcaacgctttcattccagttgaccaattaaattagtggcttggtccatcaccgacatgtttactaataatacggagttatcttttttaacaaggcaaaaagatcacaaattattactgctccncaaatatacagtccaatactagcacgacattcactgtacctgtatttgtcattacttaaaaaacaattatattacctgtttccattaattaggaagagagttatatacctactatgaaaacatttttttaggtatccgaggaaacacataaaaattgactgaaaacaaactctaaatcaacataggggtgtttgggtttagagactaatttttagtccatctattttatttcattttagtgtctaaattgttaaatacggaaattaaaatagagttctagtttccgtatttggtaatttagggactaaaatataataaaaatgaagggactacctttaggataggattgaggccagtgatnggaattacggtggttatattatttaaagcctctcactctcagtacacatacaaagatactttttctatcctaattaaagaacacaagtttagcatagtatcgagtcaaatcattttgagcatgattaaacctatacaaaacaactaccgattttaaagtacctgcccctcattccaactttttacgctacatcgatcatctagcatctacacgagaccctactatgcttaagttgttggtaagggtgtgatggagattggagtgggtgtggagccatgacaatggcgcatatatgtgcgtcatatactttattgaaggtgcctcctcatcccaccttgatggttctctcttgctgaaagcacaatccaatccttatccctgggacaacgacactgttggcgcgcgtcgtgaacaaccctgaaggcacattgttggtcgatgaagttacacatctgggaagctagagttttaacgtagagctgaatctattatcacaaaagtttggtaaaacaagtgtttagagaaaatagcagtgagaaagctaaaaaaatagtattcttatatatactgacaattatgacatgctgattgttgaactatgtttatatgttgcgtgcgtgcaggtgtcgttgccgttcctgatcgtgcacggcggggcagacaaggtgacggacccgtcggtgagcgagctgctgtaccaatcggcggcgagccaggacaagacgctcaagttctatccgggcatgtggcacgccctcacctccggcgagtcgcccgacaacatccaagccgttttccaagacatcatcgcctggctcgaccacaggtcacccgacacggaacaggaggagctggtgtcgtcggaggtggagcagaaggccaagcacgacgaccagcgccaccaggagcagctccaggacggcaacaaatagctagctgcttgcttgcctgctgctttcttctctttacagaacgaaccgtttcatttggtcatgcatggatacacatcatgtctcagtgatacgtaccgactaaattaaattattagatcgaccgcgcttacctagaaattaaacaatcagctgttcgacatcatatatcatcaggtcctttattaattttagactccaacgtgatgcattatatatatggtttactgcagccatccagctacatcatatacctatctacattatcgcctaatgagttagatatgaaactttacattaatgaaaaaactcgcttctattttgatagaagaggaaatctgtatattccggcgggcaaaagtgaaattaaacatctattggaggaagatgataacacaaaatacttctaattagtggtaaatggcaaacaccaaaaataaagaaaatatagtctcaaagatgataatggggtccgcatagaagaagtggggctcagaagtcacattactaactattacaaaggtcgtcgctttgggagacccgatcaaaacatgatttaaatggatgaatcgtttactcactatatcaaccaagtttctgaggcggaaaatgatatattaattgcactcttctatatagaagaggttcgggaagctattttttatatggaacataataaagctccggtaccggatggtttcccagtcaagttttatcaagttttctaggaagtcatcaagaaagatttgatgacattgttcatggatttacacaataatagtcttcttgtgcatagtctaaagtttgggatcattaccctaattcctaagaagggtaatgctatcaaaattcaggagtaccgaccaatttgtttgctaaatgtgagtttcaagataattactgaagttctctcgaatagaaccaggaagatcgtagataggtttattagac

SEQ ID NO: 7276 - DNA, 1491 bp, Zea mays
gcacgagaccattacctagaacatcctaatccaaaaatatcaatcatccagaaggtcaaactctcccctgtttcgacttggttccctgctcctgccctgaaaggagttgtcttggttccctgcccctgccctgaaagcagcagttggagagtcgaatcgtccttcttctctccggcgggaggaggcgggcggtgggcggtgggcggcggcaggaccgtgatgacgagcagcagcaacaacggcggccggccagacgacggcggcgaggtggtcctggaccacgagtaccaagaggagtacgtgaggaactcgcgggggatgagcctcttcgcatgcagatggctgccggcagttgcaggcaagagggggagggctccagctccaaaggcgctcgtcttcctctgccacggctacgccgtggagtgcagcgtgacgatgcgcggcaccggcgagcgcctggcgcgtgccggctacgccgtctacggcctggactacgagggccacggccgctccgacgggctgcagggctacgtgccggatttcgacgcgctggtgctggactgcgacgagtacttcacctcggtggtggcggcggcggcgcagtcgcagtccaaggacgcccaccaacttccccggttcctgctcggggagtccatgggcggcgccgtggctctcctcctccaccgccggcgccccgagtactggagcggcgccgtgctggtggcgcccatgtgcaagatcgccgacgacatgcggcctcacccgctggtggtcaacatcctcagggccatgaccaccatcatcccgacgtggaagatcgtgcccagcaacgacgtcatcgacgcggcgtacaggagccaggagaagagggacgagatccgcagcaacccttactgctacaaggacaagccgcgactcaagaccgcctacgagctgctcaaagtcagcttggacctcgagcacaacctcctccaccaggtgtcgttgccgttcctgatcgtgcacggcggggcagacaaggtgacggacccgtcggtgagcgagctgctgtaccaatcggcggcgagccaggacaagacgctcaagttctatccgggcatgtggcacgccctcacctccggcgagtcgcccgacaacatccaagccgttttccaagacatcatcgcctggctcgaccacaggtcacccgacacggaacaggaggagctggtgtcgtcggaggtggagcagaaggccaagcacgacgaccagcgccaccaggagcagctccaggacggcaacaaatagctagctgcttgcttgcctgctgctttcttctctttacagaacgaaccgtttcatttggtcatgcatggatacacatcatgtctcagtgatacgtaccgactaaattaaattattagatcgaccgcgcttacctagaaattaaacaatcagctgttcgacaccaaaaaaaaaaaaaaaaaaaaaaaaagtcgacgcggccgcgat

SEQ ID NO: 7277 - DNA, 1032 bp, Zea mays
aaaccaaaattccaaaaaaccaatgggctgaaagagaccctgaactatgcggcgcaatatttcgcgtagattcggtccagtatcagcccatctatggcggatgaaggaccgcgaatcggagaaaggccagaacagacgagagcaggaggacggagagcgccggcgaggaggcatggagccagacaaggccggggaggcagcgaaggagccgacggaaacggaggctggagactccgtggatccccgcgaactagtgtccagcgacgacgagatcgactactccgtcgagcctgatttctacgaccccgacctagatgacgtcgatgagcggtgggtgagcagacagaggaaaggccgcacatctgacgccgtgcttagctgccccgcctgtttcactaccctgtgcttggattgccagaggcatgagaagtacgtaaaccagtaccgtgcgatgttcgttcgcaactgcaagatcaagactgaccaggtcctgcgagagggcaagagcaagaggaagaaacgcagaggaggaagtgctggtgatccagctgctgcatctgaaggcgaaagcaaggggcagtcctaccaccccgtctgctgcgaggtctgctcaaccgaggttggagtgttggacgaggacgaggtgtaccacttctttaacgtgatccctagcaactcctgaatgccgtctgtaggagtagtacgttcgtagtcgtagaccccaccaccgtatacgcaagcttctgcgctacgccgtccgtctcttatcgctgatcagcctgtacatcgggtatgtatctttacggatgttttgtttctgcagcatgatgcggtttcgaaagggggtctccgcgagctctagctgtgatggctctttgttggtggccagcctgatctttgtcctgattggacgtgttcatgcttgctctagcagcaatgaatgattgttggatgaaaaaaaaaaaaaaaagggcggccgccgactagtgagctcgtcgacccgggaattaattccggaccggtacctgcagg

SEQ ID NO: 7278 - DNA, 1437 bp, Zea mays
tggccggtgcgcccgaattcttcgctgagccgtcacttttgggcggccttgggagtccaggcagatgtaccggcagggtggtggcatgccaatgccaggcagggagaagaatggagggcgccatggtccgtccagctcatttggtgagcatgagcttggtcatgtgcccaatggggtgaataggaaggcccatggcgatgcggcttatgacctgtctcacgcgtccgagagaaaggagggcctgaggcactctcagtcggagactgacaccaaacgagccaaacaacaatatgctcagagatctcgtgtccggaagctccagtatattgcagagcttgagagaagagttcagtccttacagacagagggaatagaagtaactgctgaaatggattttctcggtcagcaaaatatcatgttagacttggaaaataaagccttgaagcaacggcttgagagtctatctcaggagcatctcattaaacgttatcagcaggagatgtttgagagggaaattggccgccttagaacattgttccagcagcagcaacagcaacaacatgtgccgcagcagcaggctcctacccatagccgcagtaacagtagagacctggattcgcaatttgcaaacctgtctctgaaacacagtgatcccagttcagggcgcgacgctatctctggcctccgcatttaagatccctttgttccagcttttggatccctgagctttgcagaacctgctgcccctttatgccactctttgtggttgttagtagcatcatgagaggagcagcaccggtgaaccgggaatctcatcccacggtgaataaagctggaaaggttaataactgtggatctggtccttagttctttcagaatgtgcacctggcggtcatcgttagcttctgtccattattgatgcttgaccagtcggaggtgtttaggatctgtttgcagattgatgacttccatggatccttgtatcagtttgaatctagaacactaaggttctaatccattcctttttagtcgattctctgtcgagtttaggcgccatggcccttgtattagtgtggcacacgaatggaatgtgagctggtcctctttaggttatgccacatcctggaaaaccgttgcgtgaggagttgtcgggccatgtccattgtcctaataagatggtgaggttgaagggctggtgcagttcagtttcattttatttgtgatgtgcacagcaagatattggatactttgggttcttacatttatttgagcactgtatttttatcgcattgtgatgacagtatattccaagttcattttagctgccaagatcctgcttgtgtgcgcggccgctcgccgttgtaggttatatgagatttaactgggtttatgtttatatgcagtgtgccgttaacaatgatttggactcatctaact

SEQ ID NO: 7279 - DNA, 2374 bp, Zea mays
  misc_feature (1)..(65): n is a, c, g, or t
  misc_feature (67)..(127): n is a, c, g, or t
nnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnngggggggggggggcatagcccgggtacgccaagcgcagagagagggctcaggttaggcctctgatcctttgttttcttgcccatggaacatcacaactgctcgtttgctcttgtaagatgtagtatggatgtgatgttgatacaacatttacaatgatgacaagagtacatgaaatcgaatatactaaattgcactcccagtccccactctcgagttggttcaatggcatagaagaaggcatttcagatagacttttaatctccaactgttgtctaagggtgtcacttcatctattcatttatttacagtttacgtatgttgtgccctcacggagattttgcaacactgcttccctcttatgaaagatgacaaattggtgtcactattgaaattcactgactacaggttattggaacatgggatgaccatttttatggattgaatgatgcaggaaaacaatttagtggagaagtgtttgctcaaagttttctattagatttcttggatgaaactgaagacggtaaacagtatgcacttagaaacactggagtcaattttttcattttaaggttgtgtagttattgacttattatttgttaaatcgattcaaaccaagcacattggtaagttatttgctttctatacaatctgttttacatacttgtgtccacgtctaccctggccaggcatggctttgggcagacgcaacaccggtctagctcgggcgcagtgcgtctctggccaggagcggcccgacacgggcgcatccacgaccaacttgtcttcggcgcaaggctgcctcggcacaggtgtagccccagcacgggcacaggcattgtctacacgccaacacttctaattttagatcccgatgaaataaaaaatagaggtggttgtgctttactagctcgatggtcgaacaaggagtctggcagcataactaatggctttgttctttgttgcaatatattgatacactaagtagtcttgttgttttttcaggctagagtggagttcattgtcattgccaacaggtgactaaatttcctctctacaccctgtaggatcaatctccctgtcttaagtcatcacaaaagaaaaggatgaggtgactaagtttcacaatgtcttatttgtactttttagtttcctatatgatatactgcattctaaactctgtatccgtggagaaagttgttgagaggcattagtatgagaaaaatctctacgcctattaagagggagtttcgtcgtgcatcactcccttcctctcctccacacgatggtggttcccctccacgcaagacagcaactacaacgcagcattctaaactttgtatccgtcttcgtagttcatgtgcagtaagatactttactttgtatatgtctttgtagttcatgtgcagtcagagaagtgtttgctcaaagtcttctgttagatttcttgcatgtgcctattttgttttctccagaggctgggaactccaaagaggaatagggtccatatttggataattgtttagatataatgcacatgctcaatcaggtatgagcttagtgttcaatgttttcccctaaaatgtagaagtttcttgagatctttttccgccctttttctgatgaaagattgaaactcatgtatttttgtgggctttcaagaaacgtgtgaacgaagattcttttcctgctagtgaccgttaaaaaatatatagagatagcgtcagaaatagtttagtaaggaacaattggctcataaatcatcaggaatatactggagctcatcaatcatctttttaaaacagttgacttaacaatttttctcgctaaattttgcagatcagcaggagatgtttgagagggaaattggtcgtcttagaacattgttccagcagcatgtatcacagcagcaggctcctacccatagccgtagtaatagcagagatatggattcacaatttgcaaacctgtctctaaaacacaaatcccagttcagggcttgacattgtctctggcatttgcttttaaggttcatttgttccagcttttggttccctaagcttcacataacatgttgtccctttatgccactctttgtggagtagcaccgatgaacgagggatctcatcccatggtgaataaagctggaaaggttaataaaaaaaaaaaaaaaaaaaactcgagggggggcccggtacccaattcgtgttaaacacaataaagttggaactggaggggggaaaggagtt

SEQ ID NO: 7280 - DNA, 500 bp, Zea mays
ttggtccatcaacaaggaggaagcgcatgtgaacatttgattttttgtcggacgttcagatctggactcacgatgctttcggtaaaacttgcctctgctctgatccacctccaccttcaacgacttggcaccctcgaagaccaatcctgcaagcaattctttgttccaagaagacattgaggccctcacaaagaagacacaagatggtgggacaaaagtggttgaagcaaaggctggcaaagggctctgcaacattgtctatggcataagtttagaacatatgaatcgttgtcactgtcagcatgtctattggttacactatagaatatcttgtctgtttattagccttttagaattttatgattactttcttctatgctttgtaactattcaatcagtagatgcttcttgccttcattgatttttctatgaaaaaaaaaaaaaaaaccaaagaaaaaaaaaaaagactatggtataaattagttgctgcatgattgcct

SEQ ID NO: 7281 - DNA, 1351 bp, Zea mays
  misc_feature (60)..(60): n is a, c, g, or t
gcggccccggcggcagcctcgtcgcccgccgcgtccatgcccggcggggtgcgcctttcnttcgaccgacgggagcatggctctggcgctggcccccatctcttccgcctcggccggcggcggcggcggcgccgcagcccccgggcagcagcagcagcacggcgggttctccatcggtagccccccgtccgaccccagcgccaagcgccgcggccggccccccggctccggcaagaagaagcagttcgaggccctgggttcctggggcatcgctttcacccctcacatcctcgccgtcaaggcaggcgaggatgttgcttcaaaaataatgacattctcacagcaaggccctcgcacagtctgcatcctctcggcgaatggcgcgattagcaacgttacgcttcggcagccagccacatctggtggactagttacttatgaggggcgtttcgagataatctcgctgtccggttctttcctgctcgcggaggatggtgacactcgcagcaggactggtggcttgagcgtcgcgctcgcgggatctgacggccgagttcttggagggtgtgtcgctggaatgcttatggctgcaactcctgtccaggtcgtggtggctagttttatcgcagaggggaagaaatctaagccagccgaagcgcggaaggtcgaaccgatggctgctcccccgccgccgccgccacagatggctgccttcgtgccggctccggtggccaccagccctccgtcggaggggacgtccagcgcgtcgtctgatgactccggcagcccgatcaaccacggtgcgatgccgttcagccactccagtcagcaccagcaccctcaccagcaccagcagcacatgccgcctgcctacgcgtccgggggctggtccctctcggtgcaccagcagaacaggcatgattctgacatgaagatgatgtcgaactaacaggcgccccattcgttggtgtttgggctggagaggaaggaaaggaacctgctgatggttaggttggtactgctgctatgaaacggtcctcttgcgcgtcgtctgtgctctggtcagtgacgacgtgtcgatctgctacttaagctaagctagctaggagagttagggttcatggtctcaccccccgctgttgtgcccctgagtaagattaatttaatttgaattagtcgctctcataatgctgcgagttgtgatggtttcctgatcagatcttcaccttctaggctagttaaaatatcatttctctagtactatggatcatggatttacttggatacttgggtttaattcaggaatttgatcgtattatgtgttgttttgctctcaaaaaaaaaaaaaaaa

SEQ ID NO: 7282 - DNA, 1824 bp, Zea mays
ggcttttgttgccaccgagcattactgttcaagaccctggcggattccatcaatctgccctgtcgcattgtgaagggatgcaagtactgcaaagctggtgctggcacttcttgcttggtgcgctttggtcatgacagggaatgcctaattgatttaattgggaacccgggattcttatctgaacctgactccctcttgaatggactatcatccatctctgtttcttcaccattgcgcccaccaaaacatgactcagctgatatttctgataatttcaagttgtttgccaagaaatatttccttgattgtcagtcgttaaatctcatgttcagtgatccagcagctggaacggttatcgacttagatgaggttatgggatcaaatctaggtctaaactcatcacatgcaacaaacagtgattgtcaagctacctttactcatcttaaggctggtactcgacgcagtagtcaagatgggagttttataatgcagaggagttcccaagaggatactcaatctggactaagtgatccctttagcgatatgtcccttgagatagaagacttgattatcccatggagtgagcttgttctgaaagagaaaattggtgcaggttcttttggtactgtgcaccgtgcggattggaatggttcggatgtggcagtaaaaattctaatggagcaggacttccatccagagcgtctcaaagaatttttgagagaggttgcaattatgagaagtttgcgacatccgaacattgttcttcttatgggtgctgtcactcagccacctaacctttcaattgtgactgaatacctatcaagaggtagcttatacagacttttacacaggcatgctgcaagggaaaatctggaggagcgccgccgcttgagtatggctttcgacgtggcaaaagggatgaactatcttcataagcgtaatcctccaatagtccaccgggatcttaagtcaccaaacctgttggttgacaaaaagtacactgtgaaagtctgtgactttggtctctccagattgaaggcaaacacatttctgtcttccaagactgcagcagggactcctgagtggatggcaccagaagttctacgagacgagccctcaaatgagaagtctgatgtttacagcttcggtgtaatcttatgggagcttatgacattgcagcagccatggagtaatttaaatccagctcaggtcgttgcagcggttggtttcaagggacaaaggcttgagatcccaagcagcgttgatccgaaagtggcggcagtaatcgagtcctgctgggtcagggagccctggagacgaccctcttttgccagtatcatggaatccctgaaacttctcatcaagacattaccacccaatcagctcctcgaagaaaattagttaccacccaagcaacttgcaaattatgtcacctctagagttttctcgatttgtttagatccgatatgcgccaggcctctcaaaccattcgtcttcggcgccacgtattccctgatgagaaatattcaaaactacacctgtcacaaaaggggaaaaactatggttggacaataagattcatgaaaaaaatatgtgatccaaattaagtgtacatctcttttatcaaggaaccaaatgtaagttggtcaaatatatacatataagtactaatatttatggaatatatacttttacaataaaaacaataaaaaaatacaatatagagcttgaaccatacaaaccctaactgataatgagtaaccataacatatgtatatgtactccattcgttaccaacaataaggtgtcttacatatcaagtaa

SEQ ID NO: 7283 - DNA, 1324 bp, Zea mays
aagaccctatccaaaaccagaggcaagccaagacgcaagctgcaagcacgcgctcgtgcccgcgccatgaagtgctggtgcgtgcactcgccaaggggagcaatggcgacgccgctctccagccccttggctcccaccgccctccgctcccctctccggcaccgcgccctgctgctgctgctgccgttccctccccgtgcggcctcctccggcgaggacaccgccgcagcagccgaccaggagccggccccggcggccaccaagacggccaccgcggacgacgacttcgaggagcgcgtgctacggatcaagtcccgcgtcgggcccaagaagcgcggcgcgcgcaagaagaaggccgcggcgtccgcgtcagccagcgccgtgacgctcccgcccgtgccgctgcgggagccccggtcggcgctcggcgcgcccgtcgagctcggcttcaccgcgtacagcgagcggctcaacggcgcgctggccgcgctggggctcgccgcggtgctgctcgtggagctgggctccgggcaggccctggtgaagtaccaccagccggccacgctgttcctgcaggcgtacaccgtcgctgcggccgccgcgctgttcgtcaagtacgagaaggagcggatcagcacgtggccggggccgccggcaaagtgagatataatggcgttgtctcggtcgcggatctttacttgtacttttacctcttgatgatgtgcactgcacggatattatatgtgttcgttgtgagaactgggaaattcgaggagagaagaagagcttgattttttacagtccttttaacgcccatagtttcatttcatttctttcgtcacattaggcaggtccagcctccagcggcaggcggtttggtcggttcgagtgttttgctgcgttcgtcggttatcacggagaatatccagacagttgttggttcgagaacatttcgtttgtgaattttggtgttcggaagattgtgtaaagctttgagaagcaagttaaaattgtgcatgcatagatttttttattggctcctattcattcttctctgttggcccgactcagtccttcaactcattttataaaggcataatttaagtctgtacaaaagaacaaaaagttgttcaaaaagctaaaaaacacacctagaaagcattaaagcaagaagccagttctcaagaagagatttcattgagacttaacctaaccaaagtaggagagagatcttcacgaagttgtttccagcgctacaaagacaaatccttttcattaaaaaatatactatttctcacagaccaaatgcacacccggcagtaac

SEQ ID NO: 7284 - DNA, 1964 bp, Zea mays
gcacgagaccattacctagaacatcctaatcgaaaagtttttgtcagtcatgcggccagcttcctccccgctagctcactagccaggcccgggcgcctcaccgccacggtgaccgccgccttctttgacgcctgcggcctgcctaaccccgaagtctctcagtgcgtgtttggccgaaatccacggggagggcttgtcctcgcctttgctgagctgctccggagcggagccgtgcctacttgagttcaggtttgtttcgccatccgaggccaagattcggagcgtcgccgaagggaggcgatgaagggcaaaggcgggccggtggacaggaggtcctccgccaggtggaggttgctggtgctctgcgcattcagcttcggcatcggcatgctcttcaccgaccggttctggacagcaccggataccagtagccataccatgtctcaacgctggaggcaagagcaagagctccaacttgtatcagaagattgcaacacaaagaggaagcatggggaagacaaggatataatgggagaggtaaccaagactcatgaagccatacaatcattggataagtccatctcaacgctgcagatggagcttgcagcaaagcggagcacacttgagctactccgatctagtggttcaccagtaacctctgaaactaaccaaccaaggaaaaaggcttttgttgtcattggagtcaacactgcattcagcagccgcaagcgccgtgattctgtccgggagacatggatgcctcaaggagaaaagctgcaacaattagaagaacagaagggaatagttatccgcttcactatcgggcacagtgctacatccaacagtatactggacaaagctatagattcagaggacgctcagcatcatgactttcttaggctggaccatgttgagggatatcatgaactctcagctaagacaaaaatattcttctctactgctgttggcatctgggacgctgacttctacgtcaaggtcgatgatgatgtgcatgtaaacctaggaatgcttgccactacccttgctcggcataaatcgaaaccaagaacttatattggctgcatgaagtcaggcccagttcttgctgacaagaatgtgaagtaccatgaacctgagtactggaaatttggggaggaaggaaataagtacttccgtcatgctacagggcagatatatgccatttcgaaagatctggcgacttatatctcaatcaatcggcctatcttgcacaaatacgcaaacgaagacgtgtcgcttggatcgtggttcatcggtttggaagttaatcacatcgatgaaaggaacatgtgctgtggaactccaccagactgtgagtggaaagggcaagctggcaatgtctgcgtagcgtctttcgactggagctgcagtggcatatgcaagtctgttgagaggatcaaagatgtacatgctcgctgcggcgaaggggattcagcagtttggagtgctcttgtctagcacataccctcctttgcccgtaaatatgtagcataattggtaagctttggtggtggtggacaccagcataggcgttaggcaactccccaagtaaacttgacaaaacccagagatcatgatcatgccccgtggaacattgccaatggtaactctggctggaaaaattctgcgtaattttggtctgtcactgttcatgaccttcggacttcggtggtgttaggagctccaaggtagggttgcaactgatgttactgatcttacatgtagggggagagtttctcagctgatgcgagatcatgtaatgcagaggacattgttttatgcaaattttgacattcttttgcgggttctttccaaaaaaaaaaatcattcattcatgagagtgcaccatactgtaacatatgagccgtggacggattgttgatttagcaaatcttgttctattaggaaaaaaaaaaaaaaaaaaa

SEQ ID NO: 7285 - DNA, 1723 bp, Zea mays
aacgaaaatgctttcaaaagtgggaagaggaggatgacaacaaagtgtggggggcaagggcacatcacgcgctccactgcagtctgcagagtttcaggcggccagcttcctcctccccactcgttcggctcaccacctcggtgaccgctgcccttgacgtctgcttcggacgcggcctggcccagaaatctccgtgcgtgtttggccgaaatccacgggagggtgctcgtctttgctgagctgctccggcctccggagcggagctctgcctacttaagttcaggcttgttccgccatccgaggacaagattcggagcgtcgccgaagggaggcgatgaaggggaaaggcggggcgatggaccgcaggtcctccgccaggtggagggtgttgctgctctgcgcattcagcttcggcctcggcatgctcttcaccgaccggttctggacagcaccggatagcagtaaccatatcatgtctcaaagccggaggcaagagcaagagctccaacttgtatcagaggattgcagcacaaagaggaagcatggggaagacaaggatataatgggagaggtaaccaagacccatgaagctatacaatcattggataagtccatctcaacgctgcagatggagcttgcagcaaagcggagcacacttgagctgctccgatctagtggttcaccagtaacctttgaaactagccaaccaaggaaaaaggcatttgttgtcattggagtcaatactgcattcagcagccgcaagcgccgtgattctgtccgggagacatggatgcctcaaggagaaaaactgcaacaattagaagaacaaaagggaatagtaatccgcttcactatcgggcacagtgctacatctgacagtatactggacaaagctatagattcagaggacgctcagcatcatgactttcttaggctggaccatgttgagggataccatgaactctcagctaagacaaaaatattcttctctactgctcttggcatctgggatgctgacttctacgtcaaggttgatgatgatgtgcatgtaaacttaggaatgcttgccactacccttgctcggcataaattgaaaccaagaacttatattggctgcatgaagtcaggcccagttctcgctgacaagaatgttaagtaccatgaacctgagtactggaaatttggggaggaaggaaataaatacttccgtcatgccacggggcagatatatgccatttcgaaagatctcgctacttatatttcaatcaaccagcctatcttgcacaaatatgcaaatgaagacgtgtcgcttggatcatggttcattggtttggaagttaatcacattgatgaaaggaacatgtgctgtggaactccaccagattgtgagtggaaagggcaagctggtaatgtctgtgtagcgtccttcgattggagctgcagtggcatatgcaagtctgttgagaggatcaaagatgtacatgctcgctgtggtgagggggattcagcagtttggagtgctcttttctagcgcataccttctttgcccgtaaatatgtagcatacttgctaagctctcgcggcggacacctgcataggcaactcaagtaaacttgacaaaaaccaaagatcgtggagtatgatctgaaactgcagaaacagtatgttgcttggaaatattctgcaacaacataattttgctccggcaaaaaaaaaaaaaaaa

SEQ ID NO: 7286 - DNA, 1892 bp, Zea mays
ttgcatgcctgcagcgcttccctccaacttggaagaggcttttccttctgctaacccagaatgcagttctgtaagaagtaaggagcataactccaaacatgctggtttgtccagtgaagattgcaaaggaaccatgaatgtggggcagcggcaacagacaaaatctgtgaatgcagggatcgctacaaaaacaccaaatgaagagaaaatcaagcataacactcatctgcctgaagttacagatgtcgatgacgataacatttgccaaacagagtatgtatgcgctgaatcagaattctatgatttttcaagaataagatttctccaaaagttttcatctgggcaaatctgggctctctatagtgatatagataaattccccaattactatgcattcatacagaaagtcgatcttaaaaatggtacagtacaagttagatggctggatgtctgtcctcgaggagaagtggagaaaagattgtcccaagaagaacggaccattggcattggaacctttaggcttggctatatcttcgatatgatgacttacactggtacagatcccttttctcatcctgttaaggccagagctactggcagaaaaggtgaatatgaaatacttcctcgtcatggtgagatatgggcggtttacaaaaactgggaggctgtatggactgcacaggattttgaaaaatgtgagtatgaactggtggagatacttggccatactgattcctccatacaagttcagcttctaaggaaggtcgatggttataagatggtatttatgtcatacagagcagagggttctgtgatgacaataaggaacgatgagtaccccaagttctctcaccagattccttgctttcgtctcacacatgaaaaaggtggcaagcttcgaggctatttggagcttgaccccttatcagtaccagaggaatttctcgactgattccatctgagataaactttatcaaccacaaatctggaaccttcttgtgatgaagtttctgtaactgaggctcagttaatgttaaggtcgacaggtcaacattgttcaaatgacactgacataagatgtctggatttcagcattcatagcactaacgttcttaaggctctgttcgtttagtccggattggaggccagaaccattccaactcatcaagctaatacaaatttgtgaactattctaatccggaaccaatccagtaaagtattccggaagaaccgaacgggcactaaaggtggactaccaatctgcacaatgaaggcattgactgttggactctttgctgggtggctgtcctgcagctgtaattcacaagccgagtaaattgtttgtagttagcttcagctgtatctggggtttatggtgtaaaaactgccacttctcttgtagtgtactctggtagtgctgtatttgagctgtggggtgccatcctgattaattatcagaagagttctattggccacccttacaggaactgaaacatgaaatggagtcagccaggtcaggctcatcgatcaatgtgttatgattgtgttgttttgcaggggacaaggcctctttctattcgcatctctctgtatatacaagttacacgtcctcgtcttggttttggccatttcttctcttgaattgtgtttacttgctattactagtattagatgttgtaacacctcaaaatcttactttgagaatttagtaatactcttcaaaggttttgaattaagacatatttgactaaagaatttttctacctttgaagtcactctttccaaaatgttgatactttctatataaaattaaacaaaaagagaattattatccctagttgaagtatatggaagagaatcatgttaaaatattttctaatatctagtctgca

SEQ ID NO: 7287 - DNA, 3014 bp, Zea mays
atacatgacaattattgtggttgtacagcagtggcgctcatatctacagcatggtgaatttgttatactcacggatcacaaaagtcttacacaactgaatgaacaacgtctccacacccctagaaacacaaggttttcaccaaacttcttggcttgaactacaaaatccattatcggcatggttatgacaaccgcgccgttgatgccctttcacgaaatgggactgttgaatgttgtgtagtatcaatgttggttcctcagtggctgcagtctatctaggatagctaccaataggatttcgaggctgcttcactactctttaaactggctatcgactagtccgcagtgccccattgcaccctgtgtgatggcctgctgtgtttcaagaaccggatctgggtgggcaatgatgcacaactacaacatcatattgtggcagccttgcatagttcactggttgaaggtcacttgggagtgtcagtgacgtacagtagggtgaagaagttgtttgcctgaccatggttgaaatcatttgtccacaagtttgtgcgagagtgtcaggtttgtttataggcgaaactagatcgtgctgcctaccctggcttgttacaatcgttgccagtgccctcttctgcatgggatacaatatctatggacttcgttgaaggtttgcctcgctcacagcatgctgattgcatcctggttattgtggacaaattctctaaatatggccacttccttccactcagtcatccctatactgctcactcggttgctcacagcttcttgttcaatgtttacaagatccatggcctttcttcagttattatttcggatcgtgacctagtgttcaccagccagttttggcaacaaccgtttcgtcttgcgggcattgagcttaagccgagttcttcttaccatccccaaaccgacggacagaccgaacaagtcaatcaatgcttggaaacatatctgcgctgcttcgcaaatgtctgcccaacgaaatggaaagagtggttgcctgtgggcgagtactggtacaacaccagcctccactctgcactggggcgtgcaccatttgaggttctttatggccgccaaccccgtacctttggtctctctgtcaaccacacaatgccgtcccagctagctgattggttgcaggaacgctctgtgatgcaggagctagtgcaccaacaccttttgtgggctcaggctagaatgaagaaacaagcatatcaacatcattctgagtgttcctttgcagttggggaatgggtatacttaaaactgcagccctatgctcaatcatctatgatgtcgcgagctcaccataagctgagtttcaagtacttcggtccgtaccagatcactagccatgttttaaaggaacagcttccccaacgcttccgatgtcacttccagagcgcgtgtgccaattcgtgtgctacaaactcgtggcctgtccaagagcaaccgtctggtgcagcaagtcctggtggaatggtctgggcttccacttgaacttgcaacatgggagaaccaggaggcgcttcgtcagtgctttccatttgcacctgcttggggacaagcaggcttcgaaggatcgaggagtgtcaccaaccaaggagacgtggctgagccggggacatcatacaagcaagatggtgcgactctggatgggatacagcacacaacaaagcagaacggggcggctcgtcgcatccgtcgtcctaacaggcgtgtgtgtgggcctgagtggctgtagtgtgtggttgcggcctggtggcgggtactgttttaaccctgcctacgtgcttggggaagactatcgagaaacagaactctgataatcgagacctctcctacctgcctcccttctctcctctactgcgccttcctacctacactaacatctagtatcagattagggttcgatccctgttccactccattgcctcatggtgccatctacttcttcctccttcgattcgaccctcaccctcgctctggagcaccaaacccgatccctgcttgctgaactggataagtggttccagtccatggagggcaggtgggaaatgcgggtgtccgccctggagtccacggcggcggacgcgtccagatccgtctccgagttctcgtcttcccttcgtgccgatgtggaagcacatttgactgcttcggacgccgttgtggaaggacgtttacgtcagatcgaggctgatacgagcacctgtgtcggcgccctcgagtacgcactgcaactgttcgactattggcgtccttgcgtggattcgtccattgaagggctccgatcgaacatggattgggtgcgttcgaaaatcaccaagatggagatccagtggaaccaaggcatgcggatcggtggtgcctccttgctgggcgtgctcggtccaccagggcccttctccacaccaacgccgggcatcctcgaagctccaagccccttcgctgctcaaggatcgatgctggggcatcctcctgccgccgctgactacaccgatgggcccctatttggccactgctatgacaactactcccgggatagtggtcttcggcatccaactgccgacggccgctaccggtcacgggtgcgtggcttcccacatctccatccttttcattccagcattagagtggttttggaggtggtgacgtcgatatcaggggtattcttaatcgccatggtggggggttgcccaagctcaatttccttgtcttcgacggttcaaacccagaactttggcaaactcgttgtgaaaaataattccagatgtatgccacagaagagatcgtatgggtcagggtagctaccatgtactttgagggggtagatggccggtggctgcagtctgttgaacctcatctgccatctctttcctggaaccagttctgtcagttagttcatgaccgctttggtcatgaacaacatgagttagtgattcgcaagttgtttcacatcaaaaaaaaaaaaaaaaaaaaaaactcga

SEQ ID NO: 7288 - DNA, 2027 bp, Zea mays
  misc_feature (15)..(15): n is a, c, g, or t
cactatagggcgaantgggtaccgggccccccctcgagtttttttttttttttttttctttttttttttttttttttagccacaaacggtatatatgtttgtaacacttgtacaataatttgggatcaaatgtacactcgatggaccttcaccaatccatgtatacggaggagtctttctgagtagatgtacattgaacctattatgtccttgaggcagaagctcacacagagtagacgtacattgaacctataatgtccatgaggcagaagctcacacagagtagacatacattgaacctataatgtccttgaggctgaatgagagggtgtacgcgtcttcacgcttgtatatgaaatctgcaattcgtgcaacattgatcgctgtatcgagaagtgctatggggcgttcttgctcgaggttgtcttggacgatgtccatccatgccttttcgattacctctctaagcttctcggtggcttcctctgttgtcactccgtactgcttcatgcaagtctgaaccgtggatgccacatgatctgaagaagcttgttcccgctcatgtgacacgatgtcgttgcagatgcggcccacaatacaagcacctttgacgattttggggaaggtgaaaacccactcgacgtcctctctagtagtcatgtttccccttgatgaaataagcgcgagatttgtcatctccatgcaaacactactcgggatagaaatttggaggtgctcctcaacagtggttggcacaaagtgttcatcgcgccattttacctcagcgtggtaggatttggcagtgtcaatcaccattttcttgaccagttcagcgtgcatgttcccctgaagttttaactcctcctcgatcttgtttgtagcattcaatatgctgaccaagagtaccttcaagcctgctgaaagttgatgagcgatctgttcatcccacctttccatggctgcggtgaagacatcgctctcctctgtggtgccatagttgtcgtaaaggtcatcgaaaaagtttgcgaatatgtagaacttggtcatcatgatccgcgaatacgagtaatatggctcatgtatcactccgagcatccagaaatgaagctccaccaatctgtcccgcgtgaagcgcatatctatatgtgattggaaatccttccaccatactgtaagttctttcagttcatcacagtagatagcttgcgagatgttgtactccagcttggcgaactctagtatggtcccatctcgcccgcccttcttctcgtacacggagatgtagcgcctcgcctccactcgcttcacccgcctgaaccgaggcgtctccaaagcgcacctcacctcttcggcaagctctggctccaggttcttctcctccagcagggattgcaggcggctcttgctccaagcgatgatgtcgtcaagaatctcctccccgtgagttctcgtatgagcagcgtcatacagcatgagcaagcagccggcatcgtcgctcgagacgctcccgcgctcgtccctgaatttctcgaacacatctgaagaggttgtatacccatgcttcctgagcaagtacaaccgcagcgaggtgaggtagagatcgtcggagccgcctccgtccctgtcgtcgtcgtcgtatacagagcgaagcaactggtcgatctcctcgttgtagcggtagtccaccccgagacgctgcagcgtgtccacaagctccaacttgcgaagcaggttggaggaggccattgtttcctgtatgatctgcctcacctgttgctccttgacctttgccctctccttcatcgacaagagctgtgacggagtgcatggggtgtggtggaggaagaagtcaccccatgggctcggggtgtaggtccgtggcttgcgctgcggcgcctgcgactgtgaggccagagggacggggacgctggtggtcatctctgttctgttctctggacggttagctgctggtgccgctaggttatgcgaagcagaggatgggctctatagagcgggggggggggggg

SEQ ID NO: 7289 - DNA, 1556 bp, Zea mays
accattacctagaacatctaaatcctaatcgaaaaactccactcctaaatccaaagcaaatccgaaagcaccacgaaacacggcggcagcagcctgcgtgcctgcctgcctatccaccccctcctccagcctccgcctccgacacccccgcgcgccctcgcgcggacaaagccgtaaggggcagagccgagggaggcggggctgtgccggcctcgcaatgcagcagccggagcctgccgatctgccgggctgggccttccagccacgggcggcgccggcgcctgccgccgcgcgcggggcgcaccaccgccgggccagatctgaggttgccttccgcctgccggacgacctcggcctcggcggcggcgccggccccgatggcgacgccttcgacgagatcggctcggaggacgacctcttctccaccttcatggacatcgagaagatctccacctccgggccctccgaccgcgccgccgagaactcgtctccgccgcgccccaagcaccgccacagcagctccgtcgatggctcgggcttcttcttctcacccggcgccggcggtggcgcggggaaggatgcagcggcgtcgctggctgaggtcttggaggccaagaagtccatgactcccgagcaactggccgagctcgccgccatcgaccccaagcgcgccaagagaattctagccaacagacaatcagcagctagatcaaaagaaagaaaggctcgttatatgacagaccttgagcggaaggtccaaactcttcagactgaagccaccaccctgtcagctcaacttacactatttcagagggacacgaccggactttctacagaaaatgcagagcttaagataaggttacaggccatggaacaacaggctcaactccgtgatgctctgaatgatgcactaaagcaggagctggagaggcttaaacatgctactggtgagatgaccaattccagcgaggcatataacatgagattccaacatgttccatacaattcttccttcttcccgctttcccagcaaaatgcatccccacaccttggtagcacccagctgccactgccgttccacccaccccatcccaacgtgccaaaccaccagatgcgaaacactctcccggacataatgcagcaagagtctctcggacggctgcagggtttggacattgggaaggggcctctggttgtgaagttagagagcagctcgatctctgcaagtgaaagcagcagcaccttctaacgaggcctacaagtgaaaacccaccgtttcagtaggttccattgttcatagtagcctgacatccttgtgctgcttcctgctctgtaagcccatttgttatttaattcattcatttagttgaaattatacgctgtcgcactggctgatcaatcatgttgtagaatggtccaggaacccttcaattatgtttgttttgggctcgtttcctgtttctgtgactggtatcatcagggcatttgggttttggagtgaaattctctagtggtaacaactaaaaaaacaaagcttatctataccgtcaacctct

SEQ ID NO: 7290 - DNA, 4092 bp, Zea mays
  misc_feature (754)..(754): n is a, c, g, or t
  misc_feature (3588)..(3588): n is a, c, g, or t
ctgtttagatcgattgttcctttatttcaatgtacaaacaaactagtcaggttgtggctaatggtccatctgggtagggtcaagatctattgtcactagaatcgttgtttcaaatatcatcttggtttacattaattgtttgtgttaaatttttcatgcagaattctagctaacagacaatcagcagctagatcaaaagaaagaaaggctcgttatatgacagaccttgagcggaaggtccaaactcttcagactgaagccaccaccctgtcagctcaacttacactattttcaggtgcctttctatcgatctgttgtttcattgctatcaggtcaagtctaagttcatgctatttctggaagtgatattttaggaacaaaataattatttttcctttgctgtcatcataataaacatggacctatctcctaatagtgaggcgtctatcaaactatagcttctttacaaattgcatctagcttaatactctgttccaaattataagacgttttggttttttagattgatagtttctacatacatctatatataggttatgtctagatacaaagtaaaaactatgtctctagaaatgtcaaaacatcttataatttggaagatagggaatagtctgtgagaacttgtgtagctttatggactaggagtaggacagttgtgcatggtgtgaccaacctaaacatccttcacattgaacatcatgtattatgaacaatttgaagaactgaatgccantgatttgtatgtcagtttaatatatgttgattgttaactttgactatcggcttctggttattgttatgttttatgtgttcgtttttttgaactattgtacactttactggttcacaatcctgttgtattaattagttggatgacccttatatgttgctttacaatctcttgcagagggacacgaccggactttctacagaaaatgcagagcttaagataaggttacaggccatggagcaacaagctcaactccgtgatggtgagcattgtccgcttattgaagataacataatttatttgtctactttgttcttttaggtcccgtttgtttcctttcattttgaggaattgtaatcttactaatagaatagactattttttttagaatgtgacattccaccactttccaaagttatcatataagcatatctcaaattcatgggttgagagatgaaaattgattctatagatttacatgctatttttccgatgtacaacttatagcacactcttctacttgcttcgctataacataaatgtagtatataactatctctctcatatgatttaggataatatacaaatatattacatatataaatatatgaacttaattagttttatctaaattataattattaaaatggaattcaattccaacgaaacaaacgggaccttagtgtttttttctcagaccctggaacattaagtaacaaaaagttcgcgcaatagtttttggccttatacaataaaaaaaacttctattttttcctagttctagttcctttctctaactaaaattagaactcctggcttttaaattacaagttattctaaatgttcaagtgccacaatattttgaagtcaagtgtcttttgacatgaaaccctttcactaattttagtaggatgcatgtagtttttctgtatttgccatagcttatatatcttgccatgagatacagcaacgtactgtagaacacaacgctaattacattttacttaaatagaacaaattaatgactggaaattgtattacgacgatcggtgatctcgagtttttcagtgtgggtgtgtggggtgtgtgttgtactggggtctctccccattttcccttcttaatacaatgatacacagctcttctgcatatttgagagaaaaacaatttctttattctacatgtacattctaaacaagctcatttatcttgcagctctgaatgatgcactaaagcaggagttggagaggcttaaacatgctactggtgagatgaccaattccagcgaggcatataacatgagattccaacatgttccatacaactcttccttcttcccgctttcccagcaaaatgcatccccacaccttggtagcacccagctgccactgccgttccacccaccccatcccaacgtgccaaaccaccagatggtgtcccaccgaaacactctcccggacataatgcagcaagagtctctcggacggctgcagggtttggacattgggaaggggcctctggttgtgaagttagagagcagctcgatctctgcaagtgaaagcagcagcaccttctaacgaggcctacaagtgaaaacccaccgtttcagtaggttccattgttcatagtagcctgacatccttgtgctgcttcctgctctgtaagcccatttgttatttaattcattcatttagttgaaattatacgctgtcgcactggctgatcaatcatgttgtagaatggtccaggaacccttcaattatgtttgttttgggctcgtttcctgtttctgtgactggtatcatcagggcatttgggttttggagtgaaattctctagtggtaaaaaaaaaaaaaaaaagctatgttgcttcatggatcctctctttggaacacacatatgtattctcgtgcaatttgttgaggccctgtacattgtgtgctggcaagctatgcgtacaccctaatttatgaaatgttatcgcattgagggattttaatcacccatcagagcgcaagcggatgttgtgtcaccattggcgtgcaagtaagagcaaactttgatgcgttcgtgtctggctttacactcatgactcttttgcatttgacagtaatctgggtgcaggacattgttatttcatagctgtagtaagtccgagatgtttgatggtagttagaagtattaagaccctgtttggatccgtgtgacaaacagtttaccgactaatcttatcaccttggtctctgtcacacccagatttaaggtcaagcacccagatttaaggtcaaacacatgtgtgtcttaaatttgtgttaggatcaagtcacacatatgatgactcgtggtaaataaattaatgtcacatctttattatataataaaagttatgtataaaatagctaaataaatacatcatatggcgacatatgttcatgttccttcagcggtatctcaaccgttatagttgactgagagacgacgacctagatctcttcgaactcatcgcatcaccgttcatgttctttcagagcaagagtgggctcacatacgttcatggttcagcaagtgtggagaataatgtgtatgagctcacttacggtggggttccatgtaaaatgtaaagcttaccaagaaaaatggataacgctgagctagacctgatcatggggccactcgacacgatcaatccgacccaacccacccaacagaactcagttcgtcccggcccgatcaatgcaacaggagggtacatgccataatttttgacccacaataatttacaggttggatactgttgaaggtcttcttctccgcggaaggtattgttggaggtcttnttcaccactggcaaacaattaggcgtgaggatccaaacatagcctaaatttagtataattttaaagctaattacacatataatgactaacaacaagacaaaactatcaatattattaagtccatgatttgcccatattacactacaaaacatttgttagttttggattaattagactgaataaatttgtctcacagtttagtcttcatctatataaatagttttataattaaactatatttgatacttataattaatattcaaacattctatgtgatatggagggtgtttggtttttagggaccaacttttaatcctctattttagtccctaaattgaattttattttacacatttagtaatttagaaatatagagactaaaataaaataaaatatagacactaaaataagtttctagaaaccaaatactccataaacttttgttggtagaccaaacaccctagtcccactcccacaaaacaaataaaagatttcaaaagccta

SEQ ID NO: 7291 - DNA, 2535 bp, Zea mays
ataatgcgcttacgggtacgtctgtaccaagtcatgtgacgtctatttcgatggttgttcgcttgggaccggctgtttagactgttgtgcagctgcaatcagacaaaaagcaatgtataaacaatataagcccatccggattaaagtaaaatgtctaggttggagagagagagagttgttagtccaaatgaaagcaacgtaaaccagtcactgatgaacacgtacgtgcatgtgtgcatgtatttgatatggcccacgtacttgcattggaacacacaagagaactttcttgtactacatcttgtgctttgcaaaaacccctacatgcgtacacgtactagcaagtagctagcaaccaatgctaattctgtttcgtgtgttaagagtgcaggaatcgacagaactgagcacctactaaagatcgatctgccaccagaaagttgcgcacgttttcgacaggctatcatgaggagatattgttagaaatataggcattttccatatcattttaattccataaattaacattatgatgatgacatataaaatatatttaatcataaaaatcactatctcaaatatacccataacaatatggatcatgagaacataaagcatatgaatcatataaatataataagcatataaacatggaacatgtattatgatggaaaaactgaaaataaacagatagcaccataaacaacatgactgtaaaattaaaacaaacaaatataacattttatattatgacagatcagatgatataaattcatggctacatacgaaacaacagatatgaatatatgaaccatatataatctgcagaacgcaaaacagtaaggagataaattgatcatacccttccatgcgctctgaggatccagatccttgtacagcttctcttgtcatgccgcgtcgccaggaagaagaagatgtttatgagaacgatgttcgggcagtcgcgtagacgctccccaaaaacctaattgtcgatcccccgcgcaaggtctcgaacggcaagggcttcggaggcacctgccctctcgcctctttgtgcgcgcagagctacgagatggaaatacccacacttgcggctagactgtggttctgaaagtgttctgctcacgtgtatcaagcgacaggcgtgctctccttttaacctcatcgcgcaaaggaagctgaaggagaagggtctcgcatgcggctgacgaagagacgggcaactgaaaggtttaacccggagttgaaactcccgcggttaatgagtgctaaaaattaacacaaccacgccacgccacgccacgccacgcccggcggcggcggcggcgcgcgcgcgtgtggcacgcccttgtacgtttcttgacttttcaaattaagtggaataattcccaccatataagtcaagctaacgacccttggactttcaatatggtaccattggtattctccaccgttacataccatagagtttattgattaaatgggccaagcccataaaagatccaacaacagtatgatgcatgtagtttttctctaatgtggacaatttgacattgcctatatgtcttgccatgatatacattgactatatctataaggaacacaacactaattacattttacttacacagaacatctgcttcgctggccccccccccaatttctttattctacttgtacattctgaataatctcatgtatcttgcagctctgaatgatgcactaaagcaggagctggagaggcttaagcttgttactgggtgagatgaccaattccagtgagacatataacatgagatttcagcatattccatacaactcttccttctttccgctttcccagcaaaatgcatctccacaccctggtaccacccagttgccaccaccgttccacccaccccatcccaatgtgccaaaccaccagatgctgtcccacccaaacgctctcccagacataatgcagcaagagtctcttggacggctgcagggtttggacattggaaaggggccactggttgtcaagtcagagagcagctcgatctctgctagtgaaagcagcagcaccttctaacgaggcctaccaatgagaatctgccgtttcaatacgtcccattgttcataatagcctgacatccttgtgctgcttcctgctctgtaagcttatttgttatttaattcattcaattagttgaaattgttccttgtcgcactggcagatcgatccatgttgtagaatgatccaggaacccttctagtctgtttatgttttgggaccatttcatgtttatgtgttcggtattagggcatttggattttggagtgaaattctctgatgatacttttgttgtgttgagccatgttgactgcatgaatcctcttttgaacatactcactctgtaccaaattcgttttaggccaatggtggattcatgaaagacttgttgaatgtattttatgtgtctatattcatcctcactcatttgaatatagacaaaaactactcctttcgttccaaaaaaaaaaaaaaaaaag

SEQ ID NO: 7292 - DNA, 4618 bp, Zea mays
  misc_feature (482)..(482): n is a, c, g, or t
  misc_feature (506)..(506): n is a, c, g, or t
  misc_feature (666)..(666): n is a, c, g, or t
  misc_feature (675)..(675): n is a, c, g, or t
gatccaggggcaacgttaaatcaaaatggtccagaatggaaacagtcatggtataaatgtttcagatttaaaacgtgtaccataccttttaagcaccggatgcaacgcatgtaacttgtcttgatgtggtaaggacagaaccgtgccgtgcgcaaggcatccatcggccacccgtacctcacacgggagccgatggcgacgccgacgcctgaggaacaatttaagcccgattggttgtcgaagatatgggcccttcaggtcggaaattaacacctggaaggcccaagtagacaattgtgttgatgaattggagttaggagtagtaatgtatcacaatccaaatgtttttttcacgattcatttgagcccttacttattttagtttaaaataataaaaataatgctcggatctaatatccttaaactttagggtgtaaattttatatctcattaccacccctagttggagcacgccgtgctcnacgagcgggtggaacgcgagttangtgtcttttttactgctagtgggtttggcgctggaggtcgctgccgagttttttctactcgtgtaccatgctcactaatcatattcattgaatttctttaaaaatagcacttggaaatataaatcttctaatattatataattttattttatttattttnccctatctnatggatatatcttcttatatggcttctctgtccatgaagcaaacttcttgttgatggtaaattatcgtaccgccatcttgagctcctccattattgagtagtccattcgttccctatcttaaggttactgaggtttgtcctaaaagtcaatattttgaaactttgatcattaatagcaaaatattcataaatattgactaaataaaataaaactattacatttatttattattaaaagcatgtgccacgttatataattcctgtaatttaaaaataattatttttatagatattattggtcaaagttttaaagctttgacttaaaacaaatctttgtgaccttaagataaggaacggagggagtagattgtaccaatatccattattgagtggttcttatcatatgaaataaccatctcacttgatacgacatcactagcaggaatggcaacacaatcattattaacaacatgttcatcacatacaaattcggttggtgtctcttctcttaagcctaaaagcgcatacatctatttttcacccaaaactgcaattatattttgctcaccatgtgtctccaaagctatcccaatcaactattgccatattttctataagctctagtttagacctaaacaaatgcaatcctctattgaacatatatcatgattgtatgaggtccaatactctataggaccaataacaaaataatgaaggcaataatcctgttcagcagccacacacttgcttttgttgtcagacctgcaacctcgatattcgtgtctcacgatgcaggaccgtatgcacgactgtatccatgagctgctataaacgtttactaaatatgtgcaacactagtactcattttgcatatccacaaccacgactccacgagatgctggactcatcagtctaagggtatatatgtcctttcaggttcccgatacaaggaaaaaaaatgtcattttaataaaatggaatatattcttagtgttgttttttgaaacaaatggtccggatggcaaaacttcgaagaacaggtttgaagtcctaattttctcgttggcaacagctccgtccaacgtgcatcgagattcgtgatcctgaaacttgtggtatttggtttcgcttctctggcctccgtcctgctcgcctgccccatccgccgcgccgcgagccgcctctccttcctcggcgtgttcctggcttgcctttgccgcggtaagtgaggttggaaataagcttagaacccgctacgaattccttctcatcttccttcgattccgtgttcttttgcttttttctctctcttgacaaaattatgccccgtccgattgccgagcgacgctgttggtgatagtcgtttcattccccaatctagctctagaagcagtggcatgagggcggggcggccgaagatcggcgaccaagcgaccagcgacgtggtagtgcggctacggacgccggagggccgcgacgagtggctctactgccactccgcggtcctcgccgccggcagcacctacttcgccgaccgcctctccgacgcctggccgacgtgccagatcctcggctcgcgctactgcgtcgaggtctactgccaggagctggacctgagctcctatgtcacagcgctccggctcctatacgccatcgagccctgctcccatttcggcgtccgcggcgcgctgggcgtgctccaggcggccgtgcaccttggatgcgggcagatcgccgccgcctgcgccggctacattgagtccgccccctgggaggaggccgacgaggaggagattctgaggaccgtccccggcctcggcccgcagtacgagtgcatcctcgcgcgtctccggccaatcgatccggctccggtgacgagcatattcctttcggcgttccggcacgcgacgctctcgtcggcggctgggccagcgcgggagctcaagtccgccgctcaggagcagctggagtacatgctcaccgaagatgacgacgccccattgatagcccttgacaacgacactgtgaagtctcaagtgaaggattgtgccactgctttactaagccagttcagtgctttcatgagctctatcctgacgaaacaaaaggaggcgcctcctcttgatggtgagcacggccagcttcagcaggagttacaattttttctttgtgatatctcttgggtctctcaggtcctgagcaagctcgagatgatgaagtgcattgttgtctactgggtcggagtgtccactgatatggtagaaactgttgacgcggtatgcactggggatgactgtctgaagaccaggctgaaggtggtagaggtgtctgcaaaagtcctggatgctgttgcatttggcaatgtcatccttccagccgaaaaacgccgtcatatggtgaatttatggattcgattcgcaagggtgacaaaatctttggctgatcagggcgatcaggatggtgacggcgaagctgagacaccaaaggaaaacctggacaatgaggtctgtcagggcctggagtctgcaattgtttcgattgtgctgacacttccgtcaaatagtcaagctgagattttgtcagagtggcttcagtcgaaacatgttagatatcctgaccttacagaggcacttgaagcctggtgttatagatcgaaggttgctaaaagaaggctctctttcttgagcgacattggccaggtatcttgattcctgaccaattaacaattaaccgaagcggacctgagatatctgaattgaacaagtttgcatgctttctgctggggaaaatcatcaggttctgtgatcaccagcataaattttggaatttggaggcagtgcagaaaagggctcttgccaatattcgtatccatgacatgaatcctgataacaagtagccgaagcggggagggcctgttcggttgtttgggattggagccccgaattaattcctagccgaattacttatctaatttatatagattttaataagctggaatgaatcctggcttattccggtacaaccgaacgggcccttagtaaattacccagagtttgtctctatagattgcagactaactttaatctgaagcgaaacggcctgtgattaatagggtgtcatttcttgcttgtggaaaagaagtttgtaatgagtgatcagttaacattgtctttgagaaaagactcaagggatgcgacatattcacttaccgaatgtaaatcatgattcatgagcagttgacatgcatctatacgtgtgtcctttgtttcgtgagggtcatgactcgctgcccacgctggacgcagagcttttataacagggccattattattcaagaaaaatgctatggtggccagtacttattaatgtcctctccatggcctaatggataaggcatttgactcctataattaggtgattgtgggtttgagtcctcacttcgttgttttttttttgccgtgctctgattattatttttcttccctaccggtgttcacaaatttaacaaaaatacttccatcttacttaggtcccgtttaataaaagagctaatcattacctaactaaaagttagctctgatgcatccaaatgaaaaacttaatagatagactgatttttagccaagacttgttaacaaactaacgccaggaaccatttagaaagtcacttttgcccgctcaagtggcgagacatcctcctagtactgatgcctacaaataacaattttaactcatattgttcgctagtgattacagatatagttcagagaatgtaacgtggacatgaataaagataatatggtgatctagaaaatcaacgcctcaaaggaagacacaagatgaaagaggcctgaacaaagagatgtgaagaaatgaagaaaacatgctacctagcagcgtttgatgtgtccgatgaagcaccggataaaacaccgaacatgag

SEQ ID NO: 7293 - DNA, 2045 bp, Zea mays
gatcctgaaacttgtggtatttggtttcgcttctctagcctccgtcctgctcgcctgccccatccgccgcgccgcgagccagcgagccgcctctccttcctcggcgtgttcctggcttgcctttgccgcgctctagtagcagtggcatgagggcggggcggccgaagatcggcgaccaagcgaccagcgacgtggtagtgcggctacggacgccggagggccgcgacgagtggctctactgccactccgcggtcctcgccgccggcagcacctacttcgccgaccgcctctccgacgcctggccgacgtgccagatcctcggctcgcgctactgcgtcgaggtctactgccaggagctggacctgagctcctatgtcacagcgctccggctcctatacgccatcgagccctgctcccatttcggcgtccgcggcgcgctgggcgtgctccaggcggccgtgcaccttggatgcgggcagatcgccgccgcctgcgccggctacattgagtccgccccctgggaggaggccgacgaggaggagattctgaggaccgtccccggcctcggcccgcagtacgagtgcatcctcgcgcgtctccggccaatcgatccggctccggtgacgagcatattcctttcggcgttccggcacgcgacgctctcgtcggcggctgggccagcgcgggagctcaagtccgccgctcaggagcagctggagtacatgctcaccgaagatgacgacgccccattgatagcccttgacaacgacactgtgaagtctcaagtgaaggattgtgccactgctttactaagccagttcagtgctttcatgagctctatcctgacgaaacaaaaggaggcgcctcctcttgatggtgagcacggccagcttcagcaggagttacaattttttctttgtgatatctcttgggtctctcaggtcctgagcaagctcgagatgatgaagtgcattgttgtctactgggtcggagtgtccactgatatggtagaaactgttgacgcggtatgcactggggatgactgtctgaagaccaggctgaaggtggtagaggtgtctgcaaaagtcctggatgctgttgcatttggcaatgtcatccttccagccgaaaaacgccgtcatatggtgaatttatggattcgattcgcaagggtgacaaaatctttggctgatcagggcgatcaggatggtgacggcgaagctgagacaccaaaggaaaacctggacaatgaggtctgtcagggcctggagtctgcaattgtttcgattgtgctgacacttccgtcaaatagtcaagctgagattttgtcagagtggcttcagtcgaaacatgttagatatcctgaccttacagaggcacttgaagcctggtgttatagatcgaaggttgctaaaagaaggctctctttcttgagcgacattggccaggtatcttgattcctgaccaattaacaattaaccgaagcggacctgagatatctgaattgaacaagtttgcatgctttctgctggggaaaatcatcaggttctgtgatcaccagcataaattttggaatttggaggcagtgcagaaaagggctcttgccaatattcgtatccatgacatgaatcctgataacaagtagccgaagcgggggaggcaggatggcagccagattagtagattacccagagtttgcctctatagattgcaggctaactttaatctgaagcgaagcggcctgtgattaatagggtgtcatttcttgcttgtggaaaagaagtttgtaatgagtgatcagttaacattgtctttgagaaaagactcaagggatgcgacatgttcacttaccgaatgtaaatcatgattcatgagcagttgacatgcatctatacgtgtgtcctttgtttcgtgagggtaactcgcttcccacgctggacgcagagcttttataacagggcaactgttattccgggaaaatcctatggtggccagtacttattaatgtcctctccatggcctaatggatgaggcatttgactcct

SEQ ID NO: 7294 - DNA, 1648 bp, Zea mays
gggggaagcaaccccccgcaccgcgaggccgcaaaagcaatcgcgaaagcgagcgcgaggcgagtcggccggcgaagggggcggatggcgcgcgggctgcgcggcgtccgcgacgacctatccgagctggggcgccacctgctcgacatcgcctgcttcctgcacccgctcctcaacccggcccacaccgactccccgccacccacccccacgggccgccgccgccgccgcgccgctccccgtccccgcaccccgccgcgccgccgtcaccgtcgctcctcgcgggcatcctctccgacctcgccgagatcggcggctccttccgcggcggcttctcccgctcctcgccggcgcccgaccaccccgcccccgacgcgctcgagtcacagcaggccgcctcgtccccgtccccgcgtccgcctcctcctgctgctgccgaccagatcgcagatgatgtcgtgggagcagcgcgtgccctcgccgcgcggcccgaggcgtggatcgacttccccgtgctcgccctagatgagggttctgtaatttctggtatccaaagggatcatatggaatccattgaaaaacttgtcccagatttagcatctctacggggtaggctctgtccttcttacatggatgaagacatattctggaagatttactttaggttgcttgagtcaaacataaatgagcatagttctgaggaagatatccggagcgtgccaaattctgtacatcacaacaatgagatagagtctgattctccacctcacgtctgtgagatagaaagtgtgaaaagcaaccaagaagggtaccaatcttcggatggtcgtgctttccccaagacaagatctgagcgaagcattgaccaatgggtatttgcaaagtcaaaatctgaggaaagcatggatcagtggtctgaaataccttcagatgtggaatccttcagagaaggtaaaaggtacctcagtagcgaggagctgagtgacgttgatagtgccaacgttgttgtcatggacaaatacatggattcactcctctctgaccggaggaaccttccctacgctagctcctcggtgcgccgggattcagtcagacgaaaacctgcttcgtccgccgattacagccgccgacctccgcagccaactccacctgcatcgctgtcaaagaaggaatcgtgggatgtcattgaagattcggagttcgatatacttgacagttagtaattgagatctttgcgatctcaaggctgtttatccttctattttcttccatgtttccccacacttcacctcgtttgtaaatgtggacgtgcaggtggcgtcagtgatagtgggaaaggactaatgttctttttaccaatatattataacagtgtgtgcatataaatcttctgagctcgcaagctgtgagcctcccaggttaaaagtgtttatatgttggcatcattgtttgtttcagatattttattgcagaacagaaaattgccacctatcattgcgaaaaaaaaactcgagggggggccccggccgcccttttttttttttttttttttttttcttcaaccaaagtttctattacgagttacaagttacaagcttcagtggcatactgaacagcatacaacgaccacaaaacaaaacactgttag

SEQ ID NO: 7295 - DNA, 1042 bp, Zea mays
cggctggccccaccgagctgcagaggatgggcctcggcctggtcgtgggtgccctggccatgaccacggccgggacggtcgagcacttccggaaggccagggccaccgcagcgatgagcagcgacctgcatatcatgtggcaggtgccgcagtatgcgctgatcggcgtgtcggaggtgatgatgtacgtcgggcagctcgagttcttcaacggccagatgcccgacgggctcaaaagcttcgggagcgcgctgtgcatgatgtccatgtcgctcggcaactacttcagtgacatcatcgtgagcgcggtgaccaggctcaccacgacgcgagggcggtccgggtggatcccggctgacctcaacgaggggcacctcgacaagttctacttcctgctcgccgtgctggccgtcgcggacttcgcggtgtacctcgtatgcgcgagccgctacgggagcggcaaagtggacgggaggagcagcgacgacgaggaggagggagcggccggtcaggtgacatccccggcttacgcatgaccatcaccggccgcccggccggcgggcatcgtacgtatgttgttcttgtcttcttgaggtggaggctggcaggctgcaaatctcgagggccattggttatttggttgacggagttcttccattgacgacgatagcacaagcatggggcgagcatggacatagtgatatgactaattaaagaataagcacttaagcaggactagctaaacactacatgctgcagcatcatgctcgcggtttttggccagtgtaacaacagacgacgattgttactgaccacgactgttctttgcgtggtctacagagttcgcttctgcaaaattcaataatgggcgagtgctgtatcatataaagtcgcaggttgcgccacgtagctacgatgtgactaacaaacaaatatgtattcaagttatgtattaaacggttaaccgtgtctttttaccgtttcaaaaaaaaacaaaaggcgtccgcggacgcgtgggcggacgcgtgggcggacgcgtggg

SEQ ID NO: 7296 - DNA, 1134 bp, Zea mays
  misc_feature (640)..(642): n is a, c, g, or t
  misc_feature (660)..(660): n is a, c, g, or t
aaaacacaccgatacagcacaccgtccatctctcccctccccctcgcaccgccgcgcggacacgaacacgcgagccaccgaacaggtccgggcccgatcgcaccgaccagccgcgcccgaggggcggggaggtggatccagtccaggggtgggctcctcttcaccgccaccgatggacttgggcctcagcgtcgcgggtaggaccggcagcggaggaggagggggctggagagggagcgggggcggcgcgtccgcggcggcgtggacccggctcgtcagctctggcgtggaggacgagctggtggccgcgtcgggaggaggaggtggtggtggtggaggacgcgctggggcgagagccggaggcctgccgctgggccactttttggaggcctgcttcctctgccggaagcccctccccagcaaccgcgacatatttatgtacaggggtgacatcccgttctgcaccgaggattgcaggagggagcagatcgaaatggacgaggagatggagcggaaggagagcaaacccaagaacgtggcgccgagaggagctccatcccccaaggacgtggactccccgccgaggcctcccaaggcccgggccgggtcaatccttgccggctaacaccgtgaagaaaannnaaaagctcacaaacgagntctcacgtgtgcgcgctccccctccccaaaaccaagagatcagaccccctcttaccaccacgaactaccaccgctacagttacgtatatgggtttgtgctttttgtttaaaccccttgcgccattggtggcgccgtgacctgctcagtgtcagtgcctgcctacctgtatggctgtgatgatgtatagagatgggggaggggaggggaggggaggagagcgcgctggtgtttaggaccgcatgcagctcttattgcgctgctgtgtcgttcgttgtatcatgtgtgggtgtttctggcctccgtttacaggggatttttgtgaaatttctgtgtgtgctacgtagtagtagtagtagtcggtaatgatggtttttaggcttatggtttcccgtaatgatgacgacggaaaatggaaaacatatgtctacagaaagaaatagacatcaagtacatgaccaaaaaaaaaaaaaaaa

SEQ ID NO: 7297 - DNA, 1742 bp, Zea mays
gtttcacctgcatggctgcatctacccaaaatggtctggagatatccaggccaggcagctgttgagtgcaaagctttaatttgccatgcactgaccacagtacgtactcaaccacttttttatctttcacttttaccagatgttctatggttcgatttgctttgcaaagcaactagattaactgccaaagtagtaaaacatctcttgttcagttcctactttaaccagctcgactgtttgcctgagctaatcagcggaatcagcagccgcggctcagtataacaaaccttatcttggccgatccaccgaacctcacttttggccatcgcctgacacacccgcgccgcgtgccgtgttcgatcggcgccatgtctcctgcaccaatgcaagccaccaaccaagaatttctctcctctttttttctgttcgagtagtgcaggggccggcaacaacaacaacaatcatgcggcatgcacatcatccctgtcctgtcctccctcccctagtggcgcatactcctgcactcgtggttctggacaagtcaatctgcgttgcacacttgtcctgcactagcagcgggactgtctgccgccatgcaattgccattgcagctcccacctcgacgacgtgcctataaatgccgccggtgtctcgccggccggacgaaccacaccacacaccaccatccacgcactgctagtaagcgagcttagctactgatcgtcgtcaagcactctcgagctcgatctctcgaagcggctagctgctagcagccaattaatggcgaagccttcgcaggtgctggtgtcggcgctcgccgcctgggcggtggtcctgctgctgctgtgcgccgccgcgccgcggggcgccgacgcggccacggcgtgcgacgccgcgcagctgaccccgtgcgcgggcgccatcatcgggagctcgccgcccaccgcggcgtgctgcagcaggctcagggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgccgccgccgccgcgcgcgtacgtacgtgtcgtgactcgtgaggcgtacctgtgtcggtagcagcatggcccactggacagggacagagtgtggcgtcgctttttttctgtttcagtacgtacgtacttggatcgcggaagcccgtgtatgcgtgttccgttgtggtgttgctgtactcgatctgctgcatgtgtgtatctaccgagctcttcggacagatacgcgtgcgtatgaataaatgatgtaataacgacgtgtgcatccgctatatatatgcatatctatacatatgcttttactattgattgatggctaaaaccttaggtacgtagtgataaaagtagtgctgagaattcactgaaagactgaaacaatgtgcaaatgactagtgtgcaaaatttcctctatccaatccaatggatataaattgtatctagatactcactccgtctcggcatataaagtgtaaccacgtctaatttaaatatcaatacatatatttaattcactctatattactacatcgatgtacgcatatgtaaagaaaacatcttatattacgagactaaaataaaataagtgattacatcttatatattgagatagaaagagtaagtcctagggatggaaaaccctca

SEQ ID NO: 7298 - DNA, 1204 bp, Zea mays
  misc_feature (1193)..(1193): n is a, c, g, or t
ttttttttttttttttaggtcccacaccgaatgacctcagatttttattcgccacttttccgttttggcaacacttacaatcttccagtacctatttgtttttttacgaataaattacttcagattttaggcttgtttactgctgacacggtaaagtatggtggatcattgcagcagtagtctagcacgtacaatcagataccataaaaactgatttgagatggtctggtgacactggttactgtttttcttttatgtacgggactgccggcgtgcaccggcaatttgacaaagcacacatcttgatcagagagcctttgtcttgacagggcctcttggtatcttgttgagcacgttggagtcaaccttcctgtagaatttcttgaggtcttcgcgtcccttggccacaagatggtccacctcggcttcgtatctctcgtacagcgccggtaaagtcagagcacacaaaagcccgccatataacagcgtcgtgaagctgcatgtgtctccaagtatcgccagtatccacagagaaccaatcaccatgaggaacttcttgagatccttcccgcacgcaacgtcgtagaggacggatacaaagtgagccagtctgtaatgggtggtccgcgcagcttctctgaacgcgtgttcagaaacgatcacctccgggatctgtggaggcggcctgtcaaggagaggcgcggcgttggaccagacgaagagcaggaccatcccgagcagcgcgacgtggcaaaggagcgtcaccacgttgtactccgccacgtcgaacaggaaccagaccagcgtcgcccccgcgaggatccccgctgacaggttcctgttcctccatagcaggacgtccgagactttccggccaccgagcagcttaactggtgtgcgcatgcgtctacggaacactagccttggcttcggcccatcgtcgtcgccggaagaatccgtctcgacgtgaggaagcttggctttagacatctgagaaattcctgctgcggcttggtctggtaactcgtctggtgatcacgacggctcttcgccttataatctttttcgattaggatgttctaggtaatggtctcgtgcgaattcctgcagcccgggggatccactagttctagagcggccgccaccgcggtggagctccagcttttgttccctttagtgagggttaattgcgngcttggcgtag

SEQ ID NO: 7299 - DNA, 1456 bp, Zea mays
  misc_feature (1455)..(1456): n is a, c, g, or t
ttgttaaagacaagaaatttgatcatcatcaccaatttgtaagcattctcatattccgttctctggttcaacttcttcaaagtgggctcccgacggtggcggacagctccagtattcgcgcatcctggcgcaaatgggcggcagaaggggttgaagggcctgggaggaggcgaggcgaggcgaggcgaggcgtgtgcaggcggaggtgaggaacacggacgcgagcgctggatcaaagaaaaaaagttgggtccggagtctgggctcaggatgaaaactgttttcgaaaatcatcgtatcgcttccataaagtcaatatcgtttctgaaaattaccagttttaaaattttcatttcaaatatctgtcaatattatattatagtcgctaagaaatactctcactgtttcgttttagttatcgctagatagtacaaaattaaattatctagcgacaactaaaaaacgaaggaaatatattaatcgggtaaatttctgagcgaccggtaatcgttttgctaccggcgatatcgtttcccaccgttttggattgttttcgtctcttcggcacgcggcgtggcctacaaacgcaccaaacgcggagggacgctgaaagccgagggagttttataaagaaaaaaaatacagaggagagaatctcctgtgctggagttgatccaccgaaccctatttggccatgtggtctgacacacccgtactgagtgccgttttattataagctcagttgagtgagtcgctttcggcgccatgtctcctacaccaaccgagaattcatataaatgcctccagcccggcagcgccgggatgctcgataaatctctccatcaggcagcacctagctagcagcagccaatgacgaagccttcgcaggtgctgttggcggcgctcgccgcctgggcggtggtcctgctgctgctgtgcgccgccgcgccgcggggcgccgacgcggcgacggcgtgcgacgccacgcagctgacgccgtgcgccggcgccatcatcatcgggaggtcgcccagcgcggcgtgctgcagtaggctcaaggagcagcagccgtgcctgtgcacgtacgcgcgcgaccccaatcttcagcgctacgtcaactcgcccaacggcaagaaggccatggccgcgtgcaaggtgcccgtgccgtcgtgctagttaacttctgtttgcgccgccgccgcgtacgtgtcgtgtcgtgcctgtgtcagtagcagcatggcccactggacagggacagagtatggcgtcactttctgtttccgtacatacgtacctggatcgtgccgtactgccgtgtatgcgtgttctctggtggtactcgatccgctgcctgttgtgtctaccgagctctttggacagctacgcgtgcgtatgaataaatgatataccagatcgtttggctttaaaaaaaaaaaaaaaaaagcgtcaacccann

SEQ ID NO: 7300 - DNA, 778 bp, Zea mays
ccacgcgtccgcccccgcgccacaccaccatccacgcactagtacgtagtaagcgagcttagctactgatcgtcgtcaagcactcgagctcgatctctcgaagcggctagctgctagctgctagcagccaattaatggcgaagccttcgcaggtgctggtgtcggcgctcgccgcctgggcggtggtcctgctgctgctgtgcgccgccgcgccgcggggcgccgacgcagccacggcgtgcgacgccgcgcagctgaccccgtgcgcgggcgccatcatcgggagctcgccgcccaccgcggcgtgctgcagcaggctcagggagcagcagccgtgcctgtgcacgtacgcgcgcgaccccaagctgcagcgctacgtcagctcgcccaacggcaagaacgccatggccgcgtgcaaggtgcccgtgccgtcgtgctaatttaaacttctgttagcgccgccgccgccgcgcgcgtacgtacgtgtcgtgactcgtgaggcgtacctgtgtcggtagcagcatggcccactggacagggacagagtgtggcgtcgctttttttctgtttcagtacgtacgtacttggatcgcggaagcccgtgtatgcgtgttccgttgtggtgttgctgtactcgatctgctgcactgtgtgtatctaccgagctcttcggacagatacgcgtgcgtatgaataattgatgtaataacgacgtgtgcatccgctatatatatgcatatctaaaataaaaagatatcatatcttatattacgagact

SEQ ID NO: 7301 - DNA, 697 bp, Zea mays
cctcgaggccggccgggccgggatgctcgataaatctctccatcaggcagcacctagctagcagcagccaatgacgaagccttcgcaggtgctgttggcggcgctcgccgcctgggcggtggtcctgctgctgctgtgcgccgccgcgccgcggggcgccgacgcggcgacggcgtgcgacgccacgcagctgacgccgtgcgccggcgccatcatcatcgggaggtcgcccagcgcggcgtgctgcagtaggctcaaggagcagcagccgtgcctgtgcacgtacgcgcgcgaccccaatcttcagcgctacgtcaactcgcccaacggcaagaaggccatggccgcgtgcaaggtgcccgtgccgtcgtgctagttaacttctgtttgcgccgccgccgcgtacgtgtcgtgtcgtgcctgtgtcagtagcagcaaggcccactggacagggacagagtatggcgtcactttctgtttccgtacatacgtacctggatcgtgccgtgtatgcgtgttccctggtggtactcgatccgctgcctgttgtgtctaccgagctctttggacagctacgcgtgcgtatgaataaatgatataccagatcgtttgtgctgagaaatcaataaatttataaaacaatgtgcgaatgattagtgtgcagataaaaaaaaaaaaaaaaaaggcccctagggcc

SEQ ID NO: 7302 - DNA, 1583 bp, Zea mays
cgccccagcccagcgatcgccggagcccgggcctccccaccgctcgcgccggcggtcgccgatcatggccaccacccccgccgaggatccggagcctgggctacctcctcccaaggctctctgcgagcagccgcggcggcggcgcccgtgcgtcctccttagcttctcggcagcgcgcgaccgcttcctccggggccggttcctctcggcgggcctgcgccccttctccgtccgcctcccctcgccggccggcaccagcaccgtcgtccacctctgggcgccgccgcggtccgcgcggcggcccgtgctcctcctccacggcttcggcgcgtcggcgacgtggcagtgggccccgtacctccgcagcctcctcgcggccggcctcgaccccatcgtcccggacctcctcttcttcggcgcctcctcgtccacggtccccgaccgctccgacaccttccaggccaggaccgtgaaggccgccatggacggcatgggcgtgcgccgcttcgccgtggtcggcgtcagctacggcggcttcgtcgcgtaccggctggcggccatgtacccggaggccgtggagcgggtggtcctcgtgtcgtcgggcgtgtgcctggaggagggggacctcgccgcgggcctgttccccgtcgccgacgtcggggaggcggccgagctgctcgtcccccgccggccggcggaggtgcgccggctcgtcaagctcaccttcgtccggccgccgcccatcatgccctcctgcttcctcaaggattacatcaatgtgatgggctcagaccaccttgaggagaaggccgagcttctacacgctctcatcaacgataggaaactgtcagatcttccaaagataaaccagccaacgctgatcatttggggggagcaggatcaggtcttcccaatggagctggcgcataggttggagaggcatcttggggagagttctagattagtagtcgtaaaaaacgctgggcacgcggccaatctagagaagtccaaggaggtgtgcaagagcatcattgactattttcaggaaccgggttcaagtgattgagttggggggaaaggaggtgaagccacaatgtgacggttggaaattctgagctaggacatcgtcctgtgcttggcccgcagttttgccgtttccttggcaccttgtaattgtaacaaaagaacctttgtaatcacacggaccatacaagtctcctgtaaattgtctgagggctttctgcgctcaaagaaacacactcctgagctgtgaaattgaagaaggtagaaggctgaggtcctgttcccttgtccagccaatgccaaatgccactggaaaacggcctccaccgcaccaatctcgtcggtttttaatgccattttgatcatatcaatttatgatcattctatgctcaatatatgtaggattcagtaccatcatatataacacttagtttatctgtaaaatagaaacaacagccttattattgtaatggccccataaggtacagtaggctcgcgggctatgaacgatatggttgaaggatgaaacgggctatgaacaaatggtggctgcatgtttc

SEQ ID NO: 7303 - DNA, 1564 bp, Zea mays
gcacgagaccattacctagaacatcctaatcgaaaaagtagtcagaccatagctaagctgagagcaaagatgtcttggcggcgaaaccagctacgtgcgtttctcgttctcgccgtcatcctcctcatcaccgcagctacctaccgagccaatgcgcagccggcgcctccagcagacccaacgccagccgctgacacctgcgccgaccccagcgtggaaggggcgtgccgcaacgtcccgaaggcgctgcgcctgaagctgatcgccatcccgacgatcctcgtctccagcgtgatcggcgtgtgcctgccgctcttgtcccgctctgtgcccgcgctccgccccgaccgcaacctcttcgtcatcgtcaaggccttcgcctcaggcgtcatcctcgcgacgggctacatgcacgtgctcccggactccttcagcaacctcacctcgccgtgcctgccgcggaagccgtgggccgatttctccttcaccaccttcgtcgccatgctcgccgccctgttcacgctcatggtggactcgctcatgctcagcttctacaaccggaggaagggtggcaacacctccggccgacgcactagcggcgcggtcgccgaccacgagagcccggcgcatgagcaccactggcacagccacggccatggacatggacatggacatgctgggggcatcgtggtggctgacaagcccgaggacgatgaggccagccaggtgcagctccgccggaaccgcgttgtcgttcaggtcctggagatgggcatcgtcgtgcactcggtggtgatcgggctgggcatgggagcgtcgcagaacgtgtgcaccatccggccgctggtgacggcgatgtgcttccaccagctcttcgagggcatgggactcggcggctgcatcctgcaggcggagtacggcgcgaagatgaaggcggggctggtgttcttcttctccacgacgacgccgttcgggatcgcgctggggctggcgctcaccaaggtgtacagggagaacagccccacggcgctcatcgtggtgggcctgctcaacgcggcctcggcggggctgctccactacatggcgctcgtggagctcctggccgccgacttcatggggcccaagctgcagagcagcgtcaggctccagctcctctgcttcctcgccgtcctcctcggcgccggcggcatgtccatcatggccaagtgggcgtgatcgtattcgtatctgagacgacatgacacagtactgttacaccaacactgcctgcagtctagctatctgcaagactgcatcgctgcatgcatgttcctcctatagctggctgttgtatcatttcgcgtgcttcgttgctccgtgcgcttccgtgtcgccatcaggaagctaggtatatattagacgcagatagcgttgttgtcatgactattcaacgtccacggtacaatacaaaagtagtactctatctatgtattaactatgttcttaaatatttgtcgtggtaaataaaaaaacaatataaatagtaaaaaaaaaaaaaaaaaaaaaaaaaaaaaaaaaaaaagaa

SEQ ID NO: 7304 - DNA, 972 bp, Zea mays
gatctggagcgctcagtttgtcgttgggtgcctcgccgccggccggcaatcgcttggtttgaagcagattctatttgtggcagtcattcagtggcgattccgcttgttctcatgttaccctacttgtggcgtttattccaatgtctccggcaatacaaggatacaaaggagaagacatgtctcctcaatgctctccactcctcgaccgctattcctgtgattttcctttctgctctcaagtaccatgtacatcctgatcagtccggccgcgccggccggcccctctggcttatctctagtgtcgtatattcactgtattccttctactgggatataaagcgagattgggatttgagcatcctaaccaggattttcatgttcaaaaacccaagcatatggacatatcttctttacgggcagaactgggtactctactgggtactgggcagcaatttggtcctgcgatgcacatggacgtacaagctctcggcacatctccggcacaactacctgacagtgttcaccatagcagctctggagatactgagacggtggcagtgggtgttcttccgggtcgagaacgagtggaacaagatgacagccaaacagaacatggagatgtcatccgacatgccttccgaaggagacaggctactggattccagtaaccatacagtatgagttgaacagcagtctcataatttttgcgatacacagattcagcaccattcttttagcgtgacccatttttacgtcgacggtttagattttgtatgtagagctaaaaaggcgagggatacgtaacaggtttctatataaaaaggttgaaatttgttggcactacggatgtaatcctcttggcggatgtgtacttttgtaacccacctgcatccaacagggggcatttgttgacacattaaagaaaaatagtaatgctgaaaatcatgagtttttgggcccgtaaaaaaaaaa

SEQ ID NO: 7305 - DNA, 852 bp, Zea mays
tttttttttttttttttacaagaagctgggtctagtggtatatgatttgatgatccaatcattgtatccatccacccacagaatgaagatattttggaaataaaaaaaaggcctgaacccagaattttttttttttttttgatacaaacatactttgtctaattactagctagagcatgatccataaaaacattaagacaccaagcacaagcaggtaagcaattatgcagaaatgctagctcccaaaacaatccttgcatatatccatggctccatccttgcagtaacttgcatacatacatctactgcactagcactacataggcgattatttaacttgcatctgttattcacagtctacacaagaagaggcgaactggaccatgttccatgtgcatttgcttaatctgcacaagagactaattctatattacaaaagctaaggcgccgagaaggcgtcgtcgagcggccacgggaggtgccgttctgcgccgtccatgccgtccggctcagccgaccgcggcggcgcctgcaccatggagcgcagcgtgtcgtggaggcggtcgtggcgcctccggtggcggatgcggcgcagcacggcgtccctgtccagcgcccccgccccggggcgcaggtacaggcagctcgtcaccggcgcggcctcgacgacgctgccttcgccgtcgccgtacccggccggcggcggcgcgttcttggacaccatggaggacgacatggcgaggcaggtgctggttcctcttcctccccctgatgtgagctagctcgagaacagagagagcaggtgaagtgaaggtgggagagagtgatgagcgagattgagaggggtgaagt

SEQ ID NO: 7306 - DNA, 1831 bp, Zea mays
cctttctcccattcgcacgccgccccgtgccgtcctcctcccagatctcgtggtctcgtggccgtcgccattcccccccgctccgctacacgccgagcgcaccgattgcagatcaggcgtctccgctgcttctcgccctcgccccgcccgcggcgtggtgaggagaggagatccccctgaggttgtacgagacggtgcttcaggaccgccctctggcgcggaggacgcataagctcggcggcggcggcggcgacatgaagggctcgaccatcccttcggtcgcgatcatgccctcgccgctcttcctctggcggtttaaggttgtgttgtttcttctatggggcttatgttgttgcaagataggttgggactcagttatgagaatgagtgttgatctcagagacctatcgcgcggccgcccgggctggtactataatcctcttcttcttgtggccttgatgatttggttgtggggagtaaatctatgggtctttgcacaatcatctgtgaattatgcaaaagtgtttgatcttgcacaaacacatttatctcaccgtgagatatggaggtgtgctacttggttgacgttaattgtccccactagcatgacagcctacctatatctgtactcacatggagaagtgtcccttgcagcatctcaaccagttctcttgtatgctattcttctgatgatcctcctttctccttttgatatgttttacttatcatcacgcttttactttctgagaacagtctggcgtataatactgcctttacaagcaattacatttcctgacttctttttggctgatatttttacatccatgtcaaaggtgttctcagatctggagcgttcggtttgtcgtatggtgaatcgccaggttgcaacaatcgcttggtttgaagcagattctatttgtggcagtcattccgtagctattcctcttgttctcgtgtttccctacttgtggcgtttcttccaatgtctccgtcagtacaaggatacaaaggagaagacatgtcttttcaatgctctcaagtactcgacagcaattcctgtgattttcctttccgctctcaagtatcatgtatatcctgatcaatgggttggcttctaccgccccctctggcttatctctagtgttgtaaattcactgtattccttctactgggatataaagcgagattgggatttgagcatcctaaccaggattttcatgttcaaaaatccaagcatatggactaatcttctttacgggcagaactgggtattctactgggtactgggcagcaacttggttctgcgatgcacatggacatacaagctctcggcgcatctccggcacaactacctgacagtgttcaccatagcagctctggaaatcctgagacggtggcagtgggtgttcttccgggtcgagaacgagtggaacaagatgacggccaaacaaaacttggagatgtcatctgacatgccttccgaaggggacaggctactggattcgagtaaccacacagtgtgagctgaacagcagcctcacatttctcgatacagattcattgccattcttttagcgtgaccattgtggccaatcttacgtcgacggttcagattttgtctgtagagctcaaaaggtcaaagggatacacaataggtttctatataaaaaagttgaaatttgttggcggcttcggatgttatacctcttgaggatgtatactgttatagccctcttgaacgattgaatctaacaggaggtattcgttgagacatgaaagaataaaagtaatgctgaaattttacgaaaaaaaaaaaaaaaaaaaaaaaaaa

SEQ ID NO: 7307 - DNA, 1692 bp, Zea mays
tgcagcatcctaaccaggattttcatgttcaaaaatccaagcatatggactaatcttctttacgggcagaactgggtatcgacctgaacacataaatgcttcttagttaactccatgaacagtttgtcaccggtctgttatgtacaaattgtacaggtattctactgggtactgggcagcaacttggttctgcgatgcacatggacatacaagctctcggcgcatctccggcacaactacctgacagtgttcaccatagcagctctggaaatcctgagacggtggcagtgggtgttcttccgggtcgagaacgagtggaacaagatgacggccaaacaaaacttggagatgtcatctgacatgccttccgaaggggacaggctactggattcgagtaaccacacagtgtgagctgaacagcagcctcacatttctcgatacagattcattgccattcttttagcgtgaccattgtggccaatcttacgtcgacggttcagattttgtctgtagagctcaaaaggtcaaagggatacacaataggtttctatataaaaaagttgaaatttgttggcggcttcggatgttatacctcttgaggatgtatactgttatagccctcttgaacgattgaatctaacaggaggtattcgttgagacatgaaagaataaaagtaatgctgaaattttacgaaacttctttcaggttgtcttcacttacgactattgtcctgcctttatctttattgtgtaccaaagtgtacctgcattaaatcattagtttttttggcccccagcacatatctctttcatattgtttagcatatccttggtgagtgccgtatagcagacatacaaactgcttgcgtgagcaagacatttcacatcaccagcttatcaggtggctgggacctgatgaagtagcatcatagcagtgaagaaaacaaaccgttgaatccaaggagccctagtctttttttttttttttttgttcctcttcataacgaagacattttgttgtttttttataaaaaaaaaatgaacccagaacacaagtaaacatttaatacagacatgctttgtttaattacttgagcatgattcataaaacaccaagcatgcaagcaattatacaaaggcgctcccaaaacaatccttccatatgcatggctccatccttgcagtacagtagctcacatactacagatgattatttaatctgcacctgttcttgacgatgtacacaacaagaggcgatcatccatggcatggcatttgcttaatctgcgggcacaagagacgagcgactagtgattctatttcacaaaagctacggcgccgagaaggcgtcgtcgagcggccacgggaggcgccattcggcgccgtccggctccgccggctgcgcctgcagcaccatggggcgcatcgtgtcgcggaggcggctgtggcgcctccggtggcggatgcggcgcagcacggcgtccctgtccagcgcccccgccccgggccgcaggtacaggcagctcgtcaccggcgccgcctcgacgccgccttcgccatcgtacccggtcgggggcggcgggttcttgggcaccatggaggacgacatgcgctagctccagagagagagagagacagtgacagcaacaggtaggctatatgccgacgtgagagagcgctaacgagctcgtg

SEQ ID NO: 7308 - DNA, 2377 bp, Zea mays
  misc_feature (2267)..(2267): n is a, c, g, or t
aacccaaatagagggagtacctactgacggacgtgttgggtcagattgggtcctgggcctcaccactcatagagcccgaaggccacaccaggcctacgggctagcaggcaggaaggcccagtaaaaccgagtgattttccaccgcgcggccgcccgcggccccggcgcctgcgcctgcgcctccgcttcctcgaggccgcgtttcgccggctgcctgccggcggtccaccataacatgggcggcgggcggaagcggcggcggcgcgacggctcggagacgccgtcgatgcacccgcggaaccgctacgcagccgccgcgccagatttcgccgcgctggcggagctctacccgtcctttcgccccttcgtcttcatctccggcagcgggcgcgcgtccgttgacttcaccgacttctcctccaccagggagctcacgcgcgtgctcctcctccacgaccatggcgttaactggtggattccagatggacagctctgcccgactgttccaaacaggtccaactacattcactggatcgaggatcttctctcctcagatctgattccaccaatatccagctcgagtgagagagtgaagggcttcgacattggaacaggtgccaattgcatctaccctctccttggagcatctttactgggatggacctttgttggatctgatgtcactaatgttgctcttgaatgggctaagaagaatgtggagagcaatccacacctggcagagttaattgagatcagaaatgcaaatgcagcaccatctgaatctgaaactgttgtcagggaagctgccagcgagaagattttagagcctgcggaggatgtagctatgccaaagccacatatcccttgtgggtgttgtaaaggagagtgagagctttgacttctgtatgtgcaatcctccattctttgagagcacagaggaagctggccttaacccaaaaacatcgtgtggtgggacagctgaagagatggtttgccctggtggcgagctggcatttattacacaaatcattgaagatagtgtttcccttaagaactctttcaggtggtttacatcgatgattggcagaaaggcaaacttaaagttattgatctcaaaggttcgtgaggctggggcatcagtcgtgaaaactactgaatttgtacaaggtcatacagctagatggggccttgcttggtcattcattgctccgaaaccaagaaaaatagtcctcggctccagtgctccagcaaaaaaacaccattcctttatgcttcaggggcttcgtcgtgaacatggtgcgttccaaattctgaaatcaactgaggctttctttctagcttctaatctatcatgcaaaacggattcgtcggccttttcagtcgatgtcacattgtcagatgagcagattgaggctgcaatattgcatggggttgattatgccggttctctagaagatagctctgcaaagttacaatgcgttgtcaagggaatatcatttcgtattacagtgtttgaacaaattcctgggaccctcctaatcaaaggttcattattgaataaagcattatcaggtaccttctcatcattgttttctcggttggaggatgcgttaagggcggaatgtctcagtaaggcgcgatagatctttaattatgagctttgatgcctctgcacggataagtcttctggatgccaaggaatgtgcaaaacgaaatcatgggacggcaacagcgtattagcttatagccaggagtcacaaacagagacgctaagcggtgatggaatctctgcacttgcactgcaggaaccattgttgctcgcatgttttcttgatgtgcagtgacggcaagtttgtgggaataccagcatcatgtctggtgtgctggctgcttatctggatttggagaacgacttgacatgacaacaatgggggtcttgctttcaaggccccctgcagtggcacgcaccgtaaaccattccagtgacactgagtagatgacaaatgcagcatcagtggtctgtgcagaccggggtatctggtacactgaattgcctccagagttttttctttctttcttttttccattctttctttctttctttgctatggcacgggaactcagatgaaggctttgaacttcagtgaaccgcacagtgcatgaaactgctgctgcttcaaattaatgtgtttttggaacatgtttgtagcacaatgcctctggccggtagcagtggattatgtaactgtctctaacactgtcagctncaaggcaagttcatcatgaccagtcgattcggatcatcggtttagatgaaccgtgattcatgaagcttggtcatttagaggcgaaacgaaggcgtcatcttaggcatctc

SEQ ID NO: 7309 - DNA, 2377 bp, Zea mays
ccggccggccccgaccacaccaaccacgcccccctcccgcctccaacccattcttcggcggttcggcccggcctgcaccctgcagccaccaagcaaacccagtgctctgctttctgcattcccccccgccgccactccgtcgggcttgatgagcctctgctccaagctcttcgcgttgctccgcaagtcccgcgccctcgccaccagcaccgccgccgcagccgccgcgacaacctccgcgacggcgtcggccaacgggatggaggaggctgtcgccgcggcgggcccgctgcgcacgcgcgtctgcatcatcggcagcggcccagccgcgcacacggcggccgtctacgccgcgcgcgccgagctcaagcccgtcctcttcgagggctggctcgccaacgacatcgccgcgggtggacagctcaccaccaccaccgacgtcgagaacttcccgggcttccccgacggcatcctcggcgccgacctcatggatcgctgccgcgcgcagtcgctcaggttcgggaccaagatcctcaccgagaccgtcaccaccgtggacttctccgcccgccccttccgtgtcgcctccgacgacaccgttgtgcacgccgactccgtcgtcgtcgccacgggcgccgtcgcgcgcaggctgcacttcgccggctccgacgccttctggaaccggggcatctccgcctgcgccgtctgcgacggggctgcgcctatcttccggaacaagcccatcgccgtcgtcggaggcggggactccgccatggaggaggctaacttcctcaccaagtacggctcgcaagtttacatcatccaccgccgcagcgacttccgggcgtccaagatcatgcaggcgcgcacgctctccaaccccaagatcaaggtcgtctggaactccgaggtcgtcgaggcctacggcggtgcggatggcggcccgctagccggcgtcaaggtcaaggacgtcgtcaccggcgaggtctctgatctccaggtggccgggctcttctttgccatcggtcacgagccggcgacaaaatttcttggagggcagctcgagctcgactctgatgggtatgtggtgaccaagcccggttccacgcacaccagtgtgcagggggtctttgcagctggggatgtccaggacaagaagtaccgccaggccattactgcagctggatcaggtataagcttcattgttgttttaatgctgctgtttaggtattccatgatcccaatagtgatttgcttatggatcatgccatgctgcatccatgccatgctacgaaatggcattggtggatcctgaaatggagcatgccaggtgttagtttgtgggaagctaattgagattatatagttaagtacatctctagttaaacaaatatccgattagtaaacagagcgcctatgttattatgcaataattttgctgtttacaaaaacaataacaataacatcaacttgtgacttgatacgatggtgtttgactgtttgtgactagacaacaatagtttaaactgtgatttctagttgcatccaacatgctcacacaaacagggtgctgtggttggttctgatccccaccatctttaggtggtttatgtcatgttttctggatttcctgaaccactgtgtggtggaatcttatctttaaattgtttgcctctcaaatctaggcctattcataggtcaggaaagggtggtgtgttcatgcagcattaggttactacttgcaagtttaaatgacttacaagaataataatgagccccccttttcaactttgacctttactctttaggagctctccactctcattgttttacatgagacctacctttataaatgttgtaggcattgaaagcatatcctcactccttattccagtattgaggttcccttctctgtgatattgagattatccaatattagcggaataactgaattttgcaatcacgctatagtgatgtttttcagtattccatgtggaagcatgctgaatgattttgttgtgattaatatttaagatgagtaaaagctgttaactagtagttacatagtattaattttaatccttggaacattatttattagtaataacttggtataaatgatctagttgggcttgggcaattaggatagatagatcttggacgttggaccaatggcaattatcatatgccatgagcagcataacagtaaaacactaaggtcccatttgtttcctttcattttgatgaattagaatcttactaatggaatagactatttttttagaatgcgacattgcaccacttttcaaagttatcatataagcatatctcaaattcatgggtgaaagatggaaattgattctatagatttacatac

SEQ ID NO: 7310 - DNA, 4014 bp, Zea mays
  misc_feature (1341)..(1341): n is a, c, g, or t
  misc_feature (3347)..(3347): n is a, c, g, or t
cttggttctcccgagctgaacgacatgttcaaccatctgatcgaaattggctgtaccaagatctgataagttatattgacgaatgtttatgtaggaactgtatgcatgttttagtcatataattcaattatttgatcgcaacaacgaaatatttgtacactatgtaatgcagtgcaaataatgttcatgttctgttttcatttatcctcaattagaaacggtagcttatatttatataataatagcattggatattcttatcgatgaatgatgaactgaatttttaacattgtgctgacttctgtagcgacatcaaaggttagtaagacctttccgtgaggctagctaaaatacgacatcacatcaacctttcgagtcgggtaaatattgacatgataaggaagacgggaacttacagaaggaaaaaaaacgtaccagaaatacaaaagggagataaatatgacggcaacaagaccaaatccaaccgttctccctcttcttcttttttccgtctatgtataagtataaggctctttcgaagcggaatgtattctgctaatgtgcaccaaccttatgtagcctttacatcatatagtaaattatttgtatttgtatagccaaaatattaccaactaatagttgtgctctaacattttatcgaataatttatatacttcttattcaaaaatctataataattctttagagatattttatataatattataatgtttgttcgacatctatttattttatttgagtcagcgtatttataataatattacatattcatatcgttaatataatattaatgttacagtgatattttactatacagattttgtatatcataaaaatatttatcgatacatatctatattttatactattttttaactttctagcaacacggaggtctaatttctacgtttattgggcctgcgtggaagatgcaaacatgccctttccagcctggtacgtaccatggcagcagaaccgaggcctgccgtcacttgtgcgaggccacgcgcgtggcggattgtcagcctcataccgtcacgacgatccaggcatccagccatgcagcaagtgcctccgaactttgaccgttgtgaacgggctcgcccaccttcggccgggccggcccaccttctccccggtgcatgcacgtccccggaatcccagcgcccctgttggcagcaggcggacaagcccatacgagaactctgggcccacgcgccaaaacgtccaaccgcgcgtgactcccccctccctcgggcctcggggagatgccatgcggccgacatccatgggcggggcggggcgcagctgcttggcttngcgctagcgccacccgtgccggcacgcacccgatgacggcagcacccaccgcctgattgcgtccacggcgaccgtcacacaccgaaccgacctcctcgcagcctgtgcctgcaacgacacaaacgtgtcgtcgccgactcgcctgcatgcatgcgcccgtctatataaggccgcagatgccatgacgactgacgggccaccgttccaagagcgagccgacgacgacgagcagcgagagagatgaggccgtccatcgtgctgttcggggactccatcacggaggaggcgttcggggagggcggctggggcgcgtcgctcgccaaccactactcccgctccgccgacgtcgtgctgcgcggctacagcggctacaacacgcgctgggcggcgcgggtcgccggccgcgccgtggccagcatcgccggcccggtctcggccgtcaccgtcttcttcggcgccaacgacgccgcgctgcccgaccgcgcctgtgcgctccagcacgtgcccctcgccgagtacaaggacaacctccgcgccatcttcgcgctcctcaaggttaaacaaacctgcggttcagtccgtgggcacgcaaacctgcatttcgcgacggcggcactgacttgagctcctattgctctgtttttccagaagcggtggccgtcggtggtcgtcatcctcatcacgccgccgcccgtcgacgaggacgggcgtctgcggtgagtggccgttccgatcgggatgttctttcgtatcgtagtatacgccgcgcgcaccggcgaccggcattcgatcctgatgggacggaacatgggaggaatgaatgcaggtacccgtacgcgcacgacttctccggcctgccggaacgcacgaacgcggcggcggcggcgtacgcgcgggcgtgcgtggaggtggcgcggcagtgggggctcagggccatcgacatctggtccaggatgcagaggttccccggcggcgtgccggcggtccgcacgcacgcacgcactctgtcctgccgactgccgaggcgccgccaccgcggggatggtagtagtagaacccaaatgaaagtttgccatttcttgcctgcctgtggttgcagggacgggcttcacctgacgccgcgcgggaaccgggtgctgttcgaggaggtggtgttcgcgctcaaggacgccaacctcagcctggaggcgctgcccgccgacctgccgctcttcagcgacatcgacccggataatccggtcaagtcgttcgaggaccaggagtgaagaaggcccatgatggcaagacaacggcggcagcttcaagtctgggaactctattgttaattagaaaaaaaaatctgggaactgtgtcctacagtgcatggaatgttctggatggaatttttttagtcgaagcataattcttgaaatagtgtcttacgcttagcagtttgctactttgctgtataagtttgttcgaggtccattcttttgcccacatttttttataatacaagcaggtttctcggagttccaatttataattcgtttgactttttaatttcaaatttaatcggctcgtttattcaaacaaattataaaaattattaattttactatgatattacttaacatataatatattttaagtataattttaattttcgttttctaaaaagattaaataagacaagtcaatcaaatttaataaaaatagtcagacggagtataaattagaacgaagggaagggagtacatcgtaatgttttgtttccatgtttcgtgtgccccgcaagtatattgtgtcaactttgttagtatgtgtcgaattatttttcttcttgttggaacgaaagtcgaacccgacctcaattagatttactcggcaagagttaaccatgtttggacgcagggtccagaacagcaagagacttcactacctatcagcaaggaggtcctcggccgtccctgccaaaggcgactgtgcgaaggaccatgcaagaagaggggctcgccatttcccgnactatgacaggggaaggccacctccgcaggacgaagtcgacatctcgacgaagacgttttcgacggtcaccacaaggcgaagggatcaacatttgtgctaaggcataaagcatcctccgtggagccatccttcacccgacatggcttagaccacttgtaagcccccaagaggggtagagttttaggtgtagttaggtagtgaattttgctatgttgtaatgaccccactttatggaatattctgggaatgtagcaggtaactagggccataatggtacttcagtctacctgctccccggttacctacaaatacatctgttctatacacggacatgacatgcataacaagacgctacatttccctacctaatgtgatgtcgtgcatctgagcctcgtttgttcctgagtgcttgggcccgcttgaccacattttagtaggtctaacatttggcgctccaacatttttggtatgaagaccaacacccatggctcctaagaaaaacaccaccaaagttggcctctccctaactgaggtcatgaaggcaaccctctctactgagaatggcaaggccccctcgcagacaacgacatgcccctcacagctgaggacaatgcatgcgagcaagacaactctagcgcccccaacctaaggacccgcctacccacg

SEQ ID NO: 7311 - DNA, 1011 bp, Zea mays
accgatccaagagcgagccgacgacgacgagcagcgagagagatgaggccgtccatcgtgctgttcggggactccatcacggaggaggcgttcggggagggcggttggggcgcgtcgctcgccaaccactactcccgctccgccgacgtcgtgctgcgcggctacagcggctacaacacgcgctgggcggcgcgggtcgccggccgcgccgtggccagcatcgccggcccggtctcggccgtcaccgtcttcttcggcgccaacgacgccgcgctgcccgaccgcgcctgtgcgctccagcacgtgcccctcgccgagtacaaggacaacctccgcgccatcttcgcgctcctcaagaagcggtggccgtcggtggtcgtcatcctcatcacgccgccgccggtcgacgaggacgggcgtctgcggtacccgtacgcgcacgacttctccggcctgccggaacgcacgaacgcggcggcggcagggtacgcgcgggcgtgcgtggaggtggcgcggcagtgcgggctcagggccatcgacatctggtccaggatgcagaggttccccggctgggagaagtcgttcctgagggacgggcttcacctgacgccgcgcgggaaccgggtgctgttcgaggaggtggtgttcgcgctcaaggacgccaacctcagcctggaggcgctgcccgccgacctgccgctcttcagcgacatcgacccggataatccggtcaagtcgttcgaggaccaggagtgaagaaggcccatgatggcaagacaacggcggcagcttcaagtctgggaactctattgttaattagaaaaaaaaatctgggaactgtgtcctacagtgcatggaatgttctggatggaatttttttagtcgaagcataattcttgaaatagtgtcttacgcttagcagtttgctactttgctgtataagtttgtttgaggtccattcttttgcccacattttttataatacaagcgggtttctcgacgttctaattt

SEQ ID NO: 7312 - DNA, 2096 bp, Zea mays
cttctctagtgtccctaatcgtagcccacaacccataataattattttattaagtttttaattatgtatgattgtgaattggaaagattttgattaatcgtgctattaaattgttaaaaatgattgtgtatattatattagatggatatccgaaatccatcgaaaacccgatcgatatagacatggatatgaatttctacccgctgatataattaaatacaaccttggatatagttgcagatcgatctgttgtcatccctgttctttgcccactttcaccttgctttccccatttcacacgctttccttccgcccattgacgagttgacgaccaacagacccaggcctccgaccagatcgaggtgagcgaacgtgccccgcctgcgctggtgacggtgagggtgaggccgcacgccatccgccatcctcactgatggttccgtcccgccgccatcggagagtgtagaagtggaagcaagcagataaaccccaggttctgtacttctgtcaactgtcctgtttttcagacgaaatcgaaacatgttagatcaatcaatggacacctctttttagtgtcgcacttgttgaaacggatccactcgagactttttcagatcgattaggcttattcttggggctggtaatgtgagcttctcactaccggattttcctgctgttttctgatgcccatgcccgtctctcgcccgtgcagcacaagtagttcgtaacgccatccatgggatcctccttatcgaacctcaccgacgccgcttgcatcgtgcaccagtttaagatcaacggctactcggctaccaaatccatggcgaggacggactcgctcccgtccaagcggctggccgtgggagggtacgagtgggaggtccactacaccccaagcctcctcgtcgacggcagctacatgatagcgttcaggctcgtcctcctcggcgcgccgcgtcggaacgacgtgaaggcggcgttcagatgtcggctgctgtatccttccaccaactacggtcatcaacgcggtgcgtgcgtcagcgattcaatggggaacgtggaaggtcagatgtctcatgcgttcaagcgggcgaaggagagctcgggatggattccgctccgcaaaaggaatgttgtggaggcggcccgggtcatcgagaacgactctctcactgccgaatgtaccatcacggtggtcaccgagctacctgaacctgatacagcaaagactaacgccgtcttgccccgaattcggcgattgacgggcgtgcattccttgcaccatgatctcggtgagctcttgggcaagggaaccggatccgatgtcgtgctggtggtttgcggtgagtccttcgcagcgcacaaggccatacttgcatcgaggtccccggttttcatggcccagttctttggccccatgaaggagacgcactcgcagtcgcagagggtggagatcatggacatggaggcggccgtattcggggccatgcttcgcttcatgtacaccgacgtggtgcccgagcttgagcggcaggagaacggcgacgtcatcgcgcagcatctgcttgcagctgcggacagatatggactcgacaagctcaaatcgatgtgcgaggacaagctctgcggtggcaccacagtggagacagcagcgacgactctggcgctggcagagcagcacggttgcccaaagctcaaggcttggtgtgttgagttcatcgctgcaaaccttgatgccgtcatggtgaccgagggttacaagcatctgatgacaagctccccgttggttctgaatgaccttctgagagctgtgcgtggaacgaagaactgaagaacattggtagttgtattgtatctgctctctatgaattcggtgtttaagtttatattccttcccattgaggaagggtggattgctggaaggctgtcatttgagaacttggcttcatttctagtcgttgtcccagctcatgggtttatgggtattttctaggagaaaagaggtaagacttaactatcctaatgctacagaaaagatagttaatgaccattcgcacgtagtaaaaaacttttacagaaacctcagttgcggttgc

SEQ ID NO: 7313 - DNA, 1414 bp, Zea mays
  misc_feature (13)..(13): n is a, c, g, or t
  misc_feature (26)..(26): n is a, c, g, or t
tgggtacccttcnagtccgtgccggnaaaaatcagaggaatacatagccgagagcagactaccagatccatggtgcatgctcgaccgtgctatcttcttcccgtacagtgccagccaacaggccatcttccccagcaggctagtgctgcctgcccgtaacctaatggacggctgatgcttcgttgtgcgctcatcttccccgagcagcgcccaccgaagatccgtatgcgcaacctccgatctcatcgacgggtggtgtgctcggcgtggccgtgccgcagcggcgcaagcaagcatggcacttgccctaacagcggcgccggcgcgctcgctgaagcagcagccgaccatagcgcctgaatgctggctttcgtccccgacgccgacgcctgtccgtgggcttcttcttcccgaccatcccccacgtctagagcgagcagccgcgcctgaccggctttcgtcttcccgagcagcaacgccggccgaagccccctcccgacggcacgcgacttgctgaatcatccctcggagcacgctgcacgcgacggactgtctccgacgccggcgcgaatgtgcagatctccggcattcaggcatgtgaagggtcgcctccacccccaccacgcgacgggccggagctgccgcgcactgacgtcagtaggccttcttccccgagccgcgcactaacgtcagtaggcccggagcagccgtcgttggggctgttgaacatgtgctgctgaaactttctgttgtgcctactgaaattgaaactgaacctgttgaacgtgtgctgctgtaagcttgcttctgcttactgttcttcttactgttttgctgttgctgtcactgctgaaactgaacccgtgttcaggtgcatatgctgctaatattgcaagtaagcttgctattttgctgctattgaacctgtgttgaaactgaaaatgaatctgaacctgtatgggtgctgactgctgaaactgaaccttttttgctggtattgcttaatctgtatgtgcgttgggtgtagtaactgaaactgaacctatgttggctctctgttttgcttaaactgatacggacgtggtggtcaaataatctcatgttgtcattgtatgagaaatttgcacatagtgtggtggtctgttgttgcttggcggtctacgaggtgctggctctcttttttggcattttgttgtatttctttagaagccatggttttgtataatcctttgttttttatctcaaacaactaggaccaaattatgactccatcgtttcactttttaaccatatttagtattaataaaataaacaaaagtaagaaatatagctcaaattttgtagttgtggttgaatgttacaaaatttggtgagagaatgtgtcccatttgtgaagcgcctgcattcacacttt

SEQ ID NO: 7314 - DNA, 928 bp, Zea mays
  misc_feature (46)..(46): n is a, c, g, or t
  misc_feature (99)..(99): n is a, c, g, or t
aggggttaaaaacagataaatttccaacagaagatagcattacaancccgtgaaagctactcactctattaaacgtgatcgttaaaaagatccaattgnacaaattcctatggtagctactctctttttctcaaatacacaaaaaggactactaatgtaattacactaacgacacgttttttatgaaataagatatctgtaccattcttttttttttttttttacgcaaatggtagacatatatgtctggcaggttgcattgcatctccgcgcgcctgaaaagagcgcagctacattggaattgttcagccagtgtccaagagtccctcaatagccgagcgtcgaagctgttctctctaaatgatcgctgagaagagcatctggttggcatttttcttcttgtccaggtcctcgatctcccttgtgatgggactgacttgagcagtccagtcttggatcacctcgttgaggctgttgtggacggtctcgtcggcgtcggacaaggggggcagcccggacgcagcgagcagccgctgcgtcatgccacgctgcgccatcaagctcacgcggatctggtcgatcagctcctgcttctgggtgaggaggtcgcggcacatctccttgagcgcggccgcctcttcctccaaccgcttcacccgcgccaccagcttcgccggattcgcatggtcagggtaggcggcgcggaactcaaggtcgagtcggcgctgcacgtcggcgagggtgcctctggcgttggtgagcgtcaacaggacgtcgttcaccgccggatggtactccggccgccgcctgctcggatccgccgccatcctgacgtagctttggtggcggtcctggcggaggatcaggatgcgatgtttgctcctattttttatctttctctgtgtgtcccggccggcccctcgagggt

SEQ ID NO: 7315 - DNA, 1181 bp, Zea mays
  misc_feature (9)..(9): n is a, c, g, or t
  misc_feature (1033)..(1033): n is a, c, g, or t
  misc_feature (1064)..(1064): n is a, c, g, or t
  misc_feature (1101)..(1101): n is a, c, g, or t
  misc_feature (1106)..(1106): n is a, c, g, or t
  misc_feature (1152)..(1152): n is a, c, g, or t
taccctcgncgggcccgccgggtcccggtacccgatcccccaacgcttcgctttctcgctgactcgctcccactcccagacgaccggccgccagcgccgccgcgttgatggccgccgcaccggaggagcgcctcgacgtcctcaacgccgctggggacaagatcggcgtctccaagcccaggtcggaggtgcacagggacggcgactatcaccgggcggtgcacgtgtggatctacagcgagagcaccggggagctgctgctgcagcgccgcgctgactgcaaggactcgtggcctggacagtgggacatctccagcgccggtcacatctccgccggcgaatcctcgctcttctcggcacagagggagcttgaggaagaactaggcatcaaccttccagtcgatgctttcgagcttatatttgtatttcttcaggaatgcgttatcaacaatgggacatacacaaacaatgagtacaatgatgtttaccttgtgactactttaactccaattccacttgaggcattcactctccaagaaagtgaagtatctgcagttaggtatatgcgttgtgatgagtacaaaagctgccttgcaaaagaaagtagagaatatgttccttatgatgtgaacgggcaatatggtcaactgtttagcattattgaagaaaggtacaaagagaatacagagtcacagagtttaactttgcaaaagcaaatgaaccgttatgttcccatccatttggaaccagatttgactagtctctctgaaggagacagggaggccttgggatatatccttaaagccgcaatagttattgatgacatattctatgaacaggtatggaatagtaacaaaatgcttagagactggctgaaaggacattctgaattctcaccattcgataaattgaagtgggcatattattctattaataagagtccctggtactatctgtctcttgattaatgaagacgttcttgattgtttggaatatcttaacacaatattcaatgatattttgttcatgttgngcagttaccttttgtcaaactatttccattntatccttgtatatgatgccatcttgcttaagactctngactntctttcatcatgttatgggtagtgctttcatattgatatatatggnttagagtgtaatttaatgagatacatatg

SEQ ID NO: 7316 - DNA, 4098 bp, Zea mays
attttacaatggtaattttctgtacattcaactatcttgttattttctcttaccacagctcattacgagtcaatccgctttgggctggaagaagctcacggaaaaggacaagctctgcagtttaactggttgtatgagaaaggggcttttgtgttgcagtctgacggaaaattctcagttgattttacaatggttgaggatgctgtagaaagcctgagcagggagatactgacaatacaggcaaagggcgataagccttctgcccaatctcttctccagtcccgtgcaacattgacacaaccattgagaatggcattggagaggatagagcacatgcaggtacctgttgacatagccccggtattcagcacggcaaacaagctatttgcagacatttaactatttgggctcagaatcgttgtgctttagtaccgcccacaatacctggacgaaaccaggaattgctcaagaataaggcggcactaggaattgctcaagaataaggaagcgccccatgttaagcaaagctgataaaaccatggcgatatgtgagtgacctttttatcggaaggaaaattgtttgcatgcttatgtattgacctcaatttttacgtattggagtgatttgatgtgaaatttaaccaaattccacgtccagtacatggccatccaaacatggcctaaagtggtgtttgatcagtgagaattggaataaacccagctttgcctgaacagttgcgaagtactgagttacatcaatgcatattttgtaacaccaaaaaaagatgtattatcctaatggatgattgaacgaaggcattgtatatcgatccccaatggcccaatctttatgcacattctgacttgatcagatctagtttattagttaggcatatgacatctttaactcttaattttctaatgaacttgtcgaagttccatactagttttacattgactaacagataaaggtagctggcactagtttatactacctacgttccaaattgtaagattctaaactataagatttttgtctttttggatacatattttttatatacctatctggatacatagcagaagctgaatataggaaaaaaacaataattatagtttaaaacaagaaagcacaatgttaataaaaggttaaaaacagataaatttccaacagaagatagcattacaacccgtgaaagctactcactctattaaacgtgatcgttaaaaagatccaattgacaaattcctatggtagctactctctttttctcaaatacacaaaaaggactactaatgtaattacactcacgacacgtttttttatgaaataagatatctgtaccattcttcaagttttgatattatgcaaatggtagacatatatgtctggcaggttgcattgcatctccgcgcgcctgaaaagagcgcagctacattggaattgttcagccagtgtccaagagtccctcaatagccgagcgtcgaagctgttctctctaaatgatcgctgagaagagcatctggttggcatttttcttcttgtccaggtcctcgatctcccctgcgagcgtgacaaattgagtcagcacctagagatgtcaagagactcgtacccagaaattcctccattagggctagtttggaaactccattttctcaatagatttctgtttttctaagggaaaataaactaaatttccttggaaaaatggaaataacatgagaaaataaggttaccaaactaacccttagagttagagcatggaataaaaaatgtctccatatatatataggacaaaatcttcacccattggatagtgagtttgggaagcaatcatccaaacttgattacatgagtaatattcatccagtaaaattagatgtgtggtctaatctaatagacaataaacacaacaactaacacaacctcttacaaccctttcactcaacctacgaccacccaccacatcagcccatgtgtcactttgtgttttgttgttttatatggtaaacaatgtattttcttattacatattagatttattggtgacttattgttgttgggtcatataaaatataatgtgataatgcttttatttttgttaaggacccattggggacccaataactgaatatagatggatatgagatgaattttatatccataatgggtatgaatacggggacggggatgtctatagcttcatgggaatgggtatggatgcccaaatccagcggtaaattctccattgtcgcctctaaccggttcccagtcctgcatgaatccccaattcactagcaactatccgatcgtaaaagggaggtggattgcctacttgtgatgggactgacttgagcagtccagtcttggcgcgcctcgttgaggctgttgtggacggtctcgtcggcgtcggacaaggggggcagcccggacgcagcgagcagccgctgcgtcatgccacgctgcgccatcaagctcacgcggatctggtcgatcagctcctgcgggtagagggataattaaccatggcaaatcgttaattatcccgcgtgtataaaaaattatcgaacacggaaataaaaacgaaatgtcgagccaaaatcaattaaactcattcttaaataaaaaaaatagcacggttgtcagcatcggcagcaggtaaggcgcggattggtgaaaacataggggggaagaggatacctgcttctgggtgaggaggtcgcggcacatctccttgagcgcggccgcctcttcctccaaccgcttcacccgcgccaccagcttcgccggattcgcctgcaaccgccgccgccgatcccgtcagcgacgaaaggagcggttagggatgagggccggattcgcatggtcagggtaggcggcgcggaactcaaggtcgagtcggcgctgcacgtcggcgagggtgcctctggcgttggtgagcgtcaacaggacgtcgttcaccgccggatggtactccggccgccgcctgctcggatccgccgccatcctgacgtagctttggtggcggtcctggcggaggatcaggatgcgatgtttgctcctattttttatctttctctgtgtgtgcaggtgttgccgtgtgggctagaagcatagaaggcaggtacccgcacctgctcgtgccgctctggtttttgaaatttttgcgaactggaacgaattgccgctttggtggctttcgagtttcgacacgatgcgtgggcccacctctcagacctactccaagtctccaacagtccaactggtccagtttccactgggtggctgcggcgttcccctgcagggtacacggattgtagcgtattcccatgcaaattcactgttttctcacaaaacgccatagaaaaaaactgattgtttgcttcaaagtagctctgggcaaaaaaaaaaaaaaatcctaaacccgaaatacccgaaccccatattatccaaaatctaaattttatttagaaatttcaggtcacaacttatgaaacccaaaatcattttggttaattcggataccaccttcggtcccagataacccgaactccaggcaacactagaattctgcaatcggtgctgcactgctgcctgtgtcgactgtgtccgtgtgcatgccgatgtctctatctgcctatctacctacctgtgagtgcgtgcaaatgctgaagaaagtgcaagtgtgcagccggtaatagcagcagtgcatgtgaacgacttgaagacgtaaagaccattttccatccttccgtcaggtaatcaggcgcacattgagtcatgtgaaagccaaccaatgctcaatctctttggatgatatccatttatctgcagcctagctaatgtcctacgatctgatcagcttattgtggcttttagtatttactactagtttaactgatgaaaataatctaactgttttgaatcagttaatagctagagtagttactattagtttaaatgatcaaagagacgtttttgtgggggatctgctccaacaagatcagtttatagtcagctctatgcataggactttggtcgctccgaacattgtttcgataaatcacccaatctgggatttaaagattccttga

SEQ ID NO: 7317 - DNA, 1385 bp, Zea mays
  misc_feature (21)..(21): n is a, c, g, or t
  misc_feature (25)..(25): n is a, c, g, or t
  misc_feature (123)..(124): n is a, c, g, or t
cacgatagtactgtgcgcttngaanagctaccgtctgaactctggacaccacactgagtgcgtagagtagcgtgtgcacactaagcagctaggacggggagcttgaggggaagaactagggcnnatcaaccttccagtcgatgcttgcgagcttatatttgtatttcttcaggaatgcgttatcaacaatgggacatacacaaacaatgagtacaatgatgtttaccttgtgactactttaactccaattccacttgaggcattcactctccaagaaagtgaagtatctgcagttaggtatatgcgttgtgatgagtacaaaagctgccttgcaaaagaaagtagagaatatgttccttatgatgtgaacgggcaatatggtcaactgtttagcattattgaagaaaggtacaaagagaatacagagtcacagagtttaactttgcaaaagcaaatgaaccgttatgttcccatccatttggaaccagatttgactagtctctctgaaggagacagggaggccttgggatatatccttaaagccgcaatagttattgatgacatattctatgaacaggtatggaatagtaacaaaatgcttagagactggctgaaaggacattctgaattctcaccattcgataaattgaagtgggcatattattctattaataagagtacctggtcctgccttgatgaaaataaggcttttctatcgaccgcagattctgctgtgcaattactcacagaagccaccaaaccagtttcaggatggaaggggattgagtatcgagcagcatttcctctacataagcctcccggtgctaacttctatcctcctgacatggacaaagcggagtttgaactttggaagagtaaactgacagataaagaacaaaatgatgccactgggtttttcaccgtcataaaacgacatgactctctgtcttcatcgtcattaacacaatcagatggatcggatcagaccaagactaaagatgatctttttattgttccatactccaaggagtatagaccattcctagagaaagcagctgagcttcttgagaaagcatcagcgtgctctgattctccaagcctcaagaatttgctgagaaccaaggcgaatgctttcctttcaaatgattactatgaatccgatatagcttggatggaattggactccaacttagatctcacaattggcccatatgaaacatatgaagatagcctttttagttataaggcaacttttgaagcatttgtcggaatacgtgatgacacagcaactgctcaagctaaactctgtggtgatcagctccaggatttggagaaaaaccttccaatggacaatattttcaaatcagatagtatatctgctgctc

SEQ ID NO: 7318 - DNA, 1709 bp, Zea mays
gacccacgcgtcaatccaccggagcagaccaagaccaaggaggattttttgaaggattcatactgttaggcgcatagaccattcctagagaaagcagctgagcttcttgagaaagcatcagcgtgctctgattctccaagcctcaagaatttgctgagaaccaaggcgaatgctttcctttcaaatgattactatgaatccgatatagcttggatgcgaattggactccaacttagatctcacaattggcccatatgaaacatatgaagatagcctttttagttataaggcaacttttgaagcatttgtcggaatacgtgatgacacagcaacttctcaagttaaactctttggtgatcagctccaggatttggagaaaaaccttccaatggacaatattttcaaatcagatagtatatctgctgctcctattcgtgtgatcaatcttctctacaatgctggggatgtgaagggtccacaaaccattgctttcaatttgcccaatgatgaaaggattgtgaatgaacgaggaacttccatggttatgctcaaaaacatttcagaagccaagttcaagcatatcttaaagcctatagctgatgcctgcatcagagaggaacaaaaggaatatgttgatttcgagccatattatacacatatagtctgtcatgaatgctgccatggaattggacctcattctatcacccttccaagtggtaaaaaaacaacagttagaagggaacttcaagaattccattcagcattggaggaggcaaaagctgatatagttggtctctgggcactgaatttccttattaagaagggattgcttcctaagagcctgtcacaatctatgtatgtctctttcctggctggctgcttccggtcaatccgctttgggctggaagaagctcacggaaaaggacaagctctgcagtttaactggttgtatgagaaaggggcttttgtgttgcagtctgacggaaaattctcagttgattttacaatggttgaggatgctgtagaaagcctgagcagggagatactgacaatacaggcaaagggcgataagccttctgcccaatctcttctccagtcccgtgcaacattgacacaaccattgagaatggcattggagaggatagagcacatgcaggtacctgttgacatagccccggtattcagcacggcaaacaagctatttgcagacatttaactatttgggctcagaatcgttgtgctttagtaccgcccacaatacctggacgaaaccaggaattgctcaagaataaggcggcactaggaattgctcaagaataaggaagcgccccatgttaagcaaagctgataaaaccatggcgatatgtgagtgacctttttatcggaaggaaaattgtttgcatgcttatgtattgacctcaatttttacgtattggagtgatttgatgtgaaatttaaccaaattccacgtccagtacatggccatccaaacatgccctaaagtggtgtttgatcagtgagaattggaataaacccagctttgcctgaacagttgcgaagtactgagttacatcaatgcatattttgtaacaccaaaaaaagatgtattatcctaatggatgattgaacgaaggcattgtatatcgatccccaatggcccaatctttatgcaaaaaaaaaaaaaaaaaaaactcgagatttcctcgtgc

SEQ ID NO: 7319 - DNA, 1334 bp, Zea mays
gtttgtgatgaagcactgtcgtcgcccatgacgggaaaacggctccatatacgtactactaacgtacacaccacagcgactctccggccatgcagttgccggctgcacaacttgtgcaagtgcatgcatgcatggatttggatccatgcatggccacagcccacagcccacaggggaggggaaggtgaggccgcgccgcgaggaaccgcgtcgaccttgtcgtcgatgttggcttgcaaggcgagcccgagccggccgtgcgtcgtcccccttgtttgcctgctggtggtggcggccgcagtcgtcgtcgtcgctgcctcggcgccgccggcggaggcggcgttcgacgacaactacgtggcgcagtggggtagagatggttatcaccttgtcgtccggggcacggaggcgaatgtcaccatggaccagagctctggtgcgccgggttccggtccaagtccacgtacggctcagggttcttccacatgaggatgaagctgccctccgggtacacggccggcgtcgtcacgaccttctacctcatctcgcagccggaggatgggagccgcgacgaggtggacttggagttcctgggcgacaaggccggcgtgcccatcaccctccagaccaacgtcttcgtcgacggccgcggcgacagggagcagcggacgcgcctctggttcgaccccgccgccgacttccacgactacaagatcctctggaacccataccagctcgtgatgttcgtggacgacacgccggtccgggtgctgaggaacctgacgggcgccgtgccggggtacccgttcccggggaagcagacgatgctgatccgcgcgagcgtgtgggacggctccgactgggccacggacggcggccggaccaaggtggactggtccaggggccccttcaccgccggctaccggggcttcgacgtcgacggctgcgccaacaacgggagcgacgcgtgccaatcgcccgacctatggtggaacgccgccgagtaccggaacatcaccgcggagcagcgggcggcgtacgaggacgtgaagaggagttacatgaactacgactactgcgccgataaggccaggtttaacagcaccaccgtacccattgaatgcaactacgcttgagaagccagttaggagtggcggcgttgtatatcaacggtttatatatatatattatatatatatacacacacacgaaaaagatatgtcttcttatttgttgcaagggtttaaatatgcaaatgcttataaggactaaaaaaatatatttccatgtcacaaaaaaaaaaaaaaaaaaagggcggccgccggacgcgtggg

SEQ ID NO: 7320 - DNA, 931 bp, Zea mays
ttgggggaccccccggcccgggatagaaacgaaatatttttaatccgcttttcggttggtggtgcctggcatctaccgtgcggagggggaagagggagaggccaggagaggaaagcctgcagccaccatggattccgacctctggatctcgcgtctcacggccgccaagcggcagtttgcgctgcagcgcgcgcagcgccagcacgccgccccggcatcccatcacgatcgatttgggtatgatgatatcgaacctgaggatgatttgcactcagacttcccatgcccttactgttatgaagatcatgatgttgcttctctctgcgcccatttggaggacgagcaccctttcgagtctaaaattgtgtcttgcccagtttgctcagctaggatttcgaaggacttggtggatcatataacccttcagcatggctacctatttaaattgcagaaacatcaaagagtacgcagagttactggtaatggcaaccacaatctctcctatgcagggagagaccttcaactgcaagagacctacttaaaggtgcttcttggaaatagcagtcgaagcagcagtaccaatgcatcaagtacagtcaccgattcactgctaccctcactagttttaaatttatcatcaccagaagtagaagacgcatcaaagttttcagctcctgctgtggtggaaaataattggtttaaacgatcactgccttcaaaaacttggaaattaagaactgttgattccacccttagtcatgaagagagggagcgtaggaggaggagagctgctgtgagatcagcttttgtccagcatctccttgtcaccaccatttttgaagactagcagatcaagcacagctcatgcaaaggaatcttgtgggcgggccttttgcccactcatttatctggatggcgggcgcactaatta

SEQ ID NO: 7321 - DNA, 723 bp, Zea mays
aatatttttagccgcttttcggttggtggtgcctggcatctaccgtgcggagggggaagagggagaggccaggagaggaaagcctgcagccaccatggattccgacctctggatctcgcgtctcacggccgccaagcggcagtttgcgctgcagcgcgcgcagcgccagcacgccgccccggcatcccatcacgatcgatttgggtatgatgatatcgaacctgaggatgatttgcactcagacttcccatgcccttactgttatgaagatcatgatgttgcttctctctgcgcccatttggaggacgagcaccctttcgagtctaaaattgtgaaacatcaaagagtacgcagagttactggtaatggcaaccacaatctctcctatgcagggagagatcttcaactgcaagagacctacttaaaggtgcttcttggaaatagcagtcgaagcagcagtaccaatgcatcaagtacagtcaccgattcactgctaccctcactagttttaaatttatcatcaccagaagtagaagacgcatcaaagttttcagcttctgctgtggtggaaacataattggtttaaacgatcactgccttcaaaaacttgtgaattaagaacatgtgatttcaccctcagtcatgaaaagagggagcgtatgaggaggagagctgctgtgagatcagctattgtccagcatctccttgtcaccaccatttttg

SEQ ID NO: 7322 - DNA, 1121 bp, Zea mays
atttttaatccgcttttcggttggtggtgcctggcctctaccgtgcggagggggaagaggggagaggccaggaggggaagcctgcagccaccatggattccgacctctggatctcgcgtctcatggctgccaagcggcagtttgcgctgcagcgcgcgcagcgccagcacgccgccccggcatcccaccacgatcgattcgggtatgatgatatcgaacctgaggatgatgtgcgctcagacttcccatgcccttactgttatgaagatcatgatgttacttctctgtgcgcccatttggaggatgagcacccttttgagtctaaaattgtgtcttgccctgtttgcttggctaggatttcgaagaacttgttggatcatataacccttcagcatggctacctatttaaattgcagagacatcacagagtacgtagagttactggtaatggcaaccacaatctctcctatgcagggagagatcttcagcttcaagagacctacttaaaggtgcttcttggaaatagcagtcgaagcagcagtaccaatgcatcaagtacagtcactgattcactgctatcctcgctagttttaaatctatcttcattagaagtggaggacacgtcaaagtcttcagctccttctgtggtggaaaataattggtttaaacgatcactaccttcaaagacttggaagttaagtgctgttgattcgagccttagtcatgaagagagggagcgtaggaggaggagagcagttgtgagatcagcttttgtgcagcatctccttgtcactacccttttcgaagactagcagatcaaacacagctatgcacgggaatcgcactagttgttttggatatcatgaagttgttcatccggtctgctgggtaaccttgacaggaaaactgaagcaccgggcgtcttaccttatttattctgtggaagcagctctgtcatttattttctagatcctattcatttttgtagggctgttgatcagagcctctatagtagagtcgtgatgctttttttgttgggtttcagtctgcaattggagaatatgccaatttaatttatatattactaaacatgattccgagtttggaacttgttctaaaaa

SEQ ID NO: 7323 - DNA, 2209 bp, Zea mays
ccgaccccgaagaccacttgccccctccaggccgaggccgccgccgccaactactgacacagtgacacgcaccaatgacattcggccccgcggccggccgccgacgataacacgccggcccgcctcgccacgctcccaccctcctgcctccgcgcgccacgaccagccgccccagcagcagatgtcgcccccgtccgtcctgctcctccactcccgcatcccgcttcagccccgccccttcaggatgaactcccgggcagctcccgagcagggtcgtcgtctgctccgtcgcgtctaccgaggggttcatctccgcagcgccgatcctcctccccgagggcccttggaaacaggtggaaggcggcgtcactgccgcgaaggggttcaaggcggcgggtatctacagtgggttgcgtgccaaaggcgagaagcctgacttggcactggtcgcctgcgacgtcgacgccactgtagcaggagcatttacaacaaacgtcgtagccgccgcacctgttttgtattgcaagcatgtccttagtacatcgaaaacaggtgatcttggctatcaggatgcagtggatagtgcagatgctgttgccacgctgcgcaccgccggcccggccggcatactgattcagtctactggtgtcattggtcaaaggataaagaaggaggcacttttaaattcactacctagacttgtgggctcactgtcttcttcagttcagggtgcgaattctgctgctgtggccattacaactacagaccttgttagcaagagcattgctgtccagactgagattggaggagtggctattagaataggtgggatggctaaaggttctggaatgattcacccaaatatggcaacaatgcttggtgttttgaccacagatgctcaagtcagcagtgatgtctggagagaaatgatccggatgtcagtgagtagaagtttcaaccaaattacagtggatggtgatactagtaccaatgactgtgttattgctatggcaagtgggttgtctggtttatctggaattcaaagtcttgatagcattgaggctcaacagttccaagcatgcctagatgcagtaatgcaaagtcttgcaaaatccatagcatgggatggtgagggtgcaacatgcctaattgaggttactgtaagtggcgccaacaacgaggcagaagctgctaaaattgctcgttcagtagcatcttcttctttggttaaagccgctatatttggaagagacccaaattggggacgaattgcttgctcagttggttattcaggcattcaatttgacgcaaatcgacttgatatttctctgggagttattccactaatgaaaaatgggcaaccactcccctttgacagattggccgctagcaagtatctcaaagatgctggagatgcccatggtacagtaaacattgatatatcagttgggagtggaggaggaaatggaaaggcatggggctgtgatctgagctacaaatatgttgaaataaatgctgaatatacaacatgagatttatatttgccatgaagaaaaaaatcttgtaatgatgaatgggtgcgactaccgtcaggagaatgtagtttcgtgttgcaatggcagccttgcggatgtattatttcacgtgagatcaatcagaccaatatttcataagtgtaataatgtgatgaataacgatgggcgcaataacaacactgacgatgccaccttgttcggttctgaatttctgatgatgagaaagcattggtcagacacataattttggaattcggtatacaaagctctggtcctgccgtcctgcgtatcaaactgaagctccacttttatatgtcagttggactgatatggtgttaatttcaccactgatacctatatcaattggattccttgacggtttgccagccgcagttctcttgttttaacattttagccttacaaacacaacgtgatgttgatgtagtttgtaacgtggaatgtcagaaataatattgatacaatgttgtagatttattgttttatttgaaattatgtacattgctttagacgaatctcagcaagtcatattcgatttggaaaagccaacgtttctaggttcatgaatagttataataggggagaataaagatgtgctgtttttaaaaaaaaaaaaaaaaaaaaaaaaaaaaactcgaggagagggcgccggtacc

SEQ ID NO: 7324 - DNA, 838 bp, Zea mays
tgctgtgttaattaatgctggacaagcaaatgctgcaactgtaagtgtttataagcaccatgtcatagtcatcagtagcagttatgaactcagtgactgatatttgttgaagtgttaggctgactccagcagttcacccaaagcttacccataagcactgttttgcactgtagactgcactgttcgcagagtggagtttgaatatgggcatgagtatgggtaagctgttggagatagtcttagagtggacgcgctagcgagttcgacccaaaaggttaagctgatgggagaaagtagtttatgcacctttttggttgaactggttagtgcatccactctaacttggtatcaaagccagaggtctcgagttcgaatcctggcagaggctttatttgtgccttcacccattttattccatgtttgcgcctttctctttggctgcgtttgctcctttctctctggctgcgcgtgagtgaggatgttgaagtgtataagtggataaactatcttcttccgtcagcttaagcttttgggtcgaactggctagtacctccactctaacaatattgaggttttgtctcaaatgattgcctatcagggtgatcttggctatcaggatgcagtggatagtgcagatgctgttgccaagcttctcaatgtaagcacagataacatactgattcagtctactggtgtcattggtcaaaggataaagaaggaggcacttttaaattcactacctagacttgtgggctcactgtcttcttcagttcagggtgcgaattctgctgctgtggccattacaactacagaccttgttagcaagagcattgctgtc

SEQ ID NO: 7325 - DNA, 894 bp, Zea mays
gccgccgccaactactgtcacagtgacacgcaccaatgagtcaatgacgggggcccccccggggccggcctcgaacgataacacgccggcccgcctcgccacgctcccaccctcctgcctccgcgcgccacgaccagccgccccagcagcagatgtcgcccccgtccgtcctgctcctccactcccgcatcccgcttcagccccgccccttcaggatgaactcccgggcagctccgagcagggtcgtcgtctgctccgtcgcgtctaccgaggggttcatctccgcagcgccgatcctcctccccgagggcccttggaaacaggtggaaggcggcgtcactgccgcgaaggggttcaaggcggcgggtatctacagtgggttgcgtgccaaaggcgagaagcctgacttggcactggtcgcctgcgacgtcgacgccactgtagcaggagcatttacaacaaacgtcgtagccgccgcacctgttttgtattgcaagcatgtccttagtacatcgaaaacaggtcgtgctgtgttaattaatgctggacaagcaaatgctgcaactggtgatcttggctatcaggatgcagtggatagtgcagatgctgttgccaagcttctcaatgtaagcacagataacatactgattcagtctactggtgtcattggtcaaaggataaagaaggaggcacttttaaattcactacctagacttgtgggctcactgtcttcttcagttcagggtgcgaattctgctgctgtggccattacaactacagaccttgttagcaagagcattgctgtccagactgagattggaggagtggctattagaataggggggatggcttaagggttctggaatgattcacccaaatatggcaacaatgctt

SEQ ID NO: 7326 - DNA, 2738 bp, Zea mays
aattcggcacgagggtcatttgcttgctacactgacaggttctcagagcagaggcatccggcacccctgctcctgaacttgttgccgaggaggccacactcttgcgctgccttggcaatgggggaggttgttgctgcttcctccctggccctggtgctgctcttcttctgctcttgcgggcctgcaagcggccttctctcccccaagggtgtaaactatgaagttcaagctctcatgatgatcaagaactacctcaaggatcctcatggtgtactgaagaactgggaccaagactctgtggatccttgcagctggacaatggtcacttgctctccagagaaccttgtcaccggcttagaagcaccaagccagaacctttctggaattctctccccaagtatagggaatctgaccaaccttgagacagttcttctgcagaacaacaacataaacgggttaatcccagcagagattggaaagctaagaaagctcaaaacgcttgatctgtccagcaaccacttctctggagaaatcccaagctctgtgggccaccttgaaagccttcagtatttgaggcttaacaacaacacattgtctggtgccttcccttcatcttcaactaatttgtcacaccttattttcctggatctgtcctacaataatttgagtggtccaatcccagggtccctgacaaggactttcaacattgtagggaatccactgatctgtgcagcaaccatggaacaagattgttatgggtctttacctatgccaatgtcttacggactgaataacacacagggaactgtgattcctgcgaaagctaagagccataaagttgcaattgcatttggtgctacaactgcctgcatcagccttctgttccttgccgttggttcactattctggtggaggtgtaggcgaaaccggaagactcttttcaacgttgatgatcatcagcacatagagaacggcaacctcggaaatatgaagcggtttcaattcagagagctccaggctgcaacagaaaacttcagcagcaagaacatattaggaaaaggcgggtttggtattgtttaccgggggcagcttccagatggaagtcttgtagccgtcaagaggctcaaagatggtaatgctgcaggcggggaagcacagtttcagactgaagtcgagatgatcagcttagcagtgcacaggaacctcctcagactctatgggttctgcatgactgccagtgagaggctactggtctatccgtacatgtcgaatgggagtgtcgcgttgcgcctgaaagggaagccaccactggactggatcaccagaaagaggatagcacttggggcagcacgaggtctactttatctgcacgagcagtgtgatcccaagatcatccacagagacgttaaggcagcaaacatactgctagatgactgttgtgaagcaattgtcggggactttgggcttgcaaagctcctagaccaccgtgaatcgcatgtcaccacagctgtgcgcggaactgttggccacatcgctcccgagtacctctcgactggccagtcatctgagaaaacagatgtctttggttttggaattctgctgctggagctgatcactggtcagactgcactggagtttgggaagtcatcaaatcagaagggagccatgttagactgggtgaagaagatgcaccaagagaagcagctggacatacttgtcgacaagggcctggggagcaaatatgaccgcattgagctggaggagatggtgcaagtagcactgctatgtactcagttcctccctggtcacaggcccaagatgtcagaggtggtccggatgctggaaggcgatggacttgcagagcggtgggaggcgttacaacacactgagtcacacaaattcaaggtgcctgagttctccttcagccgctgccactctgacctgacggacgactcgtcactgttggtgcaagcagtggagctttctgggccaagatgacaccaacggagacggtctgtggcaagaagtatccagcagttgtttcccagtagaaaatgtaaataatacaaagtgaagcaactggtgctgcatcctgtcagaagtcgaagcaaatctcaatcagctgaactgtacaaagattaaaaaaagagcacaacctagtctaagcatggtacattactacatctacagattatgtaactgttggtagaataaggatagagcaatgtttccattttgtttgttattttcccctttgtattctattactgtagttatagtttgtaaaatgcaaaaacggtggcaatagcgctcgatgttggtgctgaagaactcaaatagcttagtagcgtccaagtgtagacaggtgccaacgaagaatttgattgtgtgcatgaacttcctacctccgttgccaacacatactgcaaagaaagcaggtataattcctagccatgacggcattttttgcatgatataaaatatttggtatctgctgtagactgtttaagtttgtcctaaaaattaaaatgaaaaggtttaccgcccattctctaataaatattcgaggcaaaagcaaagtatccacatcggtcattctatctcaaagttgcattcctttctcttttgcaaaagatattcataaagagagcgaggggcatctgcaccctttacttccttttttgttataaattctttgacctttggtttcctcctttttaaaaaaaaaaatctccacg

SEQ ID NO: 7327 - DNA, 2305 bp, Zea mays
  misc_feature (975)..(975): n is a, c, g, or t
cggttcgggataaaattacccacacacccagcaccgatcgagtcatccttaattaccgtaataatacgaaggccgccatgattgttgttgcagtagtactggcgctactgctgttctacggggctggccatgccgactgcgcaacgaccatcccccagaacagcacggacgacatgctctccctgctcgacatcagaaaggaaatcagcagtgatccaagtggtttcctcacatcctggaacactaataacagtagcgccgccgactactgcggctggaatggcgttacatgcagcaggacgcatccagggcgggtcattgaactcaaactcagcagccaaagcttgcaaggccgaatctctccatctcttggttagcaaccttcagcaacttattgaactagacatttcctcaaataaacttgaaggggaaataccttacactttgagtgaatgtcgtcagttgaatgtactccaaatggactccaattttatcacagggaacatttcgcctctacgtagtctaacaagcttgaacatgatcaacctctcacacaatatgttgtcagggatcatccctgcagaactgggtgggatgtcctctcttacccagctggatctatcttataatgatctacaaggcaaaattccaatggatggagtatttagaaatgcttcagctgtctcacttgttggcaactcgagactctgtggtggtctgtcagatttgcacatgcccccctgccctattgccttaaaggaaaaggcagcacaatactacatcattagagtgtttatcccaatatttggcttcatgtcactgttgatgttggtatgtttcgttctcactaagaaaaggactgcccaacaatcatcaatatctcctcttggtgaccaattcccaatagtttcttataatgatttagttcaagctacaaataccttctccaattcaaatctgatagggagaggaggnttgtggttctgtatacagagggatattgatggaaaacaacctaaaggtggctattaaagttcttgacagtgacatgccccgcgtcgagaaaagtttcttagcagaatgtgaagctttgaggaacacccgacaccgaaatctagtccctatcataacaacatgctcaaggttagatatcaaaggcaatgttttcaaagctcttgtatatgaatttatgccaaatgggaatttggactcatggttgcatcagcatggcagtgggaatgtcaggaaacctttggacttaaatcaaagaacaagcttagctaccaacatagctgacgtacttgattatctgcacaacgaatgtgggaaaacaattatccattgtgatgtcaagcccagtaacatactcctcgatggtgacatgaatgcccgtttggcgggcttcggcattgcaaaattctatattggttctatgtcaacatcaactggagattcagaacctataaactcaaccggtatgaagggtactatcggctacatgcctccagagtatgctcgaggtggacacgcatcaacatgcggggatgtttacagttttggaatagtacttctagagatgcttacagggagaaggccaactgatcatgtgtttgtggacgaactaaacattgtcaaattcgtggagaggagcttccctgataaaatattggatgtgattgatggttccttacgtgatgacttcaagagtgcccaaataaacatggtaacagagcgtgagacctaccgatgcttgttttctctactgcaagtagcactttcttgcacacgtgagattcctggtgaacgaacgaccatggaagaagcagctagcagaattggttcaatccagaccacatatgctagaggaattgaaaacgcaagcaggcattgaattgaaaccatctctatgttgagcgaacatacgtggggatggacatcatccaatatcgcttaccatatggcagaaccgacaatgatgctccaatccgatggtgtagggaactagctagtagtgaaattaccagttttcatatgagatgttacagaatggaagtgagagtcagtatcgacctttgtttgtagagcctatttctatgccaaccaaatgcgtttatagatttcagaaatacagtactctttggaaactagaaaatttatccgaagcaagtgacatgacgatgacaaccatatggaaggttgcaactcagcagcactgcttcaaattaattgtaaaataaactctgtaaatcagcagctctacaggcacccttcatagaagaagaaataaacttcgtaattgcaagcc

SEQ ID NO: 7328 - DNA, 1854 bp, Zea mays
cccactcgtccgcggacgcgtgggaggagcagtgcttatcaagaacagatcacctattttttggtggggagggacttcagattccacgcgtccgatcggtcacaaaggacatatgtagacttccttcattcttctctagtgcccttttcaagaaaatcgatgttgcatgcactggaactgtctcgagggatgcatttgttgagtactggatggatgacaataagattacaatggatatggctagtcaaatatttgaaattttaagaaagccaggttgcacatatctcactcaggatgacttcaagcctgtcctgaaagaactacttgcaactcaccctggcttagagtttttacaagggacccccgagtttcaggagagatatgcggagactgtaatatacagaatcttttactccataaatagatctgggaatggccatctgactctcagagagctcaaacgtggaaatttaattgctgcacttcagcagttagatgaggaagaagatatcaacaaagtgttgagatacttctcatatgagcacttttatgtgatctattgcaaattctgggagctggatgcagaccacgattttttgattgataaggagaacctcatcaaatatggaaatcattcgttgacctataggatagttgatagaattttcacacagataccaaggaaattcacaagcatgacagaagggaagatgggctatgaagactttgtttattttatattatcagaggaagacaaatcatctgagcctagtcttgaatactggtttaagtgcatcgatcttgatggtaatggtattttaacttacaatgaaatgcattttttctatgaggagcaattgcaccgaatggagtgcatggcacaggaacctgtggtttttggggacatattatgccagatgattgatatgattggaccagagaatgagagctattttactctacgggacttaaaacggtgtaaactctcaggaaatatattcaatattcttttcaatctgaacaagttcatggcatttgaaactcgtgatccattcctcattcgccaggaacgtgaaaatccaacgctgactgagtgggatcggtttgcgcatagagaatatattagattgtccatggaagaagatggtgaagatgcttcaaatggaagtggtgatgtgtgggacgaatcacttgaggctccattctgaatggtatcttgctgcacgaatttggttgaacatgggtgattatggttgtgaagcggaagaattgtgaagtcggtggctacagtgctgaggccattgtaggctcacagcagattcagtgacactgaagactacttacaagttttactgtgcagatctgattcgatatttttggctggaaaattggggaggttggtgggcgccctgcagtttcaagtcaacaccctcagcagtcgcaaatgataatatagtgatggacccttcctggtcgactagttgcatttgtgttctgattggtccttagggtggatatctgttaattcaattgttgtgctaaaattttggagctgaactgttaatgtttgcctgcattttctttgttaatcttggaagcgtgggctagcacttccatcaaactaagatcgtggcatgtagctttccagttctgctttatcatcagcgtgttgttctgtaattcttggtgcatcttgggcggatggatactgttgtcattttgtaacatcaccgagaagctgtggattgggtgcatagtaacacaaaggtagataacattgtcaatccaatttttgttaaggtgtaaattcagagaagttttaggtttcaagtactaaaaaaaaaaaaaaaaaaa

SEQ ID NO: 7329 - DNA, 1277 bp, Zea mays
cttgcatgcctgcagcgaaagaggtgcgacgagagaagacgcaaccacgacttttacttttgagctagacgccacgtagacaccagtgcaacactggtcgcccggtaccttgctgccataagtcgcgacatcgagacgtgttacgtcgatgccgtggaggcgtgaactgtgacatcgagaaaagggtttaaagttgaaattacgttgtccagatcaatcgtataaattttaaaaagatttaaaatgtaaaaaattcggtcaaagagagtaagagaccctaaaactatggtattttaaaagacaaatttattttgctcaattcccggccgcgccccggaccgagcatcggaaaaaaaaatgtattttgccctccgctgttatatcgccgtcgccgtcttccggtctctccacctcctagctcggctgcttgcctagggtttcgcctgctcccggccccgcctccagccgtcgcttgagatctcgccgctgccgccactcgatcctccttcgttgttcctcactgatcctgctgagctcggattttcgcccttcctccccgccggaacagcgtccggacgcgcgggcgcagatctgggttttggtggcccgcttgttgtatgagaaggcctctaaagcttgggagcaatggaggtggagccagcgaggagggacgcggcagcgctggacctggagctgctgcagctggcggagctcgcgccgggcgcgcttcgtgagaactccatagctgatgcactgtacgcgcagtggctcgtgctacctgagacgaccaagctggtaaagtctttgattgaggatgcaaagactggtgctgtgcttaatgttgctggaagctctactagcacaaatgctgcttcaagtagttctctaccatcgatgtttcctgctggtagtgctccaccactttctcctaggagcacttctggttctccccgtgttatgagacgaggatctggagctggaccatcgtccttgggttctccattaaaattagttagtgaaccagtgagagaagttatacctcagttttacttcaagaatgggcgtcctcctacaaaagatctgaaggagcagtgcttatcaagaacagatcacctattttttggtggggagggacttcagattcaagaattcagatcggtcacaaaggacatatgtagacttccttcattcttctctagtgcccttttcaagaaatcgatgttgcatgcactggaactgtctcgagggatgcatttgttgagtactggatggatgac

SEQ ID NO: 7330 - DNA, 2852 bp, Zea mays
gtttctatatttggcaattttggaactaaattggaataaaatctagggactaaacattagtccctaaaaaccaaacacctcctaattattttgctcaattctagctatagctttaccccaaaccgaaagtggcatccgaaagatcaatttattttgcactccgctgttatatcgacgtgcaccaccgtcttgccgtcgctcatttcctcctcgctcggctgcttgcctagggtttcacctgctaccgccccacctccagccgtcgcttcagatcccgccgctgccggcgctcgatcctacttcgttgctcctagctgatcccgctgagctcggatttgggcccttcctcaccgccggaacagcgtccggacgcgcgggggcagatctgggttttggtggcccgcttggtgtatgagaaggcctccagagcttggaagtaatggaggtggagccggcgaggagggacgctgcagcgctggacccggagctgctgcagctggcggagctcgcgccgggcgcgcttcgtgagaactccatagctgatgagctgtattcgcagtggctcgtgctacccgagacgaccaagctggtgaagtctttgattgatgatgcaaagactggtgctgtgcttaatgttgctggaagctctgctagcacaaatgctgcttcaagtagttctctaccttcgatgtttcctgctggtagtgctccaccactttctcctaggagcacgtctggttcccctcgtgttataagacgaggatctggagctggaccatcatccttgggttctccattaaaattagttagtgaaccagtaagagaagttatacctcagttttacttcaagaatgggcgtcctcccacaaaagatttgaaggagcagtgcttatcaagaacagatcacctattttttggtggtggcggacttcaagttcaagaattcagatcggtcacgaaggacatatgtaaacttccttcattcttgtctagtgtccttttcaagaaaatcgatgttgaatgcactagaactgtctcaagggatgcatttgttgagtactggattaacgacaataaggttacaatggatatggctagtcaaatatttgaaatattaagaaagccaggttacacatatctcacccaggatgatttcaagcctgtcctgaaagaactactggcaacacaccctggcttagagtttttacaagggacccccgagtttcaggagagatatgcggagactgtaatatacagaatcttttactccataaatagatctgggaatggtcatctgactctgagagagctcaaacgtggaaatttaattgctgcacttcagcagttagatgaggaagaagatatcaacaaagtgttgagatatttctcatatgaacacttttatgtgatctactgcaaattctgggagctggatgcagaccacgattttttgattgataaggaaaatctcatcaaatatgggaaccattcgttgacctatagaatagttgatagaattttcgcacagatcccaaggaaattcacaagcatgacagaaggaaagatgggttatgaagactttgtttactttatattatcagaggaagacaaatcatctgagcctagtcttgaatactggtttaagtgcatcgatcttgatggtaatggtattttaactttcaatgaaatgcaatttttctacgaggagcaattgcaccgaatggagtgcatggcacaagagcctgtgctttttctggacatattatgccagatgattgatatgattggaccagagaatgagagctatttaactctacgggacttaaaacggtgtaaactctcaggaaacatattcaatattcttttcaatctcaacaagttcatggcgtttgaaactcgtgatccattcctcattcgccaggaacgtgaaaatccaactctaactgagtgggaccggtttgcacatagagaatatattagattgtccatggaagaagatggtgaggatgcttcaaatggaagtggtgatgtgtgggacgaatcacttgaggctccattctgaatggcgtcttgctgcatgaatttggttggacatggatgattatggttgtgaagcggaaggattgtaaatttggtggctaccctgttgaggccattgtaggctcacagcagattcagtaacatcaaaggctactgaaaagttttactgtgcagatctgattcaatatttgtcagttatcttgttgggcaaacatttttgctttgctggaaaattggggagggaggttggtgggggcgccctgcagtttcaaggcaacaacctcagcagtcatcaacggtcgactccatttgtgttctgattgatccttagggggatatctgttattcaattgtgcgcaaattttggggctgaactgttaatgtttggctgctatttctttgttaaatcttggaagcgcaggctaccaattccatcacacaactaagatcatggcatgtagctttcaggttctgctttctcatcagcatggtgttctgtagttgtgttgccattcttggtgcatcttgggaggaatgatccgtgaccttgaagcatggatacttgtcattttgtaacattaccgagaagcagtggattgggtgcatagtaacacaggttgtaacgttaccgagaagctgtggattgggtccaatttttgttaaggtgtaaatttggagaatcttttaggttatcttacttgaaagtgctttgcgctttgcgtattgagctacttatgtcgtgatgcgctgaaactccatgtgtgtattcttgttgtattttccattttgtcaaggatcatgttttcttgcct

SEQ ID NO: 7331 - DNA, 3816 bp, Zea mays
  misc_feature (3614)..(3614): n is a, c, g, or t
gacgtccatgatgaacttgttcggatccacgcagagcttgagcgcggtcggcacctctgcccacagtgtgttccactccttgcggcgggccaccacaaatcctaggaacacaatggagtacgcgcaggcccttggtcatgctggcgtcagcggcgggcaccggatctggagccggtggtgagcccttggtggagatggagcggaggtggtcgagcacgagcgagacaaaggcatcgatggaggcctcgcggtggacgagcacgtcgagcacgtggtgggtgcgtgcatcgaagccccaacgacagatgcagagcgtgtcagagcacgcggcaagccctcgctcgacctaggtgccgcgcggtttccatttatctgcatcatttgtgcgcgcgtgctagagatcaaggaggagaagagctgacgaagtggaggtcgtgaagatgggggatgcgggcgtggaccgaagacgtcgcagcggttgcgaggacgaaggcgccgccgcatctcagcctctcgagagacgatgcgagggagagctggagggggccacagggcagtgagagcgttggcgggggactgaaacggtaagctgggccagtgccagataagtgcggcgtgctaggcatactagtgggccgcaccaaataacatagcccacgcggactaccgtcgttgtcaccgctgcgcaaatattgtaccataccggccagccaaacattgtgataccagcttataagccttcctactttgaaggaagcaatcgtgttcatgtgtacttgctagtgtcaactcgtggagtttttttgcgcgagctgagtctggcacgtggaccctgcgtgtggggtgtgcaaaactgaggctatcacatggtccgggcgtatggcgtgtggagtttgcacgatgggaatggaggtcgtagattgaacaacagtgatggacgatccagattgaatgaaggtagaacggcaggctacccttaccgccttaataagtagtagagattatgaactataattataattcttttagttaaagtaaacatgacaaattctttaaaaagtgagaacgtcaactattttaagggggaggaggaatatcttgtttcaggtcatggcgccctgggaactttacatggttcgaaaaacccaaatagtcagatacataactcatagtttttcttctcttttttaagatcagaattcaggccatctgattgatttagcgtttcacaagaaagcagttaattggatgaggtggggttaaatcaactgtacccaggcgttcgccacaagaaagcagttaattggatgaggtcattcgtttcatcttcgtcttctcgaaaatactattcgtacttccacgcacatgttcggacaccaataagcatcaccctcttctcaacagcatgtgcattttaagtcaacttttcttgccgccgacatagaccctgtttactttggggtaactaaaatttagtgactacagtttagtcacttttagtccctaaagaagcaaatatggtgactacattttagttttttagtcatcaagaagtgactaaaaaaagactaaaatatgatttttaccttatttgtcctctccaatttctttttcagcaaacactaataagtaactaatacagtcattattcacatcaattaatattttttagtctggtttagtcactagaaccaaacgggatactttagcgactaaaatttagtctagtgactaaagaaaccaaacagagtcttaagcctatttatatttactacagctagtagaggttgcactagctcaagcagcctatgccacatttgcactcaagcaagtgagcagctcccccgccctccagcaacatggagacggccaacgttgtcatcctctcgttcttcttcatctttgcaatccaccgcctcttcaaccgcctccatagcaggagcacgaagatgaagccgctgccaccgggccctctagccatcccggtcctcggccacctgtacctcctcctcgagaagaatattcaccacatgttcacgcgcctcgccgcgcgctacgggcccgtgctctacctccgcctcggctcacgtaacgccgtgatcgtgtcctctgtcgactgcgccagggagtgcttcacggagcacgacgtgaccttcgcgaaccgcccgaccttccccacgctgcatctcatgacctacgggggcaccacggtcggcacctgcgcctacggcccgtactggcgccacatccgccgcgtcatcacggtgcacctcctgtccgctctccgggtgaggtccatggtccccgccatcgaagcagaggtgcgcgccatggcgcggagcatgtaccgtgcggccgcggccgctccatgcggcaccggcgccgcgaaggtggagctgagggggaggctgttcgaggtcgcgctcagcgccctcatggaaaccgtcgcgcagagcaagacatcccgctcttccatgggcggtgccgcggacacgggcatgtcaccggaggcccaagagttcaaggagtccatggacgttatggttccgctcctcggcacggccaacatgtgggacttcctgcccgtgctacagaggttcgacgtgttcggcgtgaagaacaagatggcggccgctgtgagcggcagggacgcgttcttccggcggctcattgacgaggagcggcggaggctggacgacggcgtcgagagcgagaacaaaagtatgatggctgtgctgctcactctgcagaagtcagaaccggagaattacagtgatgacatgatcatgtctctgtgcttcgtaagttgtccttgtcccttagtttctacgtactattaggacaacgattctctcgctcacacgtcaagccataagcaattttttcgctcgttgctgaacatgtcgacgccgcagtcgtacgtcatgaccacgacatcgctcgctaagaagatcttctgcatctttgatatatattgcagtccatgttctctgcgggaacggaaaccactgcgaccacggcggaatgggcgatgtcgctgctcctgaacaaccccgaggtcctgaagaaggcgcagggggaaatcgacgcgcatgtggggaattcccgcctgctaggcgccgacgacatgccgcacctcccctacctccagtgcgtcctcaccgagacgctccggctgtacccggttttcccgatgctgatcgcccacgcgtccaccgcagactgcaaggtcggcggccaccacgtgccaagcggcacgatgctgctcaccaacgcatacgccatccacagagaccctgcggcgtggacggaaccggacgccttcaggcctgaacgattcgaggatggcagcgccgaagggaagctcctgataccgttcgggatggggcggcgcaagtgtcccggagagaccatggcgctgcggactctagggctggtgctggggactctgatccagtgcttcgactgggccactgttggaggcgtccccaaagttgacatgaccgaagcgtccgggctcactctcccgagggccgttcccctcgaggccatgtgcaaaccgcgccaagccatgcttgatgtccttcagaacctgtgagtgcccttgcggaccngaagaagttgatgagcatcattatcaaatgttgccacgttgttgccttgctatcgttatacgtagggcaatgtttaatccctacaagatctctctctccccccaataaacatgttcgtgcgttgtaatacaacatatcacttgtattgtcggttgtaatatgattcagagtgaaattctatatgtcactggatctgaacaag

SEQ ID NO: 7332 - DNA, 1646 bp, Zea mays
  misc_feature (1580)..(1580): n is a, c, g, or t
gggccacgacgaccccaccaacctggacaacggcgagggggaggcaatcgcgaagaaatttcccagaaagcacacaggatgacgccttcaaagcagagctctgtgacttgtatgccagggacagatcgcaaggggtagggacagtggctagtttggcggacttcatcaccacggctggcagcttgccgagccacgatgaccgaggtatctttactcagtacttcctccaggagatgaagatctcaaaggtacagaggttcaggcaattataaaatttttttgtgctcttgggcttgatgatgtagatgctgctaacatgcacatggagattggtagacgcatatacagagagaggttggaaacgagtgatcgtgatgctgacatggaacaaagacgggcatttcagaagttaatttatgtgtccaatcttgtctttggagatgcatctgtattcctacttccttggaaacgtctgtttggggtgactgattctcagattgacattgctatgagggaaaatgccaagaatttatactcggtgcagctcaagtctattggaagaggtcttgacataggcacactcattgaagtaaggagagcacaacttgcatataaactttctgatgagattgctgctgagatgttccgtgagcacgcgaagcagctagttcaagaaaacatttcatcagcattagacatcttgaagtcacgtattccggatagtctaactcaggctgtggaagaagtgaatattgtaattaaatttaatagtttgcttacaacattaagcaaacaccctgaagctgataattttgctcgtggtcttggccctatttcattagctggagaggatgatcacgataggagagctgatgatttcaagatactctataaggcctatgctacagaagtactttcagatggaattgtggatgataagaagctttcccctctgaatgaactgagaaacatatttggactggggaagcgggaagcagaaggaatcttatctgatgccaaagctcacatatacagaaggacacttgctaaatcatttaacactgaattagcttcagtccatagcaaagcagcatttctccaaactctttgcgaaaagttacagtttgatcctgaactggctagtaagatgcatgaagaaatttacagacagaagcttcagcagtttgtaactgatggagagctgagcaaggaggaagtggaagctctgatggcattccaagtgcgtctctgcatccctcaagaaactgtggacgctgcacatactgagatttgtgggcaactgttcgaaaaggttgtcaaagaagccattgcatctgttgacggatataatgctgatagacgtgaggctgttaggaaggcagcacaaagtctaaacctgaaaacggaggctgtcatgacgatctttagtaaagcagtaccgcggtcgcgcccgcgctacattcagagagcaaaagaagctggaaaccgcattgaaactgcaaaagaactgaagaagttaatttccttcaacatagttgttgttaccgagcctttagctgacattaaaggagaactatctncagttgctgaaactgaagcatcaagtgcagctttcagaatctgaggagaggatggtgaacatgaat

SEQ ID NO: 7333 - DNA, 2870 bp, Zea mays
atgatgagtgcatacagactaatcacctagtagataggataggaaatgggtatggattacgtattagttgctgttctgtttgcgagcgtttcgatcaaaggctaccgccgggatcgaggggcttaccgctcgtcggagagacgctggagttcttcaccgcgtcaccgaccctcgagctgttgcccttcttcaagcgacgtttggagagatacgggccgatcttccggacgagcgtcgtcggcgaggacctggtcgtgtcgctggacccggagctgagcaggcgcgcgctgcaggaggaggagcgggccttccagatatggtacccgccgtccttcctgcgcgtcctgggcgccgacagcatcgtcagcgcgctgggccctctccaccgccacatcagggcgctcgtgctccgcctcttcggccccgagagcctccgcctggtgttgctgcgtgacgtgcagcggagcgcgcgcaccgagctgcggtcctggctccggcggccgggcccgggcgtcgaggtccgggcggccacctcaagggtatgtcgtccgtgtgtgcatgtgcatggtctctcgatctctgtcgacgctggcacttctgccagacggacagtcttctgcatggttacctgctgactacgactacccatcatccagcgcagatgatatttggcgtcacggagaagaagctgatcagccacgacgtacgacgcggcggcaggagggagcctgtggaagtgcttcgacgcgtgcaccacgggcctgctggcgttcccgctccgcgttcccggcacagccttctaccgatgcatgcaggtagtctgaataaccataacctggccagtggcaatgttcgacctgtctgatccgtctcttcagggacgcaagagggtgatgggaacgctgaggcagcagctcggcgcgcgcaggagcaggaacgagccagagcacgaggtggtggatttcttcgaccttgtgatcccacgagctggacaggccggactccgagctgaacgagaacatcgcgctggacctgctgttcctgatgctcttcgctagccacgagaccacgtccatcggcctcaccgcgatcctcaagttccctgacagacagccccgaagcattgcaggaactaacggtagggaaatcgttgccgtcgcattggtttattgacttcttcttcttctttttaatgtggggctttctgctttgctttcaggaagagcacgagaacatccagaaaagaagggcggatccagactcggacgacgaagtcacatgggaggagtacaagtctatgaagttcacgtctcatgtatgaggccggccgcaacattcgtaagagacgttctcattaaactagtagaaaatttagctggttcttgcatatctaactacgcagtgactttcgtctctgtgcactgagatctgctgcttcctgcatcacatctgttaggtcatacacgaggccctaaggctggcaaatatcgctcccgtagtgtttaggaaaacaacacaggatgtacagatgaagggtatgcacacaccttccctacgttatttctcaaaagtggtccgtgttctagtgtatcgtccattgatgtgtactgcttactctgaactgaacttctacgtccagagtacactgtaccgcaaggatcaaaggtcatgatctgttcagcggcagctcacctgaatccgaaggtgtacaagaaccccacggtgttcaacccatggagatggaaggtacgctcggctcaatgcaggataatctcttgttgatcacagtatcagaatttctctcacatgtatgttgtgtgcaggatcgtactgtcgaatcagctggcggctcaaggatttcatggcctggtctgcggctatgcgttggtgccgactttgccaagctgcagatggctatcttcctccattatattgtttagtcaccaagtacaggtaccgcgccgtgacgtgcctctatttaagcacctgtttagatcatctagaacccagttagctgttcactgtactagttattactaaactataaatcgacgcagtactaagatagtgtaacttagtatacccgtgtcttgtaaactgagagagagattgagtaccccatggagtgtggaagttcaagatgtatgtggtgaattaatgccatgtcgttttcacgacagatggagagccgattagcggagggcacaatgatgttctacccaggactagggtttccagacggttttcatatcaagcttcttcccaaagattgaagtgtgataaccgacaatgcgttgcgtgctagctagattttgtgttgtgaatcaagccaaataattgtaggggcctgctagtctgatgtttatgactatactgtagttttgattgtagactaaattgtacttggaacatttgcgttgtgttgcttcgtcctttaaactgctgttcttgctcatgtttctccatccattgagtggcacccttactcctgcgttggagggggagcagtctagcaactgtccagttaaaacaaatgtcatctctcgctgacagttcagagttagttaagccgcctgcaagcctgtacaacaaaacaaacaggatccccatattatagacaggctccgcagagaaagagagaatcaaacagcaaccgttgggccagcattcccctggttgcctgggtctcttcaccgaacgggaccggccacactagctttgagaccaaagatacaggaagtgatttgatttgggcattgttcgtttacgccggattgcacccggaatggttccagctaatcaaaatttatataaattagagaagcaatccgctaggaatcgttccgatccaccaatccgacacaaacgaa

SEQ ID NO: 7334 - DNA, 1958 bp, Zea mays
tgggaccgcccggcgccgcaaacggagcatatatagctcgctagacgagttgcagagagcaagtatattgctatatatcagcaatataatgtcgatgcattacttggccgctctgtcggctgtggctctgggagctatcttgcttctccgttcggccttcaaatggatgaacggcgcccggacgggtaaagacgaagggcggatgctgccgccggggtcgaggggcctgccgctcctcggcgagacgctcgagttcttcgcggcgtcgccgacccttgagctagtgcccttcttcaagcggcggctggagaggttcgggcccatcttccggacgaacatagttggcgaggacctgatcgtgtcgctggacccggagctgaacgcgcgcgtgctgcagcaggaggagcgcggcttccagatctggtacccctcctctttcatgcgcgtcttcggcgacgacaacatcatctccgcgctcggcccgctccaccgccacatcaggaacctcgtgctccgcctcttcggccccgaggccctccgccttgggtgcatgctccgtgacgtgcagcggagcgcgcgcgacgagctgcgctcatggctcgaccacccggacgtcgaggtcaggacggccacctccaggatgatattcgccgtcacggcgaagaagctgatcagccacgacgacgcggcgtcgggaggaagcctgtggaaatgcttcgacgcctggaccaaggggctgctgtcgttcccgctctgcgttccggggacagccttctacaagtgcatgcagggacgcaagaacgtcatgaagatactgaagcagcagctccacggccgcccgaccccgcccccccccaggcccgtggatttcttcgacctcgtgatcgacgagctcaacaagcccgaccctataatgaacgagaacatcgcgttggacctgttgttcctgctcctcttcgcgagccacgagacgacgtcgatgggactgaccgcgatactcaagttcctcacggacaacccaaaggccctgcaagaattgaccgaggagcatgaaaaaatcgtggaaacaagggtggatccggactctgatatcacctgggaggagtacaagtctatgagattcacatctcatgttatacatgaatctcttaggctagcaaacatcgctccggtggtgttcagacaggcaaaccaagacgtatacataaaggggtacactatcccagaaggatcaaagatcatgatctgtccatctgcagctcacctgaactcaaaggtttacgaggaccccacggcgttcaatccatggagatggaaggatactcccgaaccagttggtggttcaaaggattttatggcctttgggggtggtttgcggttatgtgttggagctgactttgccaagctgcaaatggctatgttcatccactgcttggttaccaagtacagttggaagcccatcagcaaaggaacgatggtgttttatcccggtctacgatttccggaaggctttcacatccagcttcttgcaaaagcatgaaattttattgctggaaaagatttgcacacggggtactaaaaatatgctttttcgttagtaattatagttgtgtaataaaaaaactaaagagacaattgaatatgagtaggttttaattggtcatatctaatacacataaatatacgaacgtgctactaaacctcataaagaaaagcgaactagagcaagacttcaagatcacgcatcagcctactgtacgtgagatgcccaaagcacgtacgagcggtgaccagcaaatcagaaatgcgaagtacgcgcgtagatgaaaggctttttttttttgaaaaaatggtttatgtagtatggtttcccaattttcaagatgtatgcctttatactgaatgttgtaatgtaatgcatgtaattgtttccacattatatataataagttcagctg

SEQ ID NO: 7335 - DNA, 699 bp, Zea mays
ttacccctcctctttcatgcgcgtcttcggcgacgacaacatcatctccgcgctcggcccgctccaccgccacatcaggaacctcgtgctccgcctcttcggccccgaggccctccgcttggtgatgctccgtgacgtgcagcggagcgcgcgcgacgagctgcgctcatggctcgaccacccggacgtcgaggtcaggacggccacctccaggatgatattcgccgtcacggcgaagaagctgatcagccacgacgacgcggcgtcgggaggaagcctgtggaaatgcttcgacgcctggaccaaggggctgctgtcgttcccgctctgcgttccggggacagccttctacaagtgcatgcagggacgcaagaacgtcatgaagatactgaagcagcagctcgacgagcgcaggaacacggccgagcgcaggaccgtggatttcttcgacctcgtgatcgacgagctcaacaagcccgaccctataatgaacgagaacatcgcgttggacctgttgttcctgctcctcttcgcgagccacgagacgacgtcgatgggactgaccgcgatactcaagttcctcacggacaacccaaaggccctgcgagaactgaccgaggagcatgaaaaaatagtggaaacaaaggtggatcctgactctgatatcacctgggaggagttcctcggccgcgaccacgc

SEQ ID NO: 7336 - DNA, 680 bp, Zea mays
  misc_feature (511)..(511): n is a, c, g, or t
  misc_feature (566)..(566): n is a, c, g, or t
atcagaaccgatccttacagagagacacccccagcgcgcgaggtatctacatcgatcatcaccagcgagccagccggccgaacgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctacaccgcttcgagcggcacccggcgaacgcgccccggggcgtgggcatcggcgccccgccgcccaagtccgggcgcggcggcaagtacacgtgggagggccccggcggcctcgtcgaggaccagctcgacccggcgccgcccgccatcgaccccaacgaccccaactacgaggaggcggaggagggaggggcggcggacgaggacgacgaggcggccagggaggtggtcgtcggggaggtggaggtcgctaaggtccccgagagcagggacggcgtcgccagggtngacgtcgccccgcccccgccccaggcccagaagcagtaaaaggcctgtcttttcntggatacgtctacactctataagactgtgtgtcagtgtgttcgagtttgtcccgtgcagagagtgcacgtcaaccccgctttaattaatctgcttttgttaaaaaccccccccc

SEQ ID NO: 7337 - DNA, 2100 bp, Zea mays
attttcttgcttttgacacgatgtcttctacaaactttggtgtaatccgatctaaaacgtatttgcctaacaaagtccctacagactttcttttgatgtaaacaatatatccataccgaaacaaacattatagctagaaaggcatgtagctatagttctgacatgccaccttttacggtctttaggaccaatattttggtgcctcaacaaatatgtacatataactaggaacttgctatcaactatggttagcttacaacccactgtaatataacacatccaatctggatatgatcctatatttgcatatcctaacttttcagtggtacaaacatattcatgcttgcatatttttcattcatattacataccgtcttctacacatatattactaagatacacattgcttatatacacccacaacatcaatttacttaatgtctatatacatcaaatcagctatttaattgtgatataaaaaactcgcgcaaggcgcgagcaagtttctattcatatagtagtcagccttcaaaacattaatttagggtaaaataaaataaaattgtagaataagattttgaaaaatgaggcatgaaaaggaaggatatgcgtgcctatgcggcgcgttcaatccggcgaatggataattccattctagctccagcggtggtgtcgtactcgtgtcgtcacgtgtcctcagctctcgatgtcgccgtcgccttctgccaccttcgcccgcgttctagactcctcccgcgttcctccagcgcgcacctcagccccacgcgtccgcccacgcgtccgcccacgcgtccgcccacgcgtccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccatcgaccccaacgaccccaactacgaggagggaggggcggcggacgaggacgacgaggcggccagggaggtggtcgtcggggaggtggaggtcgctaaggtcgccgagagcagggacggcgtcgccagggtcgacgtcgcgccgggcctgctccaggaccagaagcagtaaaaggactgtcttttctggatacgtctagactctataagactgtgtgtcagtgtgttcgagtttgttccgtgcagagagtgcacgtcaactccgctttaattaatctgcttttgttaatatttttactgatcagtaatatgaaccagtggttgatatttggatggacttgctctcagcttaacctgtaaagtttctccctgaagagaactcctgcacacagctactgattgggggcacattcctaaagatcttgtggtttcttacaaattctagttgattgtggtttctaacaaattctagttggtaaccttaaccttgggacttagttccaacatatcagaagctagctttaggccttatttggaacccatagaattaatagcttagccaatactgttgagccagctaataaattactagttggctatctaacaattagttacggtttaaagcccaataactaacttttagtagctaactattagttttattagttttagggggtgtttgaatgcattcattttattgatcagtactcatatgacgtttgacatgttgtaacttagtttaattagttgtacttgtgactttgtattgatctttgaaatgaaaatattaaattgagctactaagtggttttttcttctagggggcatcgagctagcctacgggcgtgtttgccgctatggcccagcagcctggctgcgcttccgggatgcagttcctgtgttgcgtcgtctga

SEQ ID NO: 7338 - DNA, 809 bp, Zea mays
gttgccaagaaaccgatccttgtccctacgaccagcgacacgcactctgcacccagcgcgagaaaaaactacatcgatcatcaccagcgagccagccggccgagcgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcggcctcgtcgaggaccagctcgacccggcgccgcccgccatcgaccccaacgaccccaactacgaggaggcggaggagggaggggcggcggacgtggacgacgaggcggcggccagggaggtggtcgtcggggaggtggaggtcgctaaggtcgccgagagcagggacggcgtcgccagggtcgacgtcgcgccgggcctgctccaggaccagaagcagtaaaaagacttgtcttttctggatacgtctagactctaagactgtgtgtcagtgtgttcgagtttgttccgtgcagagagtgcacgtcaactccgctttaattaatctgcttttgttaatatttctactgatcagtaatatgaaccggtggttgatatttggatggaccttgctctcggcttaacctgtaaagtttattctctgaagagctcctgcacacagctactgattgggggc

SEQ ID NO: 7339 - DNA, 2518 bp, Zea mays
ggtcgaccgactctccccctctcctcctctagcttctccttctctctctctccttcctggaccattctctctatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccggtgaggaggttcgctgccgtgaagagggagctgcagacgatggaggggaacgacgacgaggccaccggcagggtacttgtctactcagtggcgtcgtcggcggtggttactgccgacgacgacgaagggtgcaacagcagccggaagaagctgaggctgtccaaggagcagtcggcgctgctggaggaccacttcaaggagcacagcaccctcaaccctgtaagtcctgtcctgctaggcagaagtagaacatattattaggtttaattagcgcttctgatgtcattttttttggctcgtgttgtgcttgtgcataacgcatctgagcagaagcagaaggctgctttggccagacaactgaacctgagcccaaggcaagtggaggtttggttccaaaacagaagagccaggttagtcatcactcatatattcacctcaaaatccatatctcctttcagttttttttcgttccatcatatattcttcgtccccaattattcttaatatctattcctaaaaaatcattcagaaattaaacacatatataattactttttaacaacgaattatcttaagtacgtactatatgatctattggatatatatataaaaactatcctgatgtgttctccatgcagaaccaagctgaagcagacagaagtggactgcgagattctcaagcgctgctgcgagacgttaacagaggagaaccggcgtctccaccgcgagctccagcagctccgcgccctcagccacccgcacccccacccggctgcctttttcatgcccaccgccgctgccgctgcgctctccatctgcccctcctgccagcgccttgttgccaccggagcatctgccgccgccgcaaccaccgccggtgcagataataagcctaaggcgggcggccccggcggccgagcgccacacgtgttcagccctttcaccaattctgccgcctgctgaacacgcacacatatgtatatacatgcatgcgcacacatacatatatacgtatttttctttagcgctagccacgctctatcattcatcgatggtcatctactagctagatagtaattggttcactagatggcatatattcctgtcccctccccccttaattcattagctttgttttttcacaagctaattaatgaattgatagcggcgtcgcgtgaggacgatggagcaccacgcatgcatatgattctagtagcaaaaacaagagatatatgtcttgtttaatttggtgttgcttctgcttagtatagtgcccactgctggtgctgtagctgtagctttaattagtaggtgttcctgatggatttcctcttgtattagttaactgtcagtcagggaatagtaatgatgacagcatgacaccacatacacatcccagtttatttggatgtggatccatgtatatatgcacatgccacatgacggatctgtttcaacaattaaatactatattgatttgtcttcagaagttttgcatatatatctttgtgggcaaggaagctccctgatgaagggacaagaactggcattttgcattttgtaatccatttcctgtttcctagccgcgaaaaaagtcgacatcgaggacttgacaaacacaaatagaagtttatatatatagtccttacatgttatatgatgagggaaaacagtagaataatagtaatatatttccgtttcagatattcaggaacgatatatataccagaaaacgagcttgttcgtttgtacaggaatgcaatagaaattgttccaacggatcaaatcttatatgtataaattagataataaatccagctaggaacatattgattccagccaaagatttcgtgaaaaccgaacaggcccctgggcctttttccagcgcgtgtacgtaactttgattcagggcagctaataactagtacacgttttattaatgatataataagctaataagagaagaagcacagattgggctgtgagcaaagcaaagacacgaaataatcgtgatataccaaattaaaggaggttggcggtggtggtttaactctctggagacatgcattgtatgcctgtatgggtgtgtgcatgcatgccggggacacaggcaagcagtgatctttctgttgacacacacacaccatccgggctccgcctgcag

SEQ ID NO: 7340 - DNA, 1528 bp, Zea mays
cattgggggccgcccggcccgccccctctcctcctctagcttctccttctctctctctccttcctggaccattctctctatctcctttctctctctacacatactcagacgagcagaagcagctagggacaccataggcaaactacttcagcaagaaattaaactatctcctacgcaagatcagaagaaactgtgtatggagcaagaagaggttggcctcgccctgggcctctccctcggctccggccaccaccaccaggagctcaagccccaacatccgtcgcatccgtgtgcggcgttgttggagccttctctgtcgctcagcggcccggcgaccaaggatgatggcccgaccgcaccggtgaggaggttcgctgccgtgaagagggagctgcagacgatggaggggaacgacgacgaggccaccggcagggtacttgtctactcagtggcgtcgtcggcggtggttactgccgacgacgacgaagggtgcaacagcagccggaagaagctgaggctgtccaaggagcagtcggcgctgctggaggaccacttcaaggagcacagcaccctcaaccctaagcagaaggctgctttggccagacaactgaacctgagcccaaggcaagtggaggtttggttccaaaacagaagagccagaaccaagctgaagcagacagaagtggactgcgagattctcaagcgctgctgcgagacgttaacagaggagaaccggcgtctccaccgcgagctccagcagctccgcgccctcagccacccgcacccccacccggctgcctttttcatgcccaccgccgctgccgctgcgctctccatctgcccctcctgccagcgccttgttgccaccggagcatctgccgccgccgcaaccaccgccggtgcagataataagcctaaggcgggcggcccccggcggccgagcgccacacgtgttcagccctttcaccaattctgccgcctgctgaacacgcacacatatgtatatacatgcatgcgcacacatacatatatacgtatttttctttagcgctagccacgctctatcattcatcgatggtcatctactagctagatagtaattggttcactagatggcatatattcctgtcccctccccccttaattcattagctttgttttttcacaagctaattaatgaattgatagcggcgtcgcgtgaggacgatggagcaccacgcatgcatatgattctagtagcaaaaacaagagatatatgtcttgtttaatttggtgttgcttctgcttagtatagtgcccactgctggtgctgtagctgtagctttaattagtaggtgttcctgatggatttcctcttgtattagttaactgtcagtcagggaatagtaatgatgacagcatgacaccacatacacatcccagtttatttggatgtggatccatgtatatatgcacatgccacatgacggatctgtttcaacaattaaatactatattgatttgtctccagaagttttgcatataaaaa

SEQ ID NO: 7341 - DNA, 1723 bp, Zea mays
  misc_feature (1682)..(1682): n is a, c, g, or t
  misc_feature (1700)..(1700): n is a, c, g, or t
  misc_feature (1710)..(1711): n is a, c, g, or t
cggccggaacttcactcccagtcccagctcccaaaccatctgatctgctctgctcccaccaatctccgtcgccgtcgctttcgccatggcttcccatcgccacttcctacgcctcctcgaagaccccttctcccccttcccaccgccgccaccttcctcctcctcctgcccgttcctccttgacggcgtctcagattacccgtccccgttccccgccgcctccccattccccgacctagatgatctcctcctgccccccgcgccggcgctcgaccccttcttggccttcacccccaccccgctcattctccgagacctcaccaaccgtgtcgccgcactcgaggtcgccgtcgccaccgcgcgccgccgccccggaccccccgccacccggaagcgcacctatgtcactgaggccggcggccgcaaggtcaagtggacttccgtcgagaagccgcgcgccggggagcggacgctcaagtgggaggccgagatcaagtcccccgacgacgacggcttcgaccgcaagtggaagtgggaggccaagggcggatcctccgcagccagcgccaggaagctcaagtggggtgccgcggtcaagggcaagggatgtctcgagccctggtcccaggcctacacctgggaggaggacttcaccgccagcgacagcgacaaagaagaggaggagcgcgcggccgacaagaacaaggccaagaagatcaccatgaacaagaatgagaagaaggaggtgaaggctgtcaagaaggagaagaaatgccccttcgccaccgtcaagatcgaggagatctcggaagacaatgatgctggatgcgtcgccatcaaaaaggcatttgctaagggcaacggcaagggaaagaggaaggagctctcaccgcaggacgctgcattgctcatccagatgacctacagggctcaccttgctcatcgctcccaggtgcttcgctgcctgcgtgacctagctgtggctaaagccaagctcaaggagctcaggtccctgttctataacatctcctacaggcaccgcattgcgcatgaccacgaagagcgccagaggttctctgagaagatcatcgtgctgctcatcaccgtagatgcactcgagggacctgactacatggtgaggaccgcgaagaaatctatgctagaggagctcgaagcaatgctggaggttgtggaccctcagcccccagggaagcagcgatcactgagccgcaggaaatttgatctcccagagggtggagccatccccgatgagaaaaccgctgctgtgaacaaagccatcaggatcatcgaggaaggcaagtgaagtgatgcaccaccaccttgttactggcaggattgaatcctgatgaaagctccatatctatccgtgtatcgtctaggagaagtttatatccgtgtgctttgctgacactcgagggaggagaactaatatctgcactttattgtaccttaaatgatagccatgtttttattgtgaacctgtagtatgttgctaggcagtcagtttgaacattacaaatagcgtaagggcctctagccgggttggttaggtagtctgagtagcacttcctcatgtcctggttgtgggagcgaatgtcagactgtggttaaaaaaatatcccatcgtttgtcccacgccgaaaaaaaaaaaaaaaaaaaancccgggggggggcccgtnaccaatttcnncccaaaagggat

SEQ ID NO: 7342 - DNA, 1582 bp, Zea mays
ttgattgactattgtaacttcacaaaaaccccaacaaggcccaggtcagtgcgtgcacacagaaatgcagcatgtatcccaggagaaactgcagtggttgaaacagttgatctagtttcttcttgtcaagcttcacagatggtaatcggtgattctgctgagagatctttgactaacgtcgcgtcagaaaacagagaagataaaatttgccatgaaaacactagctctggtgatgtctgtgctgaaccaaaagagtcgatgcttcttcaagaaaatggaataccagttgggactggaaacatggtagaagagaaggttgatgcacaaccacatgtggttgtccagcaatataaggaagaaactaacttatctccgttaacagatgccctcaagaagagcttgatgcaggaaaccaccttatctccatttgcagcttctcacaaggatagcttgacgcaagaggatggcttcatgcaagaagctgatttatctccgttgactgctaatcacagggatagcttgattgaagaaaccaaattgctaccaacaacagcttctcacaaggtcagcttgattgaggaaactggcttaactcagacaatatcttatgagaataacttgaagttacaatttaaggaaggaacaaagatcggtgatatcgatatgctgccacaagatgtggacctgattgagttgcccgatcaaaggaaaataattggtcatgatgttggtgctgaaactgtaatagaaatggaaaaaggaaagctggatcaatctagctcactaaatctatccgatcttgacctagttcgtggtacagaggttgccgctgtacacaatagtccagcgttggtccagccatctgcagctggatcttctgcagagtcaaataataaacagcaagaaggtcctgaaacttttacaggcgccaatgccagtcatacatatgatttatgccagattccattagataataaggatgttcaagtaattgatatagaatgtggcacaccagttgaagttgatggatttgatttgtcaaagtcaaagaatgagatgatttgctctagcatggatagcatgatggaccccggccatggaatacatacggatattcttcctggtattcaagatggatacagccttgcattttctgattttcttggttctgatataccatgctacccatcaatgcaatcagatcttcatgctggaataggtgccaacgactctgagggcattgctgtcatggatgatccaatatatgggtctctctctgatattggtttcatggacgtgtgggggcagcccacacaagactacgacaaattcttctaggctgccgccgggggccgaggttcagtgatttgacaggagaattagttgagttacctgagtacaggcgagaataaatagatcgggttatctcagagaaatgttgtaatcattcctaattgtagagctagagaaactctcttttttttcgatacccatttcgacggagttactgatccaaagactggtcttatgcgttcaatggtttgagtgcggtattttttcgtttttaaaaaaaaaaaaaaaa

SEQ ID NO: 7343 - DNA, 2097 bp, Zea mays
ggtcatggacctacagtacgccacacacccgacagcgacaggcaacgaactccaaaacatgtttattaccgacacaaaggtccaaaagatgtcaaaggtttgccccgctagatttacccggagaagtttctccggactccgggccccgcaaagttattttttttctggctttagatttttttagttattatttttttcaagaaaagagaggaatttattatggacgtagtaaaagtattcgctagagatagagattattagaggtagtcgcagtgttgcacgctggccactaacttcacctcaccgcactctatatagctgccaagcttgaccgcagcttacccagaacatcccaatcgaagcagcgagagagggtcgtcgaggtcgtcgtctctagctagctgctaagagagagagagagagagaggtatacgtaggaccgccggcaactagctaactaacatgtcgtcgtcgtccgggacgacgatgccgctggcgtaccagacgtcggcgtcgtctcccgagtggctgaacaagggcgacaacgcgtggcagctgacggcggcgacgctggtggggctgcagagcttcccgggtctggtggtcctgtacggcggcgtggtgaagaagaagtgggccgtgaactcggccttcatggcgctgtacgcgttcgcggcggtgtggatctgctgggtgacctgggcctacaacatgtccttcggcgacaggctgctgccgctgtggggcaaggcgcggccggcgctgagccagggcgggctggtggggcaggccggcctccccgccacggccgcaccacttcgccagcggcgccctggagaccccggccgcggagccgctgtacccgatggccacggtggtgtacttccagtgcgtgttcgcggccatcaccctggtgctggtcgccgggtcgctgctgggccggatgagcttcgccgcgtggatgctgttcgtgccgctctggctcaccttctcctacaccgtcggcgccttctccgtatggggcggcgggttcctcttccagtggggcgtcatcgactactgcggcggctacgtcatccacctctccgctggcttcgccgggttcacggcagcctactgggtggggccccgggcgcagaaggacagggagaggttcccgcccaacaacatcctgttcacgctcaccggcgcgggcctgctgtggatggggtgggccggcttcaacggcggcgggccgtacgccgccaacgtggtggcgtccatgtcggtgctcaacaccaacatctgcaccgccatgagcctcctcgtctggacctgcctcgacgtcgtcttcttcaagaagccctccgtcgtgggcgccgtccagggcatgatcaccggactcgtctgcatcacgcccgccgcagggctggtgcaggggtgggcggccatggtgatgggcgtgctggccggcagcgtgccgtggtacacgatgatgatcctgcacaagcggtcccggctgctgaagcacgtggacgacacgctgggcgtcatccacacgcacggcgtggcggggctcctgggcggcctgctcacggggctcctcgccgaccccaccctgtgcgcgctcttcctgccggtcaccaactccaagggcgccttctacggcgacggcgcgcagctcggcaagcagctggcgggcgcgctcttcatcatcggatggaacgtggccgtcacctccatcatctgcgtcgccatcaacgccgtcgtcccgctgcgcatgacccaggacaagctcgaggtcggcgacgacgccgtccatggcgaggaggcgtacgcgctctggggagacggcgagctctacgacgtcaccgaccacgggccacgcgccgccgccgccgtcgcgcccatgtccacgcccccgaattgaaatagctgcgagaacctcctgtgcgtccatccatccatccatccatccatccatccatccatcgcgtgttgataaccaccgttcattgtgaaaaataccaagtgcacgagctagctagctagtaggccttgctgttcctcctcttcttaatccaacatcgcatgtactgtacaaaaaaaaaaaaaaaa

SEQ ID NO: 7344 - DNA, 1363 bp, Zea mays
aaatccattcatcccgctgtgtctgtgtattgtagtatcagccaaaaaaaaaagaagaataccccgaacacgaccagaaggcctactaaaccctgccgccgccgccgccgcgccatggccgacgagctcgacgagctgatcggcttcctctccgaccgcaacccccaggtgcggggcgcggcggcggacatcgtgcgcgggctgacgggtggggaggacggcctccgggcgctcacggcgcgcgccgatagcgcccttccggcgttgctccgcctgctggcctccgcgggcggaagtggctcgggagaggccgcggcggactcgctcgtcaacctcagccaggacgcggccctcgcagcgcgccttgtcgcgctcggggccgtcgatgccgccatggacgtcgtggccaagcgaggcggggagcagccagctctcgcgcgcagactcgtcatgctgctcgttaacctaacccacgttgagtccggcgtcgccgcgctcctccaggttggggatgagaaggtgcaaggcttgtatgttgcaaagcttgtgcgatcattctgtaggtcatccagtgattctgaagaggaagacatttttgagtacgttgcctccacacttgtcaatatatctaaggttgaagctggaaggagaatattgttggagcctaagagaggtcttctgaagcagattattcgacaatttgattcaacaaatcaacttagaaagaaaggggttgctggtacaattcgtaactgttgctttgaggctgatactcagcttctgagtttgctttctttagcagaatatctttggccagctctacttttgcctgtagccggaaagaagatatatagtgaagaagacagatcaaaaatgccacttgagctatcgagtgcactctctcatgaacgggaagttgttgaggattctgaaattcggcagcaggcattagaggctatttatatgatcgtattgcaggatggtggccgaaggtccttttggtcagttaatggcccacgaattctgcaggttggttatgaagatgaaaaggacccgaaagtgatggaagcatatgaacttattggttccctgcttgttgggaagggtgaagatgtacaagataacaagaaggaacaaggagagaagcctcaatgagccccgccgctgataaaaacggtgctgtatttttgtttgtctagaaaacatccctcgccgtgtgcaatagcaatagtatgatatcccaacttgtcaactgttgcaactgcaagagctctgcagtgttgcttttgtaattgacgaatgtatctggaaaatttgcaggtattggccgtcttttccttggttttaaaaaaaaaaaaaaaac

SEQ ID NO: 7345 - DNA, 1430 bp, Zea mays
gcgtattcatccatcacttgcggactcgcctcgtgcgcttccatttccactccgacccggccggcgacccgccccccggtccccggagcgaccgaggcctcgctcaccgacatgtgggccctcaacaacgccaaggccggcggaccctgcctcacgccgcggcacccagcgccgccctcccttgcgtcgccgtcgacggcatcggctgggcggaggttctggaggcgcagccccgtgtgggcgcccctggtggcggtgcgcgcgtcggggggcacgaggaaggacggctccgtcggtggcgaggccagcggcgaggaagccgatagcaaggcgtcgtctgccgggcatgatgatgcatctaccccaacaggggatacctctgctgggttgaaccaatcgcatgacgaaccaaaaacaagcaagccgattaatgtttctagcagcaactactggcgagatgtcagggcaaaccttgtgcgtcgggaacaggagctattagtggatccaagtactccatcagagtcgaaggcgtcctcaggagatccattacagctccctcaaaagtgggctcatgctattacgatgccagaggcaggatgcgttctggttgctaccgaagcgctagacgacgacagcatcttcgaaagaaccgtcatcttcctcctcaggctcggtacaaggggcacgttcgacggcccgttcggagtcatcatgaaccgtccgctctacacaaagatcaagcacgtgaacccgatgttccgagaccaggcgacgcccttcggcgactcccccctcttcttcggaggccccgtcgacatgagcatgttcctggtgaggaccgaggacagcgcgcgcctcaaggggttcgaggaggtggtgccaggcatctgctacggcttccggacggacctcgagaaggccgccgccctgatgaacagcggcgcgatcaggacccaggacctgaggttctacgtcggccacgccgcctgggactacgagcagctgctgggcgagatccgggcggggtactgggccgtcgcgtcctgcagcacggagctgatcggcgatgccttgatgggcgacccttctcgcctctggaccgagatacagcagctgatgggaggataaagtgtagtactctctgagctcagccaggaacagaagcagggccggccgtaggtgtttgctcatttgagatgtaataatttgttatgggtaaggttgtggtcgagtctgtacataattggaatagggtgactcgcttgttagttgcccctagcctcgtgtagcaactgctgtgcgtcgaatgtactgaaacaggctctatataatgcctgcctgcctatgtatttcagcaattggcgaacgtgaagatggcgcttctgatgaaatcacatgtcggtcctgttgccaaaaaaaaaaaaaaaaaa

SEQ ID NO: 7346 - DNA, 2225 bp, Zea mays
ccggccgcgcctttagaagcactcttctagtttagaaattagaatagaggcgctgaggcctcacccacccttttccctggcgttgcaagttgcaacacacagcgtccggcgagatcggcgatcagaaaccacgagcccacccaccatccggaacgcgcgcgcgatgtgtcccgtcagaggcggtggttgttcttggccagcgtccgtcgtcggctctgtcacggcggcgctgctcctcgccgccgtcatcgtgcggctcttcgtccccagtgcctgttcttcaggaattatcaaggggcggcggcaggtaggtgctggtgctgccggaggagcacggctccctgccggctcgctcgggtggccgctcctcggcgagacgctggcgttcatccgggccgcgtactcgcctcgcccggagtccttcgtcgagaaacgccgcgtcttgtacgggaaggtgttcaagtcgcacctgtgggggtcgccggcggtggtgagctcggacccggaggtgagccgcgcggtgctgcaggccgacgcgtcggcgttcgttccatggtacccgcgatcgctcatggagctgatggggcaatcgtccatcctagtgctcggcggcggcctccagcgccgggtgcacggcctcgcgggcgccttcttcaagtcgccgcagctcaaggcgcaggtcaccctggacatgcagcgccgcgtcggccgcgccatggacatgtggggcaggcggcgccatcggagcatgggcgacgacgacagcggtggtatgcccgtgcgtgtgcagaacgaggccaagtcgattgtgttcgaaatcctagtgagggcgctgatagggttagaggaaggggacaagatgcagtacctcaggcaacagtttcaagaattcattgccggtttgatatcacttccggttaagcttccggggactcaactctatagatccctcaaggctaagaagaggatgacaaagttgataaaaacgatcatccaagagaagaggaagaagatgatgtcggaaggcgacgaggatctgcgtggtgggactcatccacgtgatatgatcgacgtcctgctaggcaacggcaacgacgagctcaccgacgagctgatatctgacaacatgatcgacttcatgatccctgcagaggactccgtgcccgtgctcatcacgctggccgtcaagtacctcagcgaatgcccactggctctgcagcaactcgaggaggagaacatggagctcaagaggcagaaatcaggcgcgggagaaaccctagaatggacagactacatgtcgctcgccttcacacagcacgtgatcacggagacgctgcggatgggcaacatcatcaacgggatcatgcggaaggcggtgcgagacgtggaggtgagaggccacctggtcccgaagggctggcgcgtcctcgtctacttccgcgccgtccacctcgacgccgccgtccacgacgacccgcacgccttcaacccctggaggtggaaggagaggcccgacgtcgtggccatgagcggcttcaccccgttcggcggcggccagaggctgtgccctgggctcgacctggcaaggctcgaggcctccatctttctgcaccatctcgtcaccaatttcaggtgggtggcggaggaggacaccgtcgtcaacttccccacggtgcggctcaagcgagggatgccaatcgcagtgacgcccagaacctgctgaacgcaacgcaacttgccaggcaaaaccatactatacatttatactccgtaatcaactaaagaggtgtgagaaataatacagtacatgcatgcatgtaatggagggcgaaattaaaagttggcacggcaaaggcgccgatggtatgccaaaagttcagtttgcaaattatatagtttaattgctattacactaggggcacccatgtctgatgcctcgtttatgaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttttttttaaatcggaagggcccttttaaaagaaccaaattttactaccccttgtttgaaaggaaaaattttttttttggggccccaaaattaaattccctggcccgttttttaaaaacttgggaatggaaaaacccttgggttacccaaattaaatgcttttgaaaaaaatccctttttc

SEQ ID NO: 7347 - DNA, 4937 bp, Zea mays
gtgtcgaatttcacgttgtaagttccagggactttcacctgctagtccaagccgtcagaagacctccgtgtacgctagattaattgtcagtttggctatatatttgatggacatggttttataagatgtgatatcacaaaaactgcagtttataagcaaacttgtaacaaaactgtggttttaaaaaaaggacttatgagtgaagtttctaaaactaaaaaaggtacagtacaaaccatggcttcagaagctaccaaatttattgtatctgtaaacacaaacacgtcacaacttttgaaaaaaaacgattattataccagaccacagtatttctttattattttaaaaatattttacacggaaacggagcctttgtcccttcgcaaatgatcacaagccatacgatatcaagtgaccagaagtgaaggaaacccataaagttttttttttccctgaagaaacttcgtcggccgtttggatcttctcgtgcctttctgcatgcccacgtattccatagataagtactccatctgtgtagctatggcatgggctccacgtcatatacaactgggcccatacagggccatactccattgtggtcccatctgtcatgcagtaccacaagtatgagactcctttgcatcgagaggacgatacgacttgtcgactacggactacccacgtcgtccgatccttttctccggagccgacgtttcgggccccgcgggccacgggaaatatcaggcccacaggccagcgacaccgcccacaacttatccacagaaatctccaaaaccaaaaggctccaacagaacagaaccctacgctacggcaagctattccagtgattaccaaagcaaagccttccctgttcccaagcgcttcgcctccaatatctccacgccgttcgcggtgcttccgctcgcccactcctgtgccgctgcgcgccgctgcagctcccggcaccgtcctacgaaccaacacggccccagatttcttccagctcctccaaccgattcgaccggaaccgccgcacgagccccccaaagctcgcatcctttcctgcgtttatttatttcagttcaaattccggagtgttcgttctgtttttgccctaacttggtcacaatgggcggcaataatgacggcgtttccggtgccgcttgcttgaagccgctcaacggcgtctcccctacctacgtacccagcgccggcgccggcgccctgtacttccttatcggctccgggctcggcgtcgtggcggtgctccacgcatctgggttggcggaggtcagcggagagtgggcctccgcggcgcggtggaccgaggtaagcagagagtggccctccgccgcgcggtgggctgcccaactggccggatcggtcggcgcccagcgcctgctcctcgcaacgtcgcttcttttcctggccgtcagcgtctggcgcctcgccaggcgctgcgccgccgtggaggggcgcgtcggcagcacggactccgcggtgcgggcgttgcacgtcgggggagtcgtctgcgccgtgtgcgggtcgaagattcgggccctcaagagaggctgccgtggcgtggagcgcacccgctcggtcgactcgagcaagccggtctcgaggtcgctggctgctgagttcgaccaggaggctgacggggaggaagaggacaatgctggagagaccagcgatccagatgacggcagtgtgcagtacctgaggaggaggctcaaggaggagatgctgctgaaggaggttgcgctcgaggagctggagaaggagaggcatgccgcagcgtctgcagccgacgaggccatgtccaagattgcgtgcctgcgtagcgagaaggcgctggtggagagggaggcgcggcaattccaggagatgatgcagcagaagcagatgtatgaccggcaggtgatcgagtcacttcagtgggtgatcatgaagtctggaatgcaaggctgggagccagaggccataactgatcgagccttgtcggagacaagcgaggatgacagagataagaagtagctagctcttggttattggagttgaatggaaccactgaggaaggccctgttgtttgctttgagttcatcgtcctctgatcagctcttagtaaccaaacagagaatgccaagttacgaaaactcggatgttccttgaccatgcaaagctcttcaggggaaatatctgaaatccacctgtaaatataccatcttcttttaaactacctgtgtacttatctaataagaacaacatctgtacttgatcgctctaccttgcaaatgttcattgctatttatctgcaaatgttcattgctatctatctgtgaccttgtgtgtgatacatattttgacattacaagctggatttcagcactaggggtgtctgatatccgtcataccgtgttcgtgcaaagcatgatgaaccgtaggaatgcgatcgatttgtttcaatgtggttttaatatgctgaaagtaacttacaaaatgtgcattatctatctttttttatcctatttgaatgttggccacactccaatttctcctatctagtgctcaatcttcaagcacctcagagtcgatggctcgtgtatcatatagtccacattatctgagcagaaattcagtgatcatacagatcgttactacttttgcattggttgttctaatgaaaagaaatgtgtaaattctacatgtcggtgcccctgggctcgacagactgagaggtcgctcaaggacagcacaggagacgagcaacagcttgataggtgggagggagagcgatttggtgatagagaattggagatgacgattatggtgaataccagcccgatgcggtgaggaagatgctgattgtctcttatgcactaccagttagggtaattttactctctgatgtttggttttgctgccccttagcccttctttcttgcacaagtgaggacacgagcatcagcttcaatgatggttggttccgatttgcaaagtagcagctcgattcaagaggatcccaattgggatgaacacccatgctgatttgccctatatttgtgctgcaactacggccattgaacatacctcggaaaccaatttagactgagcaatacttttccatgctaccagcttgcattgcaagtagtttcagttgggatgttactttttagttttggattactgcgagttgtacagtcttgtttcctaggtagcgcaaatattctgcttctattgcctagtgaaactcttcattttatttgtgaaatctttgaagcaatctctcgaattgagcggtattatagcttgttctgttacgagtggatacagagggattgaaggggattaaatatctcttattcaattttgaatataaatggatttaatctccctcaatcctctcgaatcccaatgtaaccgaacagaacagggccttaatgtacccttcttttttttccagatgcaatttggaaatttttgtcttctcttgtgtaagcactggatcaagctaatcttggttttcttttaattcttccctttcagtagctgtggatgcacattgcaatattgttcgtgtatatgacgatgtatttggccaatctaatcacactagacactaatctgttgcaaagtggcaatgcgccagcatctagcagtgtgaacactcagaccatgttcgtttgatcccaaaaccatagggaccgagggagattggaagggattggagaggattttgagttgtaagggatttaatcccctcaatccttatggattggcacaaaacgaacagggcctcattcttgtagatttcctgtggttctattgtcgagttaatggtactgccgttaattagtggtgttgtgcggctcagtttcttgaagggtccctcaacagggatttggagcgaggttaggggagtgacatgtgtgaaaggacaacccatgtgtcggaagtagagatgacaatgaagacatgattttttattttctgcaggaaattctcctattaaggaacggagcattgcatttgtcaaaagtagagatgacaatgagatccaatccctgattactcgcggggaattttcttattagaccttgctcggttaaatcccctccaatcacctcaatccacccctaaccgacccctccaatcacctcaatccacccctaaccgagcaaggcgctaggggacaaggatgggtggaaacaagaaaagattagtcctcatcggattcgcagggacctccccctcccctcgaatttatcttaatctaaattagttcattgacatgttagaattatactaaaaactcaatacatagcctattataaaataggaaataaaactctagagtggatatatcttgtaattttaaatcttggctattcaatttatattgatttgttataatcaatttgaatttgtcttttaatattgcattttctaacggggacaaattcttgtggagataaattccctaacggggacagggatggcagaaaaaaatctctcctgtgagcattcgcggggacatggatggataattttttttcctcgtggggacggagatggagggccattgccagacaaggaattcttcattgccatccttagtcggatgtcggaacgagtacagacaaaaatagggttagcgagagcagcgctatgtgaacattgggtggtgcactcccatttgaggcattggagggcaggactacacaagactgtggcaccatctatgtcgcgacacacgatcaaaattgctaaatgttagatgttacaactttatcgagtggatgtgttgatgaagccatatcggcataccccaacaaagcgtgcaacaccctacttggtgcgctaaatattgtcgaagcgacaccaaggtaccaagggccgtagagaaaatcaaagaaagatagatgagcataagccta

SEQ ID NO: 7348 - DNA, 3139 bp, Zea mays
tttgttgagactcctttctagccacttggcagctattgtgctaacacttaacaagtttttgatggctataagtttaagttatacaggatcacctattcacccccctctaggtgctctcagtcggctgcccttgcccgaggctaggctcgggcgaggcgtgatcgagtcgctcgtatggactgatccctgacttaatcgcactcataaggcctctgcagctttatgctgatggggttaccagctgagaattaggcgtcttgagggtacccctaattatggtccccgacaatactcgatgtatttatatcaaagaatgtttgaaaaaactttataagatgatccaatgtgccaagtaagtttttattgttttagttaatagtatttttgaacctttttaaagggcctacttatgagtttttgcccagggcccctaaaatctcaggaacggccctgaacacacgggacgcgacgcggcgcactcagggagatggtgacacgagaggatcacgaatgcgtcaccaccagcgtgacgcggacatgagccccggtcctaatttaacggagccaaaggtattttcttcgtgtatccgagatgtggcgttcccgccacagttccagccctcggtcaacatgccaaaatactatgggaaacaaaccctagcctatggcttgaagacttctataaatttgataatatcatcaataaaactaatttaatatttggaaccaccaataaaaccagaggtagaaccctaaacattataataagtaattttgagtggtgttgtggatctttaatatgaattatggtgggataatttatgactctttactgacacacatccaaaatgagaaaatagtagatttcttaagacacagaagaccaacaaaaatggttttgtagaatcgtagcgattgcaatttcctggcgacggcaatcaggcaacgctgcacggaaagtaacacccgccacttgcgaagacttgttgtacaagtgtttctgaggctacctgtttacccttcaggaattcgaatccatgttcgctttctcccgccagacacacgagctgctgctgcggttgcttcctttctaggaggtgtcaaagcttccggctcacggcacaaaacatctagaggaagaagaaaacctttgacgaacgtgcgttttcaacagcaaaacgtctcatagccacgagttgctccccgtttttgcttgagagcgaagcctgtccgcgttctggcctcatataaatgcgtccgcggccccgcgcccgcccgggtatcacataatagcaatgaagagcacttgccacagctaaaactggtgctaattaatttcagctcatcgcacgctgatcaccaccgcttcaccacagcgaaccaccatggaaagattctactacgtcgccgtggccaccttcgtgctcgtcttcctgctccaccacctcttgacgaggaagaagcagcaacgtctgccacccggcccgcggttcgcgtaccccatcctcggccacctccccttgctcaagaagccgctccagacctcgttcgccgacctcgtgtcgcgccacggcccaattattcacctgcgcctcggccgccgccacgccgtcgtcgtcggctcggcggcggtggcgaaggagtgcttctccggagagctcgacgtcgcgatcgccaaccgcccgcacttcccgtccgcgcgcgaggtcaccttcgactactcggtgctcacggccgtcaactacggcgcgctctggcgcaccatgcggcgcgtctccaccgtgcacctcctctcggcccaccgcgtcaacgtcatgtcggacaccgtgatcgcccgcgagctgcgcgtcatggtgcgccgcctcgcccgcgcctccgcctccgcgccgggcgacgccgccagagtcgagctgaagcggaggctgtttgacctctcccacagcgtcctcatggagaccatggcgcagaccaggaacacctactccgacgacccggaggaggacatgtccagggaggcgcgcgacatgaaggacatcatcgaagagatcatcccgctcgttggtgcggccaacctgtggaactacgtgcccctgctgcggtggctcgatctctacggcgccaagaggaagctcgcggacgtggttaaccgaagggacttgatcttcgacaacatgatcggtgcagagcggcagaagctgaggcagcgggaacgcaagaaaggcgaggcccatgccagcgaatcggataagatgggcatgatcggcgtcatgttatcgctgcagaaaacagagcctgatgtctacacggacacctttatcaacgctctcgtgtcaaatctgctggccgccggcacggagacgacctcgacgactctggaatgggcaatgtcgctcttgcttaaccacccagacgtgctgaaaagggcgcaagaagagatcgagtcgaacgtcggaagggaccgtcttctcgacaagaacgacctcccccgcctgccctacctccactgcatcatcagcgagactcttcgcctctaccctcccacgccgatgctgctgccgcacgaggcgtccaccgactgcaagatccacgggtacgacgtcccggcggggtcgatggtcctcgtcaatgcgtacgccatccaccgggacccggcgatgtgggaggacccggaggagttcaggccggagcggttcgagctcggcagggcagaggggaagttcatgatgccgtttgggatggggaggcgcaggtgccccggcgagaacctcgcgatgcgaaccatggggctggtcctgggggcgctgctccaatgcttcgattggaccagggttggggatagagaagttgacatggcaacagccactggcaccatcatgtctaaggctgtcccactcgaagctcagtgcaagccgcgagcgaacatgtctgctgttcttcagaaaatctagagtgagattgtgaatatttctagttgcagataaacgatacataactatgcaatgcttatatatagtgtatagtagtatagcagtttcttcattttaaagttgtacaatgacattcatagaaaataacgacataaataataaaaatatacctctatatatatttataatttgtacgaaaaaaaaaaaaaaaa

SEQ ID NO: 7349 - DNA, 1639 bp, Zea mays
ttgggtccctcgaggccggccgggcaaaaaaatcccatcgccataaatctcgccacgcccgcgcccgcgcgtgtctcttccccccaccactccgccaccggcgccgaagcagagcagccatggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgcagccggatcccccacctggcacagatatacctcatcgggttctatgaggagcgggagttcgcgctctatgtctcgtctatctcccacgagctcaggatccctgtcaggtacctacgagaggataagcctcacgggtcagctggagggctctacagctttagagattacatcatggaagacagtccgtcacacatagttctgctgaattgcgacgtctgttctagcttccctcttccagacatgctagaggcccataaaaagtatggaggaatgggtactttactagtcaacaaggtatcagcagagtcagcaaaccagttcggcgagttggtagctgatcctgaaacaaatgaactgctgcactatacggaaaagccggagacttttgtgagtgatctcataaattgcggagtatatatatttactcccgatatccttagcgccattgaggatgtcttaaaacagaaaaaagacagagcaaatttgcggcgtgtatctagcattgaagctcttcattcagcaactaaggcgcttccaccagactttgttaggttagatcaagacattttatcccctcgagcgggaaagaaggagctgtacacataccagacacttgatttctgggaacagatcaaaaccccagggatgtctttgagatgctctgggttatatctctctcagtttcgccatacctctcctcatcttttagcctcaggagatggcaaaagaactgccactattgttggcgatgtctatatccatccatctgccaaggtgcatcctacttcaaagattggcccaaatgtctctatatcagcaaatgcacgcgttggagctggtgccaggcttatcaattgcataattctggatgatgttgaaattatggaaaatgctgttgttatacattcaattgtagggtggaaatcatccattggaaaatggtcacgtgtacagggcgaaggtgatcacaatgccaaacttggcattactattcttggtgaagccgttgatgttgaagatgaagtagttgtagttaacagcatcgtgctcccaaataaaactctcaatgtcagtgtccaagaggagatcatcctataataaccatcgttttttttgtctaattccatataaggtctgagtaccaatcacatagtttaagtttattcgttctcaccatgtaatgtaaccttccattagattgagattattagtttgcatttatacctgtcttgcagcatgacactgcacaatcttgacttgctatgctactttggttagcgattgtggtgatgtaaaaaatgtacaaacaggtgacaccattttttgtgagaatgactcaagacattacatcaaaaaaaaaaaaaaaaccc

SEQ ID NO: 7350 - DNA, 1941 bp, Zea mays
ccggccgggggctcagccaccggtttcagcgccagttcaaccccgcacccgcaccccggtgcggcacggatcccaccgggcgcagcgcacgacccacaaagtcagaaagccgctgcccggaaatcgcccgcctccgctccgctacgctctcaccacctcctccgacgtctgatcggcatcgccttcgcctccgctaaaatactcgcggtccacgctctcctccaaatcccatcgccacgccttcgcccgcgcgcgtctctccctcccccacactccgccaccagcgccgaagcagagcagccatggccggttacgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgcagccggatccccaacctggcacagatataccttatcgggttctacgacgagcgggaattcgcgctatatgtctcgtctatctccaacgagctcaggatccctgtcaggtacctgcgagaggataagcctcacgggtcagctggagggctctacatctttagagattacatcatggaagacagcccgtcacacatagttctgcttaactgcgacgtctgttctagcttcccccttccagacatgctggaggcccataaaaaatatggaggaatgggtactttactagtcaacaaggtatctgcagagtcagctaaccagtttggcgagttggtagctgatcctgaaacaaacgaactgctgcactatacggaaaagccagagacttttgtgagtgatctcataaattgtggagtatatatatttacccccaatatctttagcgccattgaggatgtcttaaaacagaaaaaagacagagcaaatttgcggcgtgtatctagctttgaagctcttcattcagcaaccaaggctcttccaccagactttgttcggttagatcaagacattttatcccctcgagcaggaaagaaagagctgtacacataccagacacttgatttttgggaacagataaaaaccccagggatgtctttgagatgctctggattatatctttctcggttccgccgtacctctcctcatcttttagcctcaggagatggcaaaagaactgccactattgtaggcgatgtgtatatccatccatctgccaaggtgcatcctacttcaaagattggccccaatgtttctatatcagcaaatgcgcgcgttggagctggtgccaggcttatcaattgcataattctagatggtgttgaaattatggaaaatgccgttgttatacattcaattgtggggtggaagtcatccattggaaaatggtcacgtgtacagggcgaaggtgatcaaaatgccaaacttggcattactattcttggtgaagccgttgatgttgaagatgaagtagtgatagttaacagcatcgtgctcccaaataaaactctcaatgtcagtgtccaagaggagatcatcctataatagccgtcattttttgttttatccctaataaggtctgagtaccaatcacatagtttaagtttattcattctcaccatgtaagcttctattagattgagattattgttttgggtttataccttgcagcatgccactgcacaatcttgacttgctgtgctactttgattagcgagtgtggtgtaaaatgtacgaacaactaacacccgagctgctagcttcagattaaagcaagctgttcaaactgccgcagctgtaatccatagagacaaaacactattgaagacttctagcccacaagtgaaattggaagtgtaatcaaatcctaatataattgtcataatcatattgttaatctgtataagtgaattgcctacctttttcctaacagctt

SEQ ID NO: 7351 - DNA, 1679 bp, Zea mays
ggccgggccgggacttacccgattgttaaggctatacttggatcggtctctcgaatccatcgcatctctattccctctcccttccctcggaattcaccctagcggcgatggcgtccgcggcggcgggcgcaccgaagcgctgctactacgaggtcctcggcctatctcgcgactgctccccgacggacatcaagcttgctttccgccgcctcgcgctctcgctccaccccgacaagcagccccccggctccgacctcgccctcgccaccgccgccttccaggagctccagcatgcccactctgtcctctctgacccgcaggagcgcgcctactacgactcccaccgctcccagatcatcttctctcacccagcctccgccggcgccaaatccgcttccaccgtccccgatctcttcgccttcttctcctcgtccgctttctccggcttctccgacacgggccgcggcttctacaaggtctacggggacgtcttcgacagggtcttcgcgcaggagcttgcctatgctcgccggatgggggttcccgagcccgctgcgccgccggtcattgggaaccttgattccccctatgcgcaggtcactgctttctacagttattggcttgggtttggctcgggcatggatttcggatgggcggctgcgtgggacgctgcgcgtggggaaagtcgccgtgttcggaggctcatggaggaggacaacaagaaggcgatgcgtaaggcacggcgggagtacaatgacgctgtcaggggccttgctgccttctgcaagaagagggataagagggttgtggacatggttttaaagaagaagctggaggaggagaagagaaaggcagaggagaaggagaggaggaaggaggaggacaagaggaagaaggagcgagccatggcatatcaagaacatgagtgggcgagggcagaggagggactgtatgatgaagacgaagaagaggagatgagggccaagaaggagctgttgtactgcgcggcgtgcaataaaaagtttaaatcggacaaacagtggaagaaccacgagcagtcgaagaagcataggaataagattgctgaactgaggaagacctttagggaggaggagtctttgaaaaaggcagaggagggggaaggtgattggaatgaagttgatatggggttcgattttaagcctacacaggagtcagatgatgcgagtgcattttcagatgctgcagaagagttagctgaagaatttgaaagtaattatgctggcaatgggcatcatggtaaatgtgaggttcagcctgagggttcggtccatgttaatgatgttgatgatatcatggaagggccatcctcttctaatgtcaacaatggtgcagtaataatggtattgcagctaccatcccccctcccagtactatgttgctctcgcaggaacaagttgttttctcacttggaagaaacaggtcacgcaatgctgaagtcactcgttggttctgcatggttctcttaagttttggcacaattttgtatctgtagtgaacattttttttctagatcctttatgtgtagtgtggagatgattttttgtttataaggccatgtggtgccggtggtgtgtgtgtgtgggtgtatactgggcaggaaagacactgataattacaatatataacattatttcact

SEQ ID NO: 7352 - DNA, 3094 bp, Zea mays
  misc_feature (1973)..(1973): n is a, c, g, or t
  misc_feature (1980)..(1980): n is a, c, g, or t
  misc_feature (2253)..(2253): n is a, c, g, or t
  misc_feature (2370)..(2370): n is a, c, g, or t
  misc_feature (2426)..(2426): n is a, c, g, or t
caccaaaggctcgactccactcgtttccagtctactccgaaccgtaagtgaatgaatttctgtctcatacagtttaggtcaaagacgagggaagtcacggaaagagggagaccaactgccgccgatcggtacggacaggagaggggcggtaggcctataaaaacttaccctataatcgagcccccccgcggatccttcgcctctctgttccctctgccttccctcgtacttcaccctagcggcgatggcgtccgcggcggcgggcgcaccgaagcgctgctactacgaggtcctcggcctatctcgcgactgctccccgacggatatcaagcttgctttccgccgcctcgcgctctcgctccaccccgacaagcagccccccggctccgacctcgccctcgccaccgccgccttccaggagctccagcatgcccactctgtcctctctgacccgcaggagcgcgcctactacgactcccaccgctcccagatcatcttctctgacccagcctccgccggcgccaaatccgcttccaccgtccccgatctcttcgccttcttctcctcgtccgctttctccggcttctctgacacgggccgcggcttctacaaggtctacggggacgtcttcgacagggtcttcgcgcaggagcttgcctatgctcgccggatggtcgttcccgagcccgctgcgccgccggtcattgggaaccttgattccccctatgcgcaggtcactgctttctacagttattggcttgggtttggctcgggcatggatttcggatgggcggctgcgtgggacgctgcgcgtggggaaagtcgccgtgttcggaggctcatggaggaggacaacaagaaggcgatgcgtaaggcacggcgggagtacaatgacgctgtcaggggccttgctgccttctgcaagaagagggataagagggttgtggacatggttttaaagaagaagctggaggaggagaagagaaaggcagaggagaaggagaggaggaaggaggaggacaagaggaagaaggagcgagccatggcatatcaagaacatgagtgggcgagggcagaggagggactgtatgatgaagacgaagaagaggagatgagggccaagaaggagctgttgtactgcgcggcgtgcaataaaaagttcaaatcggacaaacagtggaagaaccacgagcagtcgaagaagcataggaataagattgctgaactgaggaagacctttagggaggaggagtctttgaaaaaggcagaggagggggaaggtgattggaatgaagttgatatggggttcgattttaagcctacacaggagtcagatgatgcgagtgcattttcagatgctgcagaagagttagctgaagaatttgaaagtaattatgctggcaatgggcatcatggtaaatgtgaggttcagcctgagggttcggtccatgttaatgatgttgatgatatcatggaagggccatcctcttctaatgtcaacaatggtgcagtaataatggtattgcagctaccatcccccctcccagtactatgttgctctcgcaggaacaagttgttttctcacttggaagaaacaggtcacgcaatgctgaagtcactcgttggttctgcatggttctcttaagttttggcacaattttgtatctgtagtgaacattttttttctagatcctttatgtgtagtgtggagatgattttttgtttataaggccatgtggtgccggtggtgtgtgtgtgtgggtgtatactgggcaggaaagacactgataattacaatatataacattatttcatcaaaaaaaaaaaaaaaaccatccttacaaattttagtgttataatggctgctccatctcaggtgtaattttaagagctggacagtcttctcttgaacagaattgccccgatcttgtttggaaacagtgggagcactgattctacatcttttgtcacanaagacangcttcattttcttgaacatagcttttaccctgttcatctatacctttaaattaaagagccaacttttttctccatttttctgtggcctttcctcaccctgtggatatgagaactagggcgggaaacgagtcgagcttggctcgtccatttcacgagttggagggataggctcggttcgcgagccaaccctaatatataattgcattatacaataatttattagtatataaatatagtatatagataccattcatcgttatgagtaatctaaantattaattgtcatatatctatcattaaacgttaaggaacaaactgattatatataaaattatctaatatgcatcattatttatacatattaagtaatttgacacaactcgcgatctngagcgagctggcttggctcgctacgccaatgagcccaaaagactggctcagctcgngaacctatccgagctcgagccgagccggctcgctacggcaacgagcctaaaagactggctcagctcgtgagcctatccgagctcgagccggctcgcgaggctcgaacttatttcctagccctaaccagagctgtctattcctctattttttctttccatttttttgtgacctttttttcactcaccctgtggacgtggaaactgtttttattcctatatttttatacgacatacacaagatttcttaaagtacctggatagaaatcttaatcaaatagaaaaggagttcatgattccttcccagtttttttatccattatggtatcccattcttttctgttttctgtttttttccaacggcacagctgtgattttgtttcttttcccacctgcgtgctttctttttctggttttcgattctattttgtgtttagattttttttcaacggcttccatgttttcaaattttgtttttgttttcggattctattttttcgggtaatgtttagagtccgattccaagatgtttttcctatactacttttcaatttttttgttgtttagcaacattacatagttcgattacgtggttaaacaatagtgcgaactttgatattaaaatatgttgaaacatctatacttctataaaacacttagtttgacggtcg

SEQ ID NO: 7353 - DNA, 1756 bp, Zea mays
cgccgcccgtcccgtcccgtgtaggccaccatcccaccccaaccgtgtcgtcgtcatcgccttatctctctctctctctctcccttcatcttatctgtctatcttgatctcatctcctatcttcttcctcctagattctttcttccgcgcgccctctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtagcgagctgcgcggtggctgcgaccggaagcagggaggggaacagggcagcgaacgcccggcgattgccttgcttgcctgtgtgctccggccggcgcgagttggtcggtcgttccatgcatggatgacaaggaacttatctcacagtccgacctgcagtcattctaccagcagcagcagcagcaccaccgggccttcggcggcggcggcggggcagcatagcccgtcctcgctggccgggatgcactccgtcattcgccccatgcccaacatgaacatgagcccgtcggcgatccttaactctatcggcgggggctccttcaccggtatgcagttccaaatggacccgccgccgccaccattgctgcacaccgccgccatgggtgcctcggctcctacctccacccccggtgccgtccccgcggcccccacggagccggtcaagcgcaaaagagggagaccgcgcaaatacggtcccgacggcaccatgaagcagcagcagctcgtcgccgcacagccaaggatagggccgtctggtcccaacatgatcagcagcgccgggatagaggactcttcgcagaagaagcggcgcggccggccgccgggcaccgccaagaagcatcagccctcgccctctcaaggcaatgcgttcgccggttcagctggaacgagcttcactccgcacatcatcacggcgtctccttcagaggacgtggcggcgaagatcgtcgcgttcgccacccagtcgtcaagggcggtgtgcgtgctctcggcgatgggctccgtctccagggccgtcctccgccacccggccgacggctctcccatggcgagggttcacgcgtcgccgcagccgtacaacaacaaccctgccatctacgaggggttctacgagatcatgagcctaaccggctcgtacaacctggccgagggctcacaacaagaacagtgccagggccagggccagccgagcggcgggctcagcgtcacgctctgcagccctgagaggaatgtgatcggaggtgttttgggcggcccactggttgctgcaggcaccgtgcaggtggtactggggagttttcaccaaggagggtcgagatccaagtccaagaaaggcgggaagcagcagcaggcgccggcgccggccgccttcagttccgactcgctcaccggcggccaggaggcgtcgcccagctctgggcacaaccaaaatctaacgcctccgccgccgccgccctccgtgacgggagggtggcccacctccgggatgtttgacaccagcattgatatcaactcatctagaggatagctcatttcatttgtcgataattccagccctcgagaaattttctgttctcgcacaagaatgatcgaaaccatacttcgaaatagattattcggtttctcccttttccaaaaaaaaaaaaaaaaacggaatttctat

SEQ ID NO: 7354 - DNA, 1572 bp, Zea mays
gcacgagaccattacctagaacatcctaatcgaaaaatcattcatctatctgatctcatctcctatcttccctctctctcctccccgtcgtctgcctcctttgcccggcaagaccgcctgcccatgtccgtggcgccgtgcaatccgcttcttcagcgcagctccgatccgccaacgccgcccaaggagccgggatcggccgagagagcgtgctgacgagaggcaggcagcggaacagagcagcggcccgcaaggcgattgctctattctgccctgttccagcgttccatgcatggatgccaaggaactcatctcacagtccgacctgcagtcgttctaccagcagcaacaacagcagcaccgtgccttcggcggccaccatagcccgtcctcgctggctgggatgcactccgtcatccgacccatgcccaacatgaatatgagcccaactgctatccttaactccatcagcgggggttccctcgccggcatgcagttccagatggacccgcccccaccattgctgcacaagatcaacgccaccggcgctgtcacaccggcccctgcggagcctctcaagcgcaaacgaggaaggccgcgcaaatacggacctgatggcaccatgaggcaacaacaacaacagcaacaggccgcgtcatcgcagcagcagcagcagcagctcgtcgctacacaaccgaggatatgttctctatcatcgggtcccgacatgctcggcagctccggtatggaggaccccgcgcagaagaagcggcgcggccggccgccgggcaccggcaagaagcaccagccctcgacctcacaaggcaacgcgttcgccggttcggctggaacgaacttcactccgcacatcatcacggcgtctccttcagaggacgtggcggcgaagatcgttgcgttcgccagccagtcgtcaaaggcgatgtgcgtcctctcggcgatgggttccgtctccagggccgtcctccgccacccggccgacggctctcccatggcgagggttcacgcgtcgccgcagccgtacaagaaccctgctgtctacgagggtttctacgagatcctgagcctaaccggctcgtacaacctggcacacggcggcggcctcagcgtcacgctctgcagccctgagaggaacgtgatcggaggcgttctgggcggcccactggtagctgcaggcaccgtgcaggtggttctggggagttttcaccagggagggtcgagatccaagtccaagaaagccgggaagcagcagcaggcggcggccttcagccccgactcgctcaccggcggccaggaggcgtcgcccagctccgggcacaaccaaaatctaacgccgccgccctccgtgacgggagggtggcccacctccggcatatttgacaccagaagttccagcattgatatcaactcgtctagaggctagctcattcgtcgatatagttccagctcgacagaaattttctgttttcgcacaagaatacccaaaaaccatacttccaaaaaaaaaaaaaaaatctttcttttgagcaaaaaaaaaaaaaaaaaaggccccta

SEQ ID NO: 7355 - DNA, 866 bp, Zea mays
cattggggccctcgaggccggccgccgggcaccggcaagaagcaccagccctcgacctcacaaggtccaggcaatgcgttcgccggttcggctggaacgagcttcactccgcacatcatcacggcgtctccttcagaggacgtggcggcgaagatcgttgcgttcgccagccagtcgtcaaaggcggtgtgcgtcctctcggcgatgggttccgtctccagggccgtcctccgccacccggccgacggctctcccatggcgagggttcacgcgtcgccgcagccgtacaagaaccctgctgtctacgagggtttctacgagatcctgagcctaaccggctcgtacaacctggcacagggcggcggcctcagcgtcacgctctgcagccctgagaggaacgtgatcggaggcgttctgggcggcccactggtagctgcaggcaccgtgcaggtggttctggggagttttcaccagggagggtcgagatccaagtccaagaaagccgggaagcagcagcaggcggcggccttcagccccgactcgctcaccggcggccaggaggcgtcgcccagctccgggcacaaccaaaatctaacgccgccgccctccgtgacgggagggtggcccacctccggcatatttgacaccagaagttccagcattgatatcaactcgtctagaggctagctcattcgtcgatataattccagctcgacagaaattttctgttttcgcacaagaatacccaaaaaccatacttcgaaatagcttattcgcttctttcttttgagtaattaaattcgtatagaattcataggcatcgctcagtctcgtgaccggccattattctttcacaatcccttcgt

SEQ ID NO: 7356 - DNA, 3982 bp, Zea mays
ttataatttgtagtgataatctagctagattataatctcaaacaaacattcctgattcttgaatgaaaatgtagcggtagtgccagtagggtcatggatctaaatgacgtgatcactgtgatcatatcttgcagctataaatacaaaatgccaatgacaggaaccagaggaggcacgagagcgccatacatacacaaacagcgtacaagactcaaccactccctccttgttgcacgagaccattacctagcacctccgcagcgccctgtaaactaaccaccaaagccgaagaaggcggcttgccctgcccgccgccttggtgccgcgcgcgccatggccaagagcaagtcgtccgccaaggccggccccccgctcctcggcaagtacgagctcggccacctcctcggccggggcaacttcgccaaggtataccacgcgcgctgcctcggcggaggcgaccccgtggccgtgaaggtgctggacaaggccgggctggccgccacgggcatggcgtcgcggctcctgcgcgaggtgtccgccatgcgccgcctgagccaccccaacgtgctccgcctccacgaggtgctggcgacgcgctccaaggtgtacctcgtgatggagctggccccgggcggggacctcctgtcccggctggcgtcgctgccgtcccgcaggctccccgagcacgcggcgcggcgcgtgttcctccagctggcgtcggcgctcatctacagccacgcgcgcggggtgttccaccgcgacgtgaagccgcagaacgtgctcctggacgccgagggcaacctcaaggtgtccgacttcggcctcgcggcgctcccggactcggtccgcgacgacgggcgcctgcacacggcgtgcggcaccccggcgttcgcggcgcccgaggtgctccggcgcagggcctacgacggcgccaaggcggacgcgtggtcctgcggggtcatcctcttcgtcctcctcgcgggccacctccccttcgacgacgccaacatcgccgacatgtgccgcagggcgcaccgccgggagtacacggtcccgcggtgggtgtcgcagccggcgcgccgcctcgtggcgcgcctgctggacccgaacccggcgacgcgcctcgccgtcgcggagctcgccggccacccctggttcaagcgctcgctcagcgtggactcccagctcggcggcctcctggacggccaggcggagcgcgagctggcgttccaggccccgccggcgctgaacgccttcgacatcatctccatgtcccccgggctggacctgtcgggcctgttcggcgagggcaggcgccgccgcgagaagcggttcatgacgacggcgtccccggagcgggcggtggagcggctcgcgcaggccggcgcgaggctcggctacttcattgtggggaagaagggggccgagcgcctgccgctgggcgtcctgccgggcctcgtggccatgtcgatggagatgtcggaggtgtcgccggagctgatgctggtggagctgaggctggagggcggccacggcgacgaggacgaggcgttcgggtgggaggagctccgggttgagctgggggacgtggtaacagcatggcacgtgagtgaagaaggttaaaaattcgcaagaggaaatgcgagaacgatttcgcaggtgtatcagtgtagcatgtatagccgtatagcaagtgcgcatctcatctcgtgtacgtgaaattagttggttaggacgaacagcagcgtgtgatgttggggattaactagactggtagtttcaatcaaatgtgtgatgtgtgggattatttgtcaaaaaaaaaaaaaaaataaagaccttactaggtacctcgcgtgattgttgttcaagtgtactagctaccaagctagtgacaagaatgttgcaaggatataccagaggaaactgtttcaaagaatgagcttaacttgaactgattgcagcattaaaacagtttccttgtccagtcgtcgaatggagctctccaaacttgactgcacattcccattgttgcatggactcgtggtcttccttccctgacagcggctgccaaaccgccgcagcgacgccgtccgaatgatgcagctagctgcgtgcctgcacccacccagatccagcaaaatacatgctgcctccgagatcctcccatgagggcgtggcaaattctttcttgtctatgtgctttgggccggggtgggggtggcaaatgcatctatctatatgcggtcaaccgtttaagtccatccaattaaggttcaggttcaaggtgctgtccaactcgatgtcacctgctccttcatcaggttgatgaagaatatatataataccatcccaattatggttggcgaattgaagaagaaccatagcgcaaaaggttgacaggcatgtctactagcattacagcgaagattcatggtgcaagtcgtagtcggtttacaggcaacgccctccagcagcagggactaaaatggccatggcgtgcgtgatcagatggatggcgaacggagaaatttaaaacggagaccacatcatcttcagtgacttgtaggctccgggctctggcagcaccgagctcatggcggacgaggatgaacatgtgtcaatggaactccgtggaaaccacacaccagtcatcttgctgtccattaaacacgtcaaatgtcgacccgcacaaggcacgtacgcgcgcggaccacatctctcgttcatcaagctagcagcagttcaagtcaactttgccgaatgcatgctaacggctgaactgttgattcaagtagcagtatcggcaggcagctgcaagctgtggcctccctgctacatatactaggtagctagtggtggtctgccggatgcggtgccagatggggacgaatgaaagcgagaatcaggaagaccccggccggaggagaaaaaggagtgatgctcttggctggcatggacgtcgccgatcaggggaaacgaacaaagcgagatcgatcagcccggcaggggtatggcaagatgacaatgcaagcagcttgtattgtatccttgtgccggataatttaattaagcatacagttttctcccttctgacgtacggcctcatccagcctgcgaagtggtgaaagtgaactgagcgttacagcagaataccagatgcgactagctgaaacgccgggttttggccatagatccaagagaaagaagctcaagtggaaccacaagcgcaagaaactaagaatatattttggtcaggtcatccgtttcacaagaaaactgagtttattttcaattcagatgcatcatgataataggcagcagaccagaaggcaaaaaaaaaaaaaaaaaaaaagagttcttcatcgctttgatctgaccatctatctcttcaaccatggcccatggggcaatcctaactggaacccagaaataagccgcccccttccttaagctagacagaagaagacgcccattatagtgtctaataacggtgttaattaagttgagtagtagcatgcatgaatactatcgggaagaatatgtcagatattgctgaaagcatgtaattaagttgagtagcggcatgcatgaatctagggccagcaagtctgacccggacgggcggaccggagagggctctccctctccaacagtccaactactaccgcaactgtcaacgcaaggcataggcatccaaaactgaagatgaacgatacctaacaccccctgcattagtgcacaacttcgttgtcgtcttgctgccgtcatgtactcgattagtctaattgtgtctagccattggacgtgaagaaaaaggttctcctccttcccttgtgccaaaataaataaataaacgaagggcaaagggcaagatcaagcgagtggtcacgatcagaggtgtacagtacagttgtacatgcatgtttctggaatctgatcagtggactcggagtgcgaatcaatcagtcaaggtgctaaaaag

SEQ ID NO: 7357 - DNA, 1324 bp, Zea mays
gcgaatattttgaactgagccatccacgcaccgccgccttttgagctcgcggcgagggtttgggcggcgggcgcgacatggccgggaagaagaccaccccagcaaagcccgccccttcttccactcagcgcaacggcagcgccgtccccggttccaagagccggcctaagcaggcttcggaggaggccgcggccgccagcgccaaggcgcagtcgccctccaaaccgcgcaaaataaccaaggagaagccggcggccgcgaagaagaagcgcgagaaaacggagccccaagagggtggcaagcgtaggaagcagcaggtgttagccgacgcggcgacgccatcgaagaagaggaagaagggcggcgaaggcccggaacccaaggaagccacgcccgcgaagaagcacaagccagccgggacgcccccgaagaagcagaaggcgcccagcaaacccgcgacgcctgctaagaagcagcagtcacccggcaaagcggagaagctcacgccgaagaagaagcagcagtcacccggcaaagcggagaagcccacgccgaagaagaagcagcagtcacccggcaaagcggagaagcccacgccgaagaagaagcagcagtcacccggcaaagcggagaaagccgcgccgaagaagcagcagcagcagccagccggcaaagcgcggaagcccgcggcggcggcgacctcgcccacgaagaagaagcaagccaagcgcgagaaggccactcccaccaagaggaagcgcggcgacgacgagcaagcaaaggaggccaagagccccaagagagcgcccgcggatggggcggcgcgcgcatctacgcccgtgaagaagaagctgaaggaccagaaggcggctgcggcaaacatgggtgtgtgcagcttctccatggcgcgggtgcggcagctgatgcgggccgaggaccccaccatccgcccttccagtgaggctgtcttcctcatcaataaggcttcagagttcttcttggggaagtttgcagaggatgcttatcacaatgccgcgaaggatcgtaagaaatccattatttacgataatctttcaacagctgtttccagccagaagactttaaagttcctttcagattttgtaccgcagagagttgcagccgaagatgctttgaaggcaatgacgagcaacaactcgtaaccgattatgctagactagattgttagtcctctactcctctatttacgctcgtctctgtcctttctatgatttattaccccgagacctgtattagtccatagataagagtggattcaaatgtttcgtgaaaggatttatttaga

SEQ ID NO: 7358 - DNA, 3130 bp, Zea mays
gtgtgtctctctctctctctctctctctctctctctctctctctatatatatatatatatatatatatatatatatatatatatatatatatgcaaaagtgtatgagcaaaataaatgcggtgccctgtgaatctctctcccttccataggcgatttagtgcatgtcaggtggaggctggtttggttactctggcctctgggctagctactttgtgtgagcttccaaactcgagtagtcagtcaatgctttctgttcaagtcaagctgccacaggcaagctatctagtcaacgagaccagccactgcagttgagctgagtttttggtgatgttcagttcattaattcatttacagaagtggaagctgtttccatagagtttggaagctgtttccagagcagagcagggtgaagcaatcaacagcagctggagggagccgctgctgagcaatccatctggatcgttgcttccctcatcggacagtccagatgaggatatgtacaatggcaggtggcaagcagtcagcggcaggaggcaagtcgtgccgtgccgtctgctccttgcctgctctgctggtctcgccgttgccggcttgccccgtccgtgcgtccatctgtttcctccttggatcctcgacaagcaatggccatggaggaggagcagacaccacccgagctgcgctacctctcgggcctgggcaacaccttcacgtcggaggcggtgccggggtcgctccccgtggggcagaacaacccgctagtgtgcccgctgggactctacgccgagcagctctccggcacctccttcaccaccccgcgcgcccggaacctgcgcacgtacgtccctctatctctctctcgctctgcctttccactttccataggcaatcacacaagcttcccctccgtggggatagagatagggatggggatcggattcagtttgctccttctgttattacaggtggctgtaccggatcaagccgtcggtgacccacgaacccttctatccgcggaaccccaccaacgagcgcctcgtcggcgagttcgaccgcaccaccaccgtcgccacgcccacgcagctgcgctggaggcccgccgacgtgcccctccacccgggcctcgacttcatcgacggactctacaccgtctgcggcgccggcagctcatgcctccgacacggatacgccatccacatgcatgtcctcgatatgccgctgcttacaagtgcaagtagcaactagttgctcgatcactgaacccccctcatgtacgcaacgcaacgcaggtatgctgctaacaagcccatggatggatgctccttgtgcaatgcggacggtgacttcctcattgttccccagcaaggaagtaagttcctcggctcggtcatcactcgccaccactcactccactaggctagtagtaatcacatcacatgcttctgttgcttggccaccaacaaaatgtcctgttcgcgtcgctttcagtgttccggcagtgccactccatgcccttcctgcctttattattgggatcaaagcgaaaagcaaatgggttgccccatcgctgttgcattcagcagcgcttacctttcttctttgtggaaatgatgcacatgttcactatctatcttcccagggttatttatcacaaccgagtgcggaaggctgctggtttcacccggcgagatcgtcgtgatccctcaaggtctccgatttgctgtcgacttgccggatggcccctcgcgtggctatgtctctgagatcttcggcgcccattttcagctccctgatcttggcccaattggtaataataaattgttttgtcacaccgagaacccatacttacctaaactgtgtgtgtgtgtgtgtgcaggtgccaatggcttggcttcgccgagggatttcctttccccgacagcatggtttgagcaggagcaccaccctggatacacaatagtgcacaagtatggtggcgagctgttcagcgccacgcaggatttctctccattcaacgtggtcgcgtggcatgggaattatgtcccttacaaggtgtgttgtatgccattgtacacctgtctgccattgagatgtgtgtcgctgttcactccacccccttctctttcagtatgatctgagtaagttctgtccattcaacaccgtcctcttggatcatggcgacccgtcagtgaacacaggtgggtgtcaggattgggttttctgttcattccgctgctgcatcttgaggactaattaacccaacaaatattgattcgcagttctaactgcgccaactgataagcctggcgtcgcgttgcttgattttgtaatattcccacccagatggctggttgctgagaatacattccgcccaccctactaccaccgcaactgcatgagcgaattcatgggcctcatctatgggatgtacgaggtatctatctatctatctatctatctatctatcttatctatctatctctctggcagtggcagcagtcatgtgaagagatgtaaagacgatgcacatctgcaggctaaggccgatggttttcttcctggtggcgccagccttcacagctgcatgacaccgcatgggccagacaccaagacgtacgaggcaacgatcagccgtgctgctgccaacgagccatccaggctcagtggtacgttggcgttcatgtttgagtcttggcttatccctcgcgtgtgcccatgggctctggattccccgtgtcgggacctcgactactaccagtgctggatcggattgaagtcacacttttcacctcctgctgctgctgttgatgatgagaacgagtagctgcttacagcagcagtcttggaacggacaggcagcgaactgaaactggggtggatatgctgtacgtcgtgtcctgcttgctgtcggtttctgaagcttttagctggcagggacaggcggctgttggctttgctgattgcccaaccctctcctgtaatattaatcctaccagagaaacttaaacttgactcaaccgatatgctattaaataaataaagcaagcaagttaggataaaaaaaaaaaaaaaaaaccaaaataataatgaggcaccaataagaaagactaaagaaaaccaattcataaaaat

SEQ ID NO: 7359 - DNA, 1942 bp, Zea mays
ccggccgggaggaggcaagtcgtgccgtgccgtctgctccttgcctgctctgctggtctcgccgttgccggcttgccccgtccgtgcgtccatctgtttcctccttggatcctcgacaagcaatggccatggaggaggagcagacaccacccgagctgcgctacctctcgggcctgggcaacaccttcacgtcggaggcggtgccggggtcgctccccgtggggcagaacaacccgctagtgtgcccgctgggactctacgccgagcagctctccggcacctccttcaccaccccgcgcgcccggaacctgcgcacgtggctgtaccggatcaagccgtcggtgacccacgaacccttctatccgcggaaccccaccaacgagcgcctcgtcggcgagttcgaccgcaccaccaccgtcgccacgcccacgcagctgcgctggaggcccgccgacgtgcccctccacccgggcctcgacttcatcgacggactctacaccgtctgcggcgccggcagctcatgcctccgacacggatacgccatccacatgtatgctgctaacaagcccatggatggatgctccttgtgcaatgcggacggtgacttcctcattgttccccagcaaggaaggttatttatcacaaccgagtgcggaaggctgctggtttcacccggcgagatcgtcgtgatccctcaaggtctccgatttgctgtcgacttgccggatggcccctcgcgtggctatgtctctgagatcttcggcgcccattttcagctccctgatcttggcccaattggtgccaatggcttggcttcgccgagggatttcctttccccgacagcatggtttgagcaggagcaccaccctggatacacaatagtgcacaagtatggtggcgagctgttcagcgccacgcaggatttctctccattcaacgtggtcgcgtggcatgggaattatgtcccttacaagtatgatctgagtaagttctgtccattcaacaccgtcctcttggatcatggcgacccgtcagtgaacacagttctaactgcgccaactgataagcctggcgtcgcgttgcttgattttgtaatattcccacccagatggctggttgctgagaatacattccgcccaccctactaccaccgcaactgcatgagcgaattcatgggcctcatctatgggatgtacgaggctaaggccgatggttttcttcctggtggcgccagccttcacagctgcatgacaccgcatgggccagacaccaagacgtacgaggcaacgatcagccgtgctgctgccaacgagccatccaggctcagtggtacgttggcgttcatgtttgagtcttggcttatccctcgcgtgtgcccatgggctctggattccccgtgtcgggacctcgactactaccagtgctggatcggattgaagtcacacttttcacctcctgctgctgctgttgatgatgagaacgagtagctgcttacagcagcagtcttggaacggacaggcagcgaactgaaactggggtggatatgctgtacgtcgtgtcctgcttgctgtcggtttctgaagcttttagctggcagggacaggcggctgttggctttgctgattgcccaaccctctcctgtaatattaatcctaccagagaaacttaaacttgactcaaccgatatgctattaaataaataaagcaagcaagttaggatacgagttaaaaaaaaaaaaaaaaatccagcaacccgtagccagtgctgtcacgtatcagtgagtacgtgattgcgacaaaaacacacacacatgttaatatgtatttttgttagtcacaataatcgtgtgttgttattaatcaccagaactgtagaggacctagatggtttcatacgcatcacactcaacttgttagtcacaatatttgacacaatgacgac

SEQ ID NO: 7360 - DNA, 2845 bp, Zea mays
  misc_feature (1897)..(1897): n is a, c, g, or t
acgctcggccgttttctgcatcaacggtggcaggcggagcgaccgaacacgcccgccgccgccctactcccacctgcccccgtcttcgttgccggcgacgagctcccactacaccgcaggctcctcctggaccatggcctctctgccttgttcacaaataaagttaagcaaagtacttgtcaggaggaagtttcatgagagtggacagaccaatttgccgagtcctcttcactggaaacccttgcgaccaggccgttttgaaaatcttgtgctgcgatgcaccaagaatttgtcatgggaaacatctcttccatatgcctctgcagaggatgatgccagtatcatcaagggaacaggtgttgttgaacctattgatacagaagaagctccacagattccaatcctccagagtgatgaagatgttgtagaggtgaagaatgaaccttcttggcatcttaaggcatttaaactgccaatgtggctagtagggccttcaatcctgttggttacgggtatagttccaactttatggctgccattgtcttcagtgtttcatggtcccaacatcgctggccttctatctctagtcggacttgacttcatttttaatatgggagcaatgttgtttttccttatggctgatgcatgcggccgtcaagagaacagtatttttgacctgaaaaggcagataccaatttcctacaggttctggaatctggctgctaccatagtaggctttgtggttccatttgccctgttttttgcatctcgcaggggcactctgcagccacaactaccattcgttccatttggagtgctgcttggaccgtatcttttactcctatctgtacagatgttgactgaaatgcttacatggcactggaaatcgccggtatggttggtagctcctgtggtttatgaaggctatcgggtactacagctgatgaggggtctccagttagctgacgaaatcagtgcgcctgactggatggtgcaaagtcttcgtggcctggtatcctggtgggtactcgtccttggaatccaattgatgcgcgttgcctggttcactggactcaattttgctagaaattcaagctatggagcaagtggtgatatgaaccaataaatcatgcaagaaaaacttgaggccgaacatctttgagaacctgcaatgcttgagcaggaaccaggctgtggtaaatagtgcagtttctcttttgctggagcaggaaccaggctgctagatacttcatactctgaactgtgtaagtattgtattgtagttagtatacaggaacatgaacatttgactgagcatcgtgctgaacacagaaacatcactgtatatattccttgaacatactacaccgtaactactcactctatcccaaattataagatattctattttttagatgtatctcaaatttgattaaagttatagaaaagctacaaatatttataatatcaaatagtatatataaaaatataattgatcaagaatctgatgatacttatttgttttattttattatataagttttgtcaaatttgatatgttttgattctttaaaaaattaaattatcgacataactgaactgacataatttgacatggatggagtactatatttagctttaaatcgtgttcagcggttcaatcatatgatcgcttaaatagattgcattgtttatagattgaagtttaaatttaaaacactgtctatagattgcattgtttatagattagagtttaaatataattatgagaataattaagctgctgaagatattcttaagttgcccagacgggcagacggcattccccttctcggagtgaaggttctgtccattccttaatcttttaaactttgttgccaaatgtcaacagaagcanctgcttttgccaaaaaaaaaaaatctgctgcaatacagagagcatcgttacgtttcctcggcgtaatcgttgttgatacggatggaacaccatatcatatggcgatcacgacaggtcgacagccgacctgatgtatcttaagctagtatatgctgagtgagaccttacgccttgcctagtaggccaaaaattcaaacctataaccatctaatctctctgttttttcttttttaagaaacaaaaaatttccacgaaggtctaacgcctgaaacgagtgaactccacacgcttgcacagcaagctaataggatgtttagtttaaagaataaattagtcaatatcttctcaatcctcactttttttgcttaatttgtgaatgaaatgagttaatcaatcaccacatcattccttatggttagttaattagtaatatcaagagcaatatgatcatcccaccaaatttgatagatgaactcatgatacaccatcttatattggatggagtaaatcaaacaacccctaaataaagagttgaagtttatttttttttcttctttaaaaaaagctttccacggtggtctaacgcctaaaacgagtgaactccacgcttgaccagcaagttaattatacgaagggtcaaaagagggaccaagacacggagtagcgttaaatggatttcaaatacagtcccgggttgtttggaacgcagaaacgctacggttctttaccgtaactccgacagaatatagtttgattccatgaaattcgtggttaaaaggaaaaactgcatcgcgacgcgttacggttcttttagaacattcacctaccgaacttttttgccgttttccagagagaggaaacgatgacgtctttttaaaaccccagcccgtgctcgcctccagcggggcagacagagtccccagtccccacagctatagatggaaaacc

SEQ ID NO: 7361 - DNA, 1790 bp, Zea mays
cctcgaggccggccggggaaagatatggatccgcgaggccggaccacttcatacacgttcgactgcccgagagctatacgctcggccgttttctgcatcaacggtggcaggcggagcaaccgaacacgcccgccgccgccctactcccacctgcccccgtcttcgttgccggcgacgagcacccactacaccagattaacatcatataccatggcctctctgccttgttcacaaataaagttaagcaaagtacttgtcaggaggaagtttcatgagagtggacagaccaatttgccaagtcctcttcactggaaacccttgcgaccaggccgttttgaaaatcttgtgctgcgatgcaccaagaatttgtcatgggaaacatctcttccatatgcctctgcacaggatgatgccagtatcatcaagggaacaggtgttgttgaacctattgatacagaagaagctccacagattccaatcctccagagtgatgaagatattgtagaggtgaagaatgaaccttcttggcatcttaaggcatttaaactgccaatgtggctagtagggccttcaatcctgttggttacgggtatagttccaactttatggctgccattgtcttcagtgtttcatggtcccaacatcgctggccttctatctctagtcggacttgacttcatttttaatatgggagcaatgttgtttttccttatggctgatgcatgcggccgtcaagagaacagtatttttgacctgaaaaggcagataccaatttcctacaggttctggaatctggctgctaccatagtaggctttgtggttccatttgccctgttttttgcatctcgcaggggcactctgcagccacaactaccattcgttccatttggagtgctgcttggaccgtatcttttactcctatctgtacagatgttgactgaaatgcttacatggcactggaaatcgccggtatggttggtagctcctgtggtttatgaaggctatcgggtactacagttgatgaggggtctccagttagctgacgaaatcagtgcgcctgactggatggtgcaaagtcttcgtggcctggtatcctggtgggtactcgtccttggaatccaattgatgcgcgttgcctggttcactggactcagttttgctagaaattcaagctatggagcaagtggtgatatgaaccaataaatcatacaagaaaaacttgaggccgaacatctttgagaacctacaatgcttgagcaatcgttttgtaacgctttttgtagctgtggtaaatagtgcagtttctcttttgctggagcaggaaccaggctgctagatacttcatactttgaactgtgtaagtattgtattgtagtatacaggaacatgaacatttgagcatcgtgcaaaaaaaaaaaaaaaaacagaaacaccactgtatatattccttgaacatactacaccgtaactactcattctatcccaaattataagatattatattttttagatgtatctcaaatttgattaaagttatagaaaagctacaaatatttataatatcaaatattatatataaaaatataattggagtttaaatttaaaataatgttttgtactatagattgtattgtttatagattagagtttaaatataattatgaaaataggtaagctgctgaagatattgttaagttgaccagacgggcagacggcattcccttctcggagtgaaggttccgtccatccttaaattttaaatttgttgccaaagtcaacagaagcagggg

SEQ ID NO: 7362 - DNA, 2786 bp, Zea mays
cccgggtcgacccacagcgtacgcggacgcgtgggcggacgcgtgcggccgcgggttaaccttcccttctcgctgccgtgctcctgctcgtgcgcgcgttcgcaatcgtagcgctggggttgagccgcgagtggataaaccctagccggtggtgtagctgggttggtggctttgatgccggcgacggcccgcttgtccccggaatggagtgaggtgacgaaggctgccatgggctctaactatgccacgattggattataggatagtagctggcagctaccagtttcctagaaccaatttgtggatagcgagaggagtgactgttgttcagtactttcacctcgatcatgggtggtgtctgctcaaggaagagaagccaattggtggatgaaggtgacgctctccagacatccccaaggttctcaaagaccagcagcttaaaatggctgttgcttacactgcctcgcagcagttctgatgtttccgggaagggacagggaaatgaacctgggcggtgcccgtccctcatggagctttgtgtggctagagtttgccaggatatcgacaggtattctacttttgcaatgctgccaagggatctcagccagcagattttcaatgaattagtaaattcaaaccgtcttacagaggcatcacttcaagtttttagggattgtgctctgcaggacattggcttaggggagtaccctggagtaaaggatgcttggatggaagtagtggcatctcaaaagcagtcattgttgtcggttgatatttcttgctctgaagtagctgatagtgggatagatcttcttagagattgctcaagcatgcaaagtttggcatgtaattactgtgatcaaatatccgaaagtggtctgggagtactgtcaggattgtcaaacctatcttctttaagcttcaagcgaagtaatgctgttactgctgaaggaatgagagcctttgcaaatttagttaacttactaaatctcgaccttgaaggttgcctaaagattcatggtggccttattcatttaaaagatctgacaaagctcgagtcattgaatatgagatattgcaattatattgcggattcagatatcaaatatttaacagatctgacaaatttgaaggaccttcaattgtcatgttgtaagatcacagatctgggggtgtcgtatatcagaggcttgcagaagctcactcacttgaacctagagggctgcccagtgactgctgcttgtttggaagctatttcaggattgtcttcattggtattgttgaacttgaaccgttgtggtatatacgatgatggctgtgaaaactttgaaggtcttaaaaggttgaaggttttaaacttggggtttaactatattacagatgcttgtttggtgcatctgaaagaattaatcagtttggagtctttgaacttggattcgtgcaagattggagatgatggtctatcacatctgaaaggtcttgtgctactgcaaagcttggagctttctgatactgaagttggaaacaatggactccagcatctatctggtcttcgtaatctgcaaagtattaatctctcatttactttggtcacggacattggtgtgaagaagatctctgtgttgaattcgctgaagtcagttaaccttgacaatcgccaaattactgatgttggcctggcagcacttataagtctcactaggctgactcatcttgacctttttggagcttgcataactgacaatggcacaaattgcttcagatattttaagaatcttgtttctcttgaagtctgtggtgggttcgttactgatgctggagtgaagaacatcaaggatctgaaggccctgacgttgctgaatctttctcaaaatgctaatctgacagacaaaaccttggagctgatctctggcctgactgctttgatcaacttgaacgtgtcaaactcacgggtgtccaatgctggtctcaaacacctgaatgacctgcacaacctgcgttcactgtctctagattccacccgggtgacggcaaacgagatgaggaagcttcgagcaacagtgctgcataatctgatcagcatgcggccagagtagtacccatttggcacctgctgtaaataatcattaggttcgagcaggctgttctgttggtaagtactgccttcgttctcgaatatttgtcgtccgctagttcatttttgaactagaccgcgataaataaaaaagaacggagggaatatcttgtaagaacctgaattgaaggcaggcatataattatataagttaacaatgtggtttagcgagtggtaggtcttgtgctgtatgtcagcgagctcgttcgtttcagggtgatgctgaagaaatggcactatggcagctgctttgcactgaattgtaaatagcctttctcgccatctgggaactgggatgcatacgtgggtcgcccttttttatgtttgggtagattagagttgaatgtgcgttatgtacttgtgttctgatgagcaccgaatgcttattttgtcacatgctgttatttaccggccttccccagtttactcttgcaacagagggctggtttgttggagattattatattatataatctgattatgttataatcctaaacaaacaactttcaaagatgggcagtttcgactgacggagggttaagtctggtcttccaagggggcatagggagctccttatttctttcccggggtggactgaggcaaggccttttcaagtaggccattgttttgggtggtaaatggaaaaaataaa

SEQ ID NO: 7363 - DNA, 2103 bp, Zea mays
cattgggtacctcgaggccggccgggattcatcctcgtcttgtgtttgttgcaagtcgcaaaggtttgcgccgcctgccgggcgtcgtcggctcatcgccgtcggcggtaggcttctgcctcccccgtctcgatacctctccttcggcgaagactcgcagggaggtccccacttcatcacctccgtttcctaccggaaaaggcaacttctgtcggccatctcagtactttttttggaagatggatccagaagactctagtgactttgaagaggaggacgacgaagaagaagatgatgacttaatgatattcatattgccagcgctatatctagcatctactggaattggaactctggatcaaacatctatggttagtgatggtactgcgattgaaactccaagtcaagtatcaaagtttaacgatgcagaaaggatttgtaaagtgcttgaagatgacagaggccaaggctatgataaacttcgtgtggagccccatgttctcctcgaactttcacgctatctgaggtcaaatgatcttttgaaaaataccagaggtgtttctgtagaagagaaaattggcatgtttatttacatgctatcccgaaatgctagttttcagaaactaagtgacagattcaagtacagtacagaaactattcacaggcatatcaaagcatgctttgatgcagtcacaccaatgactggtgaattcgtcaggccaccttcaattcaagcccaccggaaaatatcatctgatacacgttatgggccttactttgagaactgtattggagcaattgatggaatccatgtccctatgacaatatcggacagtgaagcagctccataccgaaatagacaagaatccctttcccaaaacgtgatgcttgcttgtgattttgatttgaattttgtccatgtttcttgtagccgagaagggtctgcatctgacgcagcagtcttatactctgctatagaatatggatttgaagtcccaagaggaaagttctacctggttgatgggggttatgcgaacacgccatcttttcttgctccttttagtgaagtttcttaccatgctgaagagcaagatgagagcaatttccaaccaatagactatagggagcttttcaatcttcgccatgcacagctgtacagacatatcaagcgtgctgtaggcctactgaagatgcggtttccaattctaaatgtcgcaacatcataccgaaaagacactcaactgaaaattccttcagcggcagttgttatgcataacataattcagagacaaggaggtagtgaagagttgttatgtgagcaaacaattccatttgcgtcccgtaaaacagtgaatcttcctagtggtgatgacacgtatggttatgatgtttcagctttcaacagtgaatgcgacatgggtaatgctttgagagatggtattgcactgaggatgtgggcagattatgaaagtagtatgtatgtctgatttcagaatagaacaggctggccttaaagaatattgagtggtgtggtgtggatgttttcactgccctttcaggtggtgttggagctctatatggtcctttgcatggcggtgcaaatgaggtggccattgctctagaaaaggcagcactgtcaggcgaattaatattttatcaagcgggagctatatccaaatgtggacttctgctctgggctaatttatagggcgatgggatttcctacagagtttttccccgtgctggtgtctggctgagacattataccccctgtcagagaacgagtggtggtgccaagccagagtgaggaactcgcctagattgccacctcaaacgcaaccacttttgtgcttctgccatgtagaatagctgctgcatataaacacaccggcttgcctcaataaacagcaaccacttttgcgcttgaaaaaggccacagcccacagatgcttcgcttggttggagttgtaggctttctgttgtcaaaaagtatataggcaataatgcagtaagaacactacacctttacagtgtgaaactgtcattgcgttctctatgccgtaacttccattaagatgaatgaagagatacgatcaagttcct

SEQ ID NO: 7364 - DNA, 1336 bp, Zea mays
  misc_feature (1276)..(1276): n is a, c, g, or t
  misc_feature (1288)..(1288): n is a, c, g, or t
gcgcgtgagactttggattcgtccaccaccacatcactagtctcactctcacctgtaatatatctgcacccaacgagcaggtgccgtccaattagcaagagaaacacaaggtcgaggtggtgaggcatggagctcgccttgggggccatggccagcttggcccctaagctaggcgacctgctcatggaggagtatgtcgtgcagaagggcctcaagcccgacatcgagtctctctccagggagcttgtgatgatgaacgccgctctcgtcgacgcgtcccgggttccacctgaccagctcaccgaggtggaaaagctttgggcacgcaaggtccgggacctgtcgtatgacatggaggacgccgtcgacgatttcatcctgcgtgtggctggtggtgacgactctgccgccgactcaaaattcttcaagaagacccttgccatggtcaaggacgtgatgtcgatgaagaagttcaaggatcggcgccagatctccgacaaggtcaaagacatcaagaaactctccaacgagttagctgaacttcgtgccaagtacacggtaaggggtgtgggtgctgatctcgccgcgagcaccggcatcgacccccgtgtcatcaatctgtacaagaaagagacagatctcgttggcatcgaggagtcaagggacaaagtcattaggatgctgtctatggggaccaaagatgatgatgcacttgagtcccatcaggctctaaagatagtgtctatagtcggggttggaggactaggtaagactactctagccaaaacagtgcatgacatgcttaagaagcaattcgactgttctgcttttatttctattggtagaactcctaatctgaataggacattcgagaagatgctattggaactcgatcgtgagtataaacaagttgacatggccagatgggatctagaacaatttaaaaaccaactggatgaattcttgaaggaccaagaggtacttgatcgttgttgatgaacatatgggatgattgactcatggagaagcggtcagatatgccttgaaggacaatagttgtggaagtagaataatcatgactactcgcaattctggggttgtcactaaagtagaagaggtttatagattaaaacctctttctactgaaaactccgagaaattgttctacaaaagaatagagagtcaggaaggagaaagccttgatggtgaactctctagtaaaatcatacataaatgtggcggcataccattggctatcattgcaatagctagtttngttgttgaaagnacacgtgaggagtgccagaagtgtatgacaagattggtcttggggatg
